United States Patent 9,061,059 (MODIFIED POLYNUCLEOTIDES FOR TREATING PROTEIN DEFICIENCY) - sequence listing, part 51

SEQ ID NO: 96620 - DNA, 3039 bp, Artificial Sequence
  Description of Artificial Sequence: Synthetic coding sequence
atgtgcgcccccggcatccacgtgagcagcgagggctgggaggaggtgagaagcgtggacagcgaggagggcaccatcgaggccagaagagccgtggccggcgacctggactactactggctggaccccgccacctggcacagcagagagaccagccccatcagcagccaccccgtgacctggcagcccagcaaggagggcgacagactgatcggcagagtgatcctgaacaagagaaccaccatgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagcgagctgctgatgctgcccagagccaagagaggcagaagcgccgagtgcctgcacaccaccagcgagctgcagcccttcctggacagagccagaagcgccagcaccaactgcctgagacccgacaccagcctgcacagccccgagagagagagacacagcagaaagagcgagagaagcagcatccagaagcagaccagaaagggcaccgccagcgacgccgagagaatgcacagacagagaagccccacccagagcccccccgccgacaccagcttcagcagcagaagaggcagacagctgccccaggtgcccgtgagaagcggcagcatcgagcaggccagcctggtggtggaggagagaaccagacagatgaagatgaaggtgcacagattcaagcagaccaccggcagcggcagcagccaggagctggacagagagcagtacagcaagtacaacatccacaaggaccagtacagaagctgcgacaacgtgagcgccaagagcagcgacagcgacgtgagcgacgtgagcgccatcagcagaaccagcagcgccagcagactgagcagcaccagcttcatgagcgagcagagcgagagacccagaggcagaatcagcagcttcacccccaagatgcagggcagaagaatgggcaccagcggcagaagcatcatgaagagcaccagcgtgagcggcgagatgtacaccctggagcacaacgacggcagccagagcgacaccgccgtgggcaccgtgggcgccggcggcaagaagagaagaagcagcctgagcgccaaggtggtggccatcgtgagcagaagaagcagaagcaccagccagctgagccagaccgagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96621 - DNA, 660 bp, Artificial Sequence
  Description of Artificial Sequence: Synthetic coding sequence
atggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96622 - DNA, 2283 bp, Artificial Sequence
  Description of Artificial Sequence: Synthetic coding sequence
atgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccgtgggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagcgagctgctgatgctgcccagagccaagagaggcagaagcgccgagtgcctgcacaccaccagcgagctgcagcccttcctggacagagccagaagcgccagcaccaactgcctgagacccgacaccagcctgcacagccccgagagagagagacacagcagaaagagcgagagaagcagcatccagaagcagaccagaaagggcaccgccagcgacgccgagagaatgcacagacagagaagccccacccagagcccccccgccgacaccagcttcagcagcagaagaggcagacagctgccccaggtgcccgtgagaagcggcagcatcgagcaggagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96623 - DNA, 2481 bp, Artificial Sequence
  Description of Artificial Sequence: Synthetic coding sequence
atgttcgccggcttcctgcagttcctgctgctgcacaccctgcacagcggcaccggcgacctggactactactggctggaccccgccacctggcacagcagagagaccagccccatcagcagccaccccgtgacctggcagcccagcaaggagggcgacagactgatcggcagagtgatcctgaacaagagaaccaccatgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccgtgggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagcgagctgctgatgctgcccagagccaagagaggcagaagcgccgagtgcctgcacaccaccagcgagctgcagcccttcctggacagagccagaagcgccagcaccaactgcctgagacccgacaccagcctgcacagccccgagagagagagacacagcagaaagagcgagagaagcagcatccagaagcagaccagaaagggcaccgccagcgacgccgagagaatgcacagacagagaagccccacccagagcccccccgccgacaccagcttcagcagcagaagaggcagacagctgccccaggtgcccgtgagaagcggcagcatcgagcaggagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96624 - DNA, 2454 bp, Artificial Sequence
  Description of Artificial Sequence: Synthetic coding sequence
atgtgcgcccccggcatccacgtgagcagcgagggctgggaggaggtgagaagcgtggacagcgaggagggcaccatcgaggccagaagagccgtggccggcgacctggactactactggctggaccccgccacctggcacagcagagagaccagccccatcagcagccaccccgtgacctggcagcccagcaaggagggcgacagactgatcggcagagtgatcctgaacaagagaaccaccatgcccaaggacagcggcgccctgctgggcctgaaggtggtgggcggcaagatgaccgacctgggcagactgggcgccttcatcaccaaggtgaagaagggcagcctggccgacgtggtgggccacctgagagccggcgacgaggtgctggagtggaacggcaagcccctgcccggcgccaccaacgaggaggtgtacaacatcatcctggagagcaagagcgagccccaggtggagatcatcgtgagcagacccatcggcgacatccccagaatccccgagagcagccacccccccctggagagcagcagcagcagcttcgagagccagaagatggagagacccagcatcagcgtgatcagccccaccagccccggcgccctgaaggacgccccccaggtgctgcccggccagctgagcgtgaagctgtggtacgacaaggtgggccaccagctgatcgtgaacgtgctgcaggccaccgacctgcccgccagagtggacggcagacccagaaacccctacgtgaagatgtacttcctgcccgacagaagcgacaagagcaagagaagaaccaagaccgtgaagaagatcctggagcccaagtggaaccagaccttcgtgtacagccacgtgcacagaagagacttcagagagagaatgctggagatcaccgtgtgggaccagcccagagtgcaggaggaggagagcgagttcctgggcgagatcctgatcgagctggagaccgccctgctggacgacgagccccactggtacaagctgcagacccacgacgagagcagcctgcccctgccccagcccagccccttcatgcccagaagacacatccacggcgagagcagcagcaagaagctgcagagaagccagagaatcagcgacagcgacatcagcgactacgaggtggacgacggcatcggcgtggtgccccccgtgggctacagaagcagcgccagagagagcaagagcaccaccctgaccgtgcccgagcagcagagaaccacccaccacagaagcagaagcgtgagcccccacagaggcaacgaccagggcaagcccagaagcagactgcccaacgtgcccctgcagagaagcctggacgagatccaccccaccagaagaagcagaagccccaccagacaccacgacgccagcagaagccccgtggaccacagaaccagagacgtggacagccagtacctgagcgagcaggacagcgagctgctgatgctgcccagagccaagagaggcagaagcgccgagtgcctgcacaccaccagcgagctgcagcccttcctggacagagccagaagcgccagcaccaactgcctgagacccgacaccagcctgcacagccccgagagagagagaatgcacagacagagaagccccacccagagcccccccgccgacaccagcttcagcagcagaagaggcagacagctgccccaggtgcccgtgagaagcggcagcatcgagcaggagagcggccacaagaagctgaagagcaccatccagagaagcaccgagaccggcatggccgccgagatgagaaagatggtgagacagcccagcagagagagcaccgacggcagcatcaacagctacagcagcgagggcaacctgatcttccccggcgtgagactgggcgccgacagccagttcagcgacttcctggacggcctgggccccgcccagctggtgggcagacagaccctggccacccccgccatgggcgacatccagatcggcatggaggacaagaagggccagctggaggtggaggtgatcagagccagaagcctgacccagaagcccggcagcaagagcacccccgccccctacgtgaaggtgtacctgctggagaacggcgcctgcatcgccaagaagaagaccagaatcgccagaaagaccctggaccccctgtaccagcagagcctggtgttcgacgagagcccccagggcaaggtgctgcaggtgatcgtgtggggcgactacggcagaatggaccacaagtgcttcatgggcgtggcccagatcctgctggaggagctggacctgagcagcatggtgatcggctggtacaagctgttcccccccagcagcctggtggaccccaccctgacccccctgaccagaagagccagccagagcagcctggagagcagcaccggccccccctgcatcagaagctag

SEQ ID NO: 96625 - DNA, 3567 bp, Artificial Sequence
  Description of Artificial Sequence: Synthetic coding sequence
atgcagttcgagaccctgagacaggtgtgcaacagcgtgctgagccacttccacggcgtgttcagcagcccccccaacatcctgcagaacgagctgttcggccagaccctgaacaacgccagaaagagaagccccagcgtgagcagagaccagaacagaagatacgaccagagagaggagagagaggagtacagccagtacgccaccagcgacaccgccatgcccagaagccccagcgactacgccgacagaagaagccagcacgagccccagttctacgaggacagcgaccacctgagctacagagacagcaacagaagaagccacagacacagcaaggagtacatcgtggacgacgaggacgtggagagcagagacgagtacgagagacagagaagagaggaggagtaccagagcagatacagaagcgaccccaacctggccagataccccgtgaagccccagccctacgaggagcagatgagaatccacgccgaggtgagcagagccagacacgagagaagacacagcgacgtgagcctggccaacgccgacctggaggacagcagaatcagcatgctgagaatggacagacccagcagacagagaagcatcagcgagagaagagccgccatggagaaccagagaagctacagcatggagagaaccagagaggcccagggccccagcagctacgcccagagaaccaccaaccacagcccccccacccccagaagaagccccctgcccatcgacagacccgacctgagaagaaccgacagcctgagaaagcagcaccacctggaccccagcagcgccgtgagaaagaccaagagagagaagatggagaccatgctgagaaacgacagcctgagcagcgaccagagcgagagcgtgagaccccccccccccaagccccacaagagcaagaagggcggcaagatgagacagatcagcctgagcagcagcgaggaggagctggccagcacccccgagtacaccagctgcgacgacgtggagatcgagagcgagagcgtgagcgagaagggcgacagccagaagggcaagagaaagaccagcgagcaggccgtgctgagcgacagcaacaccagaagcgagagacagaaggagatgatgtacttcggcggccacagcctggaggaggacctggagtggagcgagccccagatcaaggacagcggcgtggacacctgcagcagcaccaccctgaacgaggagcacagccacagcgacaagcaccccgtgacctggcagcccagcaaggacggcgacagactgatcggcagaatcctgctgaacaagagactgaaggacggcagcgtgcccagagacagcggcgccatgctgggcctgaaggtggtgggcggcaagatgaccgagagcggcagactgtgcgccttcatcaccaaggtgaagaagggcagcctggccgacaccgtgggccacctgagacccggcgacgaggtgctggagtggaacggcagactgctgcagggcgccaccttcgaggaggtgtacaacatcatcctggagagcaagcccgagccccaggtggagctggtggtgagcagacccatcggcgacatccccagaatccccgacagcacccacgcccagctggagagcagcagcagcagcttcgagagccagaagatggacagacccagcatcagcgtgaccagccccatgagccccggcatgctgagagacgtgccccagttcctgagcggccagctgagcatcaagctgtggttcgacaaggtgggccaccagctgatcgtgaccatcctgggcgccaaggacctgcccagcagagaggacggcagacccagaaacccctacgtgaagatctacttcctgcccgacagaagcgacaagaacaagagaagaaccaagaccgtgaagaagaccctggagcccaagtggaaccagaccttcatctacagccccgtgcacagaagagagttcagagagagaatgctggagatcaccctgtgggaccaggccagagtgagagaggaggagagcgagttcctgggcgagatcctgatcgagctggagaccgccctgctggacgacgagccccactggtacaagctgcagacccacgacgtgagcagcctgcccctgccccaccccagcccctacatgcccagaagacagctgcacggcgagagccccaccagaagactgcagagaagcaagagaatcagcgacagcgaggtgagcgactacgactgcgacgacggcatcggcgtggtgagcgactacagacacgacggcagagacctgcagagcagcaccctgagcgtgcccgagcaggtgatgagcagcaaccactgcagccccagcggcagcccccacagagtggacgtgatcggcagaaccagaagctggagccccagcgtgccccccccccagagcagaaacgtggagcagggcctgagaggcaccagaaccatgaccggccactacaacaccatcagcagaatggacagacacagagtgatggacgaccactacagccccgacagagacagagactgcgaggccgccgacagacagccctaccacagaagcagaagcaccgagcagagacccctgctggagagaaccaccaccagaagcagaagcaccgagagacccgacaccaacctgatgagaagcatgcccagcctgatgaccggcagaagcgccccccccagccccgccctgagcagaagccaccccagaaccggcagcgtgcagaccagccccagcagcacccccgtggccggcagaagaggcagacagctgccccagctgccccccaagggcaccctggacagaaaggccggcggcaagaagctgagaagcaccgtgcagagaagcaccgagaccggcctggccgtggagatgagaaactggatgaccagacaggccagcagagagagcaccgacggcagcatgaacagctacagcagcgagggcaacctgatcttccccggcgtgagactggccagcgacagccagttcagcgacttcctggacggcctgggccccgcccagctggtgggcagacagaccctggccacccccgccatgggcgacatccaggtgggcatgatggacaagaagggccagctggaggtggagatcatcagagccagaggcctggtggtgaagcccggcagcaagaccctgcccgccccctacgtgaaggtgtacctgctggacaacggcgtgtgcatcgccaagaagaagaccaaggtggccagaaagaccctggagcccctgtaccagcagctgctgagcttcgaggagagcccccagggcaaggtgctgcagatcatcgtgtggggcgactacggcagaatggaccacaagagcttcatgggcgtggcccagatcctgctggacgagctggagctgagcaacatggtgatcggctggttcaagctgttcccccccagcagcctggtggaccccaccctggcccccctgaccagaagagccagccagagcagcctggagagcagcaccggccccagctacagcagaagctag

SEQ ID NO: 96626 - DNA, 4161 bp, Artificial Sequence
  Description of Artificial Sequence: Synthetic coding sequence
atgagcgcccccgtgggccccagaggcagactggcccccatccccgccgccagccagccccccctgcagcccgagatgcccgacctgagccacctgaccgaggaggagagaaagatcatcctggccgtgatggacagacagaagaaggaggtgaaggaggagcacaagccccagctgacccagtggttccccttcagcggcatcaccgagctggtgaacaacgtgctgcagccccagcagaagcagcagaacgagaaggagccccagaccaagctgcaccagcagttcgagatgtacaaggagcaggtgaagaagatgggcgaggagagccagcagcagcaggagcagaagggcgacgcccccacctgcggcatctgccacaagaccaagttcgccgacggctgcggccacaactgcagctactgccagaccaagttctgcgccagatgcggcggcagagtgagcctgagaagcaacaaggtgatgtgggtgtgcaacctgtgcagaaagcagcaggagatcctgaccaagagcggcgcctggttctacaacagcggcagcaacaccccccagcagcccgaccagaaggtgctgagaggcctgagaaacgaggaggccccccaggagaagaagcccaagctgcacgagcagacccagttccagggccccagcggcgacctgagcgtgcccgccgtggagaagagcagaagccacggcctgaccagacagcacagcatcaagaacggcagcggcgtgaagcaccacatcgccagcgacatcgccagcgacagaaagagaagccccagcgtgagcagagaccagaacagaagatacgaccagagagaggagagagaggagtacagccagtacgccaccagcgacaccgccatgcccagaagccccagcgactacgccgacagaagaagccagcacgagccccagttctacgaggacagcgaccacctgagctacagagacagcaacagaagaagccacagacacagcaaggagtacatcgtggacgacgaggacgtggagagcagagacgagtacgagagacagagaagagaggaggagtaccagagcagatacagaagcgaccccaacctggccagataccccgtgaagccccagccctacgaggagcagatgagaatccacgccgaggtgagcagagccagacacgagagaagacacagcgacgtgagcctggccaacgccgacctggaggacagcagaatcagcatgctgagaatggacagacccagcagacagagaagcatcagcgagagaagagccgccatggagaaccagagaagctacagcatggagagaaccagagaggcccagggccccagcagctacgcccagagaaccaccaaccacagcccccccacccccagaagaagccccctgcccatcgacagacccgacctgagaagaaccgacagcctgagaaagcagcaccacctggaccccagcagcgccgtgagaaagaccaagagagagaagatggagaccatgctgagaaacgacagcctgagcagcgaccagagcgagagcgtgagaccccccccccccaagccccacaagagcaagaagggcggcaagatgagacagatcagcctgagcagcagcgaggaggagctggccagcacccccgagtacaccagctgcgacgacgtggagatcgagagcgagagcgtgagcgagaagggcgacatggactacaactggctggaccacaccagctggcacagcagcgaggccagccccatgagcctgcaccccgtgacctggcagcccagcaaggacggcgacagactgatcggcagaatcctgctgaacaagagactgaaggacggcagcgtgcccagagacagcggcgccatgctgggcctgaaggtggtgggcggcaagatgaccgagagcggcagactgtgcgccttcatcaccaaggtgaagaagggcagcctggccgacaccgtgggccacctgagacccggcgacgaggtgctggagtggaacggcagactgctgcagggcgccaccttcgaggaggtgtacaacatcatcctggagagcaagcccgagccccaggtggagctggtggtgagcagacccatcggcgacatccccagaatccccgacagcacccacgcccagctggagagcagcagcagcagcttcgagagccagaagatggacagacccagcatcagcgtgaccagccccatgagccccggcatgctgagagacgtgccccagttcctgagcggccagctgagcatcaagctgtggttcgacaaggtgggccaccagctgatcgtgaccatcctgggcgccaaggacctgcccagcagagaggacggcagacccagaaacccctacgtgaagatctacttcctgcccgacagaagcgacaagaacaagagaagaaccaagaccgtgaagaagaccctggagcccaagtggaaccagaccttcatctacagccccgtgcacagaagagagttcagagagagaatgctggagatcaccctgtgggaccaggccagagtgagagaggaggagagcgagttcctgggcgagatcctgatcgagctggagaccgccctgctggacgacgagccccactggtacaagctgcagacccacgacgtgagcagcctgcccctgccccaccccagcccctacatgcccagaagacagctgcacggcgagagccccaccagaagactgcagagaagcaagagaatcagcgacagcgaggtgagcgactacgactgcgacgacggcatcggcgtggtgagcgactacagacacgacggcagagacctgcagagcagcaccctgagcgtgcccgagcaggtgatgagcagcaaccactgcagccccagcggcagcccccacagagtggacgtgatcggcagaaccagaagctggagccccagcgtgccccccccccagagcagaaacgtggagcagggcctgagaggcaccagaaccatgaccggccactacaacaccatcagcagaatggacagacacagagtgatggacgaccactacagccccgacagagacagccacttcctgaccctgcccagaagcagatacagccagaccatcgaccaccaccacagagacggcagagactgcgaggccgccgacagacagccctaccacagaagcagaagcaccgagcagagacccctgctggagagaaccaccaccagaagcagaagcaccgagagacccgacaccaacctgatgagaagcatgcccagcctgatgaccggcagaagcgccccccccagccccgccctgagcagaagccaccccagaaccggcagcgtgcagaccagccccagcagcacccccgtggccggcagaagaggcagacagctgccccagctgccccccaagggcaccctggacagaaaggccggcggcaagaagctgagaagcaccgtgcagagaagcaccgagaccggcctggccgtggagatgagaaactggatgaccagacaggccagcagagagagcaccgacggcagcatgaacagctacagcagcgagggcaacctgatcttccccggcgtgagactggccagcgacagccagttcagcgacttcctggacggcctgggccccgcccagctggtgggcagacagaccctggccacccccgccatgggcgacatccaggtgggcatgatggacaagaagggccagctggaggtggagatcatcagagccagaggcctggtggtgaagcccggcagcaagaccctgcccgccccctacgtgaaggtgtacctgctggacaacggcgtgtgcatcgccaagaagaagaccaaggtggccagaaagaccctggagcccctgtaccagcagctgctgagcttcgaggagagcccccagggcaaggtgctgcagatcatcgtgtggggcgactacggcagaatggaccacaagagcttcatgggcgtggcccagatcctgctggacgagctggagctgagcaacatggtgatcggctggttcaagctgttcccccccagcagcctggtggaccccaccctggcccccctgaccagaagagccagccagagcagcctggagagcagcaccggccccagctacagcagaagctag

SEQ ID NO: 96627 - DNA, 858 bp, Artificial Sequence
  Description of Artificial Sequence: Synthetic coding sequence
atgggcagacagggcctgggcggcgccagcgccgccggcagaagcatgcagagaagccagagcagaagcagcctgagcgccagcttcgaggccctggccggctacttcccctgcatgaacagcctggaggaggaggagggcgaggccggcggcaagaagctgagaagcaccgtgcagagaagcaccgagaccggcctggccgtggagatgagaaactggatgaccagacaggccagcagagagagcaccgacggcagcatgaacagctacagcagcgagggcaacctgatcttccccggcgtgagactggccagcgacagccagttcagcgacttcctggacggcctgggccccgcccagctggtgggcagacagaccctggccacccccgccatgggcgacatccaggtgggcatgatggacaagaagggccagctggaggtggagatcatcagagccagaggcctggtggtgaagcccggcagcaagaccctgcccgccccctacgtgaaggtgtacctgctggacaacggcgtgtgcatcgccaagaagaagaccaaggtggccagaaagaccctggagcccctgtaccagcagctgctgagcttcgaggagagcccccagggcaaggtgctgcagatcatcgtgtggggcgactacggcagaatggaccacaagagcttcatgggcgtggcccagatcctgctggacgagctggagctgagcaacatggtgatcggctggttcaagctgttcccccccagcagcctggtggaccccaccctggcccccctgaccagaagagccagccagagcagcctggagagcagcaccggccccagctacagcagaagctag

SEQ ID NO: 96628 - DNA, 384 bp, Artificial Sequence
  Description of Artificial Sequence: Synthetic coding sequence
atgaccgagagcggcagactgtgcgccttcatcaccaaggtgaagaagggcagcctggccgacaccgtgggccacctgagacccggcgacgaggtgctggagtggaacggcagactgctgcagggcgccaccttcgaggaggtgtacaacatcatcctggagagcaagcccgagccccaggtggagctggtggtgagcagacccatcggcgacatccccagaatccccgacagcacccacgcccagctggagagcagcctgcccggcctggcctggtggctgaccagagtgatccccgccctgtgggaggccgaggccggcggcagcagaggccaggagatcgagaccatcctggccaacaccgtgaagcccagactgtactag

SEQ ID NO: 96629 - DNA, 4236 bp, Artificial Sequence
  Description of Artificial Sequence: Synthetic coding sequence
atgagcgcccccgtgggccccagaggcagactggcccccatccccgccgccagccagccccccctgcagcccgagatgcccgacctgagccacctgaccgaggaggagagaaagatcatcctggccgtgatggacagacagaagaaggaggtgaaggaggagcacaagccccagctgacccagtggttccccttcagcggcatcaccgagctggtgaacaacgtgctgcagccccagcagaagcagcagaacgagaaggagccccagaccaagctgcaccagcagttcgagatgtacaaggagcaggtgaagaagatgggcgaggagagccagcagcagcaggagcagaagggcgacgcccccacctgcggcatctgccacaagaccaagttcgccgacggctgcggccacaactgcagctactgccagaccaagttctgcgccagatgcggcggcagagtgagcctgagaagcaacaaggtgatgtgggtgtgcaacctgtgcagaaagcagcaggagatcctgaccaagagcggcgcctggttctacaacagcggcagcaacaccccccagcagcccgaccagaaggtgctgagaggcctgagaaacgaggaggccccccaggagaagaagcccaagctgcacgagcagacccagttccagggccccagcggcgacctgagcgtgcccgccgtggagaagagcagaagccacggcctgaccagacagcacagcatcaagaacggcagcggcgtgaagcaccacatcgccagcgacatcgccagcgacagaaagagaagccccagcgtgagcagagaccagaacagaagatacgaccagagagaggagagagaggagtacagccagtacgccaccagcgacaccgccatgcccagaagccccagcgactacgccgacagaagaagccagcacgagccccagttctacgaggacagcgaccacctgagctacagagacagcaacagaagaagccacagacacagcaaggagtacatcgtggacgacgaggacgtggagagcagagacgagtacgagagacagagaagagaggaggagtaccagagcagatacagaagcgaccccaacctggccagataccccgtgaagccccagccctacgaggagcagatgagaatccacgccgaggtgagcagagccagacacgagagaagacacagcgacgtgagcctggccaacgccgacctggaggacagcagaatcagcatgctgagaatggacagacccagcagacagagaagcatcagcgagagaagagccgccatggagaaccagagaagctacagcatggagagaaccagagaggcccagggccccagcagctacgcccagagaaccaccaaccacagcccccccacccccagaagaagccccctgcccatcgacagacccgacctgagaagaaccgacagcctgagaaagcagcaccacctggaccccagcagcgccgtgagaaagaccaagagagagaagatggagaccatgctgagaaacgacagcctgagcagcgaccagagcgagagcgtgagaccccccccccccaagccccacaagagcaagaagggcggcaagatgagacagatcagcctgagcagcagcgaggaggagctggccagcacccccgagtacaccagctgcgacgacgtggagatcgagagcgagagcgtgagcgagaagggcgacagccagaagggcaagagaaagaccagcgagcaggccgtgctgagcgacagcaacaccagaagcgagagacagaaggagatgatgtacttcggcggccacagcctggaggaggacctggagtggagcgagccccagatcaaggacagcggcgtggacacctgcagcagcaccaccctgaacgaggagcacagccacagcgacaagcaccccgtgacctggcagcccagcaaggacggcgacagactgatcggcagaatcctgctgaacaagagactgaaggacggcagcgtgcccagagacagcggcgccatgctgggcctgaaggtggtgggcggcaagatgaccgagagcggcagactgtgcgccttcatcaccaaggtgaagaagggcagcctggccgacaccgtgggccacctgagacccggcgacgaggtgctggagtggaacggcagactgctgcagggcgccaccttcgaggaggtgtacaacatcatcctggagagcaagcccgagccccaggtggagctggtggtgagcagacccatcggcgacatccccagaatccccgacagcacccacgcccagctggagagcagcagcagcagcttcgagagccagaagatggacagacccagcatcagcgtgaccagccccatgagccccggcatgctgagagacgtgccccagttcctgagcggccagctgagcatcaagctgtggttcgacaaggtgggccaccagctgatcgtgaccatcctgggcgccaaggacctgcccagcagagaggacggcagacccagaaacccctacgtgaagatctacttcctgcccgacagaagcgacaagaacaagagaagaaccaagaccgtgaagaagaccctggagcccaagtggaaccagaccttcatctacagccccgtgcacagaagagagttcagagagagaatgctggagatcaccctgtgggaccaggccagagtgagagaggaggagagcgagttcctgggcgagatcctgatcgagctggagaccgccctgctggacgacgagccccactggtacaagctgcagacccacgacgtgagcagcctgcccctgccccaccccagcccctacatgcccagaagacagctgcacggcgagagccccaccagaagactgcagagaagcaagagaatcagcgacagcgaggtgagcgactacgactgcgacgacggcatcggcgtggtgagcgactacagacacgacggcagagacctgcagagcagcaccctgagcgtgcccgagcaggtgatgagcagcaaccactgcagccccagcggcagcccccacagagtggacgtgatcggcagaaccagaagctggagccccagcgtgccccccccccagagcagaaacgtggagcagggcctgagaggcaccagaaccatgaccggccactacaacaccatcagcagaatggacagacacagagtgatggacgaccactacagccccgacagagacagagactgcgaggccgccgacagacagccctaccacagaagcagaagcaccgagcagagacccctgctggagagaaccaccaccagaagcagaagcaccgagagacccgacaccaacctgatgagaagcatgcccagcctgatgaccggcagaagcgccccccccagccccgccctgagcagaagccaccccagaaccggcagcgtgcagaccagccccagcagcacccccgtggccggcagaagaggcagacagctgccccagctgccccccaagggcaccctggacagaaaggccggcggcaagaagctgagaagcaccgtgcagagaagcaccgagaccggcctggccgtggagatgagaaactggatgaccagacaggccagcagagagagcaccgacggcagcatgaacagctacagcagcgagggcaacctgatcttccccggcgtgagactggccagcgacagccagttcagcgacttcctggacggcctgggccccgcccagctggtgggcagacagaccctggccacccccgccatgggcgacatccaggtgggcatgatggacaagaagggccagctggaggtggagatcatcagagccagaggcctggtggtgaagcccggcagcaagaccctgcccgccccctacgtgaaggtgtacctgctggacaacggcgtgtgcatcgccaagaagaagaccaaggtggccagaaagaccctggagcccctgtaccagcagctgctgagcttcgaggagagcccccagggcaaggtgctgcagatcatcgtgtggggcgactacggcagaatggaccacaagagcttcatgggcgtggcccagatcctgctggacgagctggagctgagcaacatggtgatcggctggttcaagctgttcccccccagcagcctggtggaccccaccctggcccccctgaccagaagagccagccagagcagcctggagagcagcaccggccccagctacagcagaagctag

SEQ ID NO: 96630 - DNA, 4050 bp, Artificial Sequence
  Description of Artificial Sequence: Synthetic coding sequence
atgagcgcccccgtgggccccagaggcagactggcccccatccccgccgccagccagccccccctgcagcccgagatgcccgacctgagccacctgaccgaggaggagagaaagatcatcctggccgtgatggacagacagaagaaggaggaggagaaggagcagagcgtgctgaagaagctgcaccagcagttcgagatgtacaaggagcaggtgaagaagatgggcgaggagagccagcagcagcaggagcagaagggcgacgcccccacctgcggcatctgccacaagaccaagttcgccgacggctgcggccacaactgcagctactgccagaccaagttctgcgccagatgcggcggcagagtgagcctgagaagcaacaaggtgatgtgggtgtgcaacctgtgcagaaagcagcaggagatcctgaccaagagcggcgcctggttctacaacagcggcagcaacaccccccagcagcccgaccagaaggtgctgagaggcctgagaaacgaggaggccccccaggagaagaagcccaagctgcacgagcagacccagttccagggccccagcggcgacctgagcgtgcccgccgtggagaagagcagaagccacggcctgaccagacagcacagcatcaagaacggcagcggcgtgaagcaccacatcgccagcgacatcgccagcgacagaaagagaagccccagcgtgagcagagaccagaacagaagatacgaccagagagaggagagagaggagtacagccagtacgccaccagcgacaccgccatgcccagaagccccagcgactacgccgacagaagaagccagcacgagccccagttctacgaggacagcgaccacctgagctacagagacagcaacagaagaagccacagacacagcaaggagtacatcgtggacgacgaggacgtggagagcagagacgagtacgagagacagagaagagaggaggagtaccagagcagatacagaagcgaccccaacctggccagataccccgtgaagccccagccctacgaggagcagatgagaatccacgccgaggtgagcagagccagacacgagagaagacacagcgacgtgagcctggccaacgccgacctggaggacagcagaatcagcatgctgagaatggacagacccagcagacagagaagcatcagcgagagaagagccgccatggagaaccagagaagctacagcatggagagaaccagagaggcccagggccccagcagctacgcccagagaaccaccaaccacagcccccccacccccagaagaagccccctgcccatcgacagacccgacctgagaagaaccgacagcctgagaaagcagcaccacctggaccccagcagcgccgtgagaaagaccaagagagagaagatggagaccatgctgagaaacgacagcctgagcagcgaccagagcgagagcgtgagaccccccccccccaagccccacaagagcaagaagggcggcaagatgagacagatcagcctgagcagcagcgaggaggagctggccagcacccccgagtacaccagctgcgacgacgtggagatcgagagcgagagcgtgagcgagaagggcgacatggactacaactggctggaccacaccagctggcacagcagcgaggccagccccatgagcctgcaccccgtgacctggcagcccagcaaggacggcgacagactgatcggcagaatcctgctgaacaagagactgaaggacggcagcgtgcccagagacagcggcgccatgctgggcctgaaggtggtgggcggcaagatgaccgagagcggcagactgtgcgccttcatcaccaaggtgaagaagggcagcctggccgacaccgtgggccacctgagacccggcgacgaggtgctggagtggaacggcagactgctgcagggcgccaccttcgaggaggtgtacaacatcatcctggagagcaagcccgagccccaggtggagctggtggtgagcagacccatcggcgacatccccagaatccccgacagcacccacgcccagctggagagcagcagcagcagcttcgagagccagaagatggacagacccagcatcagcgtgaccagccccatgagccccggcatgctgagagacgtgccccagttcctgagcggccagctgagcagccagagcctgagcagaagaaccacccccttcgtgcccagagtgcagatcaagctgtggttcgacaaggtgggccaccagctgatcgtgaccatcctgggcgccaaggacctgcccagcagagaggacggcagacccagaaacccctacgtgaagatctacttcctgcccgacagaagcgacaagaacaagagaagaaccaagaccgtgaagaagaccctggagcccaagtggaaccagaccttcatctacagccccgtgcacagaagagagttcagagagagaatgctggagatcaccctgtgggaccaggccagagtgagagaggaggagagcgagttcctgggcgagatcctgatcgagctggagaccgccctgctggacgacgagccccactggtacaagctgcagacccacgacgtgagcagcctgcccctgccccaccccagcccctacatgcccagaagacagctgcacggcgagagccccaccagaagactgcagagaagcaagagaatcagcgacagcgaggtgagcgactacgactgcgacgacggcatcggcgtggtgagcgactacagacacgacggcagagacctgcagagcagcaccctgagcgtgcccgagcaggtgatgagcagcaaccactgcagccccagcggcagcccccacagagtggacgtgatcggcagaaccagaagctggagccccagcgtgccccccccccagagcagaaacgtggagcagggcctgagaggcaccagaaccatgaccggccactacaacaccatcagcagaatggacagacacagagtgatggacgaccactacagccccgacagagacagagactgcgaggccgccgacagacagccctaccacagaagcagaagcaccgagcagagacccctgctggagagaaccaccaccagaagcagaagcaccgagagacccgacaccaacctgatgagaagcatgcccagcctgatgaccggcagaagcgccccccccagccccgccctgagcagaagccaccccagaaccggcagcgtgcagaccagccccagcagcacccccgtggccggcagaagaggcagacagctgccccagctgccccccaagggcaccctggacagaaaggccggcggcaagaagctgagaagcaccgtgcagagaagcaccgagaccggcctggccgtggagatgagaaactggatgaccagacaggccagcagagagagcaccgacggcagcatgaacagctacagcagcgagggcaacctgatcttccccggcgtgagactggccagcgacagccagttcagcgacttcctggacggcctgggccccgcccagctggtgggcagacagaccctggccacccccgccatgggcgacatccaggtgggcatgatggacaagaagggccagctggaggtggagatcatcagagccagaggcctggtggtgaagcccggcagcaagaccctgcccgccccctacgtgaaggtgtacctgctggacaacggcgtgtgcatcgccaagaagaagaccaaggtggccagaaagaccctggagcccctgtaccagcagctgctgagcttcgaggagagcccccagggcaaggtgctgcagatcatcgtgtggggcgactacggcagaatggaccacaagagcttcatgggcgtggcccagatcctgctggacgagctggagctgagcaacatggtgatcggctggttcaagctgttcccccccagcagcctggtggaccccaccctggcccccctgaccagaagagccagccagagcagcctggagagcagcaccggccccagctacagcagaagctag

SEQ ID NO: 96631 - DNA, 3492 bp, Artificial Sequence
  Description of Artificial Sequence: Synthetic coding sequence
atgcagttcgagaccctgagacaggtgtgcaacagcgtgctgagccacttccacggcgtgttcagcagcccccccaacatcctgcagaacgagctgttcggccagaccctgaacaacgccagaaagagaagccccagcgtgagcagagaccagaacagaagatacgaccagagagaggagagagaggagtacagccagtacgccaccagcgacaccgccatgcccagaagccccagcgactacgccgacagaagaagccagcacgagccccagttctacgaggacagcgaccacctgagctacagagacagcaacagaagaagccacagacacagcaaggagtacatcgtggacgacgaggacgtggagagcagagacgagtacgagagacagagaagagaggaggagtaccagagcagatacagaagcgaccccaacctggccagataccccgtgaagccccagccctacgaggagcagatgagaatccacgccgaggtgagcagagccagacacgagagaagacacagcgacgtgagcctggccaacgccgacctggaggacagcagaatcagcatgctgagaatggacagacccagcagacagagaagcatcagcgagagaagagccgccatggagaaccagagaagctacagcatggagagaaccagagaggcccagggccccagcagctacgcccagagaaccaccaaccacagcccccccacccccagaagaagccccctgcccatcgacagacccgacctgagaagaaccgacagcctgagaaagcagcaccacctggaccccagcagcgccgtgagaaagaccaagagagagaagatggagaccatgctgagaaacgacagcctgagcagcgaccagagcgagagcgtgagaccccccccccccaagccccacaagagcaagaagggcggcaagatgagacagatcagcctgagcagcagcgaggaggagctggccagcacccccgagtacaccagctgcgacgacgtggagatcgagagcgagagcgtgagcgagaagggcgacatggactacaactggctggaccacaccagctggcacagcagcgaggccagccccatgagcctgcaccccgtgacctggcagcccagcaaggacggcgacagactgatcggcagaatcctgctgaacaagagactgaaggacggcagcgtgcccagagacagcggcgccatgctgggcctgaaggtggtgggcggcaagatgaccgagagcggcagactgtgcgccttcatcaccaaggtgaagaagggcagcctggccgacaccgtgggccacctgagacccggcgacgaggtgctggagtggaacggcagactgctgcagggcgccaccttcgaggaggtgtacaacatcatcctggagagcaagcccgagccccaggtggagctggtggtgagcagacccatcggcgacatccccagaatccccgacagcacccacgcccagctggagagcagcagcagcagcttcgagagccagaagatggacagacccagcatcagcgtgaccagccccatgagccccggcatgctgagagacgtgccccagttcctgagcggccagctgagcatcaagctgtggttcgacaaggtgggccaccagctgatcgtgaccatcctgggcgccaaggacctgcccagcagagaggacggcagacccagaaacccctacgtgaagatctacttcctgcccgacagaagcgacaagaacaagagaagaaccaagaccgtgaagaagaccctggagcccaagtggaaccagaccttcatctacagccccgtgcacagaagagagttcagagagagaatgctggagatcaccctgtgggaccaggccagagtgagagaggaggagagcgagttcctgggcgagatcctgatcgagctggagaccgccctgctggacgacgagccccactggtacaagctgcagacccacgacgtgagcagcctgcccctgccccaccccagcccctacatgcccagaagacagctgcacggcgagagccccaccagaagactgcagagaagcaagagaatcagcgacagcgaggtgagcgactacgactgcgacgacggcatcggcgtggtgagcgactacagacacgacggcagagacctgcagagcagcaccctgagcgtgcccgagcaggtgatgagcagcaaccactgcagccccagcggcagcccccacagagtggacgtgatcggcagaaccagaagctggagccccagcgtgccccccccccagagcagaaacgtggagcagggcctgagaggcaccagaaccatgaccggccactacaacaccatcagcagaatggacagacacagagtgatggacgaccactacagccccgacagagacagccacttcctgaccctgcccagaagcagatacagccagaccatcgaccaccaccacagagacggcagagactgcgaggccgccgacagacagccctaccacagaagcagaagcaccgagcagagacccctgctggagagaaccaccaccagaagcagaagcaccgagagacccgacaccaacctgatgagaagcatgcccagcctgatgaccggcagaagcgccccccccagccccgccctgagcagaagccaccccagaaccggcagcgtgcagaccagccccagcagcacccccgtggccggcagaagaggcagacagctgccccagctgccccccaagggcaccctggacagaaaggccggcggcaagaagctgagaagcaccgtgcagagaagcaccgagaccggcctggccgtggagatgagaaactggatgaccagacaggccagcagagagagcaccgacggcagcatgaacagctacagcagcgagggcaacctgatcttccccggcgtgagactggccagcgacagccagttcagcgacttcctggacggcctgggccccgcccagctggtgggcagacagaccctggccacccccgccatgggcgacatccaggtgggcatgatggacaagaagggccagctggaggtggagatcatcagagccagaggcctggtggtgaagcccggcagcaagaccctgcccgccccctacgtgaaggtgtacctgctggacaacggcgtgtgcatcgccaagaagaagaccaaggtggccagaaagaccctggagcccctgtaccagcagctgctgagcttcgaggagagcccccagggcaaggtgctgcagatcatcgtgtggggcgactacggcagaatggaccacaagagcttcatgggcgtggcccagatcctgctggacgagctggagctgagcaacatggtgatcggctggttcaagctgttcccccccagcagcctggtggaccccaccctggcccccctgaccagaagagccagccagagcagcctggagagcagcaccggccccagctacagcagaagctag

SEQ ID NO: 96632 - DNA, 927 bp, Artificial Sequence
  Description of Artificial Sequence: Synthetic coding sequence
atgttcaacggcgagcccggccccgccagcagcggcgccagcagaaacgtggtgagaagcagcagcatcagcggcgagatctgcggcagccagcaggccggcggcggcgccggcaccaccaccgccaagaagagaagaagcagcctgggcgccaagatggtggccatcgtgggcctgacccagtggagcaagagcaccctgcagctgccccagcccgagggcgccaccaagaagctgagaagcaacatcagaagaagcaccgagaccggcatcgccgtggagatgagaagcagagtgaccagacagggcagcagagagagcaccgacggcagcaccaacagcaacagcagcgacggcaccttcatcttccccaccaccagactgggcgccgagagccagttcagcgacttcctggacggcctgggccccgcccagatcgtgggcagacagaccctggccaccccccccatgggcgacgtgcacatcgccatcatggacagaagcggccagctggaggtggaggtgatcgaggccagaggcctgacccccaagcccggcagcaagagcctgcccgccacctacatcaaggtgtacctgctggagaacggcgcctgcctggccaagaagaagaccaagatgaccaagaagacctgcgaccccctgtaccagcaggccctgctgttcgacgagggcccccagggcaaggtgctgcaggtgatcgtgtggggcgactacggcagaatggaccacaagtgcttcatgggcatggcccagatcatgctggacgagctggacctgagcgccgccgtgaccggctggtacaagctgttccccaccagcagcgtggccgacagcaccctgggcagcctgaccagaagactgagccagagcagcctggagagcgccaccagccccagctgcagctag

SEQ ID NO: 96633 - DNA, 927 bp, Artificial Sequence; identical to SEQ ID NO: 96632
  Description of Artificial Sequence: Synthetic coding sequence

SEQ ID NO: 96634 - DNA, 810 bp, Artificial Sequence
  Description of Artificial Sequence: Synthetic coding sequence
atggagagaagccagagcagactgagcctgagcgccagcttcgaggccctggccatctacttcccctgcatgaacagcttcgacgacgaggacgccggcgacagcagaagactgaagggcgccatccagagaagcaccgagaccggcctggccgtggagatgcccagcagaaccctgagacaggccagccacgagagcatcgaggacagcatgaacagctacggcagcgagggcaacctgaactacggcggcgtgtgcctggccagcgacgcccagttcagcgacttcctgggcagcatgggccccgcccagttcgtgggcagacagaccctggccaccacccccatgggcgacgtggagatcggcctgcaggagagaaacggccagctggaggtggacatcatccaggccagaggcctgaccgccaagcccggcagcaagaccctgcccgccgcctacatcaaggcctacctgctggagaacggcatctgcatcgccaagaagaagaccaaggtggccagaaagagcctggaccccctgtacaaccaggtgctgctgttccccgagagcccccagggcaaggtgctgcaggtgatcgtgtggggcaactacggcagaatggagagaaagcagttcatgggcgtggccagagtgctgctggaggagctggacctgaccaccctggccgtgggctggtacaagctgttccccaccagcagcatggtggaccccgccaccggccccctgctgagacaggccagccagctgagcctggagagcaccgtgggcccctgcggcgagagaagctag

SEQ ID NO: 96635 - DNA, 813 bp, Artificial Sequence
  Description of Artificial Sequence: Synthetic coding sequence
atggagagaagccagagcagactgagcctgagcgccagcttcgaggccctggccatctacttcccctgcatgaacagcttcgacgacgaggacgccgagggcgacagcagaagactgaagggcgccatccagagaagcaccgagaccggcctggccgtggagatgcccagcagaaccctgagacaggccagccacgagagcatcgaggacagcatgaacagctacggcagcgagggcaacctgaactacggcggcgtgtgcctggccagcgacgcccagttcagcgacttcctgggcagcatgggccccgcccagttcgtgggcagacagaccctggccaccacccccatgggcgacgtggagatcggcctgcaggagagaaacggccagctggaggtggacatcatccaggccagaggcctgaccgccaagcccggcagcaagaccctgcccgccgcctacatcaaggcctacctgctggagaacggcatctgcatcgccaagaagaagaccaaggtggccagaaagagcctggaccccctgtacaaccaggtgctgctgttccccgagagcccccagggcaaggtgctgcaggtgatcgtgtggggcaactacggcagaatggagagaaagcagttcatgggcgtggccagagtgctgctggaggagctggacctgaccaccctggccgtgggctggtacaagctgttccccaccagcagcatggtggaccccgccaccggccccctgctgagacaggccagccagctgagcctggagagcaccgtgggcccctgcggcgagagaagctag

SEQ ID NO: 96636 - DNA, 759 bp, Artificial Sequence
  Description of Artificial Sequence: Synthetic coding sequence
atggaggacggcgtggccggcccccagctgggcgccgccgccgaggccgccgaggccgccgaggccagagccagacccggcgtgaccctgagacccttcgcccccctgagcggcgccgccgaggccgacgagggcggcggcgactggagcttcatcgactgcgagatggaggaggtggacctgcaggacctgcccagcgccaccatcgcctgccacctggaccccagagtgttcgtggacggcctgtgcagagccaagttcgagagcctgttcagaacctacgacaaggacatcaccttccagtacttcaagagcttcaagagagtgagaatcaacttcagcaaccccttcagcgccgccgacgccagactgcagctgcacaagaccgagttcctgggcaaggagatgaagctgtacttcgcccagaccctgcacatcggcagcagccacctggccccccccaaccccgacaagcagttcctgatcagcccccccgccagcccccccgtgggctggaagcaggtggaggacgccacccccgtgatcaactacgacctgctgtacgccatcagcaagctgggccccggcgagaagtacgagctgcacgccgccaccgacaccacccccagcgtggtggtgcacgtgtgcgagagcgaccaggagaaggaggaggaggaggagatggagagaatgagaagacccaagcccaagatcatccagaccagaagacccgagtacacccccatccacctgagctag

SEQ ID NO: 96637 - DNA, 594 bp, Artificial Sequence
  Description of Artificial Sequence: Synthetic coding sequence
atgcacttcagaaacttcaactacagcttcagcagcctgatcgcctgcgtggccaacagcgacatcttcagcgagagcgagaccagagccaagttcgagagcctgttcagaacctacgacaaggacatcaccttccagtacttcaagagcttcaagagagtgagaatcaacttcagcaaccccttcagcgccgccgacgccagactgcagctgcacaagaccgagttcctgggcaaggagatgaagctgtacttcgcccagaccctgcacatcggcagcagccacctggccccccccaaccccgacaagcagttcctgatcagcccccccgccagcccccccgtgggctggaagcaggtggaggacgccacccccgtgatcaactacgacctgctgtacgccatcagcaagctgggccccggcgagaagtacgagctgcacgccgccaccgacaccacccccagcgtggtggtgcacgtgtgcgagagcgaccaggagaaggaggaggaggaggagatggagagaatgagaagacccaagcccaagatcatccagaccagaagacccgagtacacccccatccacctgagctag

SEQ ID NO: 96638 - DNA, 729 bp, Artificial Sequence
  Description of Artificial Sequence: Synthetic coding sequence
atgcagggcgagcagggcagaagactgttcagactgctgctgaacgacctgcccggcagagacagactgccctgcagctacccccagccccacgtggagcaggccagcaccagcgccagccccagactgctggccgtgaacatccccgaggacaccctgctgagctaccccgagagcagcctgcccctgcagagacactgcgccttccacagattcagcaaggccaagttcgagagcctgttcagaacctacgacaaggacatcaccttccagtacttcaagagcttcaagagagtgagaatcaacttcagcaaccccttcagcgccgccgacgccagactgcagctgcacaagaccgagttcctgggcaaggagatgaagctgtacttcgcccagaccctgcacatcggcagcagccacctggccccccccaaccccgacaagcagttcctgatcagcccccccgccagcccccccgtgggctggaagcaggtggaggacgccacccccgtgatcaactacgacctgctgtacgccatcagcaagctgggccccggcgagaagtacgagctgcacgccgccaccgacaccacccccagcgtggtggtgcacgtgtgcgagagcgaccaggagaaggaggaggaggaggagatggagagaatgagaagacccaagcccaagatcatccagaccagaagacccgagtacacccccatccacctgagctag

SEQ ID NO: 96639 - DNA, 354 bp, Artificial Sequence
  Description of Artificial Sequence: Synthetic coding sequence
atgaagctgtacttcgcccagaccctgcacatcggcagcagccacctggccccccccaaccccgacaagcagttcctgatcagcccccccgccagcccccccgtgggctggaagcaggtggaggacgccacccccgtgatcaactacgacctgctgtacgccatcagcaagctgggccccggcgagaagtacgagctgcacgccgccaccgacaccacccccagcgtggtggtgcacgtgtgcgagagcgaccaggagaaggaggaggaggaggagatggagagaatgagaagacccaagcccaagatcatccagaccagaagacccgagtacacccccatccacctgagctag

SEQ ID NO: 96640 - DNA, 354 bp, Artificial Sequence; identical to SEQ ID NO: 96639
  Description of Artificial Sequence: Synthetic coding sequence

SEQ ID NO: 96641 - DNA, 354 bp, Artificial Sequence; identical to SEQ ID NO: 96639
  Description of Artificial Sequence: Synthetic coding sequence

SEQ ID NO: 96642 - DNA, 732 bp, Artificial Sequence
  Description of Artificial Sequence: Synthetic coding sequence
atgagaggcgagagctacttcatcggcatgagaagccccggccagcagggccacgtgcccgaggacggcggcctgttcctgctgtgctgcatcgacagagactgggccgtgaccagatgcttcgccgaggaggccttccaggccatcaccgacttcaacgacctgcccaacagcctgttcgcctgcaacgtgcaccagagcgtgttcgagggcgaggagagcaaggagaagttcgagggcctgttcagaacctacgacgactgcgtgaccttccagctgttcaagagcttcagaagagtgagaatcaacttcagcaaccccaagagcgccgccagagccagaatcgagctgcacgagacccagttcagaggcaagaagctgaagctgtacttcgcccaggtgcagacccccgagaccgacggcgacaagctgcacctggcccccccccagcccgccaagcagttcctgatcagcccccccagcagcccccccgtgggctggcagcccatcaacgacgccacccccgtgctgaactacgacctgctgtacgccgtggccaagctgggccccggcgagaagtacgagctgcacgccggcaccgagagcacccccagcgtggtggtgcacgtgtgcgacagcgacatcgaggaggaggaggaccccaagaccagccccaagcccaagatcatccagaccagaagacccggcctgccccccagcgtgagcaactag

SEQ ID NO: 96643 - DNA, 594 bp, Artificial Sequence
  Description of Artificial Sequence: Synthetic coding sequence
atgcccgcccccagcatggactgcgacgtgagcaccctggtggcctgcgtggtggacgtggaggtgttcaccaaccaggaggtgaaggagaagttcgagggcctgttcagaacctacgacgactgcgtgaccttccagctgttcaagagcttcagaagagtgagaatcaacttcagcaaccccaagagcgccgccagagccagaatcgagctgcacgagacccagttcagaggcaagaagctgaagctgtacttcgcccaggtgcagacccccgagaccgacggcgacaagctgcacctggcccccccccagcccgccaagcagttcctgatcagcccccccagcagcccccccgtgggctggcagcccatcaacgacgccacccccgtgctgaactacgacctgctgtacgccgtggccaagctgggccccggcgagaagtacgagctgcacgccggcaccgagagcacccccagcgtggtggtgcacgtgtgcgacagcgacatcgaggaggaggaggaccccaagaccagccccaagcccaagatcatccagaccagaagacccggcctgccccccagcgtgagcaactag

SEQ ID NO: 96644 - DNA, 732 bp, Artificial Sequence; identical to SEQ ID NO: 96642
  Description of Artificial Sequence: Synthetic coding sequence

SEQ ID NO: 96645 - DNA, 732 bp, Artificial Sequence; identical to SEQ ID NO: 96642
  Description of Artificial Sequence: Synthetic coding sequence

SEQ ID NO: 96646 - DNA, 1596 bp, Artificial Sequence
  Description of Artificial Sequence: Synthetic coding sequence
atggtggacgtgggcaagtggcccatcttcaccctgctgagcccccaggagatcgccagcatcagaaaggcctgcgtgttcggcaccagcgccagcgaggccctgtacgtgaccgacaacgacgaggtgttcgtgttcggcctgaactacagcaactgcctgggcaccggcgacaaccagagcaccctggtgcccaagaagctggagggcctgtgcggcaagaagatcaagagcctgagctacggcagcggcccccacgtgctgctgagcaccgaggacggcgtggtgtacgcctggggccacaacggctacagccagctgggcaacggcaccaccaaccagggcatcgcccccgtgcaggtgtgcaccaacctgctgatcaagcaggtggtggaggtggcctgcggcagccaccacagcatggccctggccgccgacggcgaggtgttcgcctggggctacaacaactgcggccaggtgggcagcggcagcaccgccaaccagcccacccccagaaaggtgaccaactgcctgcacatcaagagagtggtgggcatcgcctgcggccagaccagcagcatggccgtgctggacaacggcgaggtgtacggctggggctacaacggcaacggccagctgggcctgggcaacaacggcaaccagctgacccccgtgagagtggccgccctgcacagcgtgtgcgtgaaccagatcgtgtgcggctacgcccacaccctggccctgaccgacgagggcctgctgtacgcctggggcgccaacacctacggccagctgggcaccggcaacaagaacaacctgctgagccccgcccacatcatggtggagaaggagagagtggtggagatcgccgcctgccacagcgcccacaccagcgccgccaagacccagggcggccacgtgtacatgtggggccagtgcagaggccagagcgtgatcctgccccacctgacccacttcagctgcaccgacgacgtgttcgcctgcttcgccacccccgccgtgagctggagactgctgagcgtggagcacgaggacttcctgaccgtggccgagagcctgaagaaggagttcgacagccccgagaccgccgacctgaagttcagaatcgacggcaagtacatccacgtgcacaaggccgtgctgaagatcagatgcgagcacttcagaagcatgttccagagctactggaacgaggacatgaaggaggtgatcgagatcgaccagttcagctaccccgtgtacagagccttcctgcagtacctgtacaccgacaccgtggacctgccccccgaggacgccatcggcctgctggacctggccaccagctactgcgagaacagactgaagaagctgtgccagcacatcatcaagagaggcatcaccgtggagaacgccttcagcctgttcagcgccgccgtgagatacgacgccgaggacctggaggagttctgcttcaagttctgcatcaaccacctgaccgaggtgacccagaccgccgccttctggcagatggacggccccctgctgaaggagttcatcgccaaggccagcaagtgcggcgccttcaagaactag

SEQ ID NO: 96647 - DNA, 1596 bp, Artificial Sequence; identical to SEQ ID NO: 96646
  Description of Artificial Sequence: Synthetic coding sequence

SEQ ID NO: 96648 - DNA, 1068 bp, Artificial Sequence
  Description of Artificial Sequence: Synthetic coding sequence
atggtggacgtgggcaagtggcccatcttcaccctgctgagcccccaggagatcgccagcatcagaaaggcctgcgtgttcggcaccagcgccagcgaggccctgtacgtgaccgacaacgacgaggtgttcgtgttcggcctgaactacagcaactgcctgggcaccggcgacaaccagagcaccctggtgcccaagaagctggagggcctgtgcggcaagaagatcaagagcctgagctacggcagcggcccccacgtgctgctgagcaccgaggacggcgtggtgtacgcctggggccacaacggctacagccagctgggcaacggcaccaccaaccagggcatcgcccccgtgcaggtgtgcaccaacctgctgatcaagcaggtggtggaggtggcctgcggcagccaccacagcatggccctggccgccgacggcgaggtgttcgcctggggctacaacaactgcggccaggtgggcagcggcagcaccgccaaccagcccacccccagaaaggtgaccaactgcctgcacatcaagagagtggtgggcatcgcctgcggccagaccagcagcatggccgtgctggacaacggcgaggtgtacggctggggctacaacggcaacggccagctgggcctgggcaacaacggcaaccagctgacccccgtgagagtggccgccctgcacagcgtgtgcgtgaaccagatcgtgtgcggctacgcccacaccctggccctgaccgacgagggcctgctgtacgcctggggcgccaacacctacggccagctgggcaccggcaacaagaacaacctgctgagccccgcccacatcatggtggagaaggagagagtggtggagatcgccgcctgccacagcgcccacaccagcgccgccaagacccagggcggccacgtgtacatgtggggccagtgcagaggccagagcgtgatcctgccccacctgacccacttcagctgcaccgacgacgtgttcgcctgcttcgccacccccgccgtgagctggagactgctgagcgtggtgagcatcgtgatcggcaagtag

SEQ ID NO: 96649 - DNA, 1656 bp, Artificial Sequence
  Description of Artificial Sequence: Synthetic coding sequence
atggaggaggagctgcccctgttcagcggcgacagcggcaagcccgtgcaggccaccctgagcagcctgaagatgctggacgtgggcaagtggcccatcttcagcctgtgcagcgaggaggagctgcagctgatcagacaggcctgcgtgttcggcagcgccggcaacgaggtgctgtacaccaccgtgaacgacgagatcttcgtgctgggcaccaactgctgcggctgcctgggcctgggcgacgtgcagagcaccatcgagcccagaagactggacagcctgaacggcaagaagatcgcctgcctgagctacggcagcggcccccacatcgtgctggccaccaccgagggcgaggtgttcacctggggccacaacgcctacagccagctgggcaacggcaccaccaaccacggcctggtgccctgccacatcagcaccaacctgagcaacaagcaggtgatcgaggtggcctgcggcagctaccacagcctggtgctgaccagcgacggcgaggtgttcgcctggggctacaacaacagcggccaggtgggcagcggcagcaccgtgaaccagcccatccccagaagagtgaccggctgcctgcagaacaaggtggtggtgaccatcgcctgcggccagatgtgctgcatggccgtggtggacaccggcgaggtgtacgtgtggggctacaacggcaacggccagctgggcctgggcaacagcggcaaccagcccaccccctgcagagtggccgccctgcagggcatcagagtgcagagagtggcctgcggctacgcccacaccctggtgctgaccgacgagggccaggtgtacgcctggggcgccaacagctacggccagctgggcaccggcaacaagagcaaccagagctaccccacccccgtgaccgtggagaaggacagaatcatcgagatcgccgcctgccacagcacccacaccagcgccgccaagacccagggcggccacgtgtacatgtggggccagtgcagaggccagagcgtgatcctgccccacctgacccacttcagctgcaccgacgacgtgttcgcctgcttcgccacccccgccgtgacctggagactgctgagcgtggagcccgacgaccacctgaccgtggccgagagcctgaagagagagttcgacaaccccgacaccgccgacctgaagttcctggtggacggcaagtacatctacgcccacaaggtgctgctgaagatcagatgcgagcacttcagaagcagcctggaggacaacgaggacgacatcgtggagatgagcgagttcagctaccccgtgtacagagccttcctggagtacctgtacaccgacagcatcagcctgagccccgaggaggccgtgggcctgctggacctggccaccttctacagagagaacagactgaagaagctgtgccagcagaccatcaagcagggcatctgcgaggagaacgccatcgccctgctgagcgccgccgtgaagtacgacgcccaggacctggaggagttctgcttcagattctgcatcaaccacctgaccgtggtgacccagaccagcggcttcgccgagatggaccacgacctgctgaagaacttcatcagcaaggccagcagagtgggcgccttcaagaactag

SEQ ID NO: 96650 - DNA, 1671 bp, Artificial Sequence
  Description of Artificial Sequence: Synthetic coding sequence
atgagcgccctgcccagagacctggagctgagcaaccccagagagaagctgaccaagcccgtgcaggccaccctgagcagcctgaagatgctggacgtgggcaagtggcccatcttcagcctgtgcagcgaggaggagctgcagctgatcagacaggcctgcgtgttcggcagcgccggcaacgaggtgctgtacaccaccgtgaacgacgagatcttcgtgctgggcaccaactgctgcggctgcctgggcctgggcgacgtgcagagcaccatcgagcccagaagactggacagcctgaacggcaagaagatcgcctgcctgagctacggcagcggcccccacatcgtgctggccaccaccgagggcgaggtgttcacctggggccacaacgcctacagccagctgggcaacggcaccaccaaccacggcctggtgccctgccacatcagcaccaacctgagcaacaagcaggtgatcgaggtggcctgcggcagctaccacagcctggtgctgaccagcgacggcgaggtgttcgcctggggctacaacaacagcggccaggtgggcagcggcagcaccgtgaaccagcccatccccagaagagtgaccggctgcctgcagaacaaggtggtggtgaccatcgcctgcggccagatgtgctgcatggccgtggtggacaccggcgaggtgtacgtgtggggctacaacggcaacggccagctgggcctgggcaacagcggcaaccagcccaccccctgcagagtggccgccctgcagggcatcagagtgcagagagtggcctgcggctacgcccacaccctggtgctgaccgacgagggccaggtgtacgcctggggcgccaacagctacggccagctgggcaccggcaacaagagcaaccagagctaccccacccccgtgaccgtggagaaggacagaatcatcgagatcgccgcctgccacagcacccacaccagcgccgccaagacccagggcggccacgtgtacatgtggggccagtgcagaggccagagcgtgatcctgccccacctgacccacttcagctgcaccgacgacgtgttcgcctgcttcgccacccccgccgtgacctggagactgctgagcgtggagcccgacgaccacctgaccgtggccgagagcctgaagagagagttcgacaaccccgacaccgccgacctgaagttcctggtggacggcaagtacatctacgcccacaaggtgctgctgaagatcagatgcgagcacttcagaagcagcctggaggacaacgaggacgacatcgtggagatgagcgagttcagctaccccgtgtacagagccttcctggagtacctgtacaccgacagcatcagcctgagccccgaggaggccgtgggcctgctggacctggccaccttctacagagagaacagactgaagaagctgtgccagcagaccatcaagcagggcatctgcgaggagaacgccatcgccctgctgagcgccgccgtgaagtacgacgcccaggacctggaggagttctgcttcagattctgcatcaaccacctgaccgtggtgacccagaccagcggcttcgccgagatggaccacgacctgctgaagaacttcatcagcaaggccagcagagtgggcgccttcaagaactag

SEQ ID NO: 96651 - DNA, 1512 bp, Artificial Sequence
  Description of Artificial Sequence: Synthetic coding sequence
atgctgcaggacggcagctgcaagcagatgctgctgatgctgctgatcgtgcagcccgtgcaggccaccctgagcagcctgaagatgctggacgtgggcaagtggcccatcttcagcctgtgcagcgaggaggagctgcagctgatcagacaggcctgcgtgttcggcagcgccggcaacgaggtgctgtacaccaccgtgaacgacgagatcttcgtgctgggcaccaactgctgcggctgcctgggcctgggcgacgtgcagagcaccatcgagcccagaagactggacagcctgaacggcaagaagatcgcctgcctgagctacggcagcggcccccacatcgtgctggccaccaccgagggcgaggtgttcacctggggccacaacgcctacagccagctgggcaacggcaccaccaaccacggcctggtgccctgccacatcagcaccaacctgagcaacaagcaggtgatcgaggtggcctgcggcagctaccacagcctggtgctgaccagcgacggcgaggtgttcgcctggggctacaacaacagcggccaggtgggcagcggcagcaccgtgaaccagcccatccccagaagagtgaccggctgcctgcagaacaaggtggtggtgaccatcgcctgcggccagatgtgctgcatggccgtggtggacaccggcgaggtgtacgtgtggggctacaacggcaacggccagctgggcctgggcaacagcggcaaccagcccaccccctgcagagtggccgccctgcagggcatcagagtgcagagagtggcctgcggctacacccacaccagcgccgccaagacccagggcggccacgtgtacatgtggggccagtgcagaggccagagcgtgatcctgccccacctgacccacttcagctgcaccgacgacgtgttcgcctgcttcgccacccccgccgtgacctggagactgctgagcgtggagcccgacgaccacctgaccgtggccgagagcctgaagagagagttcgacaaccccgacaccgccgacctgaagttcctggtggacggcaagtacatctacgcccacaaggtgctgctgaagatcagatgcgagcacttcagaagcagcctggaggacaacgaggacgacatcgtggagatgagcgagttcagctaccccgtgtacagagccttcctggagtacctgtacaccgacagcatcagcctgagccccgaggaggccgtgggcctgctggacctggccaccttctacagagagaacagactgaagaagctgtgccagcagaccatcaagcagggcatctgcgaggagaacgccatcgccctgctgagcgccgccgtgaagtacgacgcccaggacctggaggagttctgcttcagattctgcatcaaccacctgaccgtggtgacccagaccagcggcttcgccgagatggaccacgacctgctgaagaacttcatcagcaaggccagcagagtgggcgccttcaagaactag

SEQ ID NO: 96652 - DNA, 1671 bp, Artificial Sequence
  Description of Artificial Sequence: Synthetic coding sequence
ccctgcagcaacagataccccggcggcggcgccgacaaggcccccgcctgcgaggagcccgtgcaggccaccctgagcagcctgaagatgctggacgtgggcaagtggcccatcttcagcctgtgcagcgaggaggagctgcagctgatcagacaggcctgcgtgttcggcagcgccggcaacgaggtgctgtacaccaccgtgaacgacgagatcttcgtgctgggcaccaactgctgcggctgcctgggcctgggcgacgtgcagagcaccatcgagcccagaagactggacagcctgaacggcaagaagatcgcctgcctgagctacggcagcggcccccacatcgtgctggccaccaccgagggcgaggtgttcacctggggccacaacgcctacagccagctgggcaacggcaccaccaaccacggcctggtgccctgccacatcagcaccaacctgagcaacaagcaggtgatcgaggtggcctgcggcagctaccacagcctggtgctgaccagcgacggcgaggtgttcgcctggggctacaacaacagcggccaggtgggcagcggcagcaccgtgaaccagcccatccccagaagagtgaccggctgcctgcagaacaaggtggtggtgaccatcgcctgcggccagatgtgctgcatggccgtggtggacaccggcgaggtgtacgtgtggggctacaacggcaacggccagctgggcctgggcaacagcggcaaccagcccaccccctgcagagtggccgccctgcagggcatcagagtgcagagagtggcctgcggctacgcccacaccctggtgctgaccgacgagggccaggtgtacgcctggggcgccaacagctacggccagctgggcaccggcaacaagagcaaccagagctaccccacccccgtgaccgtggagaaggacagaatcatcgagatcgccgcctgccacagcacccacaccagcgccgccaagacccagggcggccacgtgtacatgtggggccagtgcagaggccagagcgtgatcctgccccacctgacccacttcagctgcaccgacgacgtgttcgcctgcttcgccacccccgccgtgacctggagactgctgagcgtggagcccgacgaccacctgaccgtggccgagagcctgaagagagagttcgacaaccccgacaccgccgacctgaagttcctggtggacggcaagtacatctacgcccacaaggtgctgctgaagatcagatgcgagcacttcagaagcagcctggaggacaacgaggacgacatcgtggagatgagcgagttcagctaccccgtgtacagagccttcctggagtacctgtacaccgacagcatcagcctgagccccgaggaggccgtgggcctgctggacctggccaccttctacagagagaacagactgaagaagctgtgccagcagaccatcaagcagggcatctgcgaggagaacgccatcgccctgctgagcgccgccgtgaagtacgacgcccaggacctggaggagttctgcttcagattctgcatcaaccacctgaccgtggtgacccagaccagcggcttcgccgagatggaccacgacctgctgaagaacttcatcagcaaggccagcagagtgggcgccttcaagaactag

SEQ ID NO: 96653 - DNA, 834 bp, Artificial Sequence
  Description of Artificial Sequence: Synthetic coding sequence
atgagcggcgtgaccaccgagaccggcagcctggacagcgccaccgtggccaccagccagcccctggccgagtggcagctgtgcaaggccagcgtgagcagaggcatcatcgagatcgccgcctgccacagcacccacaccagcgccgccaagacccagggcggccacgtgtacatgtggggccagtgcagaggccagagcgtgatcctgccccacctgacccacttcagctgcaccgacgacgtgttcgcctgcttcgccacccccgccgtgacctggagactgctgagcgtggagcccgacgaccacctgaccgtggccgagagcctgaagagagagttcgacaaccccgacaccgccgacctgaagttcctggtggacggcaagtacatctacgcccacaaggtgctgctgaagatcagatgcgagcacttcagaagcagcctggaggacaacgaggacgacatcgtggagatgagcgagttcagctaccccgtgtacagagccttcctggagtacctgtacaccgacagcatcagcctgagccccgaggaggccgtgggcctgctggacctggccaccttctacagagagaacagactgaagaagctgtgccagcagaccatcaagcagggcatctgcgaggagaacgccatcgccctgctgagcgccgccgtgaagtacgacgcccaggacctggaggagttctgcttcagattctgcatcaaccacctgaccgtggtgacccagaccagcggcttcgccgagatggaccacgacctgctgaagaacttcatcagcaaggccagcagagtgggcgccttcaagaactag

SEQ ID NO: 96654 - DNA, 846 bp, Artificial Sequence
  Description of Artificial Sequence: Synthetic coding sequence
atgctggacgtgggcaagtggcccatcttcagcctgtgcagcgaggaggagctgcagctgatcagacaggcctgcgtgttcggcagcgccggcaacgaggtgctgtacaccaccgtgaacgacgagatcttcgtgctgggcaccaactgctgcggctgcctgggcctgggcgacgtgcagagcaccatcgagcccagaagactggacagcctgaacggcaagaagatcgcctgcctgagctacggcagcggcccccacatcgtgctggccaccaccgagggcgaggtgttcacctggggccacaacgcctacagccagctgggcaacggcaccaccaaccacggcctggtgccctgccacatcagcaccaacctgagcaacaagcaggtgatcgaggtggcctgcggcagctaccacagcctggtgctgaccagcgacggcgaggtgttcgcctggggctacaacaacagcggccaggtgggcagcggcagcaccgtgaaccagcccatccccagaagagtgaccggctgcctgcagaacaaggtggtggtgaccatcgcctgcggccagatgtgctgcatggccgtggtggacaccggcgaggtgtacgtgtggggctacaacggcaacggccagctgggcctgggcaacagcggcaaccagcccaccccctgcagagtggccgccctgcagggcatcagagtgcagagagactacagagactgcagcctgagcctgcacacccacgtgtgcggccaggacgccggctgggccagagtgcacgtgggccccgtgcccggcagcgtgagagacccccccgccccccaccccctgctgctgcactag

SEQ ID NO: 96655 - DNA, 1359 bp, Artificial Sequence
  Description of Artificial Sequence: Synthetic coding sequence
atgagccccaagagaatcgccaagagaagaagcccccccgccgacgccatccccaagagcaagaaggtgaaggacaccagagccgccgccagcagaagagtgcccggcgccagaagctgccagggcgcctgcggccccagcccccccgaccagaagaccagacccgtgagccacagaagccacagcaccgagcccggcctggtgctgaccctgggccagggcgacgtgggccagctgggcctgggcgagaacgtgatggagagaaagaagcccgccctggtgagcatccccgaggacgtggtgcaggccgaggccggcggcatgcacaccgtgtgcctgagcaagagcggccaggtgtacagcttcggctgcaacgacgagggcgccctgggcagagacaccagcgtggagggcagcgagatggtgcccggcaaggtggagctgcaggagaaggtggtgcaggtgagcgccggcgacagccacaccgccgccctgaccgacgacggcagagtgttcctgtggggcagcttcagagacaacaacggcgtgatcggcctgctggagcccatgaagaagagcatggtgcccgtgcaggtgcagctggacgtgcccgtggtgaaggtggccagcggcaacgaccacctggtgatgctgaccgccgacggcgacctgtacaccctgggctgcggcgagcagggccagctgggcagagtgcccgagctgttcgccaacagaggcggcagacagggcctggagagactgctggtgcccaagtgcgtgatgctgaagagcagaggcagcagaggccacgtgagattccaggacgccttctgcggcgcctacttcaccttcgccatcagccacgagggccacgtgtacggcttcggcctgagcaactaccaccagctgggcacccccggcaccgagagctgcttcatcccccagaacctgaccagcttcaagaacagcaccaagagctgggtgggcttcagcggcggccagcaccacaccgtgtgcatggacagcgagggcaaggcctacagcctgggcagagccgagtacggcagactgggcctgggcgagggcgccgaggagaagagcatccccaccctgatcagcagactgcccgccgtgagcagcgtggcctgcggcgccagcgtgggctacgccgtgaccaaggacggcagagtgttcgcctggggcatgggcaccaactaccagctgggcaccggccaggacgaggacgcctggagccccgtggagatgatgggcaagcagctggagaacagagtggtgctgagcgtgagcagcggcggccagcacaccgtgctgctggtgaaggacaaggagcagagctag

SEQ ID NO: 96656 - DNA, 1266 bp, Artificial Sequence
  Description of Artificial Sequence: Synthetic coding sequence
atgagccccaagagaatcgccaagagaagaagcccccccgccgacgccatccccaagagcaagaaggtgaaggtgagccacagaagccacagcaccgagcccggcctggtgctgaccctgggccagggcgacgtgggccagctgggcctgggcgagaacgtgatggagagaaagaagcccgccctggtgagcatccccgaggacgtggtgcaggccgaggccggcggcatgcacaccgtgtgcctgagcaagagcggccaggtgtacagcttcggctgcaacgacgagggcgccctgggcagagacaccagcgtggagggcagcgagatggtgcccggcaaggtggagctgcaggagaaggtggtgcaggtgagcgccggcgacagccacaccgccgccctgaccgacgacggcagagtgttcctgtggggcagcttcagagacaacaacggcgtgatcggcctgctggagcccatgaagaagagcatggtgcccgtgcaggtgcagctggacgtgcccgtggtgaaggtggccagcggcaacgaccacctggtgatgctgaccgccgacggcgacctgtacaccctgggctgcggcgagcagggccagctgggcagagtgcccgagctgttcgccaacagaggcggcagacagggcctggagagactgctggtgcccaagtgcgtgatgctgaagagcagaggcagcagaggccacgtgagattccaggacgccttctgcggcgcctacttcaccttcgccatcagccacgagggccacgtgtacggcttcggcctgagcaactaccaccagctgggcacccccggcaccgagagctgcttcatcccccagaacctgaccagcttcaagaacagcaccaagagctgggtgggcttcagcggcggccagcaccacaccgtgtgcatggacagcgagggcaaggcctacagcctgggcagagccgagtacggcagactgggcctgggcgagggcgccgaggagaagagcatccccaccctgatcagcagactgcccgccgtgagcagcgtggcctgcggcgccagcgtgggctacgccgtgaccaaggacggcagagtgttcgcctggggcatgggcaccaactaccagctgggcaccggccaggacgaggacgcctggagccccgtggagatgatgggcaagcagctggagaacagagtggtgctgagcgtgagcagcggcggccagcacaccgtgctgctggtgaaggacaaggagcagagctag

SEQ ID NO: 96657 - DNA, 1266 bp, Artificial Sequence; identical to SEQ ID NO: 96656
  Description of Artificial Sequence: Synthetic coding sequence

SEQ ID NO: 96658 - DNA, 1266 bp, Artificial Sequence; identical to SEQ ID NO: 96656
  Description of Artificial Sequence: Synthetic coding sequence

SEQ ID NO: 96659 - DNA, 693 bp, Artificial Sequence
  Description of Artificial Sequence: Synthetic coding sequence
atgagccccaagagaatcgccaagagaagaagcccccccgccgacgccatccccaagagcaagaaggtgaaggtgagccacagaagccacagcaccgagcccggcctggtgctgaccctgggccagggcgacgtgggccagctgggcctgggcgagaacgtgatggagagaaagaagcccgccctggtgagcatccccgaggacgtggtgcaggccgaggccggcggcatgcacaccgtgtgcctgagcaagagcggccaggtgtacagcttcggctgcaacgacgagggcgccctgggcagagacaccagcgtggagggcagcgagatggtgcccggcaaggtggagctgcaggagaaggtggtgcaggtgagcgccggcgacagccacaccgccgccctgaccgacgacggcagagtgttcctgtggggcagcttcagagacaacaacggcgtgatcggcctgctggagcccatgaagaagagcatggtgcccgtgcaggtgcagctggacgtgcccgtggtgaaggtggccagcggcaacgaccacctggtgatgctgaccgccgacggcgacctgtacaccctgggctgcggcgagcagggccagctgggcagagtgcccgagctgttcgccaacagaggcggcagacagggcctggagagactgctggtgcccaagtgcgtgatgtag

SEQ ID NO: 96660 - DNA, 852 bp, Artificial Sequence
  Description of Artificial Sequence: Synthetic coding sequence
atgagccccaagagaatcgccaagagaagaagcccccccgccgacgccatccccaagagcaagaaggtgaaggtgagccacagaagccacagcaccgagcccggcctggtgctgaccctgggccagggcgacgtgggccagctgggcctgggcgagaacgtgatggagagaaagaagcccgccctggtgagcatccccgaggacgtggtgcaggccgaggccggcggcatgcacaccgtgtgcctgagcaagagcggccaggtgtacagcttcggctgcaacgacgagggcgccctgggcagagacaccagcgtggagggcagcgagatggtgcccggcaaggtggagctgcaggagaaggtggtgcaggtgagcgccggcgacagccacaccgccgccctgaccgacgacggcagagtgttcctgtggggcagcttcagagacaacaacggcgtgatcggcctgctggagcccatgaagaagagcatggtgcccgtgcaggtgcagctggacgtgcccgtggtgaaggtggccagcggcaacgaccacctggtgatgctgaccgccgacggcgacctgtacaccctgggctgcggcgagcagggccagctgggcagagtgcccgagctgttcgccaacagaggcggcagacagggcctggagagactgctggtgcccaagtgcgtgatgctgaagagcagaggcagcagaggccacgtgagattccaggacgccttctgcggcgcctacttcaccttcgccatcagccacgagggccacgtgtacggcttcggcctgagcaactaccaccagctgggcacccccggcaccgagagctgcttcatcccctag

SEQ ID NO: 96661 - DNA, 708 bp, Artificial Sequence
  Description of Artificial Sequence: Synthetic coding sequence
atggccagagaggagtgcaaggccctgctggacggcctgaacaagaccaccgcctgctaccaccacctggtgctgaccgtgggcggcagcgccgacagccagaacctgagacaggagctgcagaagaccagacagaaggcccaggagctggccgtgagcacctgcgccagactgaccgccgtgctgagagacagaggcctggccgccgacgagagagccgagttcgagagactgtgggtggccttcagcggctgcctggacctgctggaggccgacatgagaagagccctggagctgggcgccgccttccccctgcacgcccccagaagacccctggtgagaaccggcgtggccggcgccagcagcggcgtggccgccagagccctgagcaccagaagcctgagactggaggccgagggcgacttcgacgtggccgacctgagagagctggagagagaggtgctgcaggtgggcgagatgatcgacaacatggagatgaaggtgaacgtgcccagatggaccgtgcaggccagacaggccgccggcgccgagctgctgagcaccgtgagcgccggccccagcagcgtggtgagcctgcaggagagaggcggcggctgcgaccccagaaaggccctggccgccatcctgttcggcgccgtgctgctggccgccgtggccctggccgtgtgcgtggccaagctgagctag

SEQ ID NO: 96662 - DNA, 630 bp, Artificial Sequence
  Description of Artificial Sequence: Synthetic coding sequence
atgagagccgccgccatcagcacccccaagctggacaagatgcccggcatgttcttcagcgccaaccccaaggagctgaagggcaccacccacagcctgctggacgacaagatgcagaagagaagacccaagaccttcggcatggacatgaaggcctacctgagaagcatgatcccccacctggagagcggcatgaagagcagcaagagcaaggacgtgctgagcgccgccgaggtgatgcagtggagccagagcctggagaagctgctggccaaccagaccggccagaacgtgttcggcagcttcctgaagagcgagttcagcgaggagaacatcgagttctggctggcctgcgaggactacaagaagaccgagagcgacctgctgccctgcaaggccgaggagatctacaaggccttcgtgcacagcgacgccgccaagcagatcaacatcgacttcagaaccagagagagcaccgccaagaagatcaaggcccccacccccacctgcttcgacgaggcccagaaggtgatctacaccctgatggagaaggacagctaccccagattcctgaagagcgacatctacctgaacctgctgaacgacctgcaggccaacagcctgaagtag

SEQ ID NO: 96663 - DNA, 1044 bp, Artificial Sequence
  Description of Artificial Sequence: Synthetic coding sequence
atgcccggcaagcccaagcacctgggcgtgcccaacggcagaatggtgctggccgtgagcgacggcgagctgagcagcaccaccggcccccagggccagggcgagggcagaggcagcagcctgagcatccacagcctgcccagcggccccagcagccccttccccaccttcgtgagcagcaagagcgagagccacagaaagagcctgggcagcaccgagggcgagagcgagagcagacccggcaagtactgctgcgtgtacctgcccgacggcaccgccagcctggccctggccagacccggcctgaccatcagagacatgctggccggcatctgcgagaagagaggcctgagcctgcccgacatcaaggtgtacctggtgggcaacgagcagaaggccctggtgctggaccaggactgcaccgtgctggccgaccaggaggtgagactggagaacagaatcaccttcgagctggagctgaccgccctggagagagtggtgagaatcagcgccaagcccaccaagagactgcaggaggccctgcagcccatcctggagaagcacggcctgagccccctggaggtggtgctgcacagacccggcgagaagcagcccctggacctgggcaagctggtgagcagcgtggccgcccagagactggtgctggacaccctgcccggcgtgaagatcagcaaggccagagacaagagcccctgcagaagccagggctgcccccccagaacccaggacaaggccacccaccccccccccgccagccccagcagcctggtgaaggtgcccagcagcgccaccggcaagagacagacctgcgacatcgagggcctggtggagctgctgaacagagtgcagagcagcggcgcccacgaccagagaggcctgctgagaaaggaggacctggtgctgcccgagttcctgcagctgcccgcccagggccccagcagcgaggagacccccccccagaccaagagcgccgcccagcccatcggcggcagcctgaacagcaccaccgacagcgccctgtag

SEQ ID NO: 96664 - DNA, 1701 bp, Artificial Sequence
  Description of Artificial Sequence: Synthetic coding sequence
atgcccggcaagcccaagcacctgggcgtgcccaacggcagaatggtgctggccgtgagcgacggcgagctgagcagcaccaccggcccccagggccagggcgagggcagaggcagcagcctgagcatccacagcctgcccagcggccccagcagccccttccccaccgaggagcagcccgtggccagctgggccctgagcttcgagagactgctgcaggaccccctgggcctggcctacttcaccgagttcctgaagaaggagttcagcgccgagaacgtgaccttctggaaggcctgcgagagattccagcagatccccgccagcgacacccagcagctggcccaggaggccagaaacatctaccaggagttcctgagcagccaggccctgagccccgtgaacatcgacagacaggcctggctgggcgaggaggtgctggccgagcccagacccgacatgttcagagcccagcagctgcagatcttcaacctgatgaagttcgacagctacgccagattcgtgaagagccccctgtacagagagtgcctgctggccgaggccgagggcagacccctgagagagcccggcagcagcagactgggcagccccgacgccaccagaaagaagcccaagctgaagcccggcaagagcctgcccctgggcgtggaggagctgggccagctgccccccgtggagggccccggcggcagacccctgagaaagagcttcagaagagagctgggcggcaccgccaacgccgccctgagaagagagagccagggcagcctgaacagcagcgccagcctggacctgggcttcctggccttcgtgagcagcaagagcgagagccacagaaagagcctgggcagcaccgagggcgagagcgagagcagacccggcaagtactgctgcgtgtacctgcccgacggcaccgccagcctggccctggccagacccggcctgaccatcagagacatgctggccggcatctgcgagaagagaggcctgagcctgcccgacatcaaggtgtacctggtgggcaacgagcaggccctggtgctggaccaggactgcaccgtgctggccgaccaggaggtgagactggagaacagaatcaccttcgagctggagctgaccgccctggagagagtggtgagaatcagcgccaagcccaccaagagactgcaggaggccctgcagcccatcctggagaagcacggcctgagccccctggaggtggtgctgcacagacccggcgagaagcagcccctggacctgggcaagctggtgagcagcgtggccgcccagagactggtgctggacaccctgcccggcgtgaagatcagcaaggccagagacaagagcccctgcagaagccagggctgcccccccagaacccaggacaaggccacccaccccccccccgccagccccagcagcctggtgaaggtgcccagcagcgccaccggcaagagacagacctgcgacatcgagggcctggtggagctgctgaacagagtgcagagcagcggcgcccacgaccagagaggcctgctgagaaaggaggacctggtgctgcccgagttcctgcagctgcccgcccagggccccagcagcgaggagacccccccccagaccaagagcgccgcccagcccatcggcggcagcctgaacagcaccaccgacagcgccctgtag

SEQ ID NO: 96665 - DNA, 1314 bp, Artificial Sequence
  Description of Artificial Sequence: Synthetic coding sequence
tgaagccccgtgaacatcgacagacaggcctggctgggcgaggaggtgctggccgagcccagacccgacatgttcagagcccagcagctgcagatcttcaacctgatgaagttcgacagctacgccagattcgtgaagagccccctgtacagagagtgcctgctggccgaggccgagggcagacccctgagagagcccggcagcagcagactgggcagccccgacgccaccagaaagaagcccaagctgaagcccggcaagagcctgcccctgggcgtggaggagctgggccagctgccccccgtggagggccccggcggcagacccctgagaaagagcttcagaagagagctgggcggcaccgccaacgccgccctgagaagagagagccagggcagcctgaacagcagcgccagcctggacctgggcttcctggccttcgtgagcagcaagagcgagagccacagaaagagcctgggcagcaccgagggcgagagcgagagcagacccggcaagtactgctgcgtgtacctgcccgacggcaccgccagcctggccctggccagacccggcctgaccatcagagacatgctggccggcatctgcgagaagagaggcctgagcctgcccgacatcaaggtgtacctggtgggcaacgagcagaaggccctggtgctggaccaggactgcaccgtgctggccgaccaggaggtgagactggagaacagaatcaccttcgagctggagctgaccgccctggagagagtggtgagaatcagcgccaagcccaccaagagactgcaggaggccctgcagcccatcctggagaagcacggcctgagccccctggaggtggtgctgcacagacccggcgagaagcagcccctggacctgggcaagctggtgagcagcgtggccgcccagagactggtgctggacaccctgcccggcgtgaagatcagcaaggccagagacaagagcccctgcagaagccagggctgcccccccagaacccaggacaaggccacccaccccccccccgccagccccagcagcctggtgaaggtgcccagcagcgccaccggcaagagacagacctgcgacatcgagggcctggtggagctgctgaacagagtgcagagcagcggcgcccacgaccagagaggcctgctgagaaaggaggacctggtgctgcccgagttcctgcagctgcccgcccagggccccagcagcgaggagacccccccccagaccaagagcgccgcccagcccatcggcggcagcctgaacagcaccaccgacagcgccctgtag

SEQ ID NO: 96666 - DNA, 609 bp, Artificial Sequence
  Description of Artificial Sequence: Synthetic coding sequence
atgtgcagaaccctggccgccttccccaccacctgcctggagagagccaaggagttcaagaccagactgggcatcttcctgcacaagagcgagctgggctgcgacaccggcagcaccggcaagttcgagtggggcagcaagcacagcaaggagaacagaaacttcagcgaggacgtgctgggctggagagagagcttcgacctgctgctgagcagcaagaacggcgtggccgccttccacgccttcctgaagaccgagttcagcgaggagaacctggagttctggctggcctgcgaggagttcaagaagatcagaagcgccaccaagctggccagcagagcccaccagatcttcgaggagttcatctgcagcgaggcccccaaggaggtgaacatcgaccacgagacccacgagctgaccagaatgaacctgcagaccgccaccgccacctgcttcgacgccgcccagggcaagaccagaaccctgatggagaaggacagctaccccagattcctgaagagccccgcctacagagacctggccgcccaggccagcgccgccagcgccaccctgagcagctgcagcctggacgagcccagccacacctag

SEQ ID NO: 96667 - DNA, 459 bp, Artificial Sequence
  Description of Artificial Sequence: Synthetic coding sequence
atgcccgtgaagtgctgcttctacagaagccccaccgccgagaccatgacctggagcgagaacatggacaccctgctggccaaccaggccggcctggacgccttcagaatcttcctgaagagcgagttcagcgaggagaacgtggagttctggctggcctgcgaggacttcaagaagaccaagaacgccgacaagatcgccagcaaggccaagatgatctacagcgagttcatcgaggccgacgcccccaaggagatcaacatcgacttcggcaccagagacctgatcagcaagaacatcgccgagcccaccctgaagtgcttcgacgaggcccagaagctgatctactgcctgatggccaaggacagcttccccagattcctgaagagcgagatctacaagaagctggtgaacagccagcaggtgcccaaccacaagaagtggctgcccttcctgtag

SEQ ID NO: 96668 - DNA, 1809 bp, Artificial Sequence
  Description of Artificial Sequence: Synthetic coding sequence
atggagagaagcctgcacagagtgagcctgggcagcagaagagcccaccccgacctgagcttctacctgaccaccttcggccagctgagactgagcatcgacgcccaggacagagtgctgctgctgcacatcatcgagggcaagggcctgatcagcaagcagcccggcacctgcgacccctacgtgaagatcagcctgatccccgaggacagcagactgagacaccagaagacccagaccgtgcccgactgcagagaccccgccttccacgagcacttcttcttccccgtgcaggaggaggacgaccagaagagactgctggtgaccgtgtggaacagagccagccagagcagacagagcggcctgatcggctgcatgagcttcggcgtgaagagcctgctgacccccgacaaggagatcagcggctggtactacctgctgggcgagcacctgggcagaaccaagcacctgaaggtggccagaagaagactgagacccctgagagaccccctgctgagaatgcccggcggcggcgacaccgagaacggcaagaagctgaagatcaccatccccagaggcaaggacggcttcggcttcaccatctgctgcgacagccccgtgagagtgcaggccgtggacagcggcggccccgccgagagagccggcctgcagcagctggacaccgtgctgcagctgaacgagagacccgtggagcactggaagtgcgtggagctggcccacgagatcagaagctgccccagcgagatcatcctgctggtgtggagaatggtgccccaggtgaagcccggccccgacggcggcgtgctgagaagagccagctgcaagagcacccacgacctgcagagcccccccaacaagagagagaagaactgcacccacggcgtgcaggccagacccgagcagagacacagctgccacctggtgtgcgacagcagcgacggcctgctgctgggcggctgggagagatacaccgaggtggccaagagaggcggccagcacaccctgcccgccctgagcagagccaccgcccccaccgaccccaactacatcatcctggcccccctgaaccccggcagccagctgctgagacccgtgtaccaggaggacaccatccccgaggagagcggcagccccagcaagggcaagagctacaccggcctgggcaagaagagcagactgatgaagaccgtgcagaccatgaagggccacggcaactaccagaactgccccgtggtgagaccccacgccacccacagcagctacggcacctacgtgaccctggcccccaaggtgctggtgttccccgtgttcgtgcagcccctggacctgtgcaaccccgccagaaccctgctgctgagcgaggagctgctgctgtacgagggcagaaacaaggccgccgaggtgaccctgttcgcctacagcgacctgctgctgttcaccaaggaggacgagcccggcagatgcgacgtgctgagaaaccccctgtacctgcagagcgtgaagctgcaggagggcagcagcgaggacctgaagttctgcgtgctgtacctggccgagaaggccgagtgcctgttcaccctggaggcccacagccaggagcagaagaagagagtgtgctggtgcctgagcgagaacatcgccaagcagcagcagctggccgccagcccccccgacagcaagaagctgcaccccttcggcagcctgcagcaggagatgggccccgtgaacagcaccaacgccacccaggacagaagcttcaccagccccggccagaccctgatcggctag

SEQ ID NO: 96669 - DNA, 507 bp, Artificial Sequence
  Description of Artificial Sequence: Synthetic coding sequence
atgaagaacaagctgggcatcttcagaagaagaaacgagagccccggcgccccccccgccggcaaggccgacaagatgatgaagagcttcaagcccaccagcgaggaggccctgaagtggggcgagagcctggagaagctgctggtgcacaagtacggcctggccgtgttccaggccttcctgagaaccgagttcagcgaggagaacctggagttctggctggcctgcgaggacttcaagaaggtgaagagccagagcaagatggccagcaaggccaagaagatcttcgccgagtacatcgccatccaggcctgcaaggaggtgaacctggacagctacaccagagagcacaccaaggacaacctgcagagcgtgaccagaggctgcttcgacctggcccagaagagaatcttcggcctgatggagaaggacagctaccccagattcctgagaagcgacctgtacctggacctgatcaaccagaagaagatgagcccccccctgtag

SEQ ID NO: 96670 - DNA, 2754 bp, Artificial Sequence
  Description of Artificial Sequence: Synthetic coding sequence
atgaacagattcaacggcctgtgcaaggtgtgcagcgagagaagatacagacagatcaccatccccagaggcaaggacggcttcggcttcaccatctgctgcgacagccccgtgagagtgcaggccgtggacagcggcggccccgccgagagagccggcctgcagcagctggacaccgtgctgcagctgaacgagagacccgtggagcactggaagtgcgtggagctggcccacgagatcagaagctgccccagcgagatcatcctgctggtgtggagaatggtgccccaggtgaagcccggccccgacggcggcgtgctgagaagagccagctgcaagagcacccacgacctgcagagcccccccaacaagagagagaagaactgcacccacggcgtgcaggccagacccgagcagagacacagctgccacctggtgtgcgacagcagcgacggcctgctgctgggcggctgggagagatacaccgaggtggccaagagaggcggccagcacaccctgcccgccctgagcagagccaccgcccccaccgaccccaactacatcatcctggcccccctgaaccccggcagccagctgctgagacccgtgtaccaggaggacaccatccccgaggagagcggcagccccagcaagggcaagagctacaccggcctgggcaagaagagcagactgatgaagaccgtgcagaccatgaagggccacggcaactaccagaactgccccgtggtgagaccccacgccacccacagcagctacggcacctacgtgaccctggcccccaaggtgctggtgttccccgtgttcgtgcagcccctggacctgtgcaaccccgccagaaccctgctgctgagcgaggagctgctgctgtacgagggcagaaacaaggccgccgaggtgaccctgttcgcctacagcgacctgctgctgttcaccaaggaggacgagcccggcagatgcgacgtgctgagaaaccccctgtacctgcagagcgtgaagctgcaggagggcagcagcgaggacctgaagttctgcgtgctgtacctggccgagaaggccgagtgcctgttcaccctggaggcccacagccaggagcagaagaagagagtgtgctggtgcctgagcgagaacatcgccaagcagcagcagctggccgccagcccccccgacagcaagatgttcgagaccgaggccgacgagaagagagagatggccctggaggagggcaagggccccggcgccgaggacagcccccccagcaaggagcccagccccggccaggagctgccccccggccaggacctgccccccaacaaggacagccccagcggccaggagcccgcccccagccaggagcccctgagcagcaaggacagcgccaccagcgagggcagcccccccggccccgacgccccccccagcaaggacgtgcccccctgccaggagcccccccccgcccaggacctgagcccctgccaggacctgcccgccggccaggagcccctgccccaccaggaccccctgctgaccaaggacctgcccgccatccaggagagccccaccagagacctgcccccctgccaggacctgccccccagccaggtgagcctgcccgccaaggccctgaccgaggacaccatgagcagcggcgacctgctggccgccaccggcgacccccccgccgcccccagacccgccttcgtgatccccgaggtgagactggacagcacctacagccagaaggccggcgccgagcagggctgcagcggcgacgaggaggacgccgaggaggccgaggaggtggaggagggcgaggagggcgaggaggacgaggacgaggacaccagcgacgacaactacggcgagagaagcgaggccaagagaagcagcatgatcgagaccggccagggcgccgagggcggcctgagcctgagagtgcagaacagcctgagaagaagaacccacagcgagggcagcctgctgcaggagcccagaggcccctgcttcgccagcgacaccaccctgcactgcagcgacggcgagggcgccgccagcacctggggcatgcccagccccagcaccctgaagaaggagctgggcagaaacggcggcagcatgcaccacctgagcctgttcttcaccggccacagaaagatgagcggcgccgacaccgtgggcgacgacgacgaggccagcagaaagagaaagagcaagaacctggccaaggacatgaagaacaagctgggcatcttcagaagaagaaacgagagccccggcgccccccccgccggcaaggccgacaagatgatgaagagcttcaagcccaccagcgaggaggccctgaagtggggcgagagcctggagaagctgctggtgcacaagtacggcctggccgtgttccaggccttcctgagaaccgagttcagcgaggagaacctggagttctggctggcctgcgaggacttcaagaaggtgaagagccagagcaagatggccagcaaggccaagaagatcttcgccgagtacatcgccatccaggcctgcaaggaggtgaacctggacagctacaccagagagcacaccaaggacaacctgcagagcgtgaccagaggctgcttcgacctggcccagaagagaatcttcggcctgatggagaaggacagctaccccagattcctgagaagcgacctgtacctggacctgatcaaccagaagaagatgagcccccccctgtag

SEQ ID NO: 96671 - DNA, 3597 bp, Artificial Sequence
  Description of Artificial Sequence: Synthetic coding sequence
atgcccgtgatccccgccctgtgggaggtggagatgggcagaagccagggccaggagatcgagaccatcctggccaacagaagccacagcgacagcacccccctgcccaacttcctgagcggcagccacagacccgagtgctgcacctgcagactgctgaccgccagcggcgcccaggacagcctgcccttcggcagaagactgtacagcggcccctggagaagctgcgaggaggtgtgccacgtgagcgtgctgagcgtgctgagcaccagctgcggcctgagcctgagcctgcccatcttccccggctggatggagtggctgagccccgacatcgccctgcccagaagagacgagtggacccagaccagccccgccagaaagagaatcacccacgccaaggtgcagggcgccggccagctgagactgagcatcgacgcccaggacagagtgctgctgctgcacatcatcgagggcaagggcctgatcagcaagcagcccggcacctgcgacccctacgtgaagatcagcctgatccccgaggacagcagactgagacaccagaagacccagaccgtgcccgactgcagagaccccgccttccacgagcacttcttcttccccgtgcaggaggaggacgaccagaagagactgctggtgaccgtgtggaacagagccagccagagcagacagagcggcctgatcggctgcatgagcttcggcgtgaagagcctgctgacccccgacaaggagatcagcggctggtactacctgctgggcgagcacctgggcagaaccaagcacctgaaggtggccagaagaagactgagacccctgagagaccccctgctgagaatgcccggcggcggcgacaccgagaacggcaagaagctgaagatcaccatccccagaggcaaggacggcttcggcttcaccatctgctgcgacagccccgtgagagtgcaggccgtggacagcggcggccccgccgagagagccggcctgcagcagctggacaccgtgctgcagctgaacgagagacccgtggagcactggaagtgcgtggagctggcccacgagatcagaagctgccccagcgagatcatcctgctggtgtggagaatggtgccccaggtgaagcccggccccgacggcggcgtgctgagaagagccagctgcaagagcacccacgacctgcagagcccccccaacaagagagagaagaactgcacccacggcgtgcaggccagacccgagcagagacacagctgccacctggtgtgcgacagcagcgacggcctgctgctgggcggctgggagagatacaccgaggtggccaagagaggcggccagcacaccctgcccgccctgagcagagccaccgcccccaccgaccccaactacatcatcctggcccccctgaaccccggcagccagctgctgagacccgtgtaccaggaggacaccatccccgaggagagcggcagccccagcaagggcaagagctacaccggcctgggcaagaagagcagactgatgaagaccgtgcagaccatgaagggccacggcaactaccagaactgccccgtggtgagaccccacgccacccacagcagctacggcacctacgtgaccctggcccccaaggtgctggtgttccccgtgttcgtgcagcccctggacctgtgcaaccccgccagaaccctgctgctgagcgaggagctgctgctgtacgagggcagaaacaaggccgccgaggtgaccctgttcgcctacagcgacctgctgctgttcaccaaggaggacgagcccggcagatgcgacgtgctgagaaaccccctgtacctgcagagcgtgaagctgcaggagggcagcagcgaggacctgaagttctgcgtgctgtacctggccgagaaggccgagtgcctgttcaccctggaggcccacagccaggagcagaagaagagagtgtgctggtgcctgagcgagaacatcgccaagcagcagcagctggccgccagcccccccgacagcaagatgttcgagaccgaggccgacgagaagagagagatggccctggaggagggcaagggccccggcgccgaggacagcccccccagcaaggagcccagccccggccaggagctgccccccggccaggacctgccccccaacaaggacagccccagcggccaggagcccgcccccagccaggagcccctgagcagcaaggacagcgccaccagcgagggcagcccccccggccccgacgccccccccagcaaggacgtgcccccctgccaggagcccccccccgcccaggacctgagcccctgccaggacctgcccgccggccaggagcccctgccccaccaggaccccctgctgaccaaggacctgcccgccatccaggagagccccaccagagacctgcccccctgccaggacctgccccccagccaggtgagcctgcccgccaaggccctgaccgaggacaccatgagcagcggcgacctgctggccgccaccggcgacccccccgccgcccccagacccgccttcgtgatccccgaggtgagactggacagcacctacagccagaaggccggcgccgagcagggctgcagcggcgacgaggaggacgccgaggaggccgaggaggtggaggagggcgaggagggcgaggaggacgaggacgaggacaccagcgacgacaactacggcgagagaagcgaggccaagagaagcagcatgatcgagaccggccagggcgccgagggcggcctgagcctgagagtgcagaacagcctgagaagaagaacccacagcgagggcagcctgctgcaggagcccagaggcccctgcttcgccagcgacaccaccctgcactgcagcgacggcgagggcgccgccagcacctggggcatgcccagccccagcaccctgaagaaggagctgggcagaaacggcggcagcatgcaccacctgagcctgttcttcaccggccacagaaagatgagcggcgccgacaccgtgggcgacgacgacgaggccagcagaaagagaaagagcaagaacctggccaaggacatgaagaacaagctgggcatcttcagaagaagaaacgagagccccggcgccccccccgccggcaaggccgacaagatgatgaagagcttcaagcccaccagcgaggaggccctgaagtggggcgagagcctggagaagctgctggtgcacaagtacggcctggccgtgttccaggccttcctgagaaccgagttcagcgaggagaacctggagttctggctggcctgcgaggacttcaagaaggtgaagagccagagcaagatggccagcaaggccaagaagatcttcgccgagtacatcgccatccaggcctgcaaggaggtgaacctggacagctacaccagagagcacaccaaggacaacctgcagagcgtgaccagaggctgcttcgacctggcccagaagagaatcttcggcctgatggagaaggacagctaccccagattcctgagaagcgacctgtacctggacctgatcaaccagaagaagatgagcccccccctgtag

SEQ ID NO: 96672 - DNA, 1560 bp, Artificial Sequence
  Description of Artificial Sequence: Synthetic coding sequence
atgttcgagaccgaggccgacgagaagagagagatggccctggaggagggcaagggccccggcgccgaggacagcccccccagcaaggagcccagccccggccaggagctgccccccggccaggacctgccccccaacaaggacagccccagcggccaggagcccgcccccagccaggagcccctgagcagcaaggacagcgccaccagcgagggcagcccccccggccccgacgccccccccagcaaggacgtgcccccctgccaggagcccccccccgcccaggacctgagcccctgccaggacctgcccgccggccaggagcccctgccccaccaggaccccctgctgaccaaggacctgcccgccatccaggagagccccaccagagacctgcccccctgccaggacctgccccccagccaggtgagcctgcccgccaaggccctgaccgaggacaccatgagcagcggcgacctgctggccgccaccggcgacccccccgccgcccccagacccgccttcgtgatccccgaggtgagactggacagcacctacagccagaaggccggcgccgagcagggctgcagcggcgacgaggaggacgccgaggaggccgaggaggtggaggagggcgaggagggcgaggaggacgaggacgaggacaccagcgacgacaactacggcgagagaagcgaggccaagagaagcagcatgatcgagaccggccagggcgccgagggcggcctgagcctgagagtgcagaacagcctgagaagaagaacccacagcgagggcagcctgctgcaggagcccagaggcccctgcttcgccagcgacaccaccctgcactgcagcgacggcgagggcgccgccagcacctggggcatgcccagccccagcaccctgaagaaggagctgggcagaaacggcggcagcatgcaccacctgagcctgttcttcaccggccacagaaagatgagcggcgccgacaccgtgggcgacgacgacgaggccagcagaaagagaaagagcaagaacctggccaaggacatgaagaacaagctgggcatcttcagaagaagaaacgagagccccggcgccccccccgccggcaaggccgacaagatgatgaagagcttcaagcccaccagcgaggaggccctgaagtggggcgagagcctggagaagctgctggtgcacaagtacggcctggccgtgttccaggccttcctgagaaccgagttcagcgaggagaacctggagttctggctggcctgcgaggacttcaagaaggtgaagagccagagcaagatggccagcaaggccaagaagatcttcgccgagtacatcgccatccaggcctgcaaggaggtgaacctggacagctacaccagagagcacaccaaggacaacctgcagagcgtgaccagaggctgcttcgacctggcccagaagagaatcttcggcctgatggagaaggacagctaccccagattcctgagaagcgacctgtacctggacctgatcaaccagaagaagatgagcccccccctgtag

SEQ ID NO: 96673 - DNA, 3597 bp, Artificial Sequence; identical to SEQ ID NO: 96671
  Description of Artificial Sequence: Synthetic coding sequence

SEQ ID NO: 96674 - DNA, 1776 bp, Artificial Sequence
  Description of Artificial Sequence: Synthetic coding sequence
atgaacagattcaacggcctgtgcaaggtgtgcagcgagagaagatacagacagatcaccatccccagaggcaaggacggcttcggcttcaccatctgctgcgacagccccgtgagagtgcaggccgtggacagcggcggccccgccgagagagccggcctgcagcagctggacaccgtgctgcagctgaacgagagacccgtggagcactggaagtgcgtggagctggcccacgagatcagaagctgccccagcgagatcatcctgctggtgtggagaatggtgccccaggtgaagcccggccccgacggcggcgtgctgagaagagccagctgcaagagcacccacgacctgcagagcccccccaacaagagagagaagaactgcacccacggcgtgcaggccagacccgagcagagacacagctgccacctggtgtgcgacagcagcgacggcctgctgctgggcggctgggagagatacaccgaggtggccaagagaggcggccagcacaccctgcccgccctgagcagagccaccgcccccaccgaccccaactacatcatcctggcccccctgaaccccggcagccagctgctgagacccgtgtaccaggaggacaccatccccgaggagagcggcagccccagcaagggcaagagctacaccggcctgggcaagaagagcagactgatgaagaccgtgcagaccatgaagggccacggcaactaccagaactgccccgtggtgagaccccacgccacccacagcagctacggcacctacgtgaccctggcccccaaggtgctggtgttccccgtgttcgtgcagcccctggacctgtgcaaccccgccagaaccctgctgctgagcgaggagctgctgctgtacgagggcagaaacaaggccgccgaggtgaccctgttcgcctacagcgacctgctgctgttcaccaaggaggacgagcccggcagatgcgacgtgctgagaaaccccctgtacctgcagagcgtgaagctgcaggagggcagcagcgaggacctgaagttctgcgtgctgtacctggccgagaaggccgagtgcctgttcaccctggaggcccacagccaggagcagaagaagagagtgtgctggtgcctgagcgagaacatcgccaagcagcagcagctggccgccagcccccccgacagcaagatgagcggcgccgacaccgtgggcgacgacgacgaggccagcagaaagagaaagagcaagaacctggccaaggacatgaagaacaagctgggcatcttcagaagaagaaacgagagccccggcgccccccccgccggcaaggccgacaagatgatgaagagcttcaagcccaccagcgaggaggccctgaagtggggcgagagcctggagaagctgctggtgcacaagtacggcctggccgtgttccaggccttcctgagaaccgagttcagcgaggagaacctggagttctggctggcctgcgaggacttcaagaaggtgaagagccagagcaagatggccagcaaggccaagaagatcttcgccgagtacatcgccatccaggcctgcaaggaggtgaacctggacagctacaccagagagcacaccaaggacaacctgcagagcgtgaccagaggctgcttcgacctggcccagaagagaatcttcggcctgatggagaaggacagctaccccagattcctgagaagcgacctgtacctggacctgatcaaccagaagaagatgagcccccccctgtag

SEQ ID NO: 96675 - DNA, 1560 bp, Artificial Sequence; identical to SEQ ID NO: 96672
  Description of Artificial Sequence: Synthetic coding sequence

SEQ ID NO: 96676 - DNA, 936 bp, Artificial Sequence
  Description of Artificial Sequence: Synthetic coding sequence
atggtgaccagaagacccgtgaccaacagctgggactggctgcccgccggcgccgcccccgaggccgtgccctgcagacacatgcccctgagcagactgcccctgagagtgggccagaaggagttcttcttccccctgcccctgctggtgccccccatcagctggctgctgctgagcgagagccagcccagactggtgcccggcagccccgtgatcagacccggcttccagagagcctgcgtggccgccgcctgcaccgtggccgccagatgccccggcagaggcgtgggcgacagaagccagagcggcgccagctacagacccatctgcggccccaaggtgggcggccccaccgagatgctgagaggcatgtacctgaccagaaacggcaacctgcagagaagacacaccatgaaggaggccaaggacatgaagaacaagctgggcatcttcagaagaagaaacgagagccccggcgccccccccgccggcaaggccgacaagatgatgaagagcttcaagcccaccagcgaggaggccctgaagtggggcgagagcctggagaagctgctggtgcacaagtacggcctggccgtgttccaggccttcctgagaaccgagttcagcgaggagaacctggagttctggctggcctgcgaggacttcaagaaggtgaagagccagagcaagatggccagcaaggccaagaagatcttcgccgagtacatcgccatccaggcctgcaaggaggtgaacctggacagctacaccagagagcacaccaaggacaacctgcagagcgtgaccagaggctgcttcgacctggcccagaagagaatcttcggcctgatggagaaggacagctaccccagattcctgagaagcgacctgtacctggacctgatcaaccagaagaagatgagcccccccctgtag

SEQ ID NO: 96677 - DNA, 564 bp, Artificial Sequence
  Description of Artificial Sequence: Synthetic coding sequence
atgaagcacagactgggcttcctgctgcagaagagcgacagctgcgagcacaacagcagccacaacaagaaggacaaggtggtgatctgccagagagtgagccaggaggaggtgaagaagtgggccgagagcctggagaacctgatcagccacgagtgcggcctggccgccttcaaggccttcctgaagagcgagtacagcgaggagaacatcgacttctggatcagctgcgaggagtacaagaagatcaagagccccagcaagctgagccccaaggccaagaagatctacaacgagttcatcagcgtgcaggccaccaaggaggtgaacctggacagctgcaccagagaggagaccagcagaaacatgctggagcccaccatcacctgcttcgacgaggcccagaagaagatcttcaacctgatggagaaggacagctacagaagattcctgaagagcagattctacctggacctggtgaaccccagcagctgcggcgccgagaagcagaagggcgccaagagcagcgccgactgcgccagcctggtgccccagtgcgcctag

SEQ ID NO: 96678 - DNA, 282 bp, Artificial Sequence
  Description of Artificial Sequence: Synthetic coding sequence
atgtgcaagggcctggccggcctgcccgccagctgcctgagaagcgccaaggacatgaagcacagactgggcttcctgctgcagaagagcgacagctgcgagcacaacagcagccacaacaagaaggacaaggtggtgatctgccagagagtgagccaggaggaggtgaagaagtgggccgagagcctggagaacctgatcagccacgagtgcgagcccggcttcctgcaccagggcagagacaagcccgagcacgccagagcctacaacaacctgctgtag

SEQ ID NO: 96679 - DNA, 618 bp, Artificial Sequence
  Description of Artificial Sequence: Synthetic coding sequence
atgtgcaagggcctggccggcctgcccgccagctgcctgagaagcgccaaggacatgaagcacagactgggcttcctgctgcagaagagcgacagctgcgagcacaacagcagccacaacaagaaggacaaggtggtgatctgccagagagtgagccaggaggaggtgaagaagtgggccgagagcctggagaacctgatcagccacgagtgcggcctggccgccttcaaggccttcctgaagagcgagtacagcgaggagaacatcgacttctggatcagctgcgaggagtacaagaagatcaagagccccagcaagctgagccccaaggccaagaagatctacaacgagttcatcagcgtgcaggccaccaaggaggtgaacctggacagctgcaccagagaggagaccagcagaaacatgctggagcccaccatcacctgcttcgacgaggcccagaagaagatcttcaacctgatggagaaggacagctacagaagattcctgaagagcagattctacctggacctggtgaaccccagcagctgcggcgccgagaagcagaagggcgccaagagcagcgccgactgcgccagcctggtgccccagtgcgcctag

SEQ ID NO: 96680 - DNA, 909 bp, Artificial Sequence
  Description of Artificial Sequence: Synthetic coding sequence
atgtacaacatgatgctgctgatccagaagagaaagggcatcggcagccagctgctgagagccggcgaggccgagggcgacagaggcgccggcaccgccgagagaagcagcgactggctggacggcagaagctgggccatcaaggagacccccaccggcctggccggcagaagaagcgaggacagcgacaacatcttcaccggcgaggaggccaagtacgcccagagcagaagccacagcagcagctgcagaatcagcttcctgctggccaacagcaagctgctgaacaagatgtgcaagggcctggccggcctgcccgccagctgcctgagaagcgccaaggacatgaagcacagactgggcttcctgctgcagaagagcgacagctgcgagcacaacagcagccacaacaagaaggacaaggtggtgatctgccagagagtgagccaggaggaggtgaagaagtgggccgagagcctggagaacctgatcagccacgagtgcggcctggccgccttcaaggccttcctgaagagcgagtacagcgaggagaacatcgacttctggatcagctgcgaggagtacaagaagatcaagagccccagcaagctgagccccaaggccaagaagatctacaacgagttcatcagcgtgcaggccaccaaggaggtgaacctggacagctgcaccagagaggagaccagcagaaacatgctggagcccaccatcacctgcttcgacgaggcccagaagaagatcttcaacctgatggagaaggacagctacagaagattcctgaagagcagattctacctggacctggtgaaccccagcagctgcggcgccgagaagcagaagggcgccaagagcagcgccgactgcgccagcctggtgccccagtgcgcctag

SEQ ID NO: 96681 - DNA, 564 bp, Artificial Sequence; identical to SEQ ID NO: 96677
  Description of Artificial Sequence: Synthetic coding sequence

SEQ ID NO: 96682 - DNA, 432 bp, Artificial Sequence
  Description of Artificial Sequence: Synthetic coding sequence
atgaagcacagactgggcttcctgctgcagaagagcgacagctgcgagcacaacagcagccacaacaagaaggacaaggtggtgatctgccagagagtgagccaggaggaggtgaagaagtgggccgagagcctggagaacctgatcagccacgagtgcggcctggccgccttcaaggccttcctgaagagcgagtacagcgaggagaacatcgacttctggatcagctgcgaggagtacaagaagatcaagagccccagcaagctgagccccaaggccaagaagatctacaacgagttcatcagcgtgcaggccaccaaggaggtgaacctggacagctgcaccagagaggagaccagcagaaacatgctggagcccaccatcacctgcttcgacgaggcccagaagaagatcttcaacctgatggagtag

SEQ ID NO: 96683 - DNA, 546 bp, Artificial Sequence
  Description of Artificial Sequence: Synthetic coding sequence
atgtgcaagggcctggccgccctgccccacagctgcctggagagagccaaggagatcaagatcaagctgggcatcctgctgcagaagcccgacagcgtgggcgacctggtgatcccctacaacgagaagcccgagaagcccgccaagacccagaagaccagcctggacgaggccctgcagtggagagacagcctggacaagctgctgcagaacaactacggcctggccagcttcaagagcttcctgaagagcgagttcagcgaggagaacctggagttctggatcgcctgcgaggactacaagaagatcaagagccccgccaagatggccgagaaggccaagcagatctacgaggagttcatccagaccgaggcccccaaggaggtgaacatcgaccacttcaccaaggacatcaccatgaagaacctggtggagcccagcctgagcagcttcgacatggcccagaagagaatccacgccctgatggagaaggacagcctgcccagattcgtgagaagcgagttctaccaggagctgatcaagtag

SEQ ID NO: 96684 - DNA, 606 bp, Artificial Sequence
  Description of Artificial Sequence: Synthetic coding sequence
atgtgcgccagaaacatcagccaggacatcctgatcctgcagatgcacagcgcccactggcacatcaacggcaagtacgaggagaagagcaacctgatgttctgggccaaggagatcaagatcaagctgggcatcctgctgcagaagcccgacagcgtgggcgacctggtgatcccctacaacgagaagcccgagaagcccgccaagacccagaagaccagcctggacgaggccctgcagtggagagacagcctggacaagctgctgcagaacaactacggcctggccagcttcaagagcttcctgaagagcgagttcagcgaggagaacctggagttctggatcgcctgcgaggactacaagaagatcaagagccccgccaagatggccgagaaggccaagcagatctacgaggagttcatccagaccgaggcccccaaggaggtgaacatcgaccacttcaccaaggacatcaccatgaagaacctggtggagcccagcctgagcagcttcgacatggcccagaagagaatccacgccctgatggagaaggacagcctgcccagattcgtgagaagcgagttctaccaggagctgatcaagtag

SEQ ID NO: 96685 - DNA, 222 bp, Artificial Sequence
  Description of Artificial Sequence: Synthetic coding sequence
atggccgagaaggccaagcagatctacgaggagttcatccagaccgaggcccccaaggaggtgaacatcgaccacttcaccaaggacatcaccatgaagaacctggtggagcccagcctgagcagcttcgacatggcccagaagagaatccacgccctgatggagaaggacagcctgcccagattcgtgagaagcgagttctaccaggagctgatcaagtag

SEQ ID NO: 96686 - DNA, 1362 bp, Artificial Sequence
  Description of Artificial Sequence: Synthetic coding sequence
atggcccagggcagcggcgaccagagagccgtgggcgtggccgaccccgaggagagcagccccaacatgatcgtgtactgcaagatcgaggacatcatcaccaagatgcaggacgacaagaccggcggcgtgcccatcagaaccgtgaagagcttcctgagcaagatccccagcgtggtgaccggcaccgacatcgtgcagtggctgatgaagaacctgagcatcgaggaccccgtggaggccatccacctgggcagcctgatcgccgcccagggctacatcttccccatcagcgaccacgtgctgaccatgaaggacgacggcaccttctacagattccaggccccctacttctggcccagcaactgctgggagcccgagaacaccgactacgccatctacctgtgcaagagaaccatgcagaacaaggccagactggagctggccgactacgaggccgagaacctggccagactgcagagagccttcgccagaaagtgggagttcatcttcatgcaggccgaggcccaggtgaagatcgacagaaagaaggacaagaccgagagaaagatcctggacagccaggagagagccttctgggacgtgcacagacccgtgcccggctgcgtgaacaccaccgagatggacatcagaaagtgcagaagactgaagaacccccagaaggtgaagaagagcgtgtacggcgtgaccgaggagagccaggcccagagccccgtgcacgtgctgagccagcccatcagaaagaccaccaaggaggacatcagaaagcagatcaccttcctgaacgcccagatcgacagacactgcctgaagatgagcaaggtggccgagagcaaggagcccagccagcagagagtgaagagatggggcttcagcttcgacgagatcctgaaggaccaggtgggcagagaccagttcctgagattcctggagagcgagttcagcagcgagaacctgagattctggctggccgtgcaggacctgaagaagcagcccctgcaggacgtggccaagagagtggaggagatctggcaggagttcctggcccccggcgcccccagcgccatcaacctggacagccacagctacgagatcaccagccagaacgtgaaggacggcggcagatacaccttcgaggacgcccaggagcacatctacaagctgatgaagagcgacagctacgccagattcctgagaagcaacgcctaccaggacctgctgctggccaagaagaagcccgagagcgagcagggcagaagaaccagcctggagaagttcaccagaagcgtgggcaagagcctggccggcaagagactgaccggcctgatgcagagcagctag

SEQ ID NO: 96687 - DNA, 1383 bp, Artificial Sequence
  Description of Artificial Sequence: Synthetic coding sequence
atggcccagggcagcggcgaccagagagccgtgggcgtggccgaccccgaggagagcagccccaacatgatcgtgtactgcaagatcgaggacatcatcaccaagatgcaggacgacaagaccggcggcgtgcccatcagaaccgtgaagagcttcctgagcaagatccccagcgtggtgaccggcaccgacatcgtgcagtggctgatgaagaacctgagcatcgaggaccccgtggaggccatccacctgggcagcctgatcgccgcccagggctacatcttccccatcagcgaccacgtgctgaccatgaaggacgacggcaccttctacagattccaggccccctacttctggcccagcaactgctgggagcccgagaacaccgactacgccatctacctgtgcaagagaaccatgcagaacaaggccagactggagctggccgactacgaggccgagaacctggccagactgcagagagccttcgccagaaagtgggagttcatcttcatgcaggccgaggcccaggtgaagatcgacagaaagaaggacaagaccgagagaaagatcctggacagccaggagagagccttctgggacgtgcacagacccgtgcccggctgcgtgaacaccaccgagatggacatcagaaagtgcagaagactgaagaacccccagaaggtgaagaagagcgtgtacggcgtgaccgaggagagccaggcccagagccccgtgcacgtgctgagccagcccatcagaaagaccaccaaggaggacatcagaaagcagatcaccttcctgaacgcccagatcgacagacactgcctgaagatgagcaaggtggccgagagcctgatcgcctacaccgagcagtacgtggagtacgaccccctgatcacccccgccgagcccagcaacccctggatcagcgacgacgtggccctgtgggacatcgagatgagcaaggagcccagccagcagagagtgaagagatggggcttcagcttcgacgagatcctgaaggaccaggtgggcagagaccagttcctgagattcctggagagcgagttcagcagcgagaacctgagattctggctggccgtgcaggacctgaagaagcagcccctgcaggacgtggccaagagagtggaggagatctggcaggagttcctggcccccggcgcccccagcgccatcaacctggacagccacagctacgagatcaccagccagaacgtgaaggacggcggcagatacaccttcgaggacgcccaggagcacatctacaagctgatgaagagcgacagctacgccagattcctgagaagcaacgcctaccaggacctgctgctggccaagaagaaggtgtggctgctgtag

SEQ ID NO: 96688 - DNA, 1419 bp, Artificial Sequence
  Description of Artificial Sequence: Synthetic coding sequence
atggcccagggcagcggcgaccagagagccgtgggcgtggccgaccccgaggagagcagccccaacatgatcgtgtactgcaagatcgaggacatcatcaccaagatgcaggacgacaagaccggcggcgtgcccatcagaaccgtgaagagcttcctgagcaagatccccagcgtggtgaccggcaccgacatcgtgcagtggctgatgaagaacctgagcatcgaggaccccgtggaggccatccacctgggcagcctgatcgccgcccagggctacatcttccccatcagcgaccacgtgctgaccatgaaggacgacggcaccttctacagattccaggccccctacttctggcccagcaactgctgggagcccgagaacaccgactacgccatctacctgtgcaagagaaccatgcagaacaaggccagactggagctggccgactacgaggccgagaacctggccagactgcagagagccttcgccagaaagtgggagttcatcttcatgcaggccgaggcccaggtgaagatcgacagaaagaaggacaagaccgagagaaagatcctggacagccaggagagagccttctgggacgtgcacagacccgtgcccggctgcgtgaacaccaccgagatggacatcagaaagtgcagaagactgaagaacccccagaaggtgaagaagagcgtgtacggcgtgaccgaggagagccaggcccagagccccgtgcacgtgctgagccagcccatcagaaagaccaccaaggaggacatcagaaagcagatcaccttcctgaacgcccagatcgacagacactgcctgaagatgagcaaggtggccgagagcctgatcgcctacaccgagcagtacgtggagtacgaccccctgatcacccccgccgagcccagcaacccctggatcagcgacgacgtggccctgtgggacatcgagatgagcaaggagcccagccagcagagagtgaagagatggggcttcagcttcgacgagatcctgaaggaccaggtgggcagagaccagttcctgagattcctggagagcgagttcagcagcgagaacctgagattctggctggccgtgcaggacctgaagaagcagcccctgcaggacgtggccaagagagtggaggagatctggcaggagttcctggcccccggcgcccccagcgccatcaacctggacagccacagctacgagatcaccagccagaacgtgaaggacggcggcagatacaccttcgaggacgcccaggagcacatctacaagctgatgaagagcgacagctacgccagattcctgagaagcaacgcctaccaggacctgctgctggccaagaagaagggcaagagcctggccggcaagagactgaccggcctgatgcagagcagctag

SEQ ID NO: 96689 - DNA, 1443 bp, Artificial Sequence
  Description of Artificial Sequence: Synthetic coding sequence
atggcccagggcagcggcgaccagagagccgtgggcgtggccgaccccgaggagagcagccccaacatgatcgtgtactgcaagatcgaggacatcatcaccaagatgcaggacgacaagaccggcggcgtgcccatcagaaccgtgaagagcttcctgagcaagatccccagcgtggtgaccggcaccgacatcgtgcagtggctgatgaagaacctgagcatcgaggaccccgtggaggccatccacctgggcagcctgatcgccgcccagggctacatcttccccatcagcgaccacgtgctgaccatgaaggacgacggcaccttctacagattccaggccccctacttctggcccagcaactgctgggagcccgagaacaccgactacgccatctacctgtgcaagagaaccatgcagaacaaggccagactggagctggccgactacgaggccgagaacctggccagactgcagagagccttcgccagaaagtgggagttcatcttcatgcaggccgaggcccaggtgaagatcgacagaaagaaggacaagaccgagagaaagatcctggacagccaggagagagccttctgggacgtgcacagacccgtgcccggctgcgtgaacaccaccgagatggacatcagaaagtgcagaagactgaagaacccccagaaggtgaagaagagcgtgtacggcgtgaccgaggagagccaggcccagagccccgtgcacgtgctgagccagcccatcagaaagaccaccaaggaggacatcagaaagcagatcaccttcctgaacgcccagatcgacagacactgcctgaagatgagcaaggtggccgagagcctgatcgcctacaccgagcagtacgtggagtacgaccccctgatcacccccgccgagcccagcaacccctggatcagcgacgacgtggccctgtgggacatcgagatgagcaaggagcccagccagcagagagtgaagagatggggcttcagcttcgacgagatcctgaaggaccaggtgggcagagaccagttcctgagattcctggagagcgagttcagcagcgagaacctgagattctggctggccgtgcaggacctgaagaagcagcccctgcaggacgtggccaagagagtggaggagatctggcaggagttcctggcccccggcgcccccagcgccatcaacctggacagccacagctacgagatcaccagccagaacgtgaaggacggcggcagatacaccttcgaggacgcccaggagcacatctacaagctgatgaagagcgacagctacgccagattcctgagaagcaacgcctaccaggacctgctgctggccaagaagaagcccgagagcgagcagggcagaagaaccagcctggagaagttcaccagaagcgtgtgcctgcagctgctgttctag

SEQ ID NO: 96690 - DNA, 1428 bp, Artificial Sequence
  Description of Artificial Sequence: Synthetic coding sequence
atggcccagggcagcggcgaccagagagccgtgggcgtggccgaccccgaggagagcagccccaacatgatcgtgtactgcaagatcgaggacatcatcaccaagatgcaggacgacaagaccggcggcgtgcccatcagaaccgtgaagagcttcctgagcaagatccccagcgtggtgaccggcaccgacatcgtgcagtggctgatgaagaacctgagcatcgaggaccccgtggaggccatccacctgggcagcctgatcgccgcccagggctacatcttccccatcagcgaccacgtgctgaccatgaaggacgacggcaccttctacagattccaggccccctacttctggcccagcaactgctgggagcccgagaacaccgactacgccatctacctgtgcaagagaaccatgcagaacaaggccagactggagctggccgactacgaggccgagaacctggccagactgcagagagccttcgccagaaagtgggagttcatcttcatgcaggccgaggcccaggtgaagatcgacagaaagaaggacaagaccgagagaaagatcctggacagccaggagagagccttctgggacgtgcacagacccgtgcccggctgcgtgaacaccaccgagatggacatcagaaagtgcagaagactgaagaacccccagaaggtgaagaagagcgtgtacggcgtgaccgaggagagccaggcccagagccccgtgcacgtgctgagccagcccatcagaaagaccaccaaggaggacatcagaaagcagatcaccttcctgaacgcccagatcgacagacactgcctgaagatgagcaaggtggccgagagcctgatcgcctacaccgagcagtacgtggagtacgaccccctgatcacccccgccgagcccagcaacccctggatcagcgacgacgtggccctgtgggacatcgagatgagcaaggagcccagccagcagagagtgaagagatggggcttcagcttcgacgagatcctgaaggaccaggtgggcagagaccagttcctgagattcctggagagcgagttcagcagcgagaacctgagattctggctggccgtgcaggacctgaagaagcagcccctgcaggacgtggccaagagagtggaggagatctggcaggagttcctggcccccggcgcccccagcgccatcaacctggacagccacagctacgagatcaccagccagaacgtgaaggacggcggcagatacaccttcgaggacgcccaggagcacatctacaagctgatgaagagcgacagctacgccagattcctgagaagcaacgcctaccaggacctgctgctggccaagaagaagcccgagagcgagcagggcagaagaaccagcctggagaagttcaccagaagcgtgggctag

SEQ ID NO: 96691 - DNA, 1434 bp, Artificial Sequence
  Description of Artificial Sequence: Synthetic coding sequence
atggcccagggcagcggcgaccagagagccgtgggcgtggccgaccccgaggagagcagccccaacatgatcgtgtactgcaagatcgaggacatcatcaccaagatgcaggacgacaagaccggcggcgtgcccatcagaaccgtgaagagcttcctgagcaagatccccagcgtggtgaccggcaccgacatcgtgcagtggctgatgaagaacctgagcatcgaggaccccgtggaggccatccacctgggcagcctgatcgccgcccagggctacatcttccccatcagcgaccacgtgctgaccatgaaggacgacggcaccttctacagattccaggccccctacttctggcccagcaactgctgggagcccgagaacaccgactacgccatctacctgtgcaagagaaccatgcagaacaaggccagactggagctggccgactacgaggccgagaacctggccagactgcagagagccttcgccagaaagtgggagttcatcttcatgcaggccgaggcccaggtgaagatcgacagaaagaaggacaagaccgagagaaagatcctggacagccaggagagagccttctgggacgtgcacagacccgtgcccggctgcgtgaacaccaccgagatggacatcagaaagtgcagaagactgaagaacccccagaaggtgaagaagagcgtgtacggcgtgaccgaggagagccaggcccagagccccgtgcacgtgctgagccagcccatcagaaagaccaccaaggaggacatcagaaagcagatcaccttcctgaacgcccagatcgacagacactgcctgaagatgagcaaggtggccgagagcctgatcgcctacaccgagcagtacgtggagtacgaccccctgatcacccccgccgagcccagcaacccctggatcagcgacgacgtggccctgtgggacatcgagatgagcaaggagcccagccagcagagagtgaagagatggggcttcagcttcgacgagatcctgaaggaccaggtgggcagagaccagttcctgagattcctggagagcgagttcagcagcgagaacctgagattctggctggccgtgcaggacctgaagaagcagcccctgcaggacgtggccaagagagtggaggagatctggcaggagttcctggcccccggcgcccccagcgccatcaacctggacagccacagctacgagatcaccagccagaacgtgaaggacggcggcagatacaccttcgaggacgcccaggagcacatctacaagctgatgaagagcgacagctacgccagattcctgagaagcaacgcctaccaggacctgctgctggccaagaagaagcccgagagcgagcagggcagaagaaccagcctggagaagttcaccagaagcgtgctgctgttctag

SEQ ID NO: 96692 - DNA, 1620 bp, Artificial Sequence
  Description of Artificial Sequence: Synthetic coding sequence
atgaagaacctgagcatcgaggaccccgtggaggccatccacctgggcagcctgatcgccgcccagggctacatcttccccatcagcgaccacgtgctgaccatgaaggacgacggcaccttctacagattccaggccccctacttctggcccagcaactgctgggagcccgagaacaccgactacgccatctacctgtgcaagagaaccatgcagaacaaggccagactggagctggccgactacgaggccgagaacctggccagactgcagagagccttcgccagaaagtgggagttcatcttcatgcaggccgaggcccaggtgaagatcgacagaaagaaggacaagaccgagagaaagatcctggacagccaggagagagccttctgggacgtgcacagacccgtgcccggctgcgtgaacaccaccgagatggacatcagaaagtgcagaagactgaagaacccccagaaggtgaagaagagcgtgtacggcgtgaccgaggagagccaggcccagagccccgtgcacgtgctgagccagcccatcagaaagaccaccaaggaggacatcagaaagcagatcaccttcctgaacgcccagatcgacagacactgcctgaagatgagcaaggtggccgagagcctgatcgcctacaccgagcagtacgtggagtacgaccccctgatcacccccgccgagcccagcaacccctggatcagcgacgacgtggccctgtgggacatcgagatgagcaaggagcccagccagcagagagtgaagagatggggcttcagcttcgacgagatcctgaaggaccaggtgggcagagaccagttcctgagattcctggagagcgagttcagcagcgagaacctgagattctggctggccgtgcaggacctgaagaagcagcccctgcaggacgtggccaagagagtggaggagatctggcaggagttcctggcccccggcgcccccagcgccatcaacctggacagccacagctacgagatcaccagccagaacgtgaaggacggcggcagatacaccttcgaggacgcccaggagcacatctacaagctgatgaagagcgacagctacgccagattcctgagaagcaacgcctaccaggacctgctgctggccaagaagaagcccgagagcgagcagggcagaagaaccagcctggagaagttcaccagaagcgtgaacgtgcagaacaccagacccgccggcgcctggagcatcttcatggccgccctgcccatggccgtgtggctgagaacccccagaagctgccacggcctgagcgagagcagactgctgggcctgcccagcctgcacgacggcctgagagagggccagagcctgccccagagctgccccggcagcagcagcaccgccgccgagggcgccagagagagagccagcaacggcagaagcctggccagaagacagcactgccagtgccacggccagggcgaggagacccagctgtgcctgtggagcagactggagagcagcaagagaagccagagagccagcagcctgagaaccagcaaggccaagaagaagagacagaccgtgaagcagggccccaaggcctggccctag

SEQ ID NO: 96693 - DNA, 1299 bp, Artificial Sequence
  Description of Artificial Sequence: Synthetic coding sequence
atcgaggacatcatcaccaagatgcaggacgacaagaccggcggcgtgcccatcagaaccgtgaagagcttcctgagcaagatccccagcgtggtgaccggcaccgacatcgtgcagtggctgatgaagaacctgagcatcgaggaccccgtggaggccatccacctgggcagcctgatcgccgcccagggctacatcttccccatcagcgaccacgtgctgaccatgaaggacgacggcaccttctacagattccaggccccctacttctggcccagcaactgctgggagcccgagaacaccgactacgccatctacctgtgcaagagaaccatgcagaacaaggccagactggagctggccgactacgaggccgagaacctggccagactgcagagagccttcgccagaaagtgggagttcatcttcatgcaggccgaggcccaggtgaagatcgacagaaagaaggacaagaccgagagaaagatcctggacagccaggagagagccttctgggacgtgcacagacccgtgcccggctgcgtgaacaccaccgagatggacatcagaaagtgcagaagactgaagaacccccagaaggtgaagaagagcgtgtacggcgtgaccgaggagagccaggcccagagccccgtgcacgtgctgagccagcccatcagaaagaccaccaaggaggacatcagaaagcagatcaccttcctgaacgcccagatcgacagacactgcctgaagatgagcaaggtggccgagagcctgatcgcctacaccgagcagtacgtggagtacgaccccctgatcacccccgccgagcccagcaacccctggatcagcgacgacgtggccctgtgggacatcgagatgagcaaggagcccagccagcagagagtgaagagatggggcttcagcttcgacgagatcctgaaggaccaggtgggcagagaccagttcctgagattcctggagagcgagttcagcagcgagaacctgagattctggctggccgtgcaggacctgaagaagcagcccctgcaggacgtggccaagagagtggaggagatctggcaggagttcctggcccccggcgcccccagcgccatcaacctggacagccacagctacgagatcaccagccagaacgtgaaggacggcggcagatacaccttcgaggacgcccaggagcacatctacaagctgatgaagagcgacagctacgccagattcctgagaagcaacgcctaccaggacctgctgctggccaagaagaaggtgtggctgctgtag

SEQ ID NO: 96694 - DNA, 1041 bp, Artificial Sequence
  Description of Artificial Sequence: Synthetic coding sequence
atgcagaacaaggccagactggagctggccgactacgaggccgagaacctggccagactgcagagagccttcgccagaaagtgggagttcatcttcatgcaggccgaggcccaggtgaagatcgacagaaagaaggacaagaccgagagaaagatcctggacagccaggagagagccttctgggacgtgcacagacccgtgcccggctgcgtgaacaccaccgagatggacatcagaaagtgcagaagactgaagaacccccagaaggtgaagaagagcgtgtacggcgtgaccgaggagagccaggcccagagccccgtgcacgtgctgagccagcccatcagaaagaccaccaaggaggacatcagaaagcagatcaccttcctgaacgcccagatcgacagacactgcctgaagatgagcaaggtggccgagagcctgatcgcctacaccgagcagtacgtggagtacgaccccctgatcacccccgccgagcccagcaacccctggatcagcgacgacgtggccctgtgggacatcgagatgagcaaggagcccagccagcagagagtgaagagatggggcttcagcttcgacgagatcctgaaggaccaggtgggcagagaccagttcctgagattcctggagagcgagttcagcagcgagaacctgagattctggctggccgtgcaggacctgaagaagcagcccctgcaggacgtggccaagagagtggaggagatctggcaggagttcctggcccccggcgcccccagcgccatcaacctggacagccacagctacgagatcaccagccagaacgtgaaggacggcggcagatacaccttcgaggacgcccaggagcacatctacaagctgatgaagagcgacagctacgccagattcctgagaagcaacgcctaccaggacctgctgctggccaagaagaagcccgagagcgagcagggcagaagaaccagcctggagaagttcaccagaagcgtgctgtggctgctgttccccctgggcaagagaccctag

SEQ ID NO: 96695 - DNA, 1473 bp, Artificial Sequence
  Description of Artificial Sequence: Synthetic coding sequence
atggcccagggcagcggcgaccagagagccgtgggcgtggccgaccccgaggagagcagccccaacatgatcgtgtactgcaagatcgaggacatcatcaccaagatgcaggacgacaagaccggcggcgtgcccatcagaaccgtgaagagcttcctgagcaagatccccagcgtggtgaccggcaccgacatcgtgcagtggctgatgaagaacctgagcatcgaggaccccgtggaggccatccacctgggcagcctgatcgccgcccagggctacatcttccccatcagcgaccacgtgctgaccatgaaggacgacggcaccttctacagattccaggccccctacttctggcccagcaactgctgggagcccgagaacaccgactacgccatctacctgtgcaagagaaccatgcagaacaaggccagactggagctggccgactacgaggccgagaacctggccagactgcagagagccttcgccagaaagtgggagttcatcttcatgcaggccgaggcccaggtgaagatcgacagaaagaaggacaagaccgagagaaagatcctggacagccaggagagagccttctgggacgtgcacagacccgtgcccggctgcgtgaacaccaccgagatggacatcagaaagtgcagaagactgaagaacccccagaaggtgaagaagagcgtgtacggcgtgaccgaggagagccaggcccagagccccgtgcacgtgctgagccagcccatcagaaagaccaccaaggaggacatcagaaagcagatcaccttcctgaacgcccagatcgacagacactgcctgaagatgagcaaggtggccgagagcctgatcgcctacaccgagcagtacgtggagtacgaccccctgatcacccccgccgagcccagcaacccctggatcagcgacgacgtggccctgtgggacatcgagatgagcaaggagcccagccagcagagagtgaagagatggggcttcagcttcgacgagatcctgaaggaccaggtgggcagagaccagttcctgagattcctggagagcgagttcagcagcgagaacctgagattctggctggccgtgcaggacctgaagaagcagcccctgcaggacgtggccaagagagtggaggagatctggcaggagttcctggcccccggcgcccccagcgccatcaacctggacagccacagctacgagatcaccagccagaacgtgaaggacggcggcagatacaccttcgaggacgcccaggagcacatctacaagctgatgaagagcgacagctacgccagattcctgagaagcaacgcctaccaggacctgctgctggccaagaagaagcccgagagcgagcagggcagaagaaccagcctggagaagttcaccagaagcgtgggcaagagcctggccggcaagagactgaccggcctgatgcagagcagctag

SEQ ID NO: 96696 - DNA, 1419 bp, Artificial Sequence; identical to SEQ ID NO: 96688
  Description of Artificial Sequence: Synthetic coding sequence

SEQ ID NO: 96697 - DNA, 1041 bp, Artificial Sequence
  Description of Artificial Sequence: Synthetic coding sequence
atgcagaacaaggccagactggagctggccgactacgaggccgagaacctggccagactgcagagagccttcgccagaaagtgggagttcatcttcatgcaggccgaggcccaggtgaagatcgacagaaagaaggacaagaccgagagaaagatcctggacagccaggagagagccttctgggacgtgcacagacccgtgcccggctgcgtgaacaccaccgagatggacatcagaaagtgcagaagactgaagaacccccagaaggtgaagaagagcgtgtacggcgtgaccgaggagagccaggcccagagccccgtgcacgtgctgagccagcccatcagaaagaccaccaaggaggacatcagaaagcagatcaccttcctgaacgcccagatcgacagacactgcctgaagatgagcaaggtggccgagagcctgatcgcctacaccgagcagtacgtggagtacgaccccctgatcacccccgccgagcccagcaacccctggatcagcgacgacgtggccctgtgggacatcgagatgagcaaggagcccagccagcagagagtgaagagatggggcttcagcttcgacgagatcctgaaggaccaggtgggcagagaccagttcctgagattcctggagagcgagttcagcagcgagaacctgagattctggctggccgtgcaggacctgaagaagcagcccctgcaggacgtggccaagagagtggaggagatctggcaggagttcctggcccccggcgcccccagcgccatcaacctggacagccacagctacgagatcaccagccagaacgtgaaggacggcggcagatacaccttcgaggacgcccaggagcacatctacaagctgatgaagagcgacagctacgccagattcctgagaagcaacgcctaccaggacctgctgctggccaagaagaagcccgagagcgagcagggcagaagaaccagcctggagaagttcaccagaagcgtgctgtacagcaacacccccctggccaagagaccctag

SEQ ID NO: 96698 - DNA, 1419 bp, Artificial Sequence; identical to SEQ ID NO: 96688
  Description of Artificial Sequence: Synthetic coding sequence

SEQ ID NO: 96699 - DNA, 1473 bp, Artificial Sequence; identical to SEQ ID NO: 96695
  Description of Artificial Sequence: Synthetic coding sequence

SEQ ID NO: 96700 - DNA, 1398 bp, Artificial Sequence
  Description of Artificial Sequence: Synthetic coding sequence
atggcccagggcagcggcgaccagagagccgtgggcgtggccgaccccgaggagagcagccccaacatgatcgtgtactgcaagatcgaggacatcatcaccaagatgcaggacgacaagaccggcggcgtgcccatcagaaccgtgaagagcttcctgagcaagatccccagcgtggtgaccggcaccgacatcgtgcagtggctgatgaagaacctgagcatcgaggaccccgtggaggccatccacctgggcagcctgatcgccgcccagggctacatcttccccatcagcgaccacgtgctgaccatgaaggacgacggcaccttctacagattccaggccccctacttctggcccagcaactgctgggagcccgagaacaccgactacgccatctacctgtgcaagagaaccatgcagaacaaggccagactggagctggccgactacgaggccgagaacctggccagactgcagagagccttcgccagaaagtgggagttcatcttcatgcaggccgaggcccaggtgaagatcgacagaaagaaggacaagaccgagagaaagatcctggacagccaggagagagccttctgggacgtgcacagacccgtgcccggctgcgtgaacaccaccgagatggacatcagaaagtgcagaagactgaagaacccccagaaggtgaagaagagcgtgtacggcgtgaccgaggagagccaggcccagagccccgtgcacgtgctgagccagcccatcagaaagaccaccaaggaggacatcagaaagcagatcaccttcctgaacgcccagatcgacagacactgcctgaagatgagcaaggtggccgagagcctgatcgcctacaccgagcagtacgtggagtacgaccccctgatcacccccgccgagcccagcaacccctggatcagcgacgacgtggccctgtgggacatcgagatgagcaaggagcccagccagcagagagtgaagagatggggcttcagcttcgacgagatcctgaaggaccaggtgggcagagaccagttcctgagattcctggagagcgagttcagcagcgagaacctgagattctggctggccgtgcaggacctgaagaagcagcccctgcaggacgtggccaagagagtggaggagatctggcaggagttcctggcccccggcgcccccagcgccatcaacctggacagccacagctacgagatcaccagccagaacgtgaaggacggcggcagatacaccttcgaggacgcccaggagcacatctacaagctgatgaagagcgacagctacgccagattcctgagaagcaacgcctaccaggacctgctgctggccaagaagaagaaggtgagcaaggtggtggagctgccctag

SEQ ID NO: 96701 - DNA, 1356 bp, Artificial Sequence
  Description of Artificial Sequence: Synthetic coding sequence
atggaggacgtgatcgccagaatgcaggacgagaagaacggcatccccatcagaaccgtgaagagcttcctgagcaagatccccagcgtgttcagcggcagcgacatcgtgcagtggctgatcaagaacctgaccatcgaggaccccgtggaggccctgcacctgggcaccctgatggccgcccacggctacttcttccccatcagcgaccacgtgctgaccctgaaggacgacggcaccttctacagattccagaccccctacttctggcccagcaactgctgggagcccgagaacaccgactacgccgtgtacctgtgcaagagaaccatgcagaacaaggccagactggagctggccgactacgaggccgagagcctggccagactgcagagagccttcgccagaaagtgggagttcatcttcatgcaggccgaggcccaggccaaggtggacaagaagagagacaagatcgagagaaagatcctggacagccaggagagagccttctgggacgtgcacagacccgtgcccggctgcgtgaacaccaccgaggtggacatcaagaagagcagcagaatgagaaacccccacaagaccagaaagagcgtgtacggcctgcagaacgacatcagaagccacagccccacccacacccccacccccgagaccaagccccccaccgaggacgagctgcagcagcagatcaagtactggcagatccagctggacagacacagactgaagatgagcaaggtggccgacagcctgctgagctacaccgagcagtacctggagtacgaccccttcctgctgccccccgaccccagcaacccctggctgagcgacgacaccaccttctgggagctggaggccagcaaggagcccagccagcagagagtgaagagatggggcttcggcatggacgaggccctgaaggaccccgtgggcagagagcagttcctgaagttcctggagagcgagttcagcagcgagaacctgagattctggctggccgtggaggacctgaagaagagacccatcaaggaggtgcccagcagagtgcaggagatctggcaggagttcctggcccccggcgcccccagcgccatcaacctggacagcaagagctacgacaagaccacccagaacgtgaaggagcccggcagatacaccttcgaggacgcccaggagcacatctacaagctgatgaagagcgacagctaccccagattcatcagaagcagcgcctaccaggagctgctgcaggccaagaagaagggcagaaacatccccatcttcccctgccacaagaactgcacccccaccctgagagccagcaccaacctgctgtag

SEQ ID NO: 96702 - DNA, 1275 bp, Artificial Sequence
  Description of Artificial Sequence: Synthetic coding sequence
atggcccagggcaacaactacggccagaccagcaacggcgtggccgacgagagccccaacatgctggtgtacagaaagatggaggacgtgatcgccagaatgcaggacgagaagaacggcatccccatcagaaccgtgaagagcttcctgagcaagatccccagcgtgttcagcggcagcgacatcgtgcagtggctgatcaagaacctgaccatcgaggaccccgccgtgtacctgtgcaagagaaccatgcagaacaaggccagactggagctggccgactacgaggccgagagcctggccagactgcagagagccttcgccagaaagtgggagttcatcttcatgcaggccgaggcccaggccaaggtggacaagaagagagacaagatcgagagaaagatcctggacagccaggagagagccttctgggacgtgcacagacccgtgcccggctgcgtgaacaccaccgaggtggacatcaagaagagcagcagaatgagaaacccccacaagaccagaaagagcgtgtacggcctgcagaacgacatcagaagccacagccccacccacacccccacccccgagaccaagccccccaccgaggacgagctgcagcagcagatcaagtactggcagatccagctggacagacacagactgaagatgagcaaggtggccgacagcctgctgagctacaccgagcagtacctggagtacgaccccttcctgctgccccccgaccccagcaacccctggctgagcgacgacaccaccttctgggagctggaggccagcaaggagcccagccagcagagagtgaagagatggggcttcggcatggacgaggccctgaaggaccccgtgggcagagagcagttcctgaagttcctggagagcgagttcagcagcgagaacctgagattctggctggccgtggaggacctgaagaagagacccatcaaggaggtgcccagcagagtgcaggagatctggcaggagttcctggcccccggcgcccccagcgccatcaacctggacagcaagagctacgacaagaccacccagaacgtgaaggagcccggcagatacaccttcgaggacgcccaggagcacatctacaagctgatgaagagcgacagctaccccagattcatcagaagcagcgcctaccaggagctgctgcaggccaagaagaagggcagaaacatccccatcttcccctgccacaagaactgcacccccaccctgagagccagcaccaacctgctgtag

SEQ ID NO: 96703 - DNA, 1410 bp, Artificial Sequence
  Description of Artificial Sequence: Synthetic coding sequence
atggcccagggcaacaactacggccagaccagcaacggcgtggccgacgagagccccaacatgctggtgtacagaaagatggaggacgtgatcgccagaatgcaggacgagaagaacggcatccccatcagaaccgtgaagagcttcctgagcaagatccccagcgtgttcagcggcagcgacatcgtgcagtggctgatcaagaacctgaccatcgaggaccccgtggaggccctgcacctgggcaccctgatggccgcccacggctacttcttccccatcagcgaccacgtgctgaccctgaaggacgacggcaccttctacagattccagaccccctacttctggcccagcaactgctgggagcccgagaacaccgactacgccgtgtacctgtgcaagagaaccatgcagaacaaggccagactggagctggccgactacgaggccgagagcctggccagactgcagagagccttcgccagaaagtgggagttcatcttcatgcaggccgaggcccaggccaaggtggacaagaagagagacaagatcgagagaaagatcctggacagccaggagagagccttctgggacgtgcacagacccgtgcccggctgcgtgaacaccaccgaggtggacatcaagaagagcagcagaatgagaaacccccacaagaccagaaagagcgtgtacggcctgcagaacgacatcagaagccacagccccacccacacccccacccccgagaccaagccccccaccgaggacgagctgcagcagcagatcaagtactggcagatccagctggacagacacagactgaagatgagcaaggtggccgacagcctgctgagctacaccgagcagtacctggagtacgaccccttcctgctgccccccgaccccagcaacccctggctgagcgacgacaccaccttctgggagctggaggccagcaaggagcccagccagcagagagtgaagagatggggcttcggcatggacgaggccctgaaggaccccgtgggcagagagcagttcctgaagttcctggagagcgagttcagcagcgagaacctgagattctggctggccgtggaggacctgaagaagagacccatcaaggaggtgcccagcagagtgcaggagatctggcaggagttcctggcccccggcgcccccagcgccatcaacctggacagcaagagctacgacaagaccacccagaacgtgaaggagcccggcagatacaccttcgaggacgcccaggagcacatctacaagctgatgaagagcgacagctaccccagattcatcagaagcagcgcctaccaggagctgctgcaggccaagaagaagggcaagagcctgaccagcaagagactgaccagcctggcccagagctactag

SEQ ID NO: 96704 - DNA, 1434 bp, Artificial Sequence
  Description of Artificial Sequence: Synthetic coding sequence
atggcccagggcaacaactacggccagaccagcaacggcgtggccgacgagagccccaacatgctggtgtacagaaagatggaggacgtgatcgccagaatgcaggacgagaagaacggcatccccatcagaaccgtgaagagcttcctgagcaagatccccagcgtgttcagcggcagcgacatcgtgcagtggctgatcaagaacctgaccatcgaggaccccgtggaggccctgcacctgggcaccctgatggccgcccacggctacttcttccccatcagcgaccacgtgctgaccctgaaggacgacggcaccttctacagattccagaccccctacttctggcccagcaactgctgggagcccgagaacaccgactacgccgtgtacctgtgcaagagaaccatgcagaacaaggccagactggagctggccgactacgaggccgagagcctggccagactgcagagagccttcgccagaaagtgggagttcatcttcatgcaggccgaggcccaggccaaggtggacaagaagagagacaagatcgagagaaagatcctggacagccaggagagagccttctgggacgtgcacagacccgtgcccggctgcgtgaacaccaccgaggtggacatcaagaagagcagcagaatgagaaacccccacaagaccagaaagagcgtgtacggcctgcagaacgacatcagaagccacagccccacccacacccccacccccgagaccaagccccccaccgaggacgagctgcagcagcagatcaagtactggcagatccagctggacagacacagactgaagatgagcaaggtggccgacagcctgctgagctacaccgagcagtacctggagtacgaccccttcctgctgccccccgaccccagcaacccctggctgagcgacgacaccaccttctgggagctggaggccagcaaggagcccagccagcagagagtgaagagatggggcttcggcatggacgaggccctgaaggaccccgtgggcagagagcagttcctgaagttcctggagagcgagttcagcagcgagaacctgagattctggctggccgtggaggacctgaagaagagacccatcaaggaggtgcccagcagagtgcaggagatctggcaggagttcctggcccccggcgcccccagcgccatcaacctggacagcaagagctacgacaagaccacccagaacgtgaaggagcccggcagatacaccttcgaggacgcccaggagcacatctacaagctgatgaagagcgacagctaccccagattcatcagaagcagcgcctaccaggagctgctgcaggccaagaagaagggcagaaacatccccatcttcccctgccacaagaactgcacccccaccctgagagccagcaccaacctgctgtag

SEQ ID NO: 96705 - DNA, 1410 bp, Artificial Sequence; identical to SEQ ID NO: 96703
  Description of Artificial Sequence: Synthetic coding sequence

SEQ ID NO: 96706 - DNA, 1464 bp, Artificial Sequence
  Description of Artificial Sequence: Synthetic coding sequence
atggcccagggcaacaactacggccagaccagcaacggcgtggccgacgagagccccaacatgctggtgtacagaaagatggaggacgtgatcgccagaatgcaggacgagaagaacggcatccccatcagaaccgtgaagagcttcctgagcaagatccccagcgtgttcagcggcagcgacatcgtgcagtggctgatcaagaacctgaccatcgaggaccccgtggaggccctgcacctgggcaccctgatggccgcccacggctacttcttccccatcagcgaccacgtgctgaccctgaaggacgacggcaccttctacagattccagaccccctacttctggcccagcaactgctgggagcccgagaacaccgactacgccgtgtacctgtgcaagagaaccatgcagaacaaggccagactggagctggccgactacgaggccgagagcctggccagactgcagagagccttcgccagaaagtgggagttcatcttcatgcaggccgaggcccaggccaaggtggacaagaagagagacaagatcgagagaaagatcctggacagccaggagagagccttctgggacgtgcacagacccgtgcccggctgcgtgaacaccaccgaggtggacatcaagaagagcagcagaatgagaaacccccacaagaccagaaagagcgtgtacggcctgcagaacgacatcagaagccacagccccacccacacccccacccccgagaccaagccccccaccgaggacgagctgcagcagcagatcaagtactggcagatccagctggacagacacagactgaagatgagcaaggtggccgacagcctgctgagctacaccgagcagtacctggagtacgaccccttcctgctgccccccgaccccagcaacccctggctgagcgacgacaccaccttctgggagctggaggccagcaaggagcccagccagcagagagtgaagagatggggcttcggcatggacgaggccctgaaggaccccgtgggcagagagcagttcctgaagttcctggagagcgagttcagcagcgagaacctgagattctggctggccgtggaggacctgaagaagagacccatcaaggaggtgcccagcagagtgcaggagatctggcaggagttcctggcccccggcgcccccagcgccatcaacctggacagcaagagctacgacaagaccacccagaacgtgaaggagcccggcagatacaccttcgaggacgcccaggagcacatctacaagctgatgaagagcgacagctaccccagattcatcagaagcagcgcctaccaggagctgctgcaggccaagaagaagagcggcaacagcatggacagaagaaccagcttcgagaagttcgcccagaacgtgggcaagagcctgaccagcaagagactgaccagcctggcccagagctactag

SEQ ID NO: 96707 - DNA, 1275 bp, Artificial Sequence; identical to SEQ ID NO: 96702
  Description of Artificial Sequence: Synthetic coding sequence

SEQ ID NO: 96708 - DNA, 1488 bp, Artificial Sequence
  Description of Artificial Sequence: Synthetic coding sequence
atggcccagggcaacaactacggccagaccagcaacggcgtggccgacgagagccccaacatgctggtgtacagaaagatggaggacgtgatcgccagaatgcaggacgagaagaacggcatccccatcagaaccgtgaagagcttcctgagcaagatccccagcgtgttcagcggcagcgacatcgtgcagtggctgatcaagaacctgaccatcgaggaccccgtggaggccctgcacctgggcaccctgatggccgcccacggctacttcttccccatcagcgaccacgtgctgaccctgaaggacgacggcaccttctacagattccagaccccctacttctggcccagcaactgctgggagcccgagaacaccgactacgccgtgtacctgtgcaagagaaccatgcagaacaaggccagactggagctggccgactacgaggccgagagcctggccagactgcagagagccttcgccagaaagtgggagttcatcttcatgcaggccgaggcccaggccaaggtggacaagaagagagacaagatcgagagaaagatcctggacagccaggagagagccttctgggacgtgcacagacccgtgcccggctgcgtgaacaccaccgaggtggacatcaagaagagcagcagaatgagaaacccccacaagaccagaaagagcgtgtacggcctgcagaacgacatcagaagccacagccccacccacacccccacccccgagaccaagccccccaccgaggacgagctgcagcagcagatcaagtactggcagatccagctggacagacacagactgaagatgagcaaggtggccgacagcctgctgagctacaccgagcagtacctggagtacgaccccttcctgctgccccccgaccccagcaacccctggctgagcgacgacaccaccttctgggagctggaggccagcaaggagcccagccagcagagagtgaagagatggggcttcggcatggacgaggccctgaaggaccccgtgggcagagagcagttcctgaagttcctggagagcgagttcagcagcgagaacctgagattctggctggccgtggaggacctgaagaagagacccatcaaggaggtgcccagcagagtgcaggagatctggcaggagttcctggcccccggcgcccccagcgccatcaacctggacagcaagagctacgacaagaccacccagaacgtgaaggagcccggcagatacaccttcgaggacgcccaggagcacatctacaagctgatgaagagcgacagctaccccagattcatcagaagcagcgcctaccaggagctgctgcaggccaagaagaagagcggcaacagcatggacagaagaaccagcttcgagaagttcgcccagaacgtgggcagaaacatccccatcttcccctgccacaagaactgcacccccaccctgagagccagcaccaacctgctgtag

SEQ ID NO: 96709 - DNA, 981 bp, Artificial Sequence
  Description of Artificial Sequence: Synthetic coding sequence
caggccgaggcccaggccaaggtggacaagaagagagacaagatcgagagaaagatcctggacagccaggagagagccttctgggacgtgcacagacccgtgcccggctgcgtgaacaccaccgaggtggacatcaagaagagcagcagaatgagaaacccccacaagaccagaaagagcgtgtacggcctgcagaacgacatcagaagccacagccccacccacacccccacccccgagaccaagccccccaccgaggacgagctgcagcagcagatcaagtactggcagatccagctggacagacacagactgaagatgagcaaggtggccgacagcctgctgagctacaccgagcagtacctggagtacgaccccttcctgctgccccccgaccccagcaacccctggctgagcgacgacaccaccttctgggagctggaggccagcaaggagcccagccagcagagagtgaagagatggggcttcggcatggacgaggccctgaaggaccccgtgggcagagagcagttcctgaagttcctggagagcgagttcagcagcgagaacctgagattctggctggccgtggaggacctgaagaagagacccatcaaggaggtgcccagcagagtgcaggagatctggcaggagttcctggcccccggcgcccccagcgccatcaacctggacagcaagagctacgacaagaccacccagaacgtgaaggagcccggcagatacaccttcgaggacgcccaggagcacatctacaagctgatgaagagcgacagctaccccagattcatcagaagcagcgcctaccaggagctgctgcaggccaagaagaagagcggcaacagcatggacagaagaaccagcttcgagaagttcgcccagaacgtgggcagaaacatccccatcttcccctgccacaagaactgcacccccaccctgagagccagcaccaacctgctgtag

SEQ ID NO: 96710 - DNA, 1182 bp, Artificial Sequence
  Description of Artificial Sequence: Synthetic coding sequence
atggccgcccacggctacttcttccccatcagcgaccacgtgctgaccctgaaggacgacggcaccttctacagattccagaccccctacttctggcccagcaactgctgggagcccgagaacaccgactacgccgtgtacctgtgcaagagaaccatgcagaacaaggccagactggagctggccgactacgaggccgagagcctggccagactgcagagagccttcgccagaaagtgggagttcatcttcatgcaggccgaggcccaggccaaggtggacaagaagagagacaagatcgagagaaagatcctggacagccaggagagagccttctgggacgtgcacagacccgtgcccggctgcgtgaacaccaccgaggtggacatcaagaagagcagcagaatgagaaacccccacaagaccagaaagagcgtgtacggcctgcagaacgacatcagaagccacagccccacccacacccccacccccgagaccaagccccccaccgaggacgagctgcagcagcagatcaagtactggcagatccagctggacagacacagactgaagatgagcaaggtggccgacagcctgctgagctacaccgagcagtacctggagtacgaccccttcctgctgccccccgaccccagcaacccctggctgagcgacgacaccaccttctgggagctggaggccagcaaggagcccagccagcagagagtgaagagatggggcttcggcatggacgaggccctgaaggaccccgtgggcagagagcagttcctgaagttcctggagagcgagttcagcagcgagaacctgagattctggctggccgtggaggacctgaagaagagacccatcaaggaggtgcccagcagagtgcaggagatctggcaggagttcctggcccccggcgcccccagcgccatcaacctggacagcaagagctacgacaagaccacccagaacgtgaaggagcccggcagatacaccttcgaggacgcccaggagcacatctacaagctgatgaagagcgacagctaccccagattcatcagaagcagcgcctaccaggagctgctgcaggccaagaagaagggcagaaacatccccatcttcccctgccacaagaactgcacccccaccctgagagccagcaccaacctgctgtag

SEQ ID NO: 96711 - DNA, 774 bp, Artificial Sequence
  Description of Artificial Sequence: Synthetic coding sequence
atgagcagcgcccccaacggcagaaagaagagacccagcagaagcaccagaagcagcatcttccagatcagcaagccccccctgcagagcggcgactgggagagaagaggcagcggcagcgagagcgcccacaagacccagagagccctggacgactgcaagatgctggtgcaggagttcaacacccaggtggccctgtacagagagctggtgatcagcatcggcgacgtgagcgtgagctgccccagcctgagagccgagatgcacaagaccagaaccaagggctgcgagatggccagacaggcccaccagaagctggccgccatcagcggccccgaggacggcgagatccaccccgagatctgcagactgtacatccagctgcagtgctgcctggagatgtacaccaccgagatgctgaagagcatctgcctgctgggcagcctgcagttccacagaaagggcaaggagcccggcggcggcaccaagagcctggactgcaagatcgaggagagcgccgagacccccgccctggaggacagcagcagcagccccgtggacagccagcagcacagctggcaggtgagcaccgacatcgagaacaccgagagagacatgagagagatgaagaacctgctgagcaagctgagagagaccatgcccctgcccctgaagaaccaggacgacagcagcctgctgaacctgaccccctaccccctggtgagaagaagaaagagaagattcttcggcctgtgctgcctgatcagcagctag

SEQ ID NO: 96712 - DNA, 2025 bp, Artificial Sequence
  Description of Artificial Sequence: Synthetic coding sequence
atgaccatcagacaccagggccagcagtacagacccagaatggccttcctgcagaagatcgaggccctggtgaaggacatgcagaaccccgagaccggcgtgagaatgcagaaccagagagtgctggtgaccagcgtgccccacgccatgaccggcagcgacgtgctgcagtggatcgtgcagagactgtggatcagcagcctggaggcccagaacctgggcaacttcatcgtgagatacggctacatctaccccctgcaggaccccaagaacctgatcctgaagcccgacggcagcctgtacagattccagaccccctacttctggcccacccagcagtggcccgccgaggacaccgactacgccatctacctggccaagagaaacatcaagaagaagggcatcctggaggagtacgagaaggagaactacaacttcctgaaccagaagatgaactacaagtgggacttcgtgatcatgcaggccaaggagcagtacagagccggcaaggagagaaacaaggccgacagatacgccctggactgccaggagaaggcctactggctggtgcacagatgcccccccggcatggacaacgtgctggactacggcctggacagagtgaccaaccccaacgaggtgaaggtgaaccagaagcagaccgtggtggccgtgaagaaggagatcatgtactaccagcaggccctgatgagaagcaccgtgaagagcagcgtgagcctgggcggcatcgtgaagtacagcgagcagttcagcagcaacgacgccatcatgagcggctgcctgcccagcaacccctggatcaccgacgacacccagttctgggacctgaacgccaagctggtggagatccccaccaagatgagagtggagagatgggccttcaacttcagcgagctgatcagagaccccaagggcagacagagcttccagtacttcctgaagaaggagttcagcggcgagaacctgggcttctgggaggcctgcgaggacctgaagtacggcgaccagagcaaggtgaaggagaaggccgaggagatctacaagctgttcctggcccccggcgccagaagatggatcaacatcgacggcaagaccatggacatcaccgtgaagggcctgaagcacccccacagatacgtgctggacgccgcccagacccacatctacatgctgatgaagaaggacagctacgccagatacctgaagagccccatctacaaggacatgctggccaaggccatcgagccccaggagaccaccaagaagagcagcaccctgcccttcatgagaagacacctgagaagcagccccagccccgtgatcctgagacagctggaggaggaggccaaggccagagaggccgccaacaccgtggacatcacccagcccggccagcacatggcccccagcccccacctgaccgtgtacaccggcacctgcatgccccccagccccagcagccccttcagcagcagctgcagaagccccagaaagcccttcgccagccccagcagattcatcagaagacccagcaccaccatctgccccagccccatcagagtggccctggagagcagcagcggcctggagcagaagggcgagtgcagcggcagcatggcccccagaggccccagcgtgaccgagagcagcgaggccagcctggacaccagctggcccagaagcagacccagagccccccccaaggccagaatggccctgagcttcagcagattcctgagaagaggctgcctggccagccccgtgttcgccagactgagccccaagtgccccgccgtgagccacggcagagtgcagcccctgggcgacgtgggccagcagctgcccagactgaagagcaagagagtggccaacttcttccagatcaagatggacgtgcccaccggcagcggcacctgcctgatggacagcgaggacgccggcaccggcgagagcggcgacagagccaccgagaaggaggtgatctgcccctgggagagcctgtag

SEQ ID NO: 96713 - DNA, 2016 bp, Artificial Sequence
  Description of Artificial Sequence: Synthetic coding sequence
atgaccatcagacaccagggccagcagtacagacccagaatggccttcctgcagaagatcgaggccctggtgaaggacatgcagaaccccgagaccggcgtgagaatgcagaaccagagagtgctggtgaccagcgtgccccacgccatgaccggcagcgacgtgctgcagtggatcgtgcagagactgtggatcagcagcctggaggcccagaacctgggcaacttcatcgtgagatacggctacatctaccccctgcaggaccccaagaacctgatcctgaagcccgacggcagcctgtacagattccagaccccctacttctggcccacccagcagtggcccgccgaggacaccgactacgccatctacctggccaagagaaacatcaagaagaagggcatcctggaggagtacgagaaggagaactacaacttcctgaaccagaagatgaactacaagtgggacttcgtgatcatgcaggccaaggagcagtacagagccggcaaggagagaaacaaggccgacagatacgccctggactgccaggagaaggcctactggctggtgcacagatgcccccccggcatggacaacgtgctggactacggcctggacagagtgaccaaccccaacgaggtgaagaagcagaccgtggtggccgtgaagaaggagatcatgtactaccagcaggccctgatgagaagcaccgtgaagagcagcgtgagcctgggcggcatcgtgaagtacagcgagcagttcagcagcaacgacgccatcatgagcggctgcctgcccagcaacccctggatcaccgacgacacccagttctgggacctgaacgccaagctggtggagatccccaccaagatgagagtggagagatgggccttcaacttcagcgagctgatcagagaccccaagggcagacagagcttccagtacttcctgaagaaggagttcagcggcgagaacctgggcttctgggaggcctgcgaggacctgaagtacggcgaccagagcaaggtgaaggagaaggccgaggagatctacaagctgttcctggcccccggcgccagaagatggatcaacatcgacggcaagaccatggacatcaccgtgaagggcctgaagcacccccacagatacgtgctggacgccgcccagacccacatctacatgctgatgaagaaggacagctacgccagatacctgaagagccccatctacaaggacatgctggccaaggccatcgagccccaggagaccaccaagaagagcagcaccctgcccttcatgagaagacacctgagaagcagccccagccccgtgatcctgagacagctggaggaggaggccaaggccagagaggccgccaacaccgtggacatcacccagcccggccagcacatggcccccagcccccacctgaccgtgtacaccggcacctgcatgccccccagccccagcagccccttcagcagcagctgcagaagccccagaaagcccttcgccagccccagcagattcatcagaagacccagcaccaccatctgccccagccccatcagagtggccctggagagcagcagcggcctggagcagaagggcgagtgcagcggcagcatggcccccagaggccccagcgtgaccgagagcagcgaggccagcctggacaccagctggcccagaagcagacccagagccccccccaaggccagaatggccctgagcttcagcagattcctgagaagaggctgcctggccagccccgtgttcgccagactgagccccaagtgccccgccgtgagccacggcagagtgcagcccctgggcgacgtgggccagcagctgcccagactgaagagcaagagagtggccaacttcttccagatcaagatggacgtgcccaccggcagcggcacctgcctgatggacagcgaggacgccggcaccggcgagagcggcgacagagccaccgagaaggaggtgatctgcccctgggagagcctgtag

SEQ ID NO: 96714 - DNA, 4008 bp, Artificial Sequence
  Description of Artificial Sequence: Synthetic coding sequence
atggagagcgagatgctgcagagccccctgctgggcctgggcgaggaggacgaggccgacctgaccgactggaacctgcccctggccttcatgaagaagagacactgcgagaagatcgagggcagcaagagcctggcccagagctggagaatgaaggacagaatgaagaccgtgagcgtggccctggtgctgtgcctgaacgtgggcgtggacccccccgacgtggtgaagaccaccccctgcgccagactggagtgctggatcgaccccctgagcatgggcccccagaaggccctggagaccatcggcgccaacctgcagaagcagtacgagaactggcagcccagagccagatacaagcagagcctggaccccaccgtggacgaggtgaagaagctgtgcaccagcctgagaagaaacgccaaggaggagagagtgctgttccactacaacggccacggcgtgcccagacccaccgtgaacggcgaggtgtgggtgttcaacaagaactacacccagtacatccccctgagcatctacgacctgcagacctggatgggcagccccagcatcttcgtgtacgactgcagcaacgccggcctgatcgtgaagagcttcaagcagttcgccctgcagagagagcaggagctggaggtggccgccatcaaccccaaccaccccctggcccagatgcccctgccccccagcatgaagaactgcatccagctggccgcctgcgaggccaccgagctgctgcccatgatccccgacctgcccgccgacctgttcaccagctgcctgaccacccccatcaagatcgccctgagatggttctgcatgcagaagtgcgtgagcctggtgcccggcgtgaccctggacctgatcgagaagatccccggcagactgaacgacagaagaacccccctgggcgagctgaactggatcttcaccgccatcaccgacaccatcgcctggaacgtgctgcccagagacctgttccagaagctgttcagacaggacctgctggtggccagcctgttcagaaacttcctgctggccgagagaatcatgagaagctacaactgcacccccgtgagcagccccagactgccccccacctacatgcacgccatgtggcaggcctgggacctggccgtggacatctgcctgagccagctgcccaccatcatcgaggagggcaccgccttcagacacagccccttcttcgccgagcagctgaccgccttccaggtgtggctgaccatgggcgtggagaacagaaacccccccgagcagctgcccatcgtgctgcaggtgctgctgagccaggtgcacagactgagagccctggacctgctgggcagattcctggacctgggcccctgggccgtgagcctggccctgagcgtgggcatcttcccctacgtgctgaagctgctgcagagcagcgccagagagctgagacccctgctggtgttcatctgggccaagatcctggccgtggacagcagctgccaggccgacctggtgaaggacaacggccacaagtacttcctgagcgtgctggccgacccctacatgcccgccgagcacagaaccatgaccgccttcatcctggccgtgatcgtgaacagctaccacaccggccaggaggcctgcctgcagggcaacctgatcgccatctgcctggagcagctgaacgacccccaccccctgctgagacagtgggtggccatctgcctgggcagaatctggcagaacttcgacagcgccagatggtgcggcgtgagagacagcgcccacgagaagctgtacagcctgctgagcgaccccatccccgaggtgagatgcgccgccgtgttcgccctgggcaccttcgtgggcaacagcgccgagagaaccgaccacagcaccaccatcgaccacaacgtggccatgatgctggcccagctggtgagcgacggcagccccatggtgagaaaggagctggtggtggccctgagccacctggtggtgcagtacgagagcaacttctgcaccgtggccctgcagttcatcgaggaggagaagaactacgccctgcccagccccgccaccaccgagggcggcagcctgacccccgtgagagacagcccctgcacccccagactgagaagcgtgagcagctacggcaacatcagagccgtggccaccgccagaagcctgaacaagagcctgcagaacctgagcctgaccgaggagagcggcggcgccgtggccttcagccccggcaacctgagcaccagcagcagcgccagcagcaccctgggcagccccgagaacgaggagcacatcctgagcttcgagaccatcgacaagatgagaagagccagcagctacagcagcctgaacagcctgatcggcgtgagcttcaacagcgtgtacacccagatctggagagtgctgctgcacctggccgccgacccctaccccgaggtgagcgacgtggccatgaaggtgctgaacagcatcgcctacaaggccaccgtgaacgccagaccccagagagtgctggacaccagcagcctgacccagagcgcccccgccagccccaccaacaagggcgtgcacatccaccaggccggcggcagcccccccgccagcagcaccagcagcagcagcctgaccaacgacgtggccaagcagcccgtgagcagagacctgcccagcggcagacccggcaccaccggccccgccggcgcccagtacaccccccacagccaccagttccccagaaccagaaagatgttcgacaagggccccgagcagaccgccgacgacgccgacgacgccgccggccacaagagcttcatcagcgccaccgtgcagaccggcttctgcgactggagcgccagatacttcgcccagcccgtgatgaagatccccgaggagcacgacctggagagccagatcagaaaggagagagagtggagattcctgagaaacagcagagtgagaagacaggcccagcaggtgatccagaagggcatcaccagactggacgaccagatcttcctgaacagaaaccccggcgtgcccagcgtggtgaagttccaccccttcaccccctgcatcgccgtggccgacaaggacagcatctgcttctgggactgggagaagggcgagaagctggactacttccacaacggcaaccccagatacaccagagtgaccgccatggagtacctgaacggccaggactgcagcctgctgctgaccgccaccgacgacggcgccatcagagtgtggaagaacttcgccgacctggagaagaaccccgagatggtgaccgcctggcagggcctgagcgacatgctgcccaccaccagaggcgccggcatggtggtggactgggagcaggagaccggcctgctgatgagcagcggcgacgtgagaatcgtgagaatctgggacaccgacagagagatgaaggtgcaggacatccccaccggcgccgacagctgcgtgaccagcctgagctgcgacagccacagaagcctgatcgtggccggcctgggcgacggcagcatcagagtgtacgacagaagaatggccctgagcgagtgcagagtgatgacctacagagagcacaccgcctgggtggtgaaggccagcctgcagaagagacccgacggccacatcgtgagcgtgagcgtgaacggcgacgtgagaatcttcgaccccagaatgcccgagagcgtgaacgtgctgcagatcgtgaagggcctgaccgccctggacatccacccccaggccgacctgatcgcctgcggcagcgtgaaccagttcaccgccatctacaacagcagcggcgagctgatcaacaacatcaagtactacgacggcttcatgggccagagagtgggcgccatcagctgcctggccttccacccccactggccccacctggccgtgggcagcaacgactactacatcagcgtgtacagcgtggagaagagagtgagatag

SEQ ID NO: 96715 - DNA, 990 bp, Artificial Sequence
  Description of Artificial Sequence: Synthetic coding sequence
atgggcagccccagcatcttcgtgtacgactgcagcaacgccggcctgatcgtgaagagcttcaagcagttcgccctgcagagagagcaggagctggaggtggccgccatcaaccccaaccaccccctggcccagatgcccctgccccccagcatgaagaactgcatccagctggccgcctgcgaggccaccgagctgctgcccatgatccccgacctgcccgccgacctgttcaccagctgcctgaccacccccatcaagatcgccctgagatggttctgcatgcagaagtgcgtgagcctggtgcccggcgtgaccctggacctgatcgagaagatccccggcagactgaacgacagaagaacccccctgggcgagctgaactggatcttcaccgccatcaccgacaccatcgcctggaacgtgctgcccagagacctgttccagaagctgttcagacaggacctgctggtggccagcctgttcagaaacttcctgctggccgagagaatcatgagaagctacaactgcacccccgtgagcagccccagactgccccccacctacatgcacgccatgtggcaggcctgggacctggccgtggacatctgcctgagccagctgcccaccatcatcgaggagggcaccgccttcagacacagccccttcttcgccgagcagctgaccgccttccaggtgtggctgaccatgggcgtggagaacagaaacccccccgagcagctgcccatcgtgctgcaggtgctgctgagccaggtgcacagactgagagccctggacctgctgggcagattcctggacctgggcccctgggccgtgagcctggccctgagcgtgggcatcttcccctacgtgctgaagctgctgcagagcagcgccagagagctgagacccctgctggtgttcatctgggccaagatcctggccgtggacagcgtgagcatccccgccctgctgcccagagtgatgtag

SEQ ID NO: 96716 - DNA, 3534 bp, Artificial Sequence
  Description of Artificial Sequence: Synthetic coding sequence
atggagagcgagatgctgcagagccccctgctgggcctgggcgaggaggacgaggccgacctgaccgactggaacctgcccctggccttcatgaagaagagacactgcgagaagatcgagggcagcaagagcctggcccagagctggagaatgaaggacagaatgaagaccgtgagcgtggccctggtgctgtgcctgaacgtgggcgtggacccccccgacgtggtgaagaccaccccctgcgccagactggagtgctggatcgaccccctgagcatgggcccccagaaggccctggagaccatcggcgccaacctgcagaagcagtacgagaactggcagcccagagccagatacaagcagagcctggaccccaccgtggacgaggtgaagaagctgtgcaccagcctgagaagaaacgccaaggaggagagagtgctgttccactacaacggccacggcgtgcccagacccaccgtgaacggcgaggtgtgggtgttcaacaagaactacacccagtacatccccctgagcatctacgacctgcagacctggatgggcagccccagcatcttcgtgtacgactgcagcaacgccggcctgatcgtgaagagcttcaagcagttcgccctgcagagagagcaggagctggaggtggccgccatcaaccccaaccaccccctggcccagatgcccctgccccccagcatgaagaactgcatccagctggccgcctgcgaggccaccgagctgctgcccatgatccccgacctgcccgccgacctgttcaccagctgcctgaccacccccatcaagatcgccctgagatggttctgcatgcagaagtgcgtgagcctggtgcccggcgtgaccctggacctgatcgagaagatccccggcagactgaacgacagaagaacccccctgggcgagctgaactggatcttcaccgccatcaccgacaccatcgcctggaacgtgctgcccagagacctgttccagaagctgttcagacaggacctgctggtggccagcctgttcagaaacttcctgctggccgagagaatcatgagaagctacaactgcacccccgtgagcagccccagactgccccccacctacatgcacgccatgtggcaggcctgggacctggccgtggacatctgcctgagccagctgcccaccatcatcgaggagggcaccgccttcagacacagccccttcttcgccgagcagctgaccgccttccaggtgtggctgaccatgggcgtggagaacagaaacccccccgagcagctgcccatcgtgctgcaggtgctgctgagccaggtgcacagactgagagccctggacctgctgggcagattcctggacctgggcccctgggccgtgagcctggccctgagcgtgggcatcttcccctacgtgctgaagctgctgcagagcagcgccagagagctgagacccctgctggtgttcatctgggccaagatcctggccgtggacagcgagctggtggtggccctgagccacctggtggtgcagtacgagagcaacttctgcaccgtggccctgcagttcatcgaggaggagaagaactacgccctgcccagccccgccaccaccgagggcggcagcctgacccccgtgagagacagcccctgcacccccagactgagaagcgtgagcagctacggcaacatcagagccgtggccaccgccagaagcctgaacaagagcctgcagaacctgagcctgaccgaggagagcggcggcgccgtggccttcagccccggcaacctgagcaccagcagcagcgccagcagcaccctgggcagccccgagaacgaggagcacatcctgagcttcgagaccatcgacaagatgagaagagccagcagctacagcagcctgaacagcctgatcggcgtgagcttcaacagcgtgtacacccagatctggagagtgctgctgcacctggccgccgacccctaccccgaggtgagcgacgtggccatgaaggtgctgaacagcatcgcctacaaggccaccgtgaacgccagaccccagagagtgctggacaccagcagcctgacccagagcgcccccgccagccccaccaacaagggcgtgcacatccaccaggccggcggcagcccccccgccagcagcaccagcagcagcagcctgaccaacgacgtggccaagcagcccgtgagcagagacctgcccagcggcagacccggcaccaccggccccgccggcgcccagtacaccccccacagccaccagttccccagaaccagaaagatgttcgacaagggccccgagcagaccgccgacgacgccgacgacgccgccggccacaagagcttcatcagcgccaccgtgcagaccggcttctgcgactggagcgccagatacttcgcccagcccgtgatgaagatccccgaggagcacgacctggagagccagatcagaaaggagagagagtggagattcctgagaaacagcagagtgagaagacaggcccagcaggtgatccagaagggcatcaccagactggacgaccagatcttcctgaacagaaaccccggcgtgcccagcgtggtgaagttccaccccttcaccccctgcatcgccgtggccgacaaggacagcatctgcttctgggactgggagaagggcgagaagctggactacttccacaacggcaaccccagatacaccagagtgaccgccatggagtacctgaacggccaggactgcagcctgctgctgaccgccaccgacgacggcgccatcagagtgtggaagaacttcgccgacctggagaagaaccccgagatggtgaccgcctggcagggcctgagcgacatgctgcccaccaccagaggcgccggcatggtggtggactgggagcaggagaccggcctgctgatgagcagcggcgacgtgagaatcgtgagaatctgggacaccgacagagagatgaaggtgcaggacatccccaccggcgccgacagctgcgtgaccagcctgagctgcgacagccacagaagcctgatcgtggccggcctgggcgacggcagcatcagagtgtacgacagaagaatggccctgagcgagtgcagagtgatgacctacagagagcacaccgcctgggtggtgaaggccagcctgcagaagagacccgacggccacatcgtgagcgtgagcgtgaacggcgacgtgagaatcttcgaccccagaatgcccgagagcgtgaacgtgctgcagatcgtgaagggcctgaccgccctggacatccacccccaggccgacctgatcgcctgcggcagcgtgaaccagttcaccgccatctacaacagcagcggcgagctgatcaacaacatcaagtactacgacggcttcatgggccagagagtgggcgccatcagctgcctggccttccacccccactggccccacctggccgtgggcagcaacgactactacatcagcgtgtacagcgtggagaagagagtgagatag

SEQ ID NO: 96717 - DNA, 2097 bp, Artificial Sequence
  Description of Artificial Sequence: Synthetic coding sequence
atgcagaacagcgagggcggcgccgacagccccgccagcgtggccctgagacccagcgccgccgccccccccgtgcccgccagcccccagagagtgctggtgcaggccgccagcagcaaccccaagggcgcccagatgcagcccatcagcctgcccagagtgcagcaggtgccccagcaggtgcagcccgtgcagcacgtgtaccccgcccaggtgcagtacgtggagggcggcgacgccgtgtacaccaacggcgccatcagaaccgcctacacctacaaccccgagccccagatgtacgcccccagcagcaccgccagctacttcgaggcccccggcggcgcccaggtgaccgtggccgccagcagcccccccgccgtgcccagccacagcatggtgggcatcaccatggacgtgggcggcagccccatcgtgagcagcgccggcgcctacctgatccacggcggcatggacagcaccagacacagcctggcccacaccagcagaagcagccccgccaccctgcagtggctgctggacaactacgagaccgccgagggcgtgagcctgcccagaagcagcctgtacaaccactacctgagacactgccaggagcacaagctggaccccgtgaacgccgccagcttcggcaagctgatcagaagcgtgttcatgggcctgagaaccagaagactgggcaccagaggcaacagcaagtaccactactacggcatcagactgaagcccgacagccccctgaacagactgcaggaggacacccagtacatggccatgagacagcagcccatgcaccagaagcccagatacagacccgcccagaagaccgacagcctgggcgacagcggcagccacagcggcctgcacagcacccccgagcagaccatggccgtgcagagccagcaccaccagcagtacatcgacgtgagccacgtgttccccgagttccccgcccccgacctgggcagcttcctgctgcaggacggcgtgaccctgcacgacgtgaaggccctgcagctggtgtacagaagacactgcgaggccaccgtggacgtggtgatgaacctgcagttccactacatcgagaagctgtggctgagcttctggaacagcaaggccagcagcagcgacggccccaccagcctgcccgccagcgacgaggaccccgagggcgccgtgctgcccaaggacaagctgatcagcctgtgccagtgcgaccccatcctgagatggatgagaagctgcgaccacatcctgtaccaggccctggtggagatcctgatccccgacgtgctgagacccgtgcccagcaccctgacccaggccatcagaaacttcgccaagagcctggagggctggctgaccaacgccatgagcgacttcccccagcaggtgatccagaccaaggtgggcgtggtgagcgccttcgcccagaccctgagaagatacaccagcctgaaccacctggcccaggccgccagagccgtgctgcagaacaccagccagatcaaccagatgctgagcgacctgaacagagtggacttcgccaacgtgcaggagcaggccagctgggtgtgccagtgcgaggagagcgtggtgcagagactggagcaggacttcaagctgaccctgcagcagcagagcagcctggaccagtgggccagctggctggacagcgtggtgacccaggtgctgaagcagcacgccggcagccccagcttccccaaggccgccagacagttcctgctgaagtggagcttctacagcagcatggtgatcagagacctgaccctgagaagcgccgccagcttcggcagcttccacctgatcagactgctgtacgacgagtacatgttctacctggtggagcacagagtggccgaggccaccggcgagacccccatcgccgtgatgggcgagttcaacgacctggccagcctgagcctgaccctgctggacaaggacgacatgggcgacgagcagagaggcagcgaggccggccccgacgccagaagcctgggcgagcccctggtgaagagagagagaagcgaccccaaccacagcctgcagggcatctag

SEQ ID NO: 96718 - DNA, 2940 bp, Artificial Sequence
  Description of Artificial Sequence: Synthetic coding sequence
atggccacccaggcctacaccgagctgcaggccgcccccccccccagccagcccccccaggcccccccccaggcccagccccagcccccccccccccccccccccgccgccccccagcccccccagccccccaccgccgccgccaccccccagccccagtacgtgaccgagctgcagagcccccagccccaggcccagccccccggcggccagaagcagtacgtgaccgagctgcccgccgtgcccgcccccagccagcccaccggcgcccccacccccagccccgccccccagcagtacatcgtggtgaccgtgagcgagggcgccatgagagccagcgagaccgtgagcgaggccagccccggcagcaccgccagccagaccggcgtgcccacccaggtggtgcagcaggtgcagggcacccagcagagactgctggtgcagaccagcgtgcaggccaagcccggccacgtgagccccctgcagctgaccaacatccaggtgccccagcaggccctgcccacccagagactggtggtgcagagcgccgcccccggcagcaagggcggccaggtgagcctgaccgtgcacggcacccagcaggtgcacagcccccccgagcagagccccgtgcaggccaacagcagcagcagcaagaccgccggcgcccccaccggcaccgtgccccagcagctgcaggtgcacggcgtgcagcagagcgtgcccgtgacccaggagagaagcgtggtgcaggccaccccccaggcccccaagcccggccccgtgcagcccctgaccgtgcagggcctgcagcccgtgcacgtggcccaggaggtgcagcagctgcagcaggtgcccgtgccccacgtgtacagcagccaggtgcagtacgtggagggcggcgacgccagctacaccgccagcgccatcagaagcagcacctacagctaccccgagacccccctgtacacccagaccgccagcaccagctactacgaggccgccggcaccgccacccaggtgagcacccccgccaccagccaggccgtggccagcagcggcagcatgcccatgtacgtgagcggcagccaggtggtggccagcagcaccagcaccggcgccggcgccagcaacagcagcggcggcggcggcagcggcggcggcggcggcggcggcggcggcggcggcggcggcggcagcggcagcaccggcggcggcggcagcggcgccggcacctacgtgatccagggcggctacatgctgggcagcgccagccagagctacagccacaccaccagagccagccccgccaccgtgcagtggctgctggacaactacgagaccgccgagggcgtgagcctgcccagaagcaccctgtactgccactacctgctgcactgccaggagcagaagctggagcccgtgaacgccgccagcttcggcaagctgatcagaagcgtgttcatgggcctgagaaccagaagactgggcaccagaggcaacagcaagtaccactactacggcctgagaatcaaggccagcagccccctgctgagactgatggaggaccagcagcacatggccatgagaggccagcccttcagccagaagcagagactgaagcccatccagaagatggagggcatgaccaacggcgtggccgtgggccagcagcccagcaccggcctgagcgacatcagcgcccaggtgcagcagtaccagcagttcctggacgccagcagaagcctgcccgacttcaccgagctggacctgcagggcaaggtgctgcccgagggcgtgggccccggcgacatcaaggccttccaggtgctgtacagagagcactgcgaggccatcgtggacgtgatggtgaacctgcagttcaccctggtggagaccctgtggaagaccttctggagatacaacctgagccagcccagcgaggccccccccctggccgtgcacgacgaggccgagaagagactgcccaaggccatcctggtgctgctgagcaagttcgagcccgtgctgcagtggaccaagcactgcgacaacgtgctgtaccagggcctggtggagatcctgatccccgacgtgctgagacccatccccagcgccctgacccaggccatcagaaacttcgccaagagcctggagagctggctgacccacgccatggtgaacatccccgaggagatgctgagagtgaaggtggccgccgccggcgccttcgcccagaccctgagaagatacaccagcctgaaccacctggcccaggccgccagagccgtgctgcagaacaccgcccagatcaaccagatgctgagcgacctgaacagagtggacttcgccaacgtgcaggagcaggccagctgggtgtgcagatgcgaggacagagtggtgcagagactggagcaggacttcaaggtgaccctgcagcagcagaacagcctggagcagtgggccgcctggctggacggcgtggtgagccaggtgctgaagccctaccagggcagcgccggcttccccaaggccgccaagctgttcctgctgaagtggagcttctacagcagcatggtgatcagagacctgaccctgagaagcgccgccagcttcggcagcttccacctgatcagactgctgtacgacgagtacatgtactacctgatcgagcacagagtggcccaggccaagggcgagacccccatcgccgtgatgggcgagttcgccaacctggccaccagcctgaaccccctggaccccgacaaggacgaggaggaggaggaggaggaggagagcgaggacgagctgccccaggacatcagcctggccgccggcggcgagagccccgccctgggccccgagaccctggagccccccgccaagctggccagaaccgacgccagaggcctgttcgtgcaggccctgcccagcagctag

SEQ ID NO: 96719 - DNA, 2172 bp, Artificial Sequence
  Description of Artificial Sequence: Synthetic coding sequence
atgcagaacagcgagggcggcgccgacagccccgccagcgtggccctgagacccagcgccgccgccccccccgtgcccgccagcccccagagagtgctggtgcaggccgccagcagcaaccccaagggcgcccagatgcagcccatcagcctgcccagagtgcagcaggtgccccagcaggtgcagcccgtgcagcacgtgtaccccgcccaggtgcagtacgtggagggcggcgacgccgtgtacaccaacggcgccatcagaaccgcctacacctacaaccccgagccccagatgtacgcccccagcagcaccgccagctacttcgaggcccccggcggcgcccaggtgaccgtggccgccagcagcccccccgccgtgcccagccacagcatggtgggcatcaccatggacgtgggcggcagccccatcgtgagcagcgccggcgcctacctgatccacggcggcatggacagcaccagacacagcctggcccacaccagcagaagcagccccgccaccctggagatggccatcgagaacctgcagaagagcgagggcatcaccagccacaagagcggcctgctgaacagccacctgcagtggctgctggacaactacgagaccgccgagggcgtgagcctgcccagaagcagcctgtacaaccactacctgagacactgccaggagcacaagctggaccccgtgaacgccgccagcttcggcaagctgatcagaagcgtgttcatgggcctgagaaccagaagactgggcaccagaggcaacagcaagtaccactactacggcatcagactgaagcccgacagccccctgaacagactgcaggaggacacccagtacatggccatgagacagcagcccatgcaccagaagcccagatacagacccgcccagaagaccgacagcctgggcgacagcggcagccacagcggcctgcacagcacccccgagcagaccatggccgtgcagagccagcaccaccagcagtacatcgacgtgagccacgtgttccccgagttccccgcccccgacctgggcagcttcctgctgcaggacggcgtgaccctgcacgacgtgaaggccctgcagctggtgtacagaagacactgcgaggccaccgtggacgtggtgatgaacctgcagttccactacatcgagaagctgtggctgagcttctggaacagcaaggccagcagcagcgacggccccaccagcctgcccgccagcgacgaggaccccgagggcgccgtgctgcccaaggacaagctgatcagcctgtgccagtgcgaccccatcctgagatggatgagaagctgcgaccacatcctgtaccaggccctggtggagatcctgatccccgacgtgctgagacccgtgcccagcaccctgacccaggccatcagaaacttcgccaagagcctggagggctggctgaccaacgccatgagcgacttcccccagcaggtgatccagaccaaggtgggcgtggtgagcgccttcgcccagaccctgagaagatacaccagcctgaaccacctggcccaggccgccagagccgtgctgcagaacaccagccagatcaaccagatgctgagcgacctgaacagagtggacttcgccaacgtgcaggagcaggccagctgggtgtgccagtgcgaggagagcgtggtgcagagactggagcaggacttcaagctgaccctgcagcagcagagcagcctggaccagtgggccagctggctggacagcgtggtgacccaggtgctgaagcagcacgccggcagccccagcttccccaaggccgccagacagttcctgctgaagtggagcttctacagcagcatggtgatcagagacctgaccctgagaagcgccgccagcttcggcagcttccacctgatcagactgctgtacgacgagtacatgttctacctggtggagcacagagtggccgaggccaccggcgagacccccatcgccgtgatgggcgagttcaacgacctggccagcctgagcctgaccctgctggacaaggacgacatgggcgacgagcagagaggcagcgaggccggccccgacgccagaagcctgggcgagcccctggtgaagagagagagaagcgaccccaaccacagcctgcagggcatctag

SEQ ID NO: 96720 - DNA, 2097 bp, Artificial Sequence; identical to SEQ ID NO: 96717
  Description of Artificial Sequence: Synthetic coding sequence

SEQ ID NO: 96721 - DNA, 1851 bp, Artificial Sequence
  Description of Artificial Sequence: Synthetic coding sequence
atggccgaggacgagcccgacgccaagagccccaagaccggcggcagagccccccccggcggcgccgaggccggcgagcccaccaccctgctgcagagactgagaggcaccatcagcaaggccgtgcagaacaaggtggagggcatcctgcaggacgtgcagaagttcagcgacaacgacaagctgtacctgtacctgcagctgcccagcggccccaccaccggcgacaagagcagcgagcccagcaccctgagcaacgaggagtacatgtacgcctacagatggatcagaaaccacctggaggagcacaccgacacctgcctgcccaagcagagcgtgtacgacgcctacagaaagtactgcgagagcctggcctgctgcagacccctgagcaccgccaacttcggcaagatcatcagagagatcttccccgacatcaaggccagaagactgggcggcagaggccagagcaagtactgctacagcggcatcagaagaaagaccctggtgagcatgccccccctgcccggcctggacctgaagggcagcgagagccccgagatgggccccgaggtgacccccgcccccagagacgagctggtggaggccgcctgcgccctgacctgcgactgggccgagagaatcctgaagagaagcttcagcagcatcgtggaggtggccagattcctgctgcagcagcacctgatcagcgccagaagcgcccacgcccacgtgctgaaggccatgggcctggccgaggaggacgagcacgcccccagagagagaagcagcaagcccaagaacggcctggagaaccccgagggcggcgcccacaagaagcccgagagactggcccagccccccaaggacctggaggccagaaccggcgccggccccctggccagaggcgagagaaagaagagcgtggtggagagcagcgcccccggcgccaacaacctgcaggtgaacgccctggtggccagactgcccctgctgctgcccagagcccccagaagcctgatcccccccatccccgtgagcccccccatcctggcccccagactgagcagcggcgccctgaaggtggccaccctgcccctgagcagcagagccggcgccccccccgccgccgtgcccatcatcaacatgatcctgcccaccgtgcccgccctgcccggccccggccccggccccggcagagccccccccggcggcctgacccagcccagaggcaccgagaacagagaggtgggcatcggcggcgaccagggcccccacgacaagggcgtgaagagaaccgccgaggtgcccgtgagcgaggccagcggccaggccccccccgccaaggccgccaagcaggacatcgaggacaccgccagcgacgccaagagaaagagaggcagacccagaaagaagagcggcggcagcggcgagagaaacagcacccccctgaagagcgccgccgccatggagagcgcccagagcagcagactgccctgggagacctggggcagcggcggcgagggcaacagcgccggcggcgccgagagacccggccccatgggcgaggccgagaagggcgccgtgctggcccagggccagggcgacggcaccgtgagcaagggcggcagaggccccggcagccagcacaccaaggaggccgaggacaagatccccctggtgcccagcaaggtgagcgtgatcaagggcagcagaagccagaaggaggccttccccctggccaagggcgaggtggacaccgccccccagggcaacaaggacctgaaggagcacgtgctgcagagcagcctgagccaggagcacaaggaccccaaggccacccccccctag

SEQ ID NO: 96722 - DNA, 1851 bp, Artificial Sequence; identical to SEQ ID NO: 96721
  Description of Artificial Sequence: Synthetic coding sequence

SEQ ID NO: 96723 - DNA, 1791 bp, Artificial Sequence
  Description of Artificial Sequence: Synthetic coding sequence
atggccgaggacgagcccgacgccaagagccccaagaccggcggcagagccccccccggcggcgccgaggccggcgagcccaccaccctgctgcagagactgagaggcaccatcagcaaggccgtgcagaacaaggtggagggcatcctgcaggacgtgcagaagttcagcgacaacgacaagctgtacctgtacctgcagctgcccagcggccccaccaccggcgacaagagcagcgagcccagcaccctgagcaacgaggagtacatgtacgcctacagatggatcagaaaccacctggaggagcacaccgacacctgcctgcccaagcagagcgtgtacgacgcctacagaaagtactgcgagagcctggcctgctgcagacccctgagcaccgccaacttcggcaagatcatcagagagatcttccccgacatcaaggccagaagactgggcggcagaggccagagcaagtactgctacagcggcatcagaagaaagaccctggtgagcatgccccccctgcccggcctggacctgaagggcagcgagagccccgagatgggccccgaggtgacccccgcccccagagacgagctggtggaggccgcctgcgccctgacctgcgactgggccgagagaatcctgaagagaagcttcagcagcatcgtggaggtggccagattcctgctgcagcagcacctgatcagcgccagaagcgcccacgcccacgtgctgaaggccatgggcctggccgaggaggacgagcacgcccccagagagagaagcagcaagcccaagaacggcctggagaaccccgagggcggcgcccacaagaagcccgagagactggcccagccccccaaggacctggaggccagaaccggcgccggccccctggccagaggcgagagaaagaagagcgtggtggagagcagcgcccccggcgccaacaacctgcaggtgaacgccctggtggccagactgcccctgctgctgcccagagcccccagaagcctgatcccccccatccccgtgagcccccccatcctggcccccagactgagcagcggcgccctgaaggtggccaccctgcccctgagcagcagagccggcgccccccccgccgccgtgcccatcatcaacatgatcctgcccaccgtgcccgccctgcccggccccggccccggccccggcagagccccccccggcggcctgacccagcccagaggcaccgagaacagagaggtgggcatcggcggcgaccagggcccccacgacaagggcgtgaagagaaccgccgaggtgcccgtgagcgaggccagcggccaggccccccccgccaaggccgccaagcaggacatcgaggacaccgccagcgacgccaagagaaagagaggcagacccagaaagaagagcggcggcagcggcgagagaaacagcacccccctgaagagcgccgccgccatggagagcgcccagagcagcagactgccctgggagacctggggcagcggcggcgagggcaacagcgccggcggcgccgagagacccggccccatgggcgaggccgagaagggcgccgtgctggcccagggccagggcgacggcaccgtgagcaagggcggcagaggccccggcagccagcacaccaaggaggccgaggacaagatccccctggtgcccagcaaggtgagcgtgatcaagggcagcagaagccagaaggaggccttccccctggccaagggcgaggtggacaccgccccccagggcaacaaggacctgaagtag

SEQ ID NO: 96724 - DNA, 357 bp, Artificial Sequence
  Description of Artificial Sequence: Synthetic coding sequence
atggccgaggacgagcccgacgccaagagccccaagaccggcggcagagccccccccggcggcgccgaggccggcgagcccaccaccctgctgcagagactgagaggcaccatcagcaaggccgtgcagaacaaggtggagggcatcctgcaggacgtgcagaagttcagcgacaacgacaagctgtacctgtacctgcagctgcccagcggccccaccaccggcgacaagagcagcgagcccagcaccctgagcaacgaggagtacatgtacgcctacagatggatcagaaaccacctggaggagcacaccgacacctgcctgcccaagcagagcgtgtacgacgcctacagatag

SEQ ID NO: 96725 - DNA, 693 bp, Artificial Sequence
  Description of Artificial Sequence: Synthetic coding sequence
atggccgaggacgagcccgacgccaagagccccaagaccggcggcagagccccccccggcggcgccgaggccggcgagcccaccaccctgctgcagagactgagaggcaccatcagcaaggccgtgcagaacaaggtggagggcatcctgcaggacgtgcagaagttcagcgacaacgacaagctgtacctgtacctgcagctgcccagcggccccaccaccggcgacaagagcagcgagcccagcaccctgagcaacgaggagtacatgtacgcctacagatggatcagaaaccacctggaggagcacaccgacacctgcctgcccaagcagagcgtgtacgacgcctacagaaagtactgcgagagcctggcctgctgcagacccctgagcaccgccaacttcggcaagatcatcagagagatcttccccgacatcaaggccagaagactgggcggcagaggccagagcaagtactgctacagcggcatcagaagaaagaccctggtgagcatgccccccctgcccggcctggacctgaagggcagcgagagccccgagatgggccccgaggtgacccccgcccccagagacgagctggtggaggccgcctgcgccctgacctgcgactgggccgagagaatcctgaagagaagcttcagcagcatcgtggaggtggccagattcctgtag

SEQ ID NO: 96726 - DNA, 372 bp, Artificial Sequence
  Description of Artificial Sequence: Synthetic coding sequence
atggccgaggacgagcccgacgccaagagccccaagaccggcggcagagccccccccggcggcgccgaggccggcgagcccaccaccctgctgcagagactgagaggcaccatcagcaaggccgtgcagaacaaggtggagggcatcctgcaggacgtgcagaagttcagcgacaacgacaagctgtacctgtacctgcagctgcccagcggccccaccaccggcgacaagagcagcgagcccagcaccctgagcaacgaggagtacatgtacgcctacagatggatcagaaaccacctggaggagcacaccgacacctgcctgcccaagcagagcgtgtacgacgcctacagaaagtactgcgagagctag

SEQ ID NO: 96727 - DNA, 291 bp, Artificial Sequence
  Description of Artificial Sequence: Synthetic coding sequence
atggccgaggacgagcccgacgccaagagccccaagaccggcggcagagccccccccggcggcgccgaggccggcgagcccaccaccctgctgcagagactgagaggcaccatcagcaaggccgtgcagaacaaggtggagggcatcctgcaggacgtgcagaagttcagcgacaacgacaagctgtacctgtacctgcagctgcccagcggccccaccaccggcgacaagagcagcgagcccagcaccctgagcaacgaggagtacatgtacgcctacagatggatctag

SEQ ID NO: 96728 - DNA, 321 bp, Artificial Sequence
  Description of Artificial Sequence: Synthetic coding sequence
atggccgaggacgagcccgacgccaagagccccaagaccggcggcagagccccccccggcggcgccgaggccggcgagcccaccaccctgctgcagagactgagaggcaccatcagcaaggccgtgcagaacaaggtggagggcatcctgcaggacgtgcagaagttcagcgacaacgacaagctgtacctgtacctgcagctgcccagcggccccaccaccggcgacaagagcagcgagcccagcaccctgagcaacgaggagtacatgtacgcctacagatggatcagaaaccacctggaggagcacaccgacacctag

SEQ ID NO: 96729 - DNA, 555 bp, Artificial Sequence
  Description of Artificial Sequence: Synthetic coding sequence
atggccgaggacgagcccgacgccaagagccccaagaccggcggcagagccccccccggcggcgccgaggccggcgagcccaccaccctgctgcagagactgagaggcaccatcagcaaggccgtgcagaacaaggtggagggcatcctgcaggacgtgcagaagttcagcgacaacgacaagctgtacctgtacctgcagctgcccagcggccccaccaccggcgacaagagcagcgagcccagcaccctgagcaacgaggagtacatgtacgcctacagatggatcagaaaccacctggaggagcacaccgacacctgcctgcccaagcagagcgtgtacgacgcctacagaaagtactgcgagagcctggcctgctgcagacccctgagcaccgccaacttcggcaagatcatcagagagatcttccccgacatcaaggccagaagactgggcggcagaggccagagcaagtactgctacagcggcatcagaagaaagaccctggtgagcatgccccccctgcccggcctggacctgaagggcagcgagtag

SEQ ID NO: 96730 - DNA, 1731 bp, Artificial Sequence
  Description of Artificial Sequence: Synthetic coding sequence
atggccgaggacgagcccgacgccaagagccccaagaccggcggcagagccccccccggcggcgccgaggccggcgagcccaccaccctgctgcagagactgagaggcaccatcagcaaggccgtgcagaacaaggtggagggcatcctgcaggacgtgcagaagttcagcgacaacgacaagctgtacctgtacctgcagctgcccagcggccccaccaccggcgacaagagaaagtactgcgagagcctggcctgctgcagacccctgagcaccgccaacttcggcaagatcatcagagagatcttccccgacatcaaggccagaagactgggcggcagaggccagagcaagtactgctacagcggcatcagaagaaagaccctggtgagcatgccccccctgcccggcctggacctgaagggcagcgagagccccgagatgggccccgaggtgacccccgcccccagagacgagctggtggaggccgcctgcgccctgacctgcgactgggccgagagaatcctgaagagaagcttcagcagcatcgtggaggtggccagattcctgctgcagcagcacctgatcagcgccagaagcgcccacgcccacgtgctgaaggccatgggcctggccgaggaggacgagcacgcccccagagagagaagcagcaagcccaagaacggcctggagaaccccgagggcggcgcccacaagaagcccgagagactggcccagccccccaaggacctggaggccagaaccggcgccggccccctggccagaggcgagagaaagaagagcgtggtggagagcagcgcccccggcgccaacaacctgcaggtgaacgccctggtggccagactgcccctgctgctgcccagagcccccagaagcctgatcccccccatccccgtgagcccccccatcctggcccccagactgagcagcggcgccctgaaggtggccaccctgcccctgagcagcagagccggcgccccccccgccgccgtgcccatcatcaacatgatcctgcccaccgtgcccgccctgcccggccccggccccggccccggcagagccccccccggcggcctgacccagcccagaggcaccgagaacagagaggtgggcatcggcggcgaccagggcccccacgacaagggcgtgaagagaaccgccgaggtgcccgtgagcgaggccagcggccaggccccccccgccaaggccgccaagcaggacatcgaggacaccgccagcgacgccaagagaaagagaggcagacccagaaagaagagcggcggcagcggcgagagaaacagcacccccctgaagagcgccgccgccatggagagcgcccagagcagcagactgccctgggagacctggggcagcggcggcgagggcaacagcgccggcggcgccgagagacccggccccatgggcgaggccgagaagggcgccgtgctggcccagggccagggcgacggcaccgtgagcaagggcggcagaggccccggcagccagcacaccaaggaggccgaggacaagatccccctggtgcccagcaaggtgagcgtgatcaagggcagcagaagccagaaggaggccttccccctggccaagggcgaggtggacaccgccccccagggcaacaaggacctgaaggagcacgtgctgcagagcagcctgagccaggagcacaaggaccccaaggccacccccccctag

SEQ ID NO: 96731 - DNA, 1851 bp, Artificial Sequence; identical to SEQ ID NO: 96721
  Description of Artificial Sequence: Synthetic coding sequence

SEQ ID NO: 96732 - DNA, 498 bp, Artificial Sequence
  Description of Artificial Sequence: Synthetic coding sequence
atggccgaggacgagcccgacgccaagagccccaagaccggcggcagagccccccccggcggcgccgaggccggcgagcccaccaccctgctgcagagactgagaggcaccatcagcaaggccgtgcagaacaaggtggagggcatcctgcaggacgtgcagaagttcagcgacaacgacaagctgtacctgtacctgcagctgcccagcggccccaccaccggcgacaagagcagcgagcccagcaccctgagcaacgaggagtacatgtacgcctacagatggatcagaaaccacctggaggagcacaccgacacctgcctgcccaagcagagcgtgtacgacgcctacagaaagtactgcgagagcctggcctgctgcagacccctgagcaccgccaacttcggcaagatcatcagagagatcttccccgacatcaaggccagaagactgggcggcagaggccagagcaagtactgctacagcggcatcagatag

SEQ ID NO: 96733 - DNA, 2787 bp, Artificial Sequence
  Description of Artificial Sequence: Synthetic coding sequence
atggccaaggtgcccgagctggaggacaccttcctgcaggcccagcccgccccccagctgagccccggcatccaggaggactgctgcgtgcagctgctgggcaagggcctgctggtgtaccccgaggagaccgtgtacctggccgccgagggccagcccggcggcgagcagggcggcggcgagaagggcgaggaccccgagctgcccggcgccgtgaagagcgagatgcacctgaacaacggcaacttcagcagcgaggaggaggacgccgacaaccacgacagcaagaccaaggccgccgaccagtacctgagccagaagaagaccatcacccagatcgtgaaggacaagaagaagcagacccagctgaccctgcagtggctggaggagaactacatcgtgtgcgagggcgtgtgcctgcccagatgcatcctgtacgcccactacctggacttctgcagaaaggagaagctggagcccgcctgcgccgccaccttcggcaagaccatcagacagaagttccccctgctgaccaccagaagactgggcaccagaggccacagcaagtaccactactacggcatcggcatcaaggagagcagcgcctactaccacagcgtgtacagcggcaagggcctgaccagattcagcggcagcaagctgaagaacgagggcggcttcaccagaaagtacagcctgagcagcaagaccggcaccctgctgcccgagttccccagcgcccagcacctggtgtaccagggctgcatcagcaaggacaaggtggacaccctgatcatgatgtacaagacccactgccagtgcatcctggacaacgccatcaacggcaacttcgaggagatccagcacttcctgctgcacttctggcagggcatgcccgaccacctgctgcccctgctggagaaccccgtgatcatcgacatcttctgcgtgtgcgacagcatcctgtacaaggtgctgaccgacgtgctgatccccgccaccatgcaggagatgcccgagagcctgctggccgacatcagaaacttcgccaagaactgggagcagtgggtggtgagcagcctggagaacctgcccgaggccctgaccgacaagaagatccccatcgtgagaagattcgtgagcagcctgaagagacagaccagcttcctgcacctggcccagatcgccagacccgccctgttcgaccagcacgtggtgaacagcatggtgagcgacatcgagagagtggacctgaacagcatcggcagccaggccctgctgaccatcagcggcagcaccgacaccgagagcggcatctacaccgagcacgacagcatcaccgtgttccaggagctgaaggacctgctgaagaagaacgccaccgtggaggccttcatcgagtggctggacaccgtggtggagcagagagtgatcaagaccagcaagcagaacggcagaagcctgaagaagagagcccaggacttcctgctgaagtggagcttcttcggcgccagagtgatgcacaacctgaccctgaacaacgccagcagcttcggcagcttccacctgatcagaatgctgctggacgagtacatcctgctggccatggagacccagttcaacaacgacaaggagcaggagctgcagaacctgctggacaagtacatgaagaacagcgacgccagcaaggccgccttcaccgccagccccagcagctgcttcctggccaacagaaacaagggcagcatggtgagcagcgacgccgtgaagaacgagagccacgtggagaccacctacctgcccctgcccagcagccagcccggcggcctgggccccgccctgcaccagttccccgccggcaacaccgacaacatgcccctgaccggccagatggagctgagccagatcgccggccacctgatgaccccccccatcagccccgccatggccagcagaggcagcgtgatcaaccagggccccatggccggcagaccccccagcgtgggccccgtgctgagcgcccccagccactgcagcacctaccccgagcccatctaccccaccctgccccaggccaaccacgacttctacagcaccagcagcaactaccagaccgtgttcagagcccagccccacagcaccagcggcctgtacccccaccacaccgagcacggcagatgcatggcctggaccgagcagcagctgagcagagacttcttcagcggcagctgcgccggcagcccctacaacagcagaccccccagcagctacggccccagcctgcaggcccaggacagccacaacatgcagttcctgaacaccggcagcttcaacttcctgagcaacaccggcgccgccagctgccagggcgccaccctgccccccaacagccccaacggctactacggcagcaacatcaactaccccgagagccacagactgggcagcatggtgaaccagcacgtgagcgtgatcagcagcatcagaagcctgcccccctacagcgacatccacgaccccctgaacatcctggacgacagcggcagaaagcagaccagcagcttctacaccgacaccagcagccccgtggcctgcagaacccccgtgctggccagcagcctgcagacccccatccccagcagcagcagccagtgcatgtacggcaccagcaaccagtaccccgcccaggagaccctggacagccacggcaccagcagcagagagatggtgagcagcctgccccccatcaacaccgtgttcatgggcaccgccgccggcggcacctag

SEQ ID NO: 96734 - DNA, 4122 bp, Artificial Sequence
  Description of Artificial Sequence: Synthetic coding sequence
atggccgaggagcagcagcagccccccccccagcagcccgacgcccaccagcagctgccccccagcgcccccaacagcggcgtggccctgcccgccctggtgcccggcctgcccggcaccgaggccagcgccctgcagcacaagatcaagaacagcatctgcaagaccgtgcagagcaaggtggactgcatcctgcaggaggtggagaagttcaccgacctggagaagctgtacctgtacctgcagctgcccagcggcctgagcaacggcgagaagagcgaccagaacgccatgagcagcagcagagcccagcagatgcacgccttcagctggatcagaaacaccctggaggagcaccccgagaccagcctgcccaagcaggaggtgtacgacgagtacaagagctactgcgacaacctgggctaccaccccctgagcgccgccgacttcggcaagatcatgaagaacgtgttccccaacatgaaggccagaagactgggcaccagaggcaagagcaagtactgctacagcggcctgagaaagaaggccttcgtgcacatgcccaccctgcccaacctggacttccacaagaccggcgacggcctggagggcgccgagcccagcggccagctgcagaacatcgacgaggaggtgatcagcagcgcctgcagactggtgtgcgagtgggcccagaaggtgctgagccagcccttcgacaccgtgctggagctggccagattcctggtgaagagccactacatcggcaccaagagcatggccgccctgaccgtgatggccgccgcccccgccggcatgaagggcatcacccagcccagcgccttcatccccaccgccgagagcaacagcttccagccccaggtgaagaccctgcccagccccatcgacgccaagcagcagctgcagagaaagatccagaagaagcagcaggagcagaagctgcagagccccctgcccggcgagagcgccgccaagaagagcgagagcgccaccagcaacggcgtgaccaacctgcccaacggcaaccccagcatcctgagcccccagcccatcggcatcgtggtggccgccgtgcccagccccatccccgtgcagagaaccagacagctggtgaccagccccagccccatgagcagcagcgacggcaaggtgctgcccctgaacgtgcaggtggtgacccagcacatgcagagcgtgaagcaggcccccaagaccccccagaacgtgcccgccagccccggcggcgacagaagcgccagacacagatacccccagatcctgcccaagcccgccaacaccagcgccctgaccatcagaagccccaccaccgtgctgttcaccagcagccccatcaagaccgccgtggtgcccgccagccacatgagcagcctgaacgtggtgaagatgaccaccatcagcctgacccccagcaacagcaacacccccctgaagcacagcgccagcgtgagcagcgccaccggcaccaccgaggagagcagaagcgtgccccagatcaagaacggcagcgtggtgagcctgcagagccccggcagcagaagcagcagcgccggcggcaccagcgccgtggaggtgaaggtggagcccgagaccagcagcgacgagcaccccgtgcagtgccaggagaacagcgacgaggccaaggccccccagacccccagcgccctgctgggccagaagagcaacaccgacggcgccctgcagaagcccagcaacgagggcgtgatcgagatcaaggccaccaaggtgtgcgaccagagaaccaagtgcaagagcagatgcaacgagatgctgcccggcaccagcaccggcaacaaccagagcaccatcaccctgagcgtggccagccagaacctgaccttcaccagcagcagcagcccccccaacggcgacagcatcaacaaggaccccaagctgtgcaccaagagccccagaaagagactgagcagcaccctgcaggagacccaggtgccccccgtgaagaagcccatcgtggagcagctgagcgccgccaccatcgagggccagaagcagggcagcgtgaagaaggaccagaaggtgccccacagcggcaagaccgagggcagcaccgccggcgcccagatccccagcaaggtgagcgtgaacgtgagcagccacatcggcgccaaccagcccctgaacagcagcgccctggtgatcagcgacagcgccctggagcagcagaccacccccagcagcagccccgacatcaaggtgaagctggagggcagcgtgttcctgctggacagcgacagcaagagcgtgggcagcttcaaccccaacggctggcagcagatcaccaaggacagcgagttcatcagcgccagctgcgagcagcagcaggacatcagcgtgatgaccatccccgagcacagcgacatcaacgacctggagaagagcgtgtgggagctggagggcatgccccaggacacctacagccagcagctgcacagccagatccaggagagcagcctgaaccagatccaggcccacagcagcgaccagctgcccctgcagagcgagctgaaggagttcgagcccagcgtgagccagaccaacgagagctacttccccttcgacgacgagctgacccaggacagcatcgtggaggagctggtgctgatggagcagcagatgagcatgaacaacagccacagctacggcaactgcctgggcatgaccctgcagagccagagcgtgacccccggcgcccccatgagcagccacaccagcagcacccacttctaccaccccatccacagcaacggcacccccatccacacccccacccccacccccacccccacccccacccccacccccacccccacccccaccagcgagatgatcgccggcagccagagcctgagcagagagagcccctgcagcagactggcccagaccacccccgtggacagcgccctgggcagcagcagacacacccccatcggcaccccccacagcaactgcagcagcagcgtgccccccagccccgtggagtgcagaaaccccttcgccttcacccccatcagcagcagcatggcctaccacgacgccagcatcgtgagcagcagccccgtgaagcccatgcagagacccatggccacccaccccgacaagaccaagctggagtggatgaacaacggctacagcggcgtgggcaacagcagcgtgagcggccacggcatcctgcccagctaccaggagctggtggaggacagattcagaaagccccacgccttcgccgtgcccggccagagctaccagagccagagcagacaccacgacaccaacttcggcagactgacccccgtgagccccgtgcagcaccagggcgccaccgtgaacaacaccaacaagcaggagggcttcgccgtgcccgcccccctggacaacaagggcaccaacagcagcgccagcagcaacttcagatgcagaagcgtgagccccgccgtgcacagacagagaaacctgagcggcagcaccctgtaccccgtgagcaacatccccagaagcaacgtgacccccttcggcagccccgtgacccccgaggtgcacgtgttcaccaacgtgcacaccgacgcctgcgccaacaacatcgcccagagaagccagagcgtgcccctgaccgtgatgatgcagaccgccttccccaacgccctgcagaagcaggccaacagcaagaagatcaccaacgtgctgctgagcaagctggacagcgacaacgacgacgccgtgagaggcctgggcatgaacaacctgcccagcaactacaccgccagaatgaacctgacccagatcctggagcccagcaccgtgttccccagcgccaacccccagaacatgatcgacagcagcaccagcgtgtacgagttccagacccccagctacctgaccaagagcaacagcaccggccagatcaacttcagccccggcgacaaccaggcccagagcgagatcggcgagcagcagctggacttcaacagcaccgtgaaggacctgctgagcggcgacagcctgcagaccaaccagcagctgaagtaccccgacgtgctgggcgagtag

SEQ ID NO: 96735 - DNA, 3846 bp, Artificial Sequence
  Description of Artificial Sequence: Synthetic coding sequence
atgagcagcagcagagcccagcagatgcacgccttcagctggatcagaaacaccctggaggagcaccccgagaccagcctgcccaagcaggaggtgtacgacgagtacaagagctactgcgacaacctgggctaccaccccctgagcgccgccgacttcggcaagatcatgaagaacgtgttccccaacatgaaggccagaagactgggcaccagaggcaagagcaagtactgctacagcggcctgagaaagaaggccttcgtgcacatgcccaccctgcccaacctggacttccacaagaccggcgacggcctggagggcgccgagcccagcggccagctgcagaacatcgacgaggaggtgatcagcagcgcctgcagactggtgtgcgagtgggcccagaaggtgctgagccagcccttcgacaccgtgctggagctggccagattcctggtgaagagccactacatcggcaccaagagcatggccgccctgaccgtgatggccgccgcccccgccggcatgaagggcatcacccagcccagcgccttcatccccaccgccgagagcaacagcttccagccccaggtgaagaccctgcccagccccatcgacgccaagcagcagctgcagagaaagatccagaagaagcagcaggagcagaagctgcagagccccctgcccggcgagagcgccgccaagaagagcgagagcgccaccagcaacggcgtgaccaacctgcccaacggcaaccccagcatcctgagcccccagcccatcggcatcgtggtggccgccgtgcccagccccatccccgtgcagagaaccagacagctggtgaccagccccagccccatgagcagcagcgacggcaaggtgctgcccctgaacgtgcaggtggtgacccagcacatgcagagcgtgaagcaggcccccaagaccccccagaacgtgcccgccagccccggcggcgacagaagcgccagacacagatacccccagatcctgcccaagcccgccaacaccagcgccctgaccatcagaagccccaccaccgtgctgttcaccagcagccccatcaagaccgccgtggtgcccgccagccacatgagcagcctgaacgtggtgaagatgaccaccatcagcctgacccccagcaacagcaacacccccctgaagcacagcgccagcgtgagcagcgccaccggcaccaccgaggagagcagaagcgtgccccagatcaagaacggcagcgtggtgagcctgcagagccccggcagcagaagcagcagcgccggcggcaccagcgccgtggaggtgaaggtggagcccgagaccagcagcgacgagcaccccgtgcagtgccaggagaacagcgacgaggccaaggccccccagacccccagcgccctgctgggccagaagagcaacaccgacggcgccctgcagaagcccagcaacgagggcgtgatcgagatcaaggccaccaaggtgtgcgaccagagaaccaagtgcaagagcagatgcaacgagatgctgcccggcaccagcaccggcaacaaccagagcaccatcaccctgagcgtggccagccagaacctgaccttcaccagcagcagcagcccccccaacggcgacagcatcaacaaggaccccaagctgtgcaccaagagccccagaaagagactgagcagcaccctgcaggagacccaggtgccccccgtgaagaagcccatcgtggagcagctgagcgccgccaccatcgagggccagaagcagggcagcgtgaagaaggaccagaaggtgccccacagcggcaagaccgagggcagcaccgccggcgcccagatccccagcaaggtgagcgtgaacgtgagcagccacatcggcgccaaccagcccctgaacagcagcgccctggtgatcagcgacagcgccctggagcagcagaccacccccagcagcagccccgacatcaaggtgaagctggagggcagcgtgttcctgctggacagcgacagcaagagcgtgggcagcttcaaccccaacggctggcagcagatcaccaaggacagcgagttcatcagcgccagctgcgagcagcagcaggacatcagcgtgatgaccatccccgagcacagcgacatcaacgacctggagaagagcgtgtgggagctggagggcatgccccaggacacctacagccagcagctgcacagccagatccaggagagcagcctgaaccagatccaggcccacagcagcgaccagctgcccctgcagagcgagctgaaggagttcgagcccagcgtgagccagaccaacgagagctacttccccttcgacgacgagctgacccaggacagcatcgtggaggagctggtgctgatggagcagcagatgagcatgaacaacagccacagctacggcaactgcctgggcatgaccctgcagagccagagcgtgacccccggcgcccccatgagcagccacaccagcagcacccacttctaccaccccatccacagcaacggcacccccatccacacccccacccccacccccacccccacccccacccccacccccacccccacccccaccagcgagatgatcgccggcagccagagcctgagcagagagagcccctgcagcagactggcccagaccacccccgtggacagcgccctgggcagcagcagacacacccccatcggcaccccccacagcaactgcagcagcagcgtgccccccagccccgtggagtgcagaaaccccttcgccttcacccccatcagcagcagcatggcctaccacgacgccagcatcgtgagcagcagccccgtgaagcccatgcagagacccatggccacccaccccgacaagaccaagctggagtggatgaacaacggctacagcggcgtgggcaacagcagcgtgagcggccacggcatcctgcccagctaccaggagctggtggaggacagattcagaaagccccacgccttcgccgtgcccggccagagctaccagagccagagcagacaccacgacaccaacttcggcagactgacccccgtgagccccgtgcagcaccagggcgccaccgtgaacaacaccaacaagcaggagggcttcgccgtgcccgcccccctggacaacaagggcaccaacagcagcgccagcagcaacttcagatgcagaagcgtgagccccgccgtgcacagacagagaaacctgagcggcagcaccctgtaccccgtgagcaacatccccagaagcaacgtgacccccttcggcagccccgtgacccccgaggtgcacgtgttcaccaacgtgcacaccgacgcctgcgccaacaacatcgcccagagaagccagagcgtgcccctgaccgtgatgatgcagaccgccttccccaacgccctgcagaagcaggccaacagcaagaagatcaccaacgtgctgctgagcaagctggacagcgacaacgacgacgccgtgagaggcctgggcatgaacaacctgcccagcaactacaccgccagaatgaacctgacccagatcctggagcccagcaccgtgttccccagcgccaacccccagaacatgatcgacagcagcaccagcgtgtacgagttccagacccccagctacctgaccaagagcaacagcaccggccagatcaacttcagccccggcgacaaccaggcccagagcgagatcggcgagcagcagctggacttcaacagcaccgtgaaggacctgctgagcggcgacagcctgcagaccaaccagcagctgtgcagctgccccagcagcctgctggccggcatgcagatgtag

SEQ ID NO: 96736 - DNA, 4383 bp, Artificial Sequence
  Description of Artificial Sequence: Synthetic coding sequence
atggccgaggagcagcagcagccccccccccagcagcccgacgcccaccagcagctgccccccagcgcccccaacagcggcgtggccctgcccgccctggtgcccggcctgcccggcaccgaggccagcgccctgcagcacaagatcaagaacagcatctgcaagaccgtgcagagcaaggtggactgcatcctgcaggaggtggagaagttcaccgacctggagaagctgtacctgtacctgcagctgcccagcggcctgagcaacggcgagaagagcgaccagaacgccatgagcagcagcagagcccagcagatgcacgccttcagctggatcagaaacaccctggaggagcaccccgagaccagcctgcccaagcaggaggtgtacgacgagtacaagagctactgcgacaacctgggctaccaccccctgagcgccgccgacttcggcaagatcatgaagaacgtgttccccaacatgaaggccagaagactgggcaccagaggcaagagcaagtactgctacagcggcctgagaaagaaggccttcgtgcacatgcccaccctgcccaacctggacttccacaagaccggcgacggcctggagggcgccgagcccagcggccagctgcagaacatcgacgaggaggtgatcagcagcgcctgcagactggtgtgcgagtgggcccagaaggtgctgagccagcccttcgacaccgtgctggagctggccagattcctggtgaagagccactacatcggcaccaagagcatggccgccctgaccgtgatggccgccgcccccgccggcatgaagggcatcacccagcccagcgccttcatccccaccgccgagagcaacagcttccagccccaggtgaagaccctgcccagccccatcgacgccaagcagcagctgcagagaaagatccagaagaagcagcaggagcagaagctgcagagccccctgcccggcgagagcgccgccaagaagagcgagagcgccaccagcaacggcgtgaccaacctgcccaacggcaaccccagcatcctgagcccccagcccatcggcatcgtggtggccgccgtgcccagccccatccccgtgcagagaaccagacagctggtgaccagccccagccccatgagcagcagcgacggcaaggtgctgcccctgaacgtgcaggtggtgacccagcacatgcagagcgtgaagcaggcccccaagaccccccagaacgtgcccgccagccccggcggcgacagaagcgccagacacagatacccccagatcctgcccaagcccgccaacaccagcgccctgaccatcagaagccccaccaccgtgctgttcaccagcagccccatcaagaccgccgtggtgcccgccagccacatgagcagcctgaacgtggtgaagatgaccaccatcagcctgacccccagcaacagcaacacccccctgaagcacagcgccagcgtgagcagcgccaccggcaccaccgaggagagcagaagcgtgccccagatcaagaacggcagcgtggtgagcctgcagagccccggcagcagaagcagcagcgccggcggcaccagcgccgtggaggtgaaggtggagcccgagaccagcagcgacgagcaccccgtgcagtgccaggagaacagcgacgaggccaaggccccccagacccccagcgccctgctgggccagaagagcaacaccgacggcgccctgcagaagcccagcaacgagggcgtgatcgagatcaaggccaccaaggtgtgcgaccagagaaccaagtgcaagagcagatgcaacgagatgctgcccggcaccagcaccggcaacaaccagagcaccatcaccctgagcgtggccagccagaacctgaccttcaccagcagcagcagcccccccaacggcgacagcatcaacaaggaccccaagctgtgcaccaagagccccagaaagagactgagcagcaccctgcaggagacccaggtgccccccgtgaagaagcccatcgtggagcagctgagcgccgccaccatcgagggccagaagcagggcagcgtgaagaaggaccagaaggtgccccacagcggcaagaccgagggcagcaccgccggcgcccagatccccagcaaggtgagcgtgaacgtgagcagccacatcggcgccaaccagcccctgaacagcagcgccctggtgatcagcgacagcgccctggagcagcagaccacccccagcagcagccccgacatcaaggtgaagctggagggcagcgtgttcctgctggacagcgacagcaagagcgtgggcagcttcaaccccaacggctggcagcagatcaccaaggacagcgagttcatcagcgccagctgcgagcagcagcaggacatcagcgtgatgaccatccccgagcacagcgacatcaacgacctggagaagagcgtgtgggagctggagggcatgccccaggacacctacagccagcagctgcacagccagatccaggagagcagcctgaaccagatccaggcccacagcagcgaccagctgcccctgcagagcgagctgaaggagttcgagcccagcgtgagccagaccaacgagagctacttccccttcgacgacgagctgacccaggacagcatcgtggaggagctggtgctgatggagcagcagatgagcatgaacaacagccacagctacggcaactgcctgggcatgaccctgcagagccagagcgtgacccccggcgcccccatgagcagccacaccagcagcacccacttctaccaccccatccacagcaacggcacccccatccacacccccacccccacccccacccccacccccacccccacccccacccccacccccaccagcgagatgatcgccggcagccagagcctgagcagagagagcccctgcagcagactggcccagaccacccccgtggacagcgccctgggcagcagcagacacacccccatcggcaccccccacagcaactgcagcagcagcgtgccccccagccccgtggagtgcagaaaccccttcgccttcacccccatcagcagcagcatggcctaccacgacgccagcatcgtgagcagcagccccgtgaagcccatgcagagacccatggccacccaccccgacaagaccaagctggagtggatgaacaacggctacagcggcgtgggcaacagcagcgtgagcggccacggcatcctgcccagctaccaggagctggtggaggacagattcagaaagccccacgccttcgccgtgcccggccagagctaccagagccagagcagacaccacgacaccaacttcggcagactgacccccgtgagccccgtgcagcaccagggcgccaccgtgaacaacaccaacaagcaggagggcttcgccgtgcccgcccccctggacaacaagggcaccaacagcagcgccagcagcaacttcagatgcagaagcgtgagccccgccgtgcacagacagagaaacctgagcggcagcaccctgtaccccgtgagcaacatccccagaagcaacgtgacccccttcggcagccccgtgacccccgaggtgcacgtgttcaccaacgtgcacaccgacgcctgcgccaacaacatcgcccagagaagccagagcgtgcccctgaccgtgatgatgcagaccgccttccccaacgccctgcagaagcaggccaacagcaagaagatcaccaacgtgctgctgagcaagctggacagcgacaacgacgacgccgtgagaggcctgggcatgaacaacctgcccagcaactacaccgccagaatgaacctgacccagatcctggagcccagcaccgtgttccccagcgccaacccccagaacatgatcgacagcagcaccagcgtgtacgagttccagacccccagctacctgaccaagagcaacagcaccggccagatcaacttcagccccggcgacaaccaggcccagagcgagatcggcgagcagcagctggacttcaacagcaccgtgaaggacctgctgagcggcgacagcctgcagaccaaccagcagctggtgggccagggcgccagcgacctgaccaacaccgccagcgacttcagcagcgacatcagactgagcagcgagctgagcggcagcatcaacgacctgaacaccctggaccccaacctgctgttcgaccccggcagacagcagggccaggacgacgaggccaccctggaggagctgaagaacgaccccctgttccagcagatctgcagcgagagcatgaacagcatgaccagcagcggcttcgagtggatcgagagcaaggaccaccccaccgtggagatgctgggctag

SEQ ID NO: 96737 - DNA, 4092 bp, Artificial Sequence
  Description of Artificial Sequence: Synthetic coding sequence
atgagcagcagcagagcccagcagatgcacgccttcagctggatcagaaacaccctggaggagcaccccgagaccagcctgcccaagcaggaggtgtacgacgagtacaagagctactgcgacaacctgggctaccaccccctgagcgccgccgacttcggcaagatcatgaagaacgtgttccccaacatgaaggccagaagactgggcaccagaggcaagagcaagtactgctacagcggcctgagaaagaaggccttcgtgcacatgcccaccctgcccaacctggacttccacaagaccggcgacggcctggagggcgccgagcccagcggccagctgcagaacatcgacgaggaggtgatcagcagcgcctgcagactggtgtgcgagtgggcccagaaggtgctgagccagcccttcgacaccgtgctggagctggccagattcctggtgaagagccactacatcggcaccaagagcatggccgccctgaccgtgatggccgccgcccccgccggcatgaagggcatcacccagcccagcgccttcatccccaccgccgagagcaacagcttccagccccaggtgaagaccctgcccagccccatcgacgccaagcagcagctgcagagaaagatccagaagaagcagcaggagcagaagctgcagagccccctgcccggcgagagcgccgccaagaagagcgagagcgccaccagcaacggcgtgaccaacctgcccaacggcaaccccagcatcctgagcccccagcccatcggcatcgtggtggccgccgtgcccagccccatccccgtgcagagaaccagacagctggtgaccagccccagccccatgagcagcagcgacggcaaggtgctgcccctgaacgtgcaggtggtgacccagcacatgcagagcgtgaagcaggcccccaagaccccccagaacgtgcccgccagccccggcggcgacagaagcgccagacacagatacccccagatcctgcccaagcccgccaacaccagcgccctgaccatcagaagccccaccaccgtgctgttcaccagcagccccatcaagaccgccgtggtgcccgccagccacatgagcagcctgaacgtggtgaagatgaccaccatcagcctgacccccagcaacagcaacacccccctgaagcacagcgccagcgtgagcagcgccaccggcaccaccgaggagagcagaagcgtgccccagatcaagaacggcagcgtggtgagcctgcagagccccggcagcagaagcagcagcgccggcggcaccagcgccgtggaggtgaaggtggagcccgagaccagcagcgacgagcaccccgtgcagtgccaggagaacagcgacgaggccaaggccccccagacccccagcgccctgctgggccagaagagcaacaccgacggcgccctgcagaagcccagcaacgagggcgtgatcgagatcaaggccaccaaggtgtgcgaccagagaaccaagtgcaagagcagatgcaacgagatgctgcccggcaccagcaccggcaacaaccagagcaccatcaccctgagcgtggccagccagaacctgaccttcaccagcagcagcagcccccccaacggcgacagcatcaacaaggaccccaagctgtgcaccaagagccccagaaagagactgagcagcaccctgcaggagacccaggtgccccccgtgaagaagcccatcgtggagcagctgagcgccgccaccatcgagggccagaagcagggcagcgtgaagaaggaccagaaggtgccccacagcggcaagaccgagggcagcaccgccggcgcccagatccccagcaaggtgagcgtgaacgtgagcagccacatcggcgccaaccagcccctgaacagcagcgccctggtgatcagcgacagcgccctggagcagcagaccacccccagcagcagccccgacatcaaggtgaagctggagggcagcgtgttcctgctggacagcgacagcaagagcgtgggcagcttcaaccccaacggctggcagcagatcaccaaggacagcgagttcatcagcgccagctgcgagcagcagcaggacatcagcgtgatgaccatccccgagcacagcgacatcaacgacctggagaagagcgtgtgggagctggagggcatgccccaggacacctacagccagcagctgcacagccagatccaggagagcagcctgaaccagatccaggcccacagcagcgaccagctgcccctgcagagcgagctgaaggagttcgagcccagcgtgagccagaccaacgagagctacttccccttcgacgacgagctgacccaggacagcatcgtggaggagctggtgctgatggagcagcagatgagcatgaacaacagccacagctacggcaactgcctgggcatgaccctgcagagccagagcgtgacccccggcgcccccatgagcagccacaccagcagcacccacttctaccaccccatccacagcaacggcacccccatccacacccccacccccacccccacccccacccccacccccacccccacccccacccccaccagcgagatgatcgccggcagccagagcctgagcagagagagcccctgcagcagactggcccagaccacccccgtggacagcgccctgggcagcagcagacacacccccatcggcaccccccacagcaactgcagcagcagcgtgccccccagccccgtggagtgcagaaaccccttcgccttcacccccatcagcagcagcatggcctaccacgacgccagcatcgtgagcagcagccccgtgaagcccatgcagagacccatggccacccaccccgacaagaccaagctggagtggatgaacaacggctacagcggcgtgggcaacagcagcgtgagcggccacggcatcctgcccagctaccaggagctggtggaggacagattcagaaagccccacgccttcgccgtgcccggccagagctaccagagccagagcagacaccacgacaccaacttcggcagactgacccccgtgagccccgtgcagcaccagggcgccaccgtgaacaacaccaacaagcaggagggcttcgccgtgcccgcccccctggacaacaagggcaccaacagcagcgccagcagcaacttcagatgcagaagcgtgagccccgccgtgcacagacagagaaacctgagcggcagcaccctgtaccccgtgagcaacatccccagaagcaacgtgacccccttcggcagccccgtgacccccgaggtgcacgtgttcaccaacgtgcacaccgacgcctgcgccaacaacatcgcccagagaagccagagcgtgcccctgaccgtgatgatgcagaccgccttccccaacgccctgcagaagcaggccaacagcaagaagatcaccaacgtgctgctgagcaagctggacagcgacaacgacgacgccgtgagaggcctgggcatgaacaacctgcccagcaactacaccgccagaatgaacctgacccagatcctggagcccagcaccgtgttccccagcgccaacccccagaacatgatcgacagcagcaccagcgtgtacgagttccagacccccagctacctgaccaagagcaacagcaccggccagatcaacttcagccccggcgacaaccaggcccagagcgagatcggcgagcagcagctggacttcaacagcaccgtgaaggacctgctgagcggcgacagcctgcagaccaaccagcagctggtgggccagggcgccagcgacctgaccaacaccgccagcgacttcagcagcgacatcagactgagcagcgagctgagcggcagcatcaacgacctgaacaccctggaccccaacctgctgttcgaccccggcagacagcagggccaggacgacgaggccaccctggaggagctgaagaacgaccccctgttccagcagatctgcagcgagagcatgaacagcatgaccagcagcggcttcgagtggatcgagagcaaggaccaccccaccgtggagatgctgggctag

SEQ ID NO: 96738 - DNA, 783 bp, Artificial Sequence
  Description of Artificial Sequence: Synthetic coding sequence
atggagctgacccagcccgccgaggacctgatccagacccagcagacccccgccagcgagctgggcgaccccgaggaccccggcgaggaggccgccgacggcagcgacaccgtggtgctgagcctgttcccctgcacccccgagcccgtgaaccccgagcccgacgccagcgtgagcagcccccaggccggcagcagcctgaagcacagcaccaccctgaccaacagacagagaggcaacgaggtgagcgccctgcccgccaccctggacagcctgagcatccaccagctggccgcccagggcgagctggaccagctgaaggagcacctgagaaagggcgacaacctggtgaacaagcccgacgagagaggcttcacccccctgatctgggccagcgccttcggcgagatcgagaccgtgagattcctgctggagtggggcgccgacccccacatcctggccaaggagagagagagcgccctgagcctggccagcaccggcggctacaccgacatcgtgggcctgctgctggagagagacgtggacatcaacatctacgactggaacggcggcacccccctgctgtacgccgtgagaggcaaccacgtgaagtgcgtggaggccctgctggccagaggcgccgacctgaccaccgaggccgacagcggctacacccccatggacctggccgtggccctgggctacagaaaggtgcagcaggtgatcgagaaccacatcctgaagctgttccagagcaacctggtgcccgccgaccccgagtag

SEQ ID NO: 96739 - DNA, 714 bp, Artificial Sequence
  Description of Artificial Sequence: Synthetic coding sequence
atggagctgacccagcccgccgaggacctgatccagacccagcagacccccgccagcgagctgggcgaccccgaggaccccggcgaggaggccgccgacggcagcgacaccgtggtgctgagcctgttcccctgcacccccgagcccgtgaaccccgagcccgacgccagcgtgagcagcccccagggcagcagcctgaagcacagcaccaccctgaccaacagacagagaggcaacgaggtgagcgccctgcccgccaccctggactgcgacaacctggtgaacaagcccgacgagagaggcttcacccccctgatctgggccagcgccttcggcgagatcgagaccgtgagattcctgctggagtggggcgccgacccccacatcctggccaaggagagagagagcgccctgagcctggccagcaccggcggctacaccgacatcgtgggcctgctgctggagagagacgtggacatcaacatctacgactggaacggcggcacccccctgctgtacgccgtgagaggcaaccacgtgaagtgcgtggaggccctgctggccagaggcgccgacctgaccaccgaggccgacagcggctacacccccatggacctggccgtggccctgggctacagaaaggtgcagcaggtgatcgagaaccacatcctgaagctgttccagagcaacctggtgcccgccgaccccgagtag

SEQ ID NO: 96740 - DNA, 192 bp, Artificial Sequence
  Description of Artificial Sequence: Synthetic coding sequence
atggagctgacccagcccgccgaggacctgatccagacccagcagacccccgccagcgagctgggcgaccccgaggaccccggcgaggaggccgccgacggcagcgacaccgtggtgctgagcctgttcccctgcacccccgagcccgtgaaccccgagcccgacgccagcgtgagcagcccccaggcctag

SEQ ID NO: 96741 - DNA, 717 bp, Artificial Sequence
  Description of Artificial Sequence: Synthetic coding sequence
atggagctgacccagcccgccgaggacctgatccagacccagcagacccccgccagcgagctgggcgaccccgaggaccccggcgaggaggccgccgacggcagcgacaccgtggtgctgagcctgttcccctgcacccccgagcccgtgaaccccgagcccgacgccagcgtgagcagcccccaggccggcagcagcctgaagcacagcaccaccctgaccaacagacagagaggcaacgaggtgagcgccctgcccgccaccctggactgcgacaacctggtgaacaagcccgacgagagaggcttcacccccctgatctgggccagcgccttcggcgagatcgagaccgtgagattcctgctggagtggggcgccgacccccacatcctggccaaggagagagagagcgccctgagcctggccagcaccggcggctacaccgacatcgtgggcctgctgctggagagagacgtggacatcaacatctacgactggaacggcggcacccccctgctgtacgccgtgagaggcaaccacgtgaagtgcgtggaggccctgctggccagaggcgccgacctgaccaccgaggccgacagcggctacacccccatggacctggccgtggccctgggctacagaaaggtgcagcaggtgatcgagaaccacatcctgaagctgttccagagcaacctggtgcccgccgaccccgagtag

SEQ ID NO: 96742 - DNA, 819 bp, Artificial Sequence
  Description of Artificial Sequence: Synthetic coding sequence
atggaggcccagggcgtggccgagggcgccggccccggcgccgccagcggcgtgccccaccccgccgccctggcccccgccgccgcccccaccctggcccccgccagcgtggccgccgccgccagccagttcaccctgctggtgatgcagccctgcgccggccaggacgaggccgccgcccccggcggcagcgtgggcgccggcaagcccgtgagatacctgtgcgagggcgccggcgacggcgaggaggaggccggcgaggacgaggccgacctgctggacaccagcgacccccccggcggcggcgagagcgccgccagcctggaggacctggaggacgaggagacccacagcggcggcgagggcagcagcggcggcgccagaagaagaggcagcggcggcggcagcatgagcaagacctgcacctacgagggctgcagcgagaccaccagccaggtggccaagcagagaaagccctggatgtgcaagaagcacagaaacaagatgtacaaggacaagtacaagaagaagaagagcgaccaggccctgaactgcggcggcaccgccagcaccggcagcgccggcaacgtgaagctggaggagagcgccgacaacatcctgagcatcgtgaagcagagaaccggcagcttcggcgacagacccgccagacccaccctgctggagcaggtgctgaaccagaagagactgagcctgctgagaagccccgaggtggtgcagttcctgcagaagcagcagcagctgctgaaccagcaggtgctggagcagagacagcagcagttccccggcaccagcatgtag

SEQ ID NO: 96743 - DNA, 1854 bp, Artificial Sequence
  Description of Artificial Sequence: Synthetic coding sequence
atgagcagcctgcccaccagcgacggcttcaaccaccccgccagaagcagcggccagagccccgacgtgggcaaccccatgagcctggccagaagcgtgagcgccagcgtgtgccccatcaagcccagcgacagcgacagaatcgagcccaaggccgtgaaggccctgaaggccagcgccgagttccagctgaacagcgagaagaaggagcacctgagcctgcaggacctgagcgaccacgccagcagcgccgaccacgcccccaccgaccagagccccgccatgcccatgcagaacagcagcgaggagatcaccgtggccggcaacctggagaagagcgccgagagaagcacccagggcctgaagttccacctgcacaccagacaggaggccagcctgagcgtgaccagcaccagaatgcacgagccccagatgttcctgggcgagaaggactggcaccccgagaaccagaacctgagccaggtgagcgacccccagcagcacgaggagcccggcaacgagcagtacgaggtggcccagcagaaggccagccacgaccaggagtacctgtgcaacatcggcgacctggagctgcccgaggagagacagcagaaccagcacaagatcgtggacctggaggccaccatgaagggcaacggcctgccccagaacgtggacccccccagcgccaagaagagcatccccagcagcgagtgcagcggctgcagcaacagcgagaccttcatggagatcgacaccgcccagcagagcctggtgaccctgctgaacagcaccggcagacagaacgccaacgtgaagaacatcggcgccctggacctgaccctggacaaccccctgatggaggtggagaccagcaagtgcaaccccagcagcgagatcctgaacgacagcatcagcacccaggacctgcagccccccgagaccaacgtggagatccccggcaccaacaaggagtacggccactacagcagccccagcctgtgcggcagctgccagcccagcgtggagagcgccgaggagagctgccccagcatcaccgccgccctgaaggagctgcacgagctgctggtggtgagcagcaagcccgccagcgagaacaccagcgaggaggtgatctgccagagcgagaccatcgccgagggccagaccagcatcaaggacctgagcgagagatggacccagaacgagcacctgacccagaacgagcagtgcccccaggtgagcttccaccaggccatcagcgtgagcgtggagaccgagaagctgaccggcaccagcagcgacaccggcagagaggccgtggagaacgtgaacttcagaagcctgggcgacggcctgagcaccgacaaggagggcgtgcccaagagcagagagagcatcaacaagaacagaagcgtgaccgtgaccagcgccaagaccagcaaccagctgcactgcaccctgggcgtggagatcagccccaagctgctggccggcgaggaggacgccctgaaccagaccagcgagcagaccaagagcctgagcagcaacttcatcctggtgaaggacctgggccagggcatccagaacagcgtgaccgacagacccgagaccagagagaacgtgtgccccgacgccagcagacccctgctggagtacgagccccccaccagccaccccagcagcagccccgccatcctgccccccctgatcttccccgccaccgacatcgacagaatcctgagagccggcttcaccctgcaggaggccctgggcgccctgcacagagtgggcggcaacgccgacctggccctgctggtgctgctggccaagaacatcgtggtgcccacctag

SEQ ID NO: 96744 - DNA, 657 bp, Artificial Sequence
  Description of Artificial Sequence: Synthetic coding sequence
atgagcagcggcgccgccagcggcaccggcagaggcagacccagaggcggcggccccggccccggcgaccccccccccagcgagacccacaagctggtggtggtgggcggcggcggcgtgggcaagagcgccctgaccatccagttcatccagagctacttcgtgagcgactacgaccccaccatcgaggacagctacaccaagatctgcagcgtggacggcatccccgccagactggacatcctggacaccgccggccaggaggagttcggcgccatgagagagcagtacatgagagccggccacggcttcctgctggtgttcgccatcaacgacagacagagcttcaacgaggtgggcaagctgttcacccagatcctgagagtgaaggacagagacgacttccccgtggtgctggtgggcaacaaggccgacctggagagccagagacaggtgcccagaagcgaggccagcgccttcggcgccagccaccacgtggcctacttcgaggccagcgccaagctgagactgaacgtggacgaggccttcgagcagctggtgagagccgtgagaaagtaccaggagcaggagctgccccccagcccccccagcgcccccagaaagaagggcggcggctgcccctgcgtgctgctgtag

SEQ ID NO: 96745 - DNA, 615 bp, Artificial Sequence
  Description of Artificial Sequence: Synthetic coding sequence
atggccgccgccggctggagagacggcagcggccaggagaagtacagactggtggtggtgggcggcggcggcgtgggcaagagcgccctgaccatccagttcatccagagctacttcgtgaccgactacgaccccaccatcgaggacagctacaccaagcagtgcgtgatcgacgacagagccgccagactggacatcctggacaccgccggccaggaggagttcggcgccatgagagagcagtacatgagaaccggcgagggcttcctgctggtgttcagcgtgaccgacagaggcagcttcgaggagatctacaagttccagagacagatcctgagagtgaaggacagagacgagttccccatgatcctgatcggcaacaaggccgacctggaccaccagagacaggtgacccaggaggagggccagcagctggccagacagctgaaggtgacctacatggaggccagcgccaagatcagaatgaacgtggaccaggccttccacgagctggtgagagtgatcagaaagttccaggagcaggagtgcccccccagccccgagcccaccagaaaggagaaggacaagaagggctgccactgcgtgatcttctag

SEQ ID NO: 96746 - DNA, 384 bp, Artificial Sequence
  Description of Artificial Sequence: Synthetic coding sequence
atgagagagcagtacatgagaaccggcgagggcttcctgctggtgttcagcgtgaccgacagaggcagcttcgaggagatctacaagttccagagacagatcctgagagtgaaggacagagacgagttccccatgatcctgatcggcaacaaggccgacctggaccaccagagacaggtgacccaggaggagggccagcagctggccagacagctgaaggtgacctacatggaggccagcgccaagatcagaatgaacgtggaccaggccttccacgagctggtgagagtgatcagaaagttccaggagcaggagtgcccccccagccccgagcccaccagaaaggagaaggacaagaagggctgccactgcgtgatcttctag

SEQ ID NO: 96747 - DNA, 384 bp, Artificial Sequence; identical to SEQ ID NO: 96746
  Description of Artificial Sequence: Synthetic coding sequence

SEQ ID NO: 96748 - DNA, 384 bp, Artificial Sequence; identical to SEQ ID NO: 96746
  Description of Artificial Sequence: Synthetic coding sequence

SEQ ID NO: 96749 - DNA, 210 bp, Artificial Sequence
  Description of Artificial Sequence: Synthetic coding sequence
atgagagagcagtacatgagaaccggcgagggcttcctgctggtgttcagcgtgaccgacagaggcagcttcgaggagatctacaagttccagagacagatcctgagagtgaaggacagagacgagttccccatgatcctgatcggcaacaaggccgacctggaccaccagagacaggtgacccaggaggagggccagcagctggcctag

SEQ ID NO: 96750 - DNA, 384 bp, Artificial Sequence; identical to SEQ ID NO: 96746
  Description of Artificial Sequence: Synthetic coding sequence

SEQ ID NO: 96751 - DNA, 384 bp, Artificial Sequence; identical to SEQ ID NO: 96746
  Description of Artificial Sequence: Synthetic coding sequence

SEQ ID NO: 96752 - DNA, 510 bp, Artificial Sequence
  Description of Artificial Sequence: Synthetic coding sequence
atgagctacttcgtgaccgactacgaccccaccatcgaggacagctacaccaagcagtgcgtgatcgacgacagagccgccagactggacatcctggacaccgccggccaggaggagttcggcgccatgagagagcagtacatgagaaccggcgagggcttcctgctggtgttcagcgtgaccgacagaggcagcttcgaggagatctacaagttccagagacagatcctgagagtgaaggacagagacgagttccccatgatcctgatcggcaacaaggccgacctggaccaccagagacaggtgacccaggaggagggccagcagctggccagacagctgaaggtgacctacatggaggccagcgccaagatcagaatgaacgtggaccaggccttccacgagctggtgagagtgatcagaaagttccaggagcaggagtgcccccccagccccgagcccaccagaaaggagaaggacaagaagggctgccactgcgtgatcttctag

SEQ ID NO: 96753 - DNA, 633 bp, Artificial Sequence
  Description of Artificial Sequence: Synthetic coding sequence
atggccgccgccggctggagagacggcagcggccaggagaagtacagactggtggtggtgggcggcggcggcgtgggcaagagcgccctgaccatccagttcatccagttcttcctgttcctgcagagctacttcgtgaccgactacgaccccaccatcgaggacagctacaccaagcagtgcgtgatcgacgacagagccgccagactggacatcctggacaccgccggccaggaggagttcggcgccatgagagagcagtacatgagaaccggcgagggcttcctgctggtgttcagcgtgaccgacagaggcagcttcgaggagatctacaagttccagagacagatcctgagagtgaaggacagagacgagttccccatgatcctgatcggcaacaaggccgacctggaccaccagagacaggtgacccaggaggagggccagcagctggccagacagctgaaggtgacctacatggaggccagcgccaagatcagaatgaacgtggaccaggccttccacgagctggtgagagtgatcagaaagttccaggagcaggagtgcccccccagccccgagcccaccagaaaggagaaggacaagaagggctgccactgcgtgatcttctag

SEQ ID NO: 96754 - DNA, 633 bp, Artificial Sequence
  Description of Artificial Sequence: Synthetic coding sequence
atgggctgctgcagcagcagcgaccccagaagagaggacgacctgagagccagagagaagctgaagaagaccaagatcatcttcgtggtgggcggccccggcagcggcaagggcacccagtgcgagaagatcgtgcagaagtacggctacacccacctgagcaccggcgacctgctgagaagcgaggtgagcagcggcagcgccagaggcaagaagctgagcgagatcatggagaagggccagctggtgcccctggagaccgtgctggacatgctgagagacgccatggtggccaaggtgaacaccagcaagggcttcctgatcgacggctaccccagagaggtgcagcagggcgaggagttcgagagaagaatcggccagcccaccctgctgctgtacgtggacgccggccccgagaccatgacccagagactgctgaagagaggcgagaccagcggcagagtggacgacaacgaggagaccatcaagaagagactggagacctactacaaggccaccgagcccgtgatcgccttctacgagaagagaggcatcgtgagaaaggtgaacgccgagggcagcgtggacagcgtgttcagccaggtgtgcacccacctggacgccctgaagtag

SEQ ID NO: 96755 - DNA, 354 bp, Artificial Sequence
  Description of Artificial Sequence: Synthetic coding sequence
atgcccagactgttcctgttccacctgctggagttctgcctgctgctgaaccagttcagcagagccgtggccgccaagtggaaggacgacgtgatcaagctgtgcggcagagagctggtgagagcccagatcgccatctgcggcatgagcacctggagcaagagaagcctgagccaggaggacgccccccagacccccagacccgtggccggcgacttcatccagaccgtgagcctgggcatcagccccgacggcggcaaggccctgagaaccggcagctgcttcaccagagagttcctgggcgccctgagcaagctgtaccaccccagcagcaccaagatccagaagctgtag

SEQ ID NO: 96756 - DNA, 429 bp, Artificial Sequence
  Description of Artificial Sequence: Synthetic coding sequence
atggccagatacatgctgctgctgctgctggccgtgtgggtgctgaccggcgagctgtggcccggcgccgaggccagagccgccccctacggcgtgagactgtgcggcagagagttcatcagagccgtgatcttcacctgcggcggcagcagatggagaagaagcgacatcctggcccacgaggccatgggcgacaccttccccgacgccgacgccgacgaggacagcctggccggcgagctggacgaggccatgggcagcagcgagtggctggccctgaccaagagcccccaggccttctacagaggcagacccagctggcagggcacccccggcgtgctgagaggcagcagagacgtgctggccggcctgagcagcagctgctgcaagtggggctgcagcaagagcgagatcagcagcctgtgctag

SEQ ID NO: 96757 - DNA, 1293 bp, Artificial Sequence
  Description of Artificial Sequence: Synthetic coding sequence
atgaagcccagcctgctgtgcagacccctgagctgcttcctgatgctgctgccctggcccctggccaccctgaccagcaccaccctgtggcagtgcccccccggcgaggagcccgacctggaccccggccagggcaccctgtgcagaccctgcccccccggcaccttcagcgccgcctggggcagcagcccctgccagccccacgccagatgcagcctgtggagaagactggaggcccaggtgggcatggccaccagagacaccctgtgcggcgactgctggcccggctggttcggcccctggggcgtgcccagagtgccctgccagccctgcagctgggcccccctgggcacccacggctgcgacgagtggggcagaagagccagaagaggcgtggaggtggccgccggcgccagcagcggcggcgagaccagacagcccggcaacggcaccagagccggcggccccgaggagaccgccgcccagtacgccgtgatcgccatcgtgcccgtgttctgcctgatgggcctgctgggcatcctggtgtgcaacctgctgaagagaaagggctaccactgcaccgcccacaaggaggtgggccccggccccggcggcggcggcagcggcatcaaccccgcctacagaaccgaggacgccaacgaggacaccatcggcgtgctggtgagactgatcaccgagaagaaggagaacgccgccgccctggaggagctgctgaaggagtaccacagcaagcagctggtgcagaccagccacagacccgtgagcaagctgccccccgccccccccaacgtgccccacatctgcccccacagacaccacctgcacaccgtgcagggcctggccagcctgagcggcccctgctgcagcagatgcagccagaagaagtggcccgaggtgctgctgagccccgaggccgtggccgccaccacccccgtgcccagcctgctgcccaaccccaccagagtgcccaaggccggcgccaaggccggcagacagggcgagatcaccatcctgagcgtgggcagattcagagtggccagaatccccgagcagagaaccagcagcatggtgagcgaggtgaagaccatcaccgaggccggccccagctggggcgacctgcccgacagcccccagcccggcctgccccccgagcagcaggccctgctgggcagcggcggcagcagaaccaagtggctgaagccccccgccgagaacaaggccgaggagaacagatacgtggtgagactgagcgagagcaacctggtgatctag

SEQ ID NO: 96758 - DNA, 1293 bp, Artificial Sequence; identical to SEQ ID NO: 96757
  Description of Artificial Sequence: Synthetic coding sequence

SEQ ID NO: 96759 - DNA, 897 bp, Artificial Sequence
  Description of Artificial Sequence: Synthetic coding sequence
atgcaccccggctgctgggtgcaggaggccctggtgctgaaccacgagggcgacatgggcttcagcgagcccggcagccacatctgcagagccctgggcggcctgagccccaagtgcacctgcagcggccccctgagaagacccggcctgcccagcgccggcagaagctggttcagcagcggcgtgagactgccccccagccccggcagcggccccttcagcagccccggcatcaaccccgcctacagaaccgaggacgccaacgaggacaccatcggcgtgctggtgagactgatcaccgagaagaaggagaacgccgccgccctggaggagctgctgaaggagtaccacagcaagcagctggtgcagaccagccacagacccgtgagcaagctgccccccgccccccccaacgtgccccacatctgcccccacagacaccacctgcacaccgtgcagggcctggccagcctgagcggcccctgctgcagcagatgcagccagaagaagtggcccgaggtgctgctgagccccgaggccgtggccgccaccacccccgtgcccagcctgctgcccaaccccaccagagtgcccaaggccggcgccaaggccggcagacagggcgagatcaccatcctgagcgtgggcagattcagagtggccagaatccccgagcagagaaccagcagcatggtgagcgaggtgaagaccatcaccgaggccggccccagctggggcgacctgcccgacagcccccagcccggcctgccccccgagcagcaggccctgctgggcagcggcggcagcagaaccaagtggctgaagccccccgccgagaacaaggccgaggagaacagatacgtggtgagactgagcgagagcaacctggtgatctag

SEQ ID NO: 96760 - DNA, 306 bp, Artificial Sequence
  Description of Artificial Sequence: Synthetic coding sequence
atgaagcccagcctgctgtgcagacccctgagctgcttcctgatgctgctgccctggcccctggccaccctgaccagcaccaccctgtggcagtgcccccccggcgaggagcccgacctggaccccggccagggcaccctgtgcagaccctgcccccccggcaccttcagcgccgcctggggcagcagcccctgccagccccacgccagatgcagcctgtggagaagactggaggcccaggtgggcatggccaccagagacaccctgtgcggcgactgctggcccggctggttcggcccctggtag

SEQ ID NO: 96761 - DNA, 4326 bp, Artificial Sequence
  Description of Artificial Sequence: Synthetic coding sequence
atggccaccgccgccgccgccgccgccgtgatggccccccccggctgccccggcagctgccccaacttcgccgtggtgtgcagcttcctggagagatacggccccctgctggacctgcccgagctgcccttccccgagctggagagagtgctgcaggcccccccccccgacgtgggcaacggcgaggtgcccaaggagctggtggagctgcacctgaagctgatgagaaagatcggcaagagcgtgaccgccgacagatgggagaagtacctgatcaagatctgccaggagttcaacagcacctgggcctgggagatggagaagaagggctacctggagatgagcgtggagtgcaagctggccctgctgaagtacctgtgcgagtgccagttcgacgacaacctgaagttcaagaacatcatcaacgaggaggacgccgacaccatgagactgcagcccatcggcagagacaaggacggcctgatgtactggtaccagctggaccaggaccacaacgtgagaatgtacatcgaggagcaggacgaccaggacggcagcagctggaagtgcatcgtgagaaacagaaacgagctggccgagaccctggccctgctgaaggcccagatcgaccccgtgctgctgaagaacagcagccagcaggacaacagcagcagagagagccccagcctggaggacgaggagaccaagaaggaggaggagacccccaagcaggaggagcagaaggagagcgagaagatgaagagcgaggagcagcccatggacctggagaacagaagcaccgccaacgtgctggaggagaccaccgtgaagaaggagaaggaggacgagaaggagctggtgaagctgcccgtgatcgtgaagctggagaagcccctgcccgagaacgaggagaagaagatcatcaaggaggagagcgacagcttcaaggagaacgtgaagcccatcaaggtggaggtgaaggagtgcagagccgaccccaaggacaccaagagcagcatggagaagcccgtggcccaggagcccgagagaatcgagttcggcggcaacatcaagagcagccacgagatcaccgagaagagcaccgaggagaccgagaagctgaagaacgaccagcaggccaagatccccctgaagaagagagagatcaagctgagcgacgacttcgacagccccgtgaagggccccctgtgcaagagcgtgacccccaccaaggagttcctgaaggacgagatcaagcaggaggaggagacctgcaagagaatcagcaccatcaccgccctgggccacgagggcaagcagctggtgaacggcgaggtgagcgacgagagagtggcccccaacttcaagaccgagcccatcgagaccaagttctacgagaccaaggaggagagctacagccccagcaaggacagaaacatcatcaccgagggcaacggcaccgagagcctgaacagcgtgatcaccagcatgaagaccggcgagctggagaaggagaccgcccccctgagaaaggacgccgacagcagcatcagcgtgctggagatccacagccagaaggcccagatcgaggagcccgacccccccgagatggagaccagcctggacagcagcgagatggccaaggacctgagcagcaagaccgccctgagcagcaccgagagctgcaccatgaagggcgaggagaagagccccaagaccaagaaggacaagagaccccccatcctggagtgcctggagaagctggagaagagcaagaagaccttcctggacaaggacgcccagagactgagccccatccccgaggaggtgcccaagagcaccctggagagcgagaagcccggcagccccgaggccgccgagaccagcccccccagcaacatcatcgaccactgcgagaagctggccagcgagaaggaggtggtggagtgccagagcaccagcaccgtgggcggccagagcgtgaagaaggtggacctggagaccctgaaggaggacagcgagttcaccaaggtggagatggacaacctggacaacgcccagaccagcggcatcgaggagcccagcgagaccaagggcagcatgcagaagagcaagttcaagtacaagctggtgcccgaggaggagaccaccgccagcgagaacaccgagatcaccagcgagagacagaaggagggcatcaagctgaccatcagaatcagcagcagaaagaagaagcccgacagcccccccaaggtgctggagcccgagaacaagcaggagaagaccgagaaggaggaggagaagaccaacgtgggcagaaccctgagaagaagccccagaatcagcagacccaccgccaaggtggccgagatcagagaccagaaggccgacaagaagagaggcgagggcgaggacgaggtggaggaggagagcaccgccctgcagaagaccgacaagaaggagatcctgaagaagagcgagaaggacaccaacagcaaggtgagcaaggtgaagcccaagggcaaggtgagatggaccggcagcagaaccagaggcagatggaagtacagcagcaacgacgagagcgagggcagcggcagcgagaagagcagcgccgccagcgaggaggaggaggagaaggagagcgaggaggccatcctggccgacgacgacgagccctgcaagaagtgcggcctgcccaaccaccccgagctgatcctgctgtgcgacagctgcgacagcggctaccacaccgcctgcctgagaccccccctgatgatcatccccgacggcgagtggttctgccccccctgccagcacaagctgctgtgcgagaagctggaggagcagctgcaggacctggacgtggccctgaagaagaaggagagagccgagagaagaaaggagagactggtgtacgtgggcatcagcatcgagaacatcatccccccccaggagcccgacttcagcgaggaccaggaggagaagaagaaggacagcaagaagagcaaggccaacctgctggagagaagaagcaccagaaccagaaagtgcatcagctacagattcgacgagttcgacgaggccatcgacgaggccatcgaggacgacatcaaggaggccgacggcggcggcgtgggcagaggcaaggacatcagcaccatcaccggccacagaggcaaggacatcagcaccatcctggacgaggagagaaaggagaacaagagaccccagagagccgccgccgccagaagaaagaagagaagaagactgaacgacctggacagcgacagcaacctggacgaggaggagagcgaggacgagttcaagatcagcgacggcagccaggacgagttcgtggtgagcgacgagaaccccgacgagagcgaggaggacccccccagcaacgacgacagcgacaccgacttctgcagcagaagactgagaagacaccccagcagacccatgagacagagcagaagactgagaagaaagacccccaagaagaagtacagcgacgacgacgaggaggaggagagcgaggagaacagcagagacagcgagagcgacttcagcgacgacttcagcgacgacttcgtggagaccagaagaagaagaagcagaagaaaccagaagagacagatcaactacaaggaggacagcgagagcgacggcagccagaagagcctgagaagaggcaaggagatcagaagagtgcacaagagaagactgagcagcagcgagagcgaggagagctacctgagcaagaacagcgaggacgacgagctggccaaggagagcaagagaagcgtgagaaagagaggcagaagcaccgacgagtacagcgaggccgacgaggaggaggaggaggaggagggcaagcccagcagaaagagactgcacagaatcgagaccgacgaggaggagagctgcgacaacgcccacggcgacgccaaccagcccgccagagacagccagcccagagtgctgcccagcgagcaggagagcaccaagaagccctacagaatcgagagcgacgaggaggaggacttcgagaacgtgggcaaggtgggcagccccctggactacagcctggtggacctgcccagcaccaacggccagagccccggcaaggccatcgagaacctgatcggcaagcccaccgagaagagccagacccccaaggacaacagcaccgccagcgccagcctggccagcaacggcaccagcggcggccaggaggccggcgcccccgaggaggaggaggacgagctgctgagagtgaccgacctggtggactacgtgtgcaacagcgagcagctgtag

SEQ ID NO: 96762 - DNA, 4233 bp, Artificial Sequence
  Description of Artificial Sequence: Synthetic coding sequence
atggccaccgccgccgccgccgccgccgtgatggccccccccggctgccccggcagctgccccaacttcgccgtggtgtgcagcttcctggagagatacggccccctgctggacctgcccgagctgcccttccccgagctggagagagtgctgcaggcccccccccccgacgtgggcaacggcgaggtgcccaaggagctggtggagctgcacctgaagctgatgagaaagatcggcaagagcgtgaccgccgacagatgggagaagtacctgatcaagtacctgtgcgagtgccagttcgacgacaacctgaagttcaagaacatcatcaacgaggaggacgccgacaccatgagactgcagcccatcggcagagacaaggacggcctgatgtactggtaccagctggaccaggaccacaacgtgagaatgtacatcgaggagcaggacgaccaggacggcagcagctggaagtgcatcgtgagaaacagaaacgagctggccgagaccctggccctgctgaaggcccagatcgaccccgtgctgctgaagaacagcagccagcaggacaacagcagcagagagagccccagcctggaggacgaggagaccaagaaggaggaggagacccccaagcaggaggagcagaaggagagcgagaagatgaagagcgaggagcagcccatggacctggagaacagaagcaccgccaacgtgctggaggagaccaccgtgaagaaggagaaggaggacgagaaggagctggtgaagctgcccgtgatcgtgaagctggagaagcccctgcccgagaacgaggagaagaagatcatcaaggaggagagcgacagcttcaaggagaacgtgaagcccatcaaggtggaggtgaaggagtgcagagccgaccccaaggacaccaagagcagcatggagaagcccgtggcccaggagcccgagagaatcgagttcggcggcaacatcaagagcagccacgagatcaccgagaagagcaccgaggagaccgagaagctgaagaacgaccagcaggccaagatccccctgaagaagagagagatcaagctgagcgacgacttcgacagccccgtgaagggccccctgtgcaagagcgtgacccccaccaaggagttcctgaaggacgagatcaagcaggaggaggagacctgcaagagaatcagcaccatcaccgccctgggccacgagggcaagcagctggtgaacggcgaggtgagcgacgagagagtggcccccaacttcaagaccgagcccatcgagaccaagttctacgagaccaaggaggagagctacagccccagcaaggacagaaacatcatcaccgagggcaacggcaccgagagcctgaacagcgtgatcaccagcatgaagaccggcgagctggagaaggagaccgcccccctgagaaaggacgccgacagcagcatcagcgtgctggagatccacagccagaaggcccagatcgaggagcccgacccccccgagatggagaccagcctggacagcagcgagatggccaaggacctgagcagcaagaccgccctgagcagcaccgagagctgcaccatgaagggcgaggagaagagccccaagaccaagaaggacaagagaccccccatcctggagtgcctggagaagctggagaagagcaagaagaccttcctggacaaggacgcccagagactgagccccatccccgaggaggtgcccaagagcaccctggagagcgagaagcccggcagccccgaggccgccgagaccagcccccccagcaacatcatcgaccactgcgagaagctggccagcgagaaggaggtggtggagtgccagagcaccagcaccgtgggcggccagagcgtgaagaaggtggacctggagaccctgaaggaggacagcgagttcaccaaggtggagatggacaacctggacaacgcccagaccagcggcatcgaggagcccagcgagaccaagggcagcatgcagaagagcaagttcaagtacaagctggtgcccgaggaggagaccaccgccagcgagaacaccgagatcaccagcgagagacagaaggagggcatcaagctgaccatcagaatcagcagcagaaagaagaagcccgacagcccccccaaggtgctggagcccgagaacaagcaggagaagaccgagaaggaggaggagaagaccaacgtgggcagaaccctgagaagaagccccagaatcagcagacccaccgccaaggtggccgagatcagagaccagaaggccgacaagaagagaggcgagggcgaggacgaggtggaggaggagagcaccgccctgcagaagaccgacaagaaggagatcctgaagaagagcgagaaggacaccaacagcaaggtgagcaaggtgaagcccaagggcaaggtgagatggaccggcagcagaaccagaggcagatggaagtacagcagcaacgacgagagcgagggcagcggcagcgagaagagcagcgccgccagcgaggaggaggaggagaaggagagcgaggaggccatcctggccgacgacgacgagccctgcaagaagtgcggcctgcccaaccaccccgagctgatcctgctgtgcgacagctgcgacagcggctaccacaccgcctgcctgagaccccccctgatgatcatccccgacggcgagtggttctgccccccctgccagcacaagctgctgtgcgagaagctggaggagcagctgcaggacctggacgtggccctgaagaagaaggagagagccgagagaagaaaggagagactggtgtacgtgggcatcagcatcgagaacatcatccccccccaggagcccgacttcagcgaggaccaggaggagaagaagaaggacagcaagaagagcaaggccaacctgctggagagaagaagcaccagaaccagaaagtgcatcagctacagattcgacgagttcgacgaggccatcgacgaggccatcgaggacgacatcaaggaggccgacggcggcggcgtgggcagaggcaaggacatcagcaccatcaccggccacagaggcaaggacatcagcaccatcctggacgaggagagaaaggagaacaagagaccccagagagccgccgccgccagaagaaagaagagaagaagactgaacgacctggacagcgacagcaacctggacgaggaggagagcgaggacgagttcaagatcagcgacggcagccaggacgagttcgtggtgagcgacgagaaccccgacgagagcgaggaggacccccccagcaacgacgacagcgacaccgacttctgcagcagaagactgagaagacaccccagcagacccatgagacagagcagaagactgagaagaaagacccccaagaagaagtacagcgacgacgacgaggaggaggagagcgaggagaacagcagagacagcgagagcgacttcagcgacgacttcagcgacgacttcgtggagaccagaagaagaagaagcagaagaaaccagaagagacagatcaactacaaggaggacagcgagagcgacggcagccagaagagcctgagaagaggcaaggagatcagaagagtgcacaagagaagactgagcagcagcgagagcgaggagagctacctgagcaagaacagcgaggacgacgagctggccaaggagagcaagagaagcgtgagaaagagaggcagaagcaccgacgagtacagcgaggccgacgaggaggaggaggaggaggagggcaagcccagcagaaagagactgcacagaatcgagaccgacgaggaggagagctgcgacaacgcccacggcgacgccaaccagcccgccagagacagccagcccagagtgctgcccagcgagcaggagagcaccaagaagccctacagaatcgagagcgacgaggaggaggacttcgagaacgtgggcaaggtgggcagccccctggactacagcctggtggacctgcccagcaccaacggccagagccccggcaaggccatcgagaacctgatcggcaagcccaccgagaagagccagacccccaaggacaacagcaccgccagcgccagcctggccagcaacggcaccagcggcggccaggaggccggcgcccccgaggaggaggaggacgagctgctgagagtgaccgacctggtggactacgtgtgcaacagcgagcagctgtag

SEQ ID NO: 96763 - DNA, 3570 bp, Artificial Sequence
  Description of Artificial Sequence: Synthetic coding sequence
atgaagagcgaggagcagcccatggacctggagaacagaagcaccgccaacgtgctggaggagaccaccgtgaagaaggagaaggaggacgagaaggagctggtgaagctgcccgtgatcgtgaagctggagaagcccctgcccgagaacgaggagaagaagatcatcaaggaggagagcgacagcttcaaggagaacgtgaagcccatcaaggtggaggtgaaggagtgcagagccgaccccaaggacaccaagagcagcatggagaagcccgtggcccaggagcccgagagaatcgagttcggcggcaacatcaagagcagccacgagatcaccgagaagagcaccgaggagaccgagaagctgaagaacgaccagcaggccaagatccccctgaagaagagagagatcaagctgagcgacgacttcgacagccccgtgaagggccccctgtgcaagagcgtgacccccaccaaggagttcctgaaggacgagatcaagcaggaggaggagacctgcaagagaatcagcaccatcaccgccctgggccacgagggcaagcagctggtgaacggcgaggtgagcgacgagagagtggcccccaacttcaagaccgagcccatcgagaccaagttctacgagaccaaggaggagagctacagccccagcaaggacagaaacatcatcaccgagggcaacggcaccgagagcctgaacagcgtgatcaccagcatgaagaccggcgagctggagaaggagaccgcccccctgagaaaggacgccgacagcagcatcagcgtgctggagatccacagccagaaggcccagatcgaggagcccgacccccccgagatggagaccagcctggacagcagcgagatggccaaggacctgagcagcaagaccgccctgagcagcaccgagagctgcaccatgaagggcgaggagaagagccccaagaccaagaaggacaagagaccccccatcctggagtgcctggagaagctggagaagagcaagaagaccttcctggacaaggacgcccagagactgagccccatccccgaggaggtgcccaagagcaccctggagagcgagaagcccggcagccccgaggccgccgagaccagcccccccagcaacatcatcgaccactgcgagaagctggccagcgagaaggaggtggtggagtgccagagcaccagcaccgtgggcggccagagcgtgaagaaggtggacctggagaccctgaaggaggacagcgagttcaccaaggtggagatggacaacctggacaacgcccagaccagcggcatcgaggagcccagcgagaccaagggcagcatgcagaagagcaagttcaagtacaagctggtgcccgaggaggagaccaccgccagcgagaacaccgagatcaccagcgagagacagaaggagggcatcaagctgaccatcagaatcagcagcagaaagaagaagcccgacagcccccccaaggtgctggagcccgagaacaagcaggagaagaccgagaaggaggaggagaagaccaacgtgggcagaaccctgagaagaagccccagaatcagcagacccaccgccaaggtggccgagatcagagaccagaaggccgacaagaagagaggcgagggcgaggacgaggtggaggaggagagcaccgccctgcagaagaccgacaagaaggagatcctgaagaagagcgagaaggacaccaacagcaaggtgagcaaggtgaagcccaagggcaaggtgagatggaccggcagcagaaccagaggcagatggaagtacagcagcaacgacgagagcgagggcagcggcagcgagaagagcagcgccgccagcgaggaggaggaggagaaggagagcgaggaggccatcctggccgacgacgacgagccctgcaagaagtgcggcctgcccaaccaccccgagctgatcctgctgtgcgacagctgcgacagcggctaccacaccgcctgcctgagaccccccctgatgatcatccccgacggcgagtggttctgccccccctgccagcacaagctgctgtgcgagaagctggaggagcagctgcaggacctggacgtggccctgaagaagaaggagagagccgagagaagaaaggagagactggtgtacgtgggcatcagcatcgagaacatcatccccccccaggagcccgacttcagcgaggaccaggaggagaagaagaaggacagcaagaagagcaaggccaacctgctggagagaagaagcaccagaaccagaaagtgcatcagctacagattcgacgagttcgacgaggccatcgacgaggccatcgaggacgacatcaaggaggccgacggcggcggcgtgggcagaggcaaggacatcagcaccatcaccggccacagaggcaaggacatcagcaccatcctggacgaggagagaaaggagaacaagagaccccagagagccgccgccgccagaagaaagaagagaagaagactgaacgacctggacagcgacagcaacctggacgaggaggagagcgaggacgagttcaagatcagcgacggcagccaggacgagttcgtggtgagcgacgagaaccccgacgagagcgaggaggacccccccagcaacgacgacagcgacaccgacttctgcagcagaagactgagaagacaccccagcagacccatgagacagagcagaagactgagaagaaagacccccaagaagaagtacagcgacgacgacgaggaggaggagagcgaggagaacagcagagacagcgagagcgacttcagcgacgacttcagcgacgacttcgtggagaccagaagaagaagaagcagaagaaaccagaagagacagatcaactacaaggaggacagcgagagcgacggcagccagaagagcctgagaagaggcaaggagatcagaagagtgcacaagagaagactgagcagcagcgagagcgaggagagctacctgagcaagaacagcgaggacgacgagctggccaaggagagcaagagaagcgtgagaaagagaggcagaagcaccgacgagtacagcgaggccgacgaggaggaggaggaggaggagggcaagcccagcagaaagagactgcacagaatcgagaccgacgaggaggagagctgcgacaacgcccacggcgacgccaaccagcccgccagagacagccagcccagagtgctgcccagcgagcaggagagcaccaagaagccctacagaatcgagagcgacgaggaggaggacttcgagaacgtgggcaaggtgggcagccccctggactacagcctggtggacctgcccagcaccaacggccagagccccggcaaggccatcgagaacctgatcggcaagcccaccgagaagagccagacccccaaggacaacagcaccgccagcgccagcctggccagcaacggcaccagcggcggccaggaggccggcgcccccgaggaggaggaggacgagctgctgagagtgaccgacctggtggactacgtgtgcaacagcgagcagctgtag

SEQ ID NO: 96764 - DNA, 2412 bp, Artificial Sequence
  Description of Artificial Sequence: Synthetic coding sequence
gagaccctggccctgctgaaggcccagatcgaccccgtgctgctgaagaacagcagccagcaggacaacagcagcagagagagccccagcctggaggacgaggagaccaagaaggaggaggagacccccaagcaggaggagcagaaggagagcgagaagatgaagagcgaggagcagcccatggacctggagaacagaagcaccgccaacgtgctggaggagaccaccgtgaagaaggagaaggaggacgagaaggagctggtgaagctgcccgtgatcgtgaagctggagaagcccctgcccgagaacgaggagaagaagatcatcaaggaggagagcgacagcttcaaggagaacgtgaagcccatcaaggtggaggtgaaggagtgcagagccgaccccaaggacaccaagagcagcatggagaagcccgtggcccaggagcccgagagaatcgagttcggcggcaacatcaagagcagccacgagatcaccgagaagagcaccgaggagaccgagaagctgaagaacgaccagcaggccaagatccccctgaagaagagagagatcaagctgagcgacgacttcgacagccccgtgaagggccccctgtgcaagagcgtgacccccaccaaggagttcctgaaggacgagatcaagcaggaggaggagacctgcaagagaatcagcaccatcaccgccctgggccacgagggcaagcagctggtgaacggcgaggtgagcgacgagagagtggcccccaacttcaagaccgagcccatcgagaccaagttctacgagaccaaggaggagagctacagccccagcaaggacagaaacatcatcaccgagggcaacggcaccgagagcctgaacagcgtgatcaccagcatgaagaccggcgagctggagaaggagaccgcccccctgagaaaggacgccgacagcagcatcagcgtgctggagatccacagccagaaggcccagatcgaggagcccgacccccccgagatggagaccagcctggacagcagcgagatggccaaggacctgagcagcaagaccgccctgagcagcaccgagagctgcaccatgaagggcgaggagaagagccccaagaccaagaaggacaagagaccccccatcctggagtgcctggagaagctggagaagagcaagaagaccttcctggacaaggacgcccagagactgagccccatccccgaggaggtgcccaagagcaccctggagagcgagaagcccggcagccccgaggccgccgagaccagcccccccagcaacatcatcgaccactgcgagaagctggccagcgagaaggaggtggtggagtgccagagcaccagcaccgtgggcggccagagcgtgaagaaggtggacctggagaccctgaaggaggacagcgagttcaccaaggtggagatggacaacctggacaacgcccagaccagcggcatcgaggagcccagcgagaccaagggcagcatgcagaagagcaagttcaagtacaagctggtgcccgaggaggagaccaccgccagcgagaacaccgagatcaccagcgagagacagaaggagggcatcaagctgaccatcagaatcagcagcagaaagaagaagcccgacagcccccccaaggtgctggagcccgagaacaagcaggagaagaccgagaaggaggaggagaagaccaacgtgggcagaaccctgagaagaagccccagaatcagcagacccaccgccaaggtggccgagatcagagaccagaaggccgacaagaagagaggcgagggcgaggacgaggtggaggaggagagcaccgccctgcagaagaccgacaagaaggagatcctgaagaagagcgagaaggacaccaacagcaaggtgagcaaggtgaagcccaagggcaaggtgagatggaccggcagcagaaccagaggcagatggaagtacagcagcaacgacgagagcgagggcagcggcagcgagaagagcagcgccgccagcgaggaggaggaggagaaggagagcgaggaggccatcctggccgacgacgacgagccctgcaagaagtgcggcctgcccaaccaccccgagctgatcctgctgtgcgacagctgcgacagcggctaccacaccgcctgcctgagaccccccctgatgatcatccccgacggcgagtggttctgccccccctgccagcacaagctgctgtgcgagaagctggaggagcagctgcaggacctggacgtggccctgaagaagaaggagagagccgagagaagaaaggagagactggtgtacgtgggcatcagcatcgagaacatcatccccccccaggagcccgacttcagcgaggaccaggaggagaagaagaaggacagcaagaagtag

SEQ ID NO: 96765 - DNA, 2109 bp, Artificial Sequence
  Description of Artificial Sequence: Synthetic coding sequence
gccaccgccgccgccgccgccgccgtgatggccccccccggctgccccggcagctgccccaacttcgccgtggtgtgcagcttcctggagagatacggccccctgctggacctgcccgagctgcccttccccgagctggagagagtgctgcaggcccccccccccgacgtgggcaacggcgaggtgcccaaggagctggtggagctgcacctgaagctgatgagaaagatcggcaagagcgtgaccgccgacagatgggagaagtacctgatcaagatctgccaggagttcaacagcacctgggcctgggagatggagaagaagggctacctggagatgagcgtggagtgcaagctggccctgctgaagtacctgtgcgagtgccagttcgacgacaacctgaagttcaagaacatcatcaacgaggaggacgccgacaccatgagactgcagcccatcggcagagacaaggacggcctgatgtactggtaccagctggaccaggaccacaacgtgagaatgtacatcgaggagcaggacgaccaggacggcagcagctggaagtgcatcgtgagaaacagaaacgagctggccgagaccctggccctgctgaaggcccagatcgaccccgtgctgctgaagaacagcagccagcaggacaacagcagcagagagagccccagcctggaggacgaggagaccaagaaggaggaggagacccccaagcaggaggagcagaaggagagcgagaagatgaagagcgaggagcagcccatggacctggagaacagaagcaccgccaacgtgctggaggagaccaccgtgaagaaggagaaggaggacgagaaggagctggtgaagctgcccgtgatcgtgaagctggagaagcccctgcccgagaacgaggagaagaagatcatcaaggaggagagcgacagcttcaaggagaacgtgaagcccatcaaggtggaggtgaaggagtgcagagccgaccccaaggacaccaagagcagcatggagaagcccgtggcccaggagcccgagagaatcgagttcggcggcaacatcaagagcagccacgagatcaccgagaagagcaccgaggagaccgagaagctgaagaacgaccagcaggccaagatccccctgaagaagagagagatcaagctgagcgacgacttcgacagccccgtgaagggccccctgtgcaagagcgtgacccccaccaaggagttcctgaaggacgagatcaagcaggaggaggagacctgcaagagaatcagcaccatcaccgccctgggccacgagggcaagcagctggtgaacggcgaggtgagcgacgagagagtggcccccaacttcaagaccgagcccatcgagaccaagttctacgagaccaaggaggagagctacagccccagcaaggacagaaacatcatcaccgagggcaacggcaccgagagcctgaacagcgtgatcaccagcatgaagaccggcgagctggagaaggagaccgcccccctgagaaaggacgccgacagcagcatcagcgtgctggagatccacagccagaaggcccagatcgaggagcccgacccccccgagatggagaccagcctggacagcagcgagatggccaaggacctgagcagcaagaccgccctgagcagcaccgagagctgcaccatgaagggcgaggagaagagccccaagaccaagaaggacaagagaccccccatcctggagtgcctggagaagctggagaagagcaagaagaccttcctggacaaggacgcccagagactgagccccatccccgaggaggtgcccaagagcaccctggagagcgagaagcccggcagccccgaggccgccgagaccagcccccccagcaacatcatcgaccactgcgagaagctggccagcgagaaggaggtggtggagtgccagagcaccagcaccgtgggcggccagagcgtgaagaaggtggacctggagaccctgaaggaggacagcgagttcaccaaggtggagatggacaacctggacaacgcccagaccagcggcatcgaggagcccagcgagaccaagggcagcatgcagaagtag

SEQ ID NO: 96766 - DNA, 831 bp, Artificial Sequence
  Description of Artificial Sequence: Synthetic coding sequence
gagccctgcaagaagtgcggcctgcccaaccaccccgagctgatcctgctgtgcgacagctgcgacagcggctaccacaccgcctgcctgagaccccccctgatgatcatccccgacggcgagtggttctgccccccctgccagcacaagctgctgtgcgagaagctggaggagcagctgcaggacctggacgtggccctgaagaagaaggagagagccgagagaagaaaggagagactggtgtacgtgggcatcagcatcgagaacatcatccccccccaggagcccgacttcagcgaggaccaggaggagaagaagaaggacagcaagaagagcaaggccaacctgctggagagaagaagcaccagaaccagaaagtgcatcagctacagattcgacgagttcgacgaggccatcgacgaggccatcgaggacgacatcaaggaggccgacggcggcggcgtgggcagaggcaaggacatcagcaccatcaccggccacagaggcaaggacatcagcaccatcctggacgaggagagaaaggagaacaagagaccccagagagccgccgccgccagaagaaagaagagaagaagactgaacgacctggacagcgacagcaacctggacgaggaggagagcgaggacgagttcaagatcagcgacggcagccaggacgagttcgtggtgagcgacgagaaccccgacgagagcgaggaggacccccccagcaacgacgacagcgacaccgacttctgcagcagaagactgagaagacaccccagcagacccatgagacagagcagaagactgagaagaaagaccccctag

SEQ ID NO: 96767 - DNA, 1029 bp, Artificial Sequence
  Description of Artificial Sequence: Synthetic coding sequence
atggcccaggtgctgatcgtgggcgccggcatgaccggcagcctgtgcgccgccctgctgagaagacagaccagcggccccctgtacctggccgtgtgggacaaggccgaggacagcggcggcagaatgaccaccgcctgcagcccccacaacccccagtgcaccgccgacctgggcgcccagtacatcacctgcaccccccactacgccaagaagcaccagagattctacgacgagctgctggcctacggcgtgctgagacccctgagcagccccatcgagggcatggtgatgaaggagggcgactgcaacttcgtggccccccagggcatcagcagcatcatcaagcactacctgaaggagagcggcgccgaggtgtacttcagacacagagtgacccagatcaacctgagagacgacaagtgggaggtgagcaagcagaccggcagccccgagcagttcgacctgatcgtgctgaccatgcccgtgcccgagatcctgcagctgcagggcgacatcaccaccctgatcagcgagtgccagagacagcagctggaggccgtgagctacagcagcagatacgccctgggcctgttctacgaggccggcaccaagatcgacgtgccctgggccggccagtacatcaccagcaacccctgcatcagattcgtgagcatcgacaacaagaagagaaacatcgagagcagcgagatcggccccagcctggtgatccacaccaccgtgcccttcggcgtgacctacctggagcacagcatcgaggacgtgcaggagctggtgttccagcagctggagaacatcctgcccggcctgccccagcccatcgccaccaagtgccagaagtggagacacagccaggtgaccaacgccgccgccaactgccccggccagatgaccctgcaccacaagcccttcctggcctgcggcggcgacggcttcacccagagcaacttcgacggctgcatcaccagcgccctgtgcgtgctggaggccctgaagaactacatctag

SEQ ID NO: 96768 - DNA, 948 bp, Artificial Sequence
  Description of Artificial Sequence: Synthetic coding sequence
atggcccaggtgctgatcgtgggcgccggcatgaccggcagcctgtgcgccgccctgctgagaagacagaccagcggccccctgtacctggccgtgtgggacaaggccgaggacagcggcggcagaatgaccaccgcctgcagcccccacaacccccagtgcaccgccgacctgggcgcccagtacatcacctgcaccccccactacgccaagaagcaccagagattctacgacgagctgctggcctacggcgtgctgagacccctgagcagccccatcgagggcatggtgatgaaggagggcgactgcaacttcgtggccccccagggcatcagcagcatcatcaagcactacctgaaggagagcggcgccgaggtgtacttcagacacagagtgacccagatcaacctgagagacgacaagtgggaggtgagcaagcagaccggcagccccgagcagttcgacctgatcgtgctgaccatgcccgtgcccgagatcctgcagctgcagggcgacatcaccaccctgatcagcgagtgccagagacagcagctggaggccgtgagctacagcagcagatacgccctgggcctgttctacgaggccggcaccaagatcgacgtgccctgggccggccagtacatcaccagcaacccctgcatcagattcgtgagcatcgacaacaagaagagaaacatcgagagcagcgagatcggccccagcctggtgatccacaccaccgtgcccttcggcgtgacctacctggagcacagcatcgaggacgtgcaggagctggtgttccagcagctggagaacatcctgcccggcctgccccagcccatcgccaccaagtgccagaagtggagacacagccaggtgcccagcgccggcgtgatcctgggctgcgccaagagcccctggatgatggccatcggcttccccatctag

SEQ ID NO: 96769 - DNA, 699 bp, Artificial Sequence
  Description of Artificial Sequence: Synthetic coding sequence
atggcccaggtgctgatcgtgggcgccggcatgaccggcagcctgtgcgccgccctgctgagaagacagaccagcggccccctgtacctggccgtgtgggacaaggccgaggacagcggcgccgaggtgtacttcagacacagagtgacccagatcaacctgagagacgacaagtgggaggtgagcaagcagaccggcagccccgagcagttcgacctgatcgtgctgaccatgcccgtgcccgagatcctgcagctgcagggcgacatcaccaccctgatcagcgagtgccagagacagcagctggaggccgtgagctacagcagcagatacgccctgggcctgttctacgaggccggcaccaagatcgacgtgccctgggccggccagtacatcaccagcaacccctgcatcagattcgtgagcatcgacaacaagaagagaaacatcgagagcagcgagatcggccccagcctggtgatccacaccaccgtgcccttcggcgtgacctacctggagcacagcatcgaggacgtgcaggagctggtgttccagcagctggagaacatcctgcccggcctgccccagcccatcgccaccaagtgccagaagtggagacacagccaggtgcccagcgccggcgtgatcctgggctgcgccaagagcccctggatgatggccatcggcttccccatctag

SEQ ID NO: 96770 - DNA, 1221 bp, Artificial Sequence
  Description of Artificial Sequence: Synthetic coding sequence
atggacggctggagaagaatgcccagatggggcctgctgctgctgctgtggggcagctgcaccttcggcctgcccaccgacaccaccaccttcaagagaatcttcctgaagagaatgcccagcatcagagagagcctgaaggagagaggcgtggacatggccagactgggccccgagtggagccagcccatgaagagactgaccctgggcaacaccaccagcagcgtgatcctgaccaactacatggacacccagtactacggcgagatcggcatcggcacccccccccagaccttcaaggtggtgttcgacaccggcagcagcaacgtgtgggtgcccagcagcaagtgcagcagactgtacaccgcctgcgtgtaccacaagctgttcgacgccagcgacagcagcagctacaagcacaacggcaccgagctgaccctgagatacagcaccggcaccgtgagcggcttcctgagccaggacatcatcaccgtgggcggcatcaccgtgacccagatgttcggcgaggtgaccgagatgcccgccctgcccttcatgctggccgagttcgacggcgtggtgggcatgggcttcatcgagcaggccatcggcagagtgacccccatcttcgacaacatcatcagccagggcgtgctgaaggaggacgtgttcagcttctactacaacagagacagcgagaacagccagagcctgggcggccagatcgtgctgggcggcagcgacccccagcactacgagggcaacttccactacatcaacctgatcaagaccggcgtgtggcagatccagatgaagggcgtgagcgtgggcagcagcaccctgctgtgcgaggacggctgcctggccctggtggacaccggcgccagctacatcagcggcagcaccagcagcatcgagaagctgatggaggccctgggcgccaagaagagactgttcgactacgtggtgaagtgcaacgagggccccaccctgcccgacatcagcttccacctgggcggcaaggagtacaccctgaccagcgccgactacgtgttccaggagagctacagcagcaagaagctgtgcaccctggccatccacgccatggacatccccccccccaccggccccacctgggccctgggcgccaccttcatcagaaagttctacaccgagttcgacagaagaaacaacagaatcggcttcgccctggccagatag

SEQ ID NO: 96771 - DNA, 1212 bp, Artificial Sequence
  Description of Artificial Sequence: Synthetic coding sequence
atggacggctggagaagaatgcccagatggggcctgctgctgctgctgtggggcagctgcaccttcggcctgcccaccgacaccaccaccttcaagagaatcttcctgaagagaatgcccagcatcagagagagcctgaaggagagaggcgtggacatggccagactgggccccgagtggagccagcccatgaagagactgaccctgggcaacaccaccagcagcgtgatcctgaccaactacatggacacccagtactacggcgagatcggcatcggcacccccccccagaccttcaaggtggtgttcgacaccggcagcagcaacgtgtgggtgcccagcagcaagtgcagcagactgtacaccgcctgcgtgtaccacaagctgttcgacgccagcgacagcagcagctacaagcacaacggcaccgagctgaccctgagatacagcaccggcaccgtgagcggcttcctgagccaggacatcatcaccgtgggcggcatcaccgtgacccagatgttcggcgaggtgaccgagatgcccgccctgcccttcatgctggccgagttcgacggcgtggtgggcatgggcttcatcgagcaggccatcggcagagtgacccccatcttcgacaacatcatcagccagggcgtgctgaaggaggacgtgttcagcttctactacaacagaaacagccagagcctgggcggccagatcgtgctgggcggcagcgacccccagcactacgagggcaacttccactacatcaacctgatcaagaccggcgtgtggcagatccagatgaagggcgtgagcgtgggcagcagcaccctgctgtgcgaggacggctgcctggccctggtggacaccggcgccagctacatcagcggcagcaccagcagcatcgagaagctgatggaggccctgggcgccaagaagagactgttcgactacgtggtgaagtgcaacgagggccccaccctgcccgacatcagcttccacctgggcggcaaggagtacaccctgaccagcgccgactacgtgttccaggagagctacagcagcaagaagctgtgcaccctggccatccacgccatggacatccccccccccaccggccccacctgggccctgggcgccaccttcatcagaaagttctacaccgagttcgacagaagaaacaacagaatcggcttcgccctggccagatag

SEQ ID NO: 96772 - DNA, 978 bp, Artificial Sequence
  Description of Artificial Sequence: Synthetic coding sequence
atggacacccagtactacggcgagatcggcatcggcacccccccccagaccttcaaggtggtgttcgacaccggcagcagcaacgtgtgggtgcccagcagcaagtgcagcagactgtacaccgcctgcgtgtaccacaagctgttcgacgccagcgacagcagcagctacaagcacaacggcaccgagctgaccctgagatacagcaccggcaccgtgagcggcttcctgagccaggacatcatcaccgtgggcggcatcaccgtgacccagatgttcggcgaggtgaccgagatgcccgccctgcccttcatgctggccgagttcgacggcgtggtgggcatgggcttcatcgagcaggccatcggcagagtgacccccatcttcgacaacatcatcagccagggcgtgctgaaggaggacgtgttcagcttctactacaacagagacggcgagaacagccagagcctgggcggccagatcgtgctgggcggcagcgacccccagcactacgagggcaacttccactacatcaacctgatcaagaccggcgtgtggcagatccagatgaagggcgtgagcgtgggcagcagcaccctgctgtgcgaggacggctgcctggccctggtggacaccggcgccagctacatcagcggcagcaccagcagcatcgagaagctgatggaggccctgggcgccaagaagagactgttcgactacgtggtgaagtgcaacgagggccccaccctgcccgacatcagcttccacctgggcggcaaggagtacaccctgaccagcgccgactacgtgttccaggagagctacagcagcaagaagctgtgcaccctggccatccacgccatggacatccccccccccaccggccccacctgggccctgggcgccaccttcatcagaaagttctacaccgagttcgacagaagaaacaacagaatcggcttcgccctggccagatag

SEQ ID NO: 96773 - DNA, 1284 bp, Artificial Sequence
  Description of Artificial Sequence: Synthetic coding sequence
atgagcaagggcctgcccgccagacaggacatggagaaggagagagagaccctgcaggcctggaaggagagagtgggccaggagctggacagagtggtggccttctggatggagcacagccacgaccaggagcacggcggcttcttcacctgcctgggcagagagggcagagtgtacgacgacctgaagtacgtgtggctgcagggcagacaggtgtggatgtactgcagactgtacagaaccttcgagagattcagacacgcccagctgctggacgccgccaaggccggcggcgagttcctgctgagatacgccagagtggccccccccggcaagaagtgcgccttcgtgctgaccagagacggcagacccgtgaaggtgcagagaaccatcttcagcgagtgcttctacaccatggccatgaacgagctgtggagagccaccggcgaggtgagataccagaccgaggccgtggagatgatggaccagatcgtgcactgggtgcaggaggacgccagcggcctgggcagaccccagctgcagggcgcccccgccgccgagcccatggccgtgcccatgatgctgctgaacctggtggagcagctgggcgaggccgacgaggagctggccggcaagtacgccgagctgggcgactggtgcgccagaagaatcctgcagcacgtgcagagagacggccaggccgtgctggagaacgtgagcgagggcggcaaggagctgcccggctgcctgggcagacagcagaaccccggccacaccctggaggccggctggttcctgctgagacactgcatcagaaagggcgaccccgagctgagagcccacgtgatcgacaagttcctgctgctgcccttccacagcggctgggaccccgaccacggcggcctgttctacttccaggacgccgacaacttctgccccacccagctggagtgggccatgaagctgtggtggccccacagcgaggccatgatcgccttcctgatgggctacagcgacagcggcgaccccgtgctgctgagactgttctaccaggtggccgagtacaccttcagacagttcagagaccccgagtacggcgagtggttcggctacctgagcagagagggcaaggtggccctgagcatcaagggcggccccttcaagggctgcttccacgtgcccagatgcctggccatgtgcgaggagatgctgggcgccctgctgagcagacccgcccccgcccccagccccgcccccacccccgcctgcagaggcgccgagtag

SEQ ID NO: 96774 - DNA, 765 bp, Artificial Sequence
  Description of Artificial Sequence: Synthetic coding sequence
atgagcaagggcctgcccgccagacaggacatggagaaggagagagagaccctgcaggcctggaaggagagagtgggccaggagctggacagagtggtggccttctggatggagcacagccacgaccaggagcacggcggcttcttcacctgcctgggcagagagggcagagtgtacgacgacctgaagtacgtgtggctgcagggcagacaggtgtggatgtactgcagactgtacagaaccttcgagagattcagacacgcccagctgctggacgccgccaaggccggcggcgagttcctgctgagatacgccagagtggccccccccggcaagaagtgcgccttcgtgctgaccagagacggcagacccgtgaaggtgcagagaaccatcttcagcgagtgcttctacaccatggccatgaacgagctgtggagagccaccggcgaggtgagataccagaccgaggccgtggagatgatggaccagatcgtgcactgggtgcaggaggacgccagcggcctgggcagaccccagctgcagggcgcccccgccgccgagcccatggccgtgcccatgatgctgctgaacctggtggagcagctgggcgaggccgacgaggagctggccggcaagtacgccgagctgggcgactggtgcgccagaagaatcctgcagcacgtgcaggccaccagatggaagcccgccggcttctgcagcgtgatcgccttcggcaaggccacccccaacttcgagcccacctag

SEQ ID NO: 96775 - DNA, 2355 bp, Artificial Sequence
  Description of Artificial Sequence: Synthetic coding sequence
atggcccagctgctgaacagcatcctgagcgtgatcgacgtgttccacaagtacgccaagggcaacggcgactgcgccctgctgtgcaaggaggagctgaagcagctgctgctggccgagttcggcgacatcctgcagagacccaacgaccccgagaccgtggagaccatcctgaacctgctggaccaggacagagacggccacatcgacttccacgagtacctgctgctggtgttccagctggtgcaggcctgctaccacaagctggacaacaagagccacggcggcagaaccagccagcaggagagaggccaggagggcgcccaggactgcaagttccccggcaacaccggcagacagcacagacagagacacgaggaggagagacagaacagccaccacagccagcccgagagacaggacggcgacagccaccacggccagcccgagagacaggacagagacagccaccacggccagagcgagaagcaggacagagacagccaccacagccagcccgagagacaggacagagacagccaccacaaccagagcgagagacaggacaaggacttcagcttcgaccagagcgagagacagagccaggacagcagcagcggcaagaaggtgagccacaagagcaccagcggccaggccaagtggcagggccacatcttcgccctgaacagatgcgagaagcccatccaggacagccactacggccagagcgagagacacacccagcagagcgagaccctgggccaggccagccacttcaaccagaccaaccagcagaagagcggcagctactgcggccagagcgagagactgggccaggagctgggctgcggccagaccgacagacagggccagagcagccactacggccagaccgacagacaggaccagagctaccactacggccagaccgacagacagggccagagcagccactacagccagaccgacagacagggccagagcagccactacagccagcccgacagacagggccagagcagccactacggccagatggacagaaagggccagtgctaccactacgaccagaccaacagacagggccagggcagccactacagccagcccaacagacagggccagagcagccactacggccagcccgacacccaggaccagagcagccactacggccagaccgacagacaggaccagagcagccactacggccagaccgagagacagggccagagcagccactacagccagatggacagacagggccagggcagccactacggccagaccgacagacagggccagagcagccactacggccagcccgacagacagggccagaacagccactacggccagaccgacagacagggccagagcagccactacggccagaccgacagacagggccagagcagccactacagccagcccgacaagcagggccagagcagccactacggcaagatcgacagacaggaccagagctaccactacggccagcccgacggccagggccagagcagccactacggccagaccgacagacagggccagagcttccactacggccagcccgacagacagggccagagcagccactacagccagatggacagacagggccagagcagccactacggccagaccgacagacagggccagagcagccactacggccagaccgacagacagggccagagctaccactacggccagaccgacagacagggccagagcagccactacatccagagccagaccggcgagatccagggccagaacaagtacttccagggcaccgagggcaccagaaaggccagctacgtggagcagagcggcagaagcggcagactgagccagcagacccccggccaggagggctaccagaaccagggccagggcttccagagcagagacagccagcagaacggccaccaggtgtgggagcccgaggaggacagccagcaccaccagcacaagctgctggcccagatccagcaggagagacccctgtgccacaagggcagagactggcagagctgcagcagcgagcagggccacagacaggcccagaccagacagagccacggcgagggcctgagccactgggccgaggaggagcagggccaccagacctgggacagacacagccacgagagccaggagggcccctgcggcacccaggacagaagaacccacaaggacgagcagaaccaccagagaagagacagacagacccacgagcacgagcagagccaccagagaagagacagacagacccacgaggacaagcagaacagacagagaagagacagacagacccacgaggacgagcagaaccaccagagatag

SEQ ID NO: 96776 - DNA, 1320 bp, Artificial Sequence
  Description of Artificial Sequence: Synthetic coding sequence
atggacagaaagggccagtgctaccactacgaccagaccaacagacagggccagggcagccactacagccagcccaacagacagggccagagcagccactacggccagcccgacacccaggaccagagcagccactacggccagaccgacagacaggaccagagcagccactacggccagaccgagagacagggccagagcagccactacagccagatggacagacagggccagggcagccactacggccagaccgacagacagggccagagcagccactacggccagcccgacagacagggccagaacagccactacggccagaccgacagacagggccagagcagccactacggccagaccgacagacagggccagagcagccactacagccagcccgacaagcagggccagagcagccactacggcaagatcgacagacaggaccagagctaccactacggccagcccgacggccagggccagagcagccactacggccagaccgacagacagggccagagcttccactacggccagcccgacagacagggccagagcagccactacagccagatggacagacagggccagagcagccactacggccagaccgacagacagggccagagcagccactacggccagaccgacagacagggccagagctaccactacggccagaccgacagacagggccagagcagccactacatccagagccagaccggcgagatccagggccagaacaagtacttccagggcaccgagggcaccagaaaggccagctacgtggagcagagcggcagaagcggcagactgagccagcagacccccggccaggagggctaccagaaccagggccagggcttccagagcagagacagccagcagaacggccaccaggtgtgggagcccgaggaggacagccagcaccaccagcacaagctgctggcccagatccagcaggagagacccctgtgccacaagggcagagactggcagagctgcagcagcgagcagggccacagacaggcccagaccagacagagccacggcgagggcctgagccactgggccgaggaggagcagggccaccagacctgggacagacacagccacgagagccaggagggcccctgcggcacccaggacagaagaacccacaaggacgagcagaaccaccagagaagagacagacagacccacgagcacgagcagagccaccagagaagagacagacagacccacgaggacaagcagaacagacagagaagagacagacagacccacgaggacgagcagaaccaccagagatag

SEQ ID NO: 96777 - DNA, 1065 bp, Artificial Sequence
  Description of Artificial Sequence: Synthetic coding sequence
atggaggtggaggccgtgtgcggcggcgccggcgaggtggaggcccaggacagcgaccccgcccccgccttcagcaaggcccccggcagcgccggccactacgagctgccctgggtggagaagtacagacccgtgaagctgaacgagatcgtgggcaacgaggacaccgtgagcagactggaggtgttcgccagagagggcaacgtgcccaacatcatcatcgccggcccccccggcaccggcaagaccaccagcatcctgtgcctggccagagccctgctgggccccgccctgaaggacgccatgctggagctgaacgccagcaacgacagaggcatcgacgtggtgagaaacaagatcaagatgttcgcccagcagaaggtgaccctgcccaagggcagacacaagatcatcatcctggacgaggccgacagcatgaccgacggcgcccagcaggccctgagaagaaccatggagatctacagcaagaccaccagattcgccctggcctgcaacgccagcgacaagatcatcgagcccatccagagcagatgcgccgtgctgagatacaccaagctgaccgacgcccagatcctgaccagactgatgaacgtgatcgagaaggagagagtgccctacaccgacgacggcctggaggccatcatcttcaccgcccagggcgacatgagacaggccctgaacaacctgcagagcaccttcagcggcttcggcttcatcaacagcgagaacgtgttcaaggtgtgcgacgagccccaccccctgctggtgaaggagatgatccagcactgcgtgaacgccaacatcgacgaggcctacaagatcctggcccacctgtggcacctgggctacagccccgaggacatcatcggcaacatcttcagagtgtgcaagaccttccagatggccgagtacctgaagctggagttcatcaaggagatcggctacacccacatgaagatcgccgagggcgtgaacagcctgctgcagatggccggcctgctggccagactgtgccagaagaccatggcccccgtggccagctag

SEQ ID NO: 96778 - DNA, 963 bp, Artificial Sequence
  Description of Artificial Sequence: Synthetic coding sequence
atggaggtggaggccgtgtgcggcggcgccggcgaggtggaggcccaggacagcgaccccgcccccgccttcagcaaggcccccggcagcgccggccactacgagctgccctgggtggagaagtacagacccgtgaagctgaacgagatcgtgggcaacgaggacaccgtgagcagactggaggtgttcgccagagagggcaacgtgcccaacatcatcatcgccggcccccccggcaccggcaagaccaccagcatcctgtgcctggccagagccctgctgggccccgccctgaaggacgccatgctggagctgaacgccagcaacgacagcatgaccgacggcgcccagcaggccctgagaagaaccatggagatctacagcaagaccaccagattcgccctggcctgcaacgccagcgacaagatcatcgagcccatccagagcagatgcgccgtgctgagatacaccaagctgaccgacgcccagatcctgaccagactgatgaacgtgatcgagaaggagagagtgccctacaccgacgacggcctggaggccatcatcttcaccgcccagggcgacatgagacaggccctgaacaacctgcagagcaccttcagcggcttcggcttcatcaacagcgagaacgtgttcaaggtgtgcgacgagccccaccccctgctggtgaaggagatgatccagcactgcgtgaacgccaacatcgacgaggcctacaagatcctggcccacctgtggcacctgggctacagccccgaggacatcatcggcaacatcttcagagtgtgcaagaccttccagatggccgagtacctgaagctggagttcatcaaggagatcggctacacccacatgaagatcgccgagggcgtgaacagcctgctgcagatggccggcctgctggccagactgtgccagaagaccatggcccccgtggccagctag

SEQ ID NO: 96779 - DNA, 1071 bp, Artificial Sequence
  Description of Artificial Sequence: Synthetic coding sequence
atgagcctgtgggtggacaagtacagaccctgcagcctgggcagactggactaccacaaggagcaggccgcccagctgagaaacctggtgcagtgcggcgacttcccccacctgctggtgtacggccccagcggcgccggcaagaagaccagaatcatgtgcatcctgagagagctgtacggcgtgggcgtggagaagctgagaatcgagcaccagaccatcaccacccccagcaagaagaagatcgagatcagcaccatcgccagcaactaccacctggaggtgaaccccagcgacgccggcaacagcgacagagtggtgatccaggagatgctgaagaccgtggcccagagccagcagctggagaccaacagccagagagacttcaaggtggtgctgctgaccgaggtggacaagctgaccaaggacgcccagcacgccctgagaagaaccatggagaagtacatgagcacctgcagactgatcctgtgctgcaacagcaccagcaaggtgatcccccccatcagaagcagatgcctggccgtgagagtgcccgcccccagcatcgaggacatctgccacgtgctgagcaccgtgtgcaagaaggagggcctgaacctgcccagccagctggcccacagactggccgagaagagctgcagaaacctgagaaaggccctgctgatgtgcgaggcctgcagagtgcagcagtaccccttcaccgccgaccaggagatccccgagaccgactgggaggtgtacctgagagagaccgccaacgccatcgtgagccagcagaccccccagagactgctggaggtgagaggcagactgtacgagctgctgacccactgcatcccccccgagatcatcatgaagggcctgctgagcgagctgctgcacaactgcgacggccagctgaagggcgaggtggcccagatggccgcctactacgagcacagactgcagctgggcagcaaggccatctaccacctggaggccttcgtggccaagttcatggccctgtacaagaagttcatggaggacggcctggagggcatgatgttctag

SEQ ID NO: 96780 - DNA, 918 bp, Artificial Sequence
  Description of Artificial Sequence: Synthetic coding sequence
atgagcctgtgggtggacaagtacagaccctgcagcctgggcagactggactaccacaaggagcaggccgcccagctgagaaacctggtgcagtgcggcgacttcccccacctgctggtgtacggccccagcggcgccggcaagaagaccagaatcatgtgcatcctgagagagctgtacggcgtgggcgtggagaagctgagaatcgagcaccagaccatcaccacccccagcaagaagaagatcgagatcagcaccatcgccagcaactaccacctggaggtgaaccccagcgacgccggcaacagcgacagagtggtgatccaggagatgctgaagaccgtggcccagagccagcagctggagaccaacagccagagagacttcaaggtggtgctgctgaccgaggtggacaagctgaccaaggacgcccagcacgccctgagaagaaccatggagaagtacatgagcacctgcagactgatcctgtgctgcaacagcaccagcaaggtgatcccccccatcagaagcagatgcctggccgtgagagtgcccgcccccagcatcgaggacatctgccacgtgctgagcaccgtgtgcaagaaggagggcctgaacctgcccagccagctggcccacagactggccgagaagagctgcagaaacctgagaaaggccctgctgatgtgcgaggcctgcagagtgcagcagtaccccttcaccgccgaccaggagatccccgagaccgactgggaggtgtacctgagagagaccgccaacgccatcgtgagccagcagaccccccagagactgctggaggtgagaggcagactgtacgagctgctgacccactgcatcccccccgagatcatcatgaaggcctgcaaggaggagagcagaagctgcgacatcttctag

SEQ ID NO: 96781 - DNA, 1092 bp, Artificial Sequence
  Description of Artificial Sequence: Synthetic coding sequence
atgcaggccttcctgaagggcaccagcatcagcaccaagccccccctgaccaaggacagaggcgtggccgccagcgccggcagcagcggcgagaacaagaaggccaagcccgtgccctgggtggagaagtacagacccaagtgcgtggacgaggtggccttccaggaggaggtggtggccgtgctgaagaagagcctggagggcgccgacctgcccaacctgctgttctacggcccccccggcaccggcaagaccagcaccatcctggccgccgccagagagctgttcggccccgagctgttcagactgagagtgctggagctgaacgccagcgacgagagaggcatccaggtggtgagagagaaggtgaagaacttcgcccagctgaccgtgagcggcagcagaagcgacggcaagccctgcccccccttcaagatcgtgatcctggacgaggccgacagcatgaccagcgccgcccaggccgccctgagaagaaccatggagaaggagagcaagaccaccagattctgcctgatctgcaactacgtgagcagaatcatcgagcccctgaccagcagatgcagcaagttcagattcaagcccctgagcgacaagatccagcagcagagactgctggacatcgccaagaaggagaacgtgaagatcagcgacgagggcatcgcctacctggtgaaggtgagcgagggcgacctgagaaaggccatcaccttcctgcagagcgccaccagactgaccggcggcaaggagatcaccgagaaggtgatcaccgacatcgccggcgtgatccccgccgagaagatcgacggcgtgttcgccgcctgccagagcggcagcttcgacaagctggaggccgtggtgaaggacctgatcgacgagggccacgccgccacccagctggtgaaccagctgcacgacgtggtggtggagaacaacctgagcgacaagcagaagagcatcatcaccgagaagctggccgaggtggacaagtgcctggccgacggcgccgacgagcacctgcagctgatcagcctgtgcgccaccgtgatgcagcagctgagccagaactgctag

SEQ ID NO: 96782 - DNA, 1092 bp, Artificial Sequence; identical to SEQ ID NO: 96781
  Description of Artificial Sequence: Synthetic coding sequence

SEQ ID NO: 96783 - DNA, 132 bp, Artificial Sequence
  Description of Artificial Sequence: Synthetic coding sequence
atgcaggccttcctgaagggcaccagcatcagcaccaagccccccctgaccaaggacagaggcgtggccgccagcgccggcagcagcggcgagaacaagaaggccaagcccgtgccctgggtggagaagtag

SEQ ID NO: 96784 - DNA, 645 bp, Artificial Sequence
  Description of Artificial Sequence: Synthetic coding sequence
atgcaggccttcctgaagggcaccagcatcagcaccaagccccccctgaccaaggacagaggcgtggccgccagcgccggcagcagcggcgagaacaagaaggccaagcccgtgccctgggtggagaagtacagacccaagtgcgtggacgaggtggccttccaggaggaggtggtggccgtgctgaagaagagcctggagggcgccgacctgcccaacctgctgttctacggcccccccggcaccggcaagaccagcaccatcctggccgccgccagagagctgttcggccccgagctgttcagactgagagtgctggagctgaacgccagcgacgagagaggcatccaggtggtgagagagaaggtgaagaacttcgcccagctgaccgtgagcggcagcagaagcgacggcaagccctgcccccccttcaagatcgtgatcctggacgaggccgacagcatgaccagcgccgcccaggccgccctgagaagaaccatggagaaggagagcaagaccaccagattctgcctgatctgcaactacgtgagcagaatcatcgagcccctgaccagcagatgcagcaagttcagattcaagcccctgagcgacaagatccagcagcagagactgctggacatctag

SEQ ID NO: 96785 - DNA, 372 bp, Artificial Sequence
  Description of Artificial Sequence: Synthetic coding sequence
atgcaggccttcctgaagggcaccagcatcagcaccaagccccccctgaccaaggacagaggcgtggccgccagcgccggcagcagcggcgagaacaagaaggccaagcccgtgccctgggtggagaagtacagacccaagtgcgtggacgaggtggccttccaggaggaggtggtggccgtgctgaagaagagcctggagggcgccgacctgcccaacctgctgttctacggcccccccggcaccggcaagaccagcaccatcctggccgccgccagagagctgttcggccccgagctgttcagactgagagtgctggagctgaacgccagcgacgagagaggcatccaggtggtgagagagaaggtgtag

SEQ ID NO: 96786 - DNA, 504 bp, Artificial Sequence
  Description of Artificial Sequence: Synthetic coding sequence
atgcaggccttcctgaagggcaccagcatcagcaccaagccccccctgaccaaggacagaggcgtggccgccagcgccggcagcagcggcgagaacaagaaggccaagcccgtgccctgggtggagaagtacagacccaagtgcgtggacgaggtggccttccaggaggaggtggtggccgtgctgaagaagagcctggagggcgccgacctgcccaacctgctgttctacggcccccccggcaccggcaagaccagcaccatcctggccgccgccagagagctgttcggccccgagctgttcagactgagagtgctggagctgaacgccagcgacgagagaggcatccaggtggtgagagagaaggtgaagaacttcgcccagctgaccgtgagcggcagcagaagcgacggcaagccctgcccccccttcaagatcgtgatcctggacgaggccgacagcatgaccagcgccgcccaggccgccctgagaagaaccatgtag

SEQ ID NO: 96787 - DNA, 288 bp, Artificial Sequence
  Description of Artificial Sequence: Synthetic coding sequence
atgcaggccttcctgaagggcaccagcatcagcaccaagccccccctgaccaaggacagaggcgtggccgccagcgccggcagcagcggcgagaacaagaaggccaagcccgtgccctgggtggagaagtacagacccaagtgcgtggacgaggtggccttccaggaggaggtggtggccgtgctgaagaagagcctggagggcgccgacctgcccaacctgctgttctacggcccccccggcaccggcaagaccagcaccatcctggccgccgccagagagctgtag

SEQ ID NO: 96788 - DNA, 1746 bp, Artificial Sequence
  Description of Artificial Sequence: Synthetic coding sequence
atgcagagacccggccccagactgtggctggtgctgcaggtgatgggcagctgcgccgccatcagcagcatggacatggagagacccggcgacggcaagtgccagcccatcgagatccccatgtgcaaggacatcggctacaacatgaccagaatgcccaacctgatgggccacgagaaccagagagaggccgccatccagctgcacgagttcgcccccctggtggagtacggctgccacggccacctgagattcttcctgtgcagcctgtacgcccccatgtgcaccgagcaggtgagcacccccatccccgcctgcagagtgatgtgcgagcaggccagactgaagtgcagccccatcatggagcagttcaacttcaagtggcccgacagcctggactgcagaaagctgcccaacaagaacgaccccaactacctgtgcatggaggcccccaacaacggcagcgacgagcccaccagaggcagcggcctgttcccccccctgttcagaccccagagaccccacagcgcccaggagcaccccctgaaggacggcggccccggcagaggcggctgcgacaaccccggcaagttccaccacgtggagaagagcgccagctgcgcccccctgtgcacccccggcgtggacgtgtactggagcagagaggacaagagattcgccgtggtgtggctggccatctgggccgtgctgtgcttcttcagcagcgccttcaccgtgctgaccttcctgatcgaccccgccagattcagataccccgagagacccatcatcttcctgagcatgtgctactgcgtgtacagcgtgggctacctgatcagactgttcgccggcgccgagagcatcgcctgcgacagagacagcggccagctgtacgtgatccaggagggcctggagagcaccggctgcaccctggtgttcctggtgctgtactacttcggcatggccagcagcctgtggtgggtggtgctgaccctgacctggttcctggccgccggcaagaagtggggccacgaggccatcgaggccaacagcagctacttccacctggccgcctgggccatccccgccgtgaagaccatcctgatcctggtgatgagaagagtggccggcgacgagctgaccggcgtgtgctacgtgggcagcatggacgtgaacgccctgaccggcttcgtgctgatccccctggcctgctacctggtgatcggcaccagcttcatcctgagcggcttcgtggccctgttccacatcagaagagtgatgaagaccggcggcgagaacaccgacaagctggagaagctgatggtgagaatcggcctgttcagcgtgctgtacaccgtgcccgccacctgcgtgatcgcctgctacttctacgagagactgaacatggactactggaagatcctggccgcccagcacaagtgcaagatgaacaaccagaccaagaccctggactgcctgatggccgccagcatccccgccgtggagatcttcatggtgaagatcttcatgctgctggtggtgggcatcaccagcggcatgtggatctggaccagcaagaccctgcagagctggcagcaggtgtgcagcagaagactgaagaagaagagcagaagaaagcccgccagcgtgatcaccagcggcggcatctacaagaaggcccagcacccccagaagacccaccacggcaagtacgagatccccgcccagagccccacctgcgtgtag

SEQ ID NO: 96789 - DNA, 960 bp, Artificial Sequence
  Description of Artificial Sequence: Synthetic coding sequence
atggtggagaagtacagaccccagaccctgaacgacctgatcagccaccaggacatcctgagcaccatccagaagttcatcaacgaggacagactgccccacctgctgctgtacggcccccccggcaccggcaagaccagcaccatcctggcctgcgccaagcagctgtacaaggacaaggagttcggcagcatggtgctggagctgaacgccagcgacgacagaggcatcgacatcatcagaggccccatcctgagcttcgccagcaccagaaccatcttcaagaagggcttcaagctggtgatcctggacgaggccgacgccatgacccaggacgcccagaacgccctgagaagagtgatcgagaagttcaccgagaacaccagattctgcctgatctgcaactacctgagcaagatcatccccgccctgcagagcagatgcaccagattcagattcggccccctgacccccgagctgatggtgcccagactggagcacgtggtggaggaggagaaggtggacatcagcgaggacggcatgaaggccctggtgaccctgagcagcggcgacatgagaagagccctgaacatcctgcagagcaccaacatggccttcggcaaggtgaccgaggagaccgtgtacacctgcaccggccaccccctgaagagcgacatcgccaacatcctggactggatgctgaaccaggacttcaccaccgcctacagaaacatcaccgagctgaagaccctgaagggcctggccctgcacgacatcctgaccgagatccacctgttcgtgcacagagtggacttccccagcagcgtgagaatccacctgctgaccaagatggccgacatcgagtacagactgagcgtgggcaccaacgagaagatccagctgagcagcctgatcgccgccttccaggtgaccagagacctgatcgtggccgaggcctag

SEQ ID NO: 96790 - DNA, 315 bp, Artificial Sequence
  Description of Artificial Sequence: Synthetic coding sequence
atggtggagaagtacagaccccagaccctgaacgacctgatcagccaccaggacatcctgagcaccatccagaagttcatcaacgaggacagactgccccacctgctgctgtacggcccccccggcaccggcaagaccagcaccatcctggcctgcgccaagcagctgtacaaggacaaggagttcggcagcatggtgctggagctgaacgccagcgacgacagaggcatcgacatcatcagaggccccatcctgagcttcgccagcaccagaaccatcttcaagaagggcttcaagctggtgatcctggactag

SEQ ID NO: 96791 - DNA, 1023 bp, Artificial Sequence
  Description of Artificial Sequence: Synthetic coding sequence
atggagaccagcgccctgaagcagcaggagcagcccgccgccaccaagatcagaaacctgccctgggtggagaagtacagaccccagaccctgaacgacctgatcagccaccaggacatcctgagcaccatccagaagttcatcaacgaggacagactgccccacctgctgctgtacggcccccccggcaccggcaagaccagcaccatcctggcctgcgccaagcagctgtacaaggacaaggagttcggcagcatggtgctggagctgaacgccagcgacgacagaggcatcgacatcatcagaggccccatcctgagcttcgccagcaccagaaccatcttcaagaagggcttcaagctggtgatcctggacgaggccgacgccatgacccaggacgcccagaacgccctgagaagagtgatcgagaagttcaccgagaacaccagattctgcctgatctgcaactacctgagcaagatcatccccgccctgcagagcagatgcaccagattcagattcggccccctgacccccgagctgatggtgcccagactggagcacgtggtggaggaggagaaggtggacatcagcgaggacggcatgaaggccctggtgaccctgagcagcggcgacatgagaagagccctgaacatcctgcagagcaccaacatggccttcggcaaggtgaccgaggagaccgtgtacacctgcaccggccaccccctgaagagcgacatcgccaacatcctggactggatgctgaaccaggacttcaccaccgcctacagaaacatcaccgagctgaagaccctgaagggcctggccctgcacgacatcctgaccgagatccacctgttcgtgcacagagtggacttccccagcagcgtgagaatccacctgctgaccaagatggccgacatcgagtacagactgagcgtgggcaccaacgagaagatccagctgagcagcctgatcgccgccttccaggtgaccagagacctgatcgtggccgaggcctag

SEQ ID NO: 96792 - DNA, 192 bp, Artificial Sequence
  Description of Artificial Sequence: Synthetic coding sequence
atggtggagaagtacagaccccagaccctgaacgacctgatcagccaccaggacatcctgagcaccatccagaagttcatcaacgaggacagactgccccacctgctgctgtacggcccccccggcaccggcaagaccagcaccatcctggcctgcgccaagcagctgtacaaggacaaggagttcggctag

SEQ ID NO: 96793 - DNA, 1077 bp, Artificial Sequence
  Description of Artificial Sequence: Synthetic coding sequence
atgtggaacagcaacgacggcggcgccggctggagaagaaagagaatcgccggcggcttcagcaagagagccagcctgggcagcgagagaagagtggtggccggcgaggagggcagagagagaagctggggcgtgtggggcagccccgccggcagaagaagaggcagactgggcagactgggccagtgcctgaagggcagaagcctgagagagcccgccggcttcagcgaggcctgggacgtggcccaggccctgatcctgctgttcaagaccggcggcttcgagagctacggcagcagcagctacggcggcgccggcggctacacccagagccccggcggcttcggcagccccgcccccagccaggccgagaagaagagcagagccagagcccagcacatcgtgccctgcaccatcagccagctgctgagcgccaccctggtggacgaggtgttcagaatcggcaacgtggagatcagccaggtgaccatcgtgggcatcatcagacacgccgagaaggcccccaccaacatcgtgtacaagatcgacgacatgaccgccgcccccatggacgtgagacagtgggtggacaccgacgacaccagcagcgagaacaccgtggtgccccccgagacctacgtgaaggtggccggccacctgagaagcttccagaacaagaagagcctggtggccttcaagatcatgcccctggaggacatgaacgagttcaccacccacatcctggaggtgatcaacgcccacatggtgctgagcaaggccaacagccagcccagcgccggcagagcccccatcagcaaccccggcatgagcgaggccggcaacttcggcggcaacagcttcatgcccgccaacggcctgaccgtggcccagaaccaggtgctgaacctgatcaaggcctgccccagacccgagggcctgaacttccaggacctgaagaaccagctgaagcacatgagcgtgagcagcatcaagcaggccgtggacttcctgagcaacgagggccacatctacagcaccgtggacgacgaccacttcaagagcaccgacgccgagtag

SEQ ID NO: 96794 - DNA, 837 bp, Artificial Sequence
  Description of Artificial Sequence: Synthetic coding sequence
atgggcagaggcgacagaaacaagagaagcatcagaggcttcgagagctacggcagcagcagctacggcggcgccggcggctacacccagagccccggcggcttcggcagccccgcccccagccaggccgagaagaagagcagagccagagcccagcacatcgtgccctgcaccatcagccagctgctgagcgccaccctggtggacgaggtgttcagaatcggcaacgtggagatcagccaggtgaccatcgtgggcatcatcagacacgccgagaaggcccccaccaacatcgtgtacaagatcgacgacatgaccgccgcccccatggacgtgagacagtgggtggacaccgacgacaccagcagcgagaacaccgtggtgccccccgagacctacgtgaaggtggccggccacctgagaagcttccagaacaagaagagcctggtggccttcaagatcatgcccctggaggacatgaacgagttcaccacccacatcctggaggtgatcaacgcccacatggtgctgagcaaggccaacagccagcccagcgccggcagagcccccatcagcaaccccggcatgagcgaggccggcaacttcggcggcaacagcttcatgcccgccaacggcctgaccgtggcccagaaccaggtgctgaacctgatcaaggcctgccccagacccgagggcctgaacttccaggacctgaagaaccagctgaagcacatgagcgtgagcagcatcaagcaggccgtggacttcctgagcaacgagggccacatctacagcaccgtggacgacgaccacttcaagagcaccgacgccgagtag

SEQ ID NO: 96795 - DNA, 813 bp, Artificial Sequence
  Description of Artificial Sequence: Synthetic coding sequence
atgtggaacagcggcttcgagagctacggcagcagcagctacggcggcgccggcggctacacccagagccccggcggcttcggcagccccgcccccagccaggccgagaagaagagcagagccagagcccagcacatcgtgccctgcaccatcagccagctgctgagcgccaccctggtggacgaggtgttcagaatcggcaacgtggagatcagccaggtgaccatcgtgggcatcatcagacacgccgagaaggcccccaccaacatcgtgtacaagatcgacgacatgaccgccgcccccatggacgtgagacagtgggtggacaccgacgacaccagcagcgagaacaccgtggtgccccccgagacctacgtgaaggtggccggccacctgagaagcttccagaacaagaagagcctggtggccttcaagatcatgcccctggaggacatgaacgagttcaccacccacatcctggaggtgatcaacgcccacatggtgctgagcaaggccaacagccagcccagcgccggcagagcccccatcagcaaccccggcatgagcgaggccggcaacttcggcggcaacagcttcatgcccgccaacggcctgaccgtggcccagaaccaggtgctgaacctgatcaaggcctgccccagacccgagggcctgaacttccaggacctgaagaaccagctgaagcacatgagcgtgagcagcatcaagcaggccgtggacttcctgagcaacgagggccacatctacagcaccgtggacgacgaccacttcaagagcaccgacgccgagtag

SEQ ID NO: 96796 - DNA, 369 bp, Artificial Sequence
  Description of Artificial Sequence: Synthetic coding sequence
ctggaggacatgaacgagttcaccacccacatcctggaggtgatcaacgcccacatggtgctgagcaaggccaacagccagcccagcgccggcagagcccccatcagcaaccccggcatgagcgaggccggcaacttcggcggcaacagcttcatgcccgccaacggcctgaccgtggcccagaaccaggtgctgaacctgatcaaggcctgccccagacccgagggcctgaacttccaggacctgaagaaccagctgaagcacatgagcgtgagcagcatcaagcaggccgtggacttcctgagcaacgagggccacatctacagcaccgtggacgacgaccacttcaagagcaccgacgccgagtag

SEQ ID NO: 96797 - DNA, 540 bp, Artificial Sequence
  Description of Artificial Sequence: Synthetic coding sequence
atgtggaacagcaacgacggcggcggcttcgagagctacggcagcagcagctacggcggcgccggcggctacacccagagccccggcggcttcggcagccccgcccccagccaggccgagaagaagagcagagccagagcccagcacatcgtgccctgcaccatcagccagctgctgagcgccaccctggtggacgaggtgttcagaatcggcaacgtggagatcagccaggtgaccatcgtgggcatcatcagacacgccgagaaggcccccaccaacatcgtgtacaagatcgacgacatgaccgccgcccccatggacgtgagacagtgggtggacaccgacgacaccagcagcgagaacaccgtggtgccccccgagacctacgtgaaggtggccggccacctgagaagcttccagaacaagaagagcctggtggccttcaagatcatgcccctggaggacatgaacgagttcaccacccacatcctggaggtgatcaacgcccacatggtgctgagcaaggccaacagccagtag

SEQ ID NO: 96798 - DNA, 786 bp, Artificial Sequence
  Description of Artificial Sequence: Synthetic coding sequence
atgagcaagagcggcttcggcagctacggcagcatcagcgccgccgacggcgccagcggcggcagcgaccagctgtgcgagagagacgccacccccgccatcaagacccagagacccaaggtgagaatccaggacgtggtgccctgcaacgtgaaccagctgctgagcagcaccgtgttcgaccccgtgttcaaggtgagaggcatcatcgtgagccaggtgagcatcgtgggcgtgatcagaggcgccgagaaggccagcaaccacatctgctacaagatcgacgacatgaccgccaagcccatcgaggccagacagtggttcggcagagagaaggtgaagcaggtgacccccctgagcgtgggcgtgtacgtgaaggtgttcggcatcctgaagtgccccaccggcaccaagagcctggaggtgctgaagatccacgtgctggaggacatgaacgagttcaccgtgcacatcctggagaccgtgaacgcccacatgatgctggacaaggccagaagagacaccaccgtggagagcgtgcccgtgagccccagcgaggtgaacgacgccggcgacaacgacgagagccacagaaacttcatccaggacgaggtgctgagactgatccacgagtgcccccaccaggagggcaagagcatccacgagctgagagcccagctgtgcgacctgagcgtgaaggccatcaaggaggccatcgactacctgaccgtggagggccacatctaccccaccgtggacagagagcacttcaagagcgccgactag

SEQ ID NO: 96799 - DNA, 330 bp, Artificial Sequence
  Description of Artificial Sequence: Synthetic coding sequence
atgaaccccgccctgggcaaccagaccgacgtggccggcctgttcctggccaacagcagcgaggccctggagagagccgtgagatgctgcacccaggccagcgtggtgaccgacgacggcttcgccgagggcggccccgacgagagaagcctgtacatcatgagagtggtgcagatcgccgtgatgtgcgtgctgagcctgaccgtggtgttcggcatcttcttcctgggctgcaacctgctgatcaagagcgagggcatgatcaacttcctggtgaaggacagaagacccagcaaggaggtggaggccgtggtggtgggcccctactag

SEQ ID NO: 96800 - DNA, 1893 bp, Artificial Sequence
  Description of Artificial Sequence: Synthetic coding sequence
atgcagggcagcagcctgtggctgagcctgaccttcagaagcgccagagtgctgagcagagccagattcttcgagtggcagagccccggcctgcccaacaccgccgccatggagaacggcaccggcccctacggcgaggagagacccagagaggtgcaggagaccaccgtgaccgagggcgccgccaagatcgccttccccagcgccaacgaggtgttctacaaccccgtgcaggagttcaacagagacctgacctgcgccgtgatcaccgagttcgccagaatccagctgggcgccaagggcatccagatcaaggtgcccggcgagaaggacacccagaaggtggtggtggacctgagcgagcaggaggaggagaaggtggagctgaaggagagcgagaacctggccagcggcgaccagcccagaaccgccgccgtgggcgagatctgcgaggagggcctgcacgtgctggagggcctggccgccagcggcctgagaagcatcagattcgccctggaggtgcccggcctgagaagcgtggtggccaacgacgccagcaccagagccgtggacctgatcagaagaaacgtgcagctgaacgacgtggcccacctggtgcagcccagccaggccgacgccagaatgctgatgtaccagcaccagagagtgagcgagagattcgacgtgatcgacctggacccctacggcagccccgccaccttcctggacgccgccgtgcaggccgtgagcgagggcggcctgctgtgcgtgacctgcaccgacatggccgtgctggccggcaacagcggcgagacctgctacagcaagtacggcgccatggccctgaagagcagagcctgccacgagatggccctgagaatcgtgctgcacagcctggacctgagagccaactgctaccagagattcgtggtgcccctgctgagcatcagcgccgacttctacgtgagagtgttcgtgagagtgttcaccggccaggccaaggtgaaggccagcgccagagccaagttcagcgccgcctgcggcccccccgtgacccccgagtgcgagcactgcggccagagacaccagctgggcggccccatgtgggccgagcccatccacgacctggacttcgtgggcagagtgctggaggccgtgagcgccaaccccggcagattccacaccagcgagagaatcagaggcgtgctgagcgtgatcaccgaggagctgcccgacgtgcccctgtactacaccctggaccagctgagcagcaccatccactgcaacacccccagcctgctgcagctgagaagcgccctgctgcacgccgacttcagagtgagcctgagccacgcctgcaagaacgccgtgaagaccgacgcccccgccagcgccctgtgggacatcatgagatgctgggagaaggagtgccccgtgaagagagagagactgagcgagaccagccccgccttcagaatcctgagcgtggagcccagactgcaggccaacttcaccatcagagaggacgccaaccccagcagcagacagagaggcctgaagagattccaggccaaccccgaggccaactggggccccagacccagagccagacccggcggcaaggccgccgacgaggccatggaggagagaagaagactgctgcagaacaagagaaaggagccccccgaggacgtggcccagagagccgccagactgaagaccttcccctgcaagagattcaaggagggcacctgccagagaggcgaccagtgctgctacagccacagcccccccacccccagagtgagcgccgacgccgcccccgactgccccgagaccagcaaccagaccccccccggccccggcgccgccgccggccccggcatcgactag

SEQ ID NO: 96801 - DNA, 249 bp, Artificial Sequence
  Description of Artificial Sequence: Synthetic coding sequence
atgaaggccctgtgcctgctgctgctgcccgtgctgggcctgctggtgagcagcaagaccctgtgcagcatggaggaggccatcaacgagagaatccaggaggtggccggcagcctgagcttcgccgtgaccggctgcacctgcggcagcgcctgcggcagctgggacgtgagagccgagaccacctgccactgccagtgcgccggcatggactggaccggcgccagatgctgcagagtgcagccctag

SEQ ID NO: 96802 - DNA, 954 bp, Artificial Sequence
  Description of Artificial Sequence: Synthetic coding sequence
atgaagagactgagcctggtgaccaccaacagactgagcccccacggcaacttcctgcccctgtgcaccttccccctggccgtggacatggccgccctgttccaggaggccagcagctgccccgtgtgcagcgactacctggagaagcccatgagcctggagtgcggctgcgccgtgtgcttcaagtgcatcaacagcctgcagaaggagccccacggcgaggacctgctgtgctgctgctgcagcatggtgagccagaagaacaagatcagacccagctggcagctggagagactggccagccacatcaaggagctggagcccaagctgaagaagatcctgcagatgaaccccagaatgagaaagttccaggtggacatgaccctggacgccgacaccgccaacaacttcctgctgatcagcgacgacctgagaagcgtgagaagcggctgcatcacccagaacagacaggacctggccgagagattcgacgtgagcatctgcatcctgggcagccccagattcacctgcggcagacactactgggaggtggacgtgggcaccagcaccgagtgggacctgggcgtgtgcagagagagcgtgcacagaaagggcagaatccacctgaccaccgagagaggcttctggaccgtgagcctgagagacggcagcagactgagcgccagcaccgtgcccctgaccttcctgttcgtggacagaaagctgcagagagtgggcatcttcctggacatgggcatgcagaacgtgagcttcttcgacgccgagggcggcagccacgtgtacaccttcagaagcgtgagcgccgaggagcccctgcacctgttcttcgccccccccagcccccccaacggcgacaagagcgtgctgagcatctgccccgtgatcaaccccggcaccaccgacgcccccgtgcaccccggcgaggccaagtag

SEQ ID NO: 96803 - DNA, 954 bp, Artificial Sequence
  Description of Artificial Sequence: Synthetic coding sequence
atgaagagactgagcctggtgaccaccaacagactgagcccccacggcaacttcttcaccctgtgcaccttccccctggccgtggacatggccgccctgttccaggaggccagcagctgccccgtgtgcagcgactacctggagaagcccatgagcctggagtgcggctgcgccgtgtgcctgaagtgcatcaacagcctgcagaaggagccccacggcgaggacctgctgtgctgctgcagcagcatggtgagcagaaagaacaagatcagaagaaacagacagctggagagactggccagccacatcaaggagctggagcccaagctgaagaagatcctgcagatgaaccccagaatgagaaagttccaggtggacatgaccctggacgccaacaccgccaacaacttcctgctgatcagcgacgacctgagaagcgtgagaagcggcagaatcagacagaacagacaggacctggccgagagattcgacgtgagcgtgtgcatcctgggcagccccagattcacctgcggcagacactgctgggaggtggacgtgggcaccagcaccgagtgggacctgggcgtgtgcagagagagcgtgcacagaaagggcagaatccagctgaccaccgagctgggcttctggaccgtgagcctgagagacggcggcagactgagcgccaccaccgtgcccctgaccttcctgttcgtggacagaaagctgcagagagtgggcatcttcctggacatgggcatgcagaacgtgagcttcttcgacgccgagagcggcagccacgtgtacaccttcagaagcgtgagcgccgaggagcccctgagacccttcctggcccccagcgtgccccccaacggcgaccagggcgtgctgagcatctgccccctgatgaacagcggcaccaccgacgcccccgtgagacccggcgaggccaagtag

SEQ ID NO: 96804 - DNA, 867 bp, Artificial Sequence
  Description of Artificial Sequence: Synthetic coding sequence
atggccgccctgttccaggaggccagcagctgccccgtgtgcagcgactacctggagaagcccatgagcctggagtgcggctgcgccgtgtgcctgaagtgcatcaacagcctgcagaaggagccccacggcgaggacctgctgtgctgctgcagcagcatggtgagcagaaagaacaagatcagaagaaacagacagctggagagactggccagccacatcaaggagctggagcccaagctgaagaagatcctgcagatgaaccccagaatgagaaagttccaggtggacatgaccctggacgccaacaccgccaacaacttcctgctgatcagcgacgacctgagaagcgtgagaagcggcagaatcagacagaacagacaggacctggccgagagattcgacgtgagcgtgtgcatcctgggcagccccagattcacctgcggcagacactgctgggaggtggacgtgggcaccagcaccgagtgggacctgggcgtgtgcagagagagcgtgcacagaaagggcagaatccagctgaccaccgagctgggcttctggaccgtgagcctgagagacggcggcagactgagcgccaccaccgtgcccctgaccttcctgttcgtggacagaaagctgcagagagtgggcatcttcctggacatgggcatgcagaacgtgagcttcttcgacgccgagagcggcagccacgtgtacaccttcagaagcgtgagcgccgaggagcccctgagacccttcctggcccccagcgtgccccccaacggcgaccagggcgtgctgagcatctgccccctgatgaacagcggcaccaccgacgcccccgtgagacccggcgaggccaagtag

SEQ ID NO: 96805 - DNA, 867 bp, Artificial Sequence; identical to SEQ ID NO: 96804
  Description of Artificial Sequence: Synthetic coding sequence

SEQ ID NO: 96806 - DNA, 1137 bp, Artificial Sequence
  Description of Artificial Sequence: Synthetic coding sequence
atggaggtggccgagctgggcttccccgagaccgccgtgagccagagcagaatctgcctgtgcgccgtgctgtgcggccactgggacttcgccgacatgatggtgatcagaagcctgagcctgatcagactggagggcgtggagggcagagaccccgtgggcggcggcaacctgaccaacaagagacccagctgcgcccccagcccccaggacctgagcgcccagtggaagcagctggaggacagaggcgccagcagcagaagagtggacatggccgccctgttccaggaggccagcagctgccccgtgtgcagcgactacctggagaagcccatgagcctggagtgcggctgcgccgtgtgcctgaagtgcatcaacagcctgcagaaggagccccacggcgaggacctgctgtgctgctgcagcagcatggtgagcagaaagaacaagatcagaagaaacagacagctggagagactggccagccacatcaaggagctggagcccaagctgaagaagatcctgcagatgaaccccagaatgagaaagttccaggtggacatgaccctggacgccaacaccgccaacaacttcctgctgatcagcgacgacctgagaagcgtgagaagcggcagaatcagacagaacagacaggacctggccgagagattcgacgtgagcgtgtgcatcctgggcagccccagattcacctgcggcagacactgctgggaggtggacgtgggcaccagcaccgagtgggacctgggcgtgtgcagagagagcgtgcacagaaagggcagaatccagctgaccaccgagctgggcttctggaccgtgagcctgagagacggcggcagactgagcgccaccaccgtgcccctgaccttcctgttcgtggacagaaagctgcagagagtgggcatcttcctggacatgggcatgcagaacgtgagcttcttcgacgccgagagcggcagccacgtgtacaccttcagaagcgtgagcgccgaggagcccctgagacccttcctggcccccagcgtgccccccaacggcgaccagggcgtgctgagcatctgccccctgatgaacagcggcaccaccgacgcccccgtgagacccggcgaggccaagtag

SEQ ID NO: 96807 - DNA, 954 bp, Artificial Sequence
  Description of Artificial Sequence: Synthetic coding sequence
atgaagagactgagcctggtgaccaccaacagactgagcccccagggcaacttcctgcccctgtgcaccttccccctggccgtggacatggccgccctgttccaggaggccagcagctgccccgtgtgcagcgactacctggagaagcccatgagcctggagtgcggctgcaccgtgtgcctgaagtgcatcaacagcctgcagaaggagccccacggcgaggacctgctgtgctgctgctgcagcatggtgagccagagaaacaagatcagacccaacagacagctggagagactggtgagccacatcaaggagctggagcccaagctgaagaagatcctgcagatgaaccccagaatgagaaagttccaggtggacatgaccctggacgccgacaccgccaacaacttcctgctgatcagcgacgacctgagaagcgtgagaagcggcctgatcacccagaacagacaggacctggccgagagattcgacgtgagcgtgtgcatcctgggcagccccagattcacctgcggcagacactactgggaggtggacgtgggcaccagcaccgagtgggacctgggcgtgtgcagagagagcgtgcactgcaagggcaagatccagctgaccaccgagctgggcttctggaccgtgagcctgagagacggcagcagactgagcgccagcaccgtgcccctgaccttcctgctggtggacagaaagctgcagagagtgggcatcttcctggacatgggcatgcagaacgtgagcttcttcgacgccgagagcggcagccacgtgtacaccttcagaagcgtgagcgccgaggagcccctgagacccttcctggcccccagcatcccccccaacggcgaccagggcgtgctgagcatctgccccctgatgaacagcggcaccaccgacgcccccgtgagacccggcgaggccaagtag

SEQ ID NO: 96808 - DNA, 867 bp, Artificial Sequence
  Description of Artificial Sequence: Synthetic coding sequence
atggccgccctgttccaggaggccagcagctgccccgtgtgcagcgactacctggagaagcccatgagcctggagtgcggctgcaccgtgtgcctgaagtgcatcaacagcctgcagaaggagccccacggcgaggacctgctgtgctgctgctgcagcatggtgagccagagaaacaagatcagacccaacagacagctggagagactggtgagccacatcaaggagctggagcccaagctgaagaagatcctgcagatgaaccccagaatgagaaagttccaggtggacatgaccctggacgccgacaccgccaacaacttcctgctgatcagcgacgacctgagaagcgtgagaagcggcctgatcacccagaacagacaggacctggccgagagattcgacgtgagcgtgtgcatcctgggcagccccagattcacctgcggcagacactactgggaggtggacgtgggcaccagcaccgagtgggacctgggcgtgtgcagagagagcgtgcactgcaagggcaagatccagctgaccaccgagctgggcttctggaccgtgagcctgagagacggcagcagactgagcgccagcaccgtgcccctgaccttcctgctggtggacagaaagctgcagagagtgggcatcttcctggacatgggcatgcagaacgtgagcttcttcgacgccgagagcggcagccacgtgtacaccttcagaagcgtgagcgccgaggagcccctgagacccttcctggcccccagcatcccccccaacggcgaccagggcgtgctgagcatctgccccctgatgaacagcggcaccaccgacgcccccgtgagacccggcgaggccaagtag

SEQ ID NO: 96809 - DNA, 867 bp, Artificial Sequence; identical to SEQ ID NO: 96808
  Description of Artificial Sequence: Synthetic coding sequence

SEQ ID NO: 96810 - DNA, 3219 bp, Artificial Sequence
  Description of Artificial Sequence: Synthetic coding sequence
atggccaaggccaccagcggcgccgccggcctgagactgctgctgctgctgctgctgcccctgctgggcaaggtggccctgggcctgtacttcagcagagacgcctactgggagaagctgtacgtggaccaggccgccggcacccccctgctgtacgtgcacgccctgagagacgcccccgaggaggtgcccagcttcagactgggccagcacctgtacggcacctacagaaccagactgcacgagaacaactggatctgcatccaggaggacaccggcctgctgtacctgaacagaagcctggaccacagcagctgggagaagctgagcgtgagaaacagaggcttccccctgctgaccgtgtacctgaaggtgttcctgagccccaccagcctgagagagggcgagtgccagtggcccggctgcgccagagtgtacttcagcttcttcaacaccagcttccccgcctgcagcagcctgaagcccagagagctgtgcttccccgagaccagacccagcttcagaatcagagagaacagaccccccggcaccttccaccagttcagactgctgcccgtgcagttcctgtgccccaacatcagcgtggcctacagactgctggagggcgagggcctgcccttcagatgcgcccccgacagcctggaggtgagcaccagatgggccctggacagagagcagagagagaagtacgagctggtggccgtgtgcaccgtgcacgccggcgccagagaggaggtggtgatggtgcccttccccgtgaccgtgtacgacgaggacgacagcgcccccaccttccccgccggcgtggacaccgccagcgccgtggtggagttcaagagaaaggaggacaccgtggtggccaccctgagagtgttcgacgccgacgtggtgcccgccagcggcgagctggtgagaagatacaccagcaccctgctgcccggcgacacctgggcccagcagaccttcagagtggagcactggcccaacgagaccagcgtgcaggccaacggcagcttcgtgagagccaccgtgcacgactacagactggtgctgaacagaaacctgagcatcagcgagaacagaaccatgcagctggccgtgctggtgaacgacagcgacttccagggccccggcgccggcgtgctgctgctgcacttcaacgtgagcgtgctgcccgtgagcctgcacctgcccagcacctacagcctgagcgtgagcagaagagccagaagattcgcccagatcggcaaggtgtgcgtggagaactgccaggccttcagcggcatcaacgtgcagtacaagctgcacagcagcggcgccaactgcagcaccctgggcgtggtgaccagcgccgaggacaccagcggcatcctgttcgtgaacgacaccaaggccctgagaagacccaagtgcgccgagctgcactacatggtggtggccaccgaccagcagaccagcagacaggcccaggcccagctgctggtgaccgtggagggcagctacgtggccgaggaggccggctgccccctgagctgcgccgtgagcaagagaagactggagtgcgaggagtgcggcggcctgggcagccccaccggcagatgcgagtggagacagggcgacggcaagggcatcaccagaaacttcagcacctgcagccccagcaccaagacctgccccgacggccactgcgacgtggtggagacccaggacatcaacatctgcccccaggactgcctgagaggcagcatcgtgggcggccacgagcccggcgagcccagaggcatcaaggccggctacggcacctgcaactgcttccccgaggaggagaagtgcttctgcgagcccgaggacatccaggaccccctgtgcgacgagctgtgcagaaccgtgatcgccgccgccgtgctgttcagcttcatcgtgagcgtgctgctgagcgccttctgcatccactgctaccacaagttcgcccacaagccccccatcagcagcgccgagatgaccttcagaagacccgcccaggccttccccgtgagctacagcagcagcggcgccagaagacccagcctggacagcatggagaaccaggtgagcgtggacgccttcaagatcctggaggaccccaagtgggagttccccagaaagaacctggtgctgggcaagaccctgggcgagggcgagttcggcaaggtggtgaaggccaccgccttccacctgaagggcagagccggctacaccaccgtggccgtgaagatgctgaaggagaacgccagccccagcgagctgagagacctgctgagcgagttcaacgtgctgaagcaggtgaaccacccccacgtgatcaagctgtacggcgcctgcagccaggacggccccctgctgctgatcgtggagtacgccaagtacggcagcctgagaggcttcctgagagagagcagaaaggtgggccccggctacctgggcagcggcggcagcagaaacagcagcagcctggaccaccccgacgagagagccctgaccatgggcgacctgatcagcttcgcctggcagatcagccagggcatgcagtacctggccgagatgaagctggtgcacagagacctggccgccagaaacatcctggtggccgagggcagaaagatgaagatcagcgacttcggcctgagcagagacgtgtacgaggaggacagctacgtgaagagaagccagggcagaatccccgtgaagtggatggccatcgagagcctgttcgaccacatctacaccacccagagcgacgtgtggagcttcggcgtgctgctgtgggagatcgtgaccctgggcggcaacccctaccccggcatcccccccgagagactgttcaacctgctgaagaccggccacagaatggagagacccgacaactgcagcgaggagatgtacagactgatgctgcagtgctggaagcaggagcccgacaagagacccgtgttcgccgacatcagcaaggacctggagaagatgatggtgaagagaagagactacctggacctggccgccagcacccccagcgacagcctgatctacgacgacggcctgagcgaggaggagacccccctggtggactgcaacaacgcccccctgcccagagccctgcccagcacctggatcgagaacaagctgtacggcagaatcagccacgccttcaccagattctag

SEQ ID NO: 96811 - DNA, 3345 bp, Artificial Sequence
  Description of Artificial Sequence: Synthetic coding sequence
atggccaaggccaccagcggcgccgccggcctgagactgctgctgctgctgctgctgcccctgctgggcaaggtggccctgggcctgtacttcagcagagacgcctactgggagaagctgtacgtggaccaggccgccggcacccccctgctgtacgtgcacgccctgagagacgcccccgaggaggtgcccagcttcagactgggccagcacctgtacggcacctacagaaccagactgcacgagaacaactggatctgcatccaggaggacaccggcctgctgtacctgaacagaagcctggaccacagcagctgggagaagctgagcgtgagaaacagaggcttccccctgctgaccgtgtacctgaaggtgttcctgagccccaccagcctgagagagggcgagtgccagtggcccggctgcgccagagtgtacttcagcttcttcaacaccagcttccccgcctgcagcagcctgaagcccagagagctgtgcttccccgagaccagacccagcttcagaatcagagagaacagaccccccggcaccttccaccagttcagactgctgcccgtgcagttcctgtgccccaacatcagcgtggcctacagactgctggagggcgagggcctgcccttcagatgcgcccccgacagcctggaggtgagcaccagatgggccctggacagagagcagagagagaagtacgagctggtggccgtgtgcaccgtgcacgccggcgccagagaggaggtggtgatggtgcccttccccgtgaccgtgtacgacgaggacgacagcgcccccaccttccccgccggcgtggacaccgccagcgccgtggtggagttcaagagaaaggaggacaccgtggtggccaccctgagagtgttcgacgccgacgtggtgcccgccagcggcgagctggtgagaagatacaccagcaccctgctgcccggcgacacctgggcccagcagaccttcagagtggagcactggcccaacgagaccagcgtgcaggccaacggcagcttcgtgagagccaccgtgcacgactacagactggtgctgaacagaaacctgagcatcagcgagaacagaaccatgcagctggccgtgctggtgaacgacagcgacttccagggccccggcgccggcgtgctgctgctgcacttcaacgtgagcgtgctgcccgtgagcctgcacctgcccagcacctacagcctgagcgtgagcagaagagccagaagattcgcccagatcggcaaggtgtgcgtggagaactgccaggccttcagcggcatcaacgtgcagtacaagctgcacagcagcggcgccaactgcagcaccctgggcgtggtgaccagcgccgaggacaccagcggcatcctgttcgtgaacgacaccaaggccctgagaagacccaagtgcgccgagctgcactacatggtggtggccaccgaccagcagaccagcagacaggcccaggcccagctgctggtgaccgtggagggcagctacgtggccgaggaggccggctgccccctgagctgcgccgtgagcaagagaagactggagtgcgaggagtgcggcggcctgggcagccccaccggcagatgcgagtggagacagggcgacggcaagggcatcaccagaaacttcagcacctgcagccccagcaccaagacctgccccgacggccactgcgacgtggtggagacccaggacatcaacatctgcccccaggactgcctgagaggcagcatcgtgggcggccacgagcccggcgagcccagaggcatcaaggccggctacggcacctgcaactgcttccccgaggaggagaagtgcttctgcgagcccgaggacatccaggaccccctgtgcgacgagctgtgcagaaccgtgatcgccgccgccgtgctgttcagcttcatcgtgagcgtgctgctgagcgccttctgcatccactgctaccacaagttcgcccacaagccccccatcagcagcgccgagatgaccttcagaagacccgcccaggccttccccgtgagctacagcagcagcggcgccagaagacccagcctggacagcatggagaaccaggtgagcgtggacgccttcaagatcctggaggaccccaagtgggagttccccagaaagaacctggtgctgggcaagaccctgggcgagggcgagttcggcaaggtggtgaaggccaccgccttccacctgaagggcagagccggctacaccaccgtggccgtgaagatgctgaaggagaacgccagccccagcgagctgagagacctgctgagcgagttcaacgtgctgaagcaggtgaaccacccccacgtgatcaagctgtacggcgcctgcagccaggacggccccctgctgctgatcgtggagtacgccaagtacggcagcctgagaggcttcctgagagagagcagaaaggtgggccccggctacctgggcagcggcggcagcagaaacagcagcagcctggaccaccccgacgagagagccctgaccatgggcgacctgatcagcttcgcctggcagatcagccagggcatgcagtacctggccgagatgaagctggtgcacagagacctggccgccagaaacatcctggtggccgagggcagaaagatgaagatcagcgacttcggcctgagcagagacgtgtacgaggaggacagctacgtgaagagaagccagggcagaatccccgtgaagtggatggccatcgagagcctgttcgaccacatctacaccacccagagcgacgtgtggagcttcggcgtgctgctgtgggagatcgtgaccctgggcggcaacccctaccccggcatcccccccgagagactgttcaacctgctgaagaccggccacagaatggagagacccgacaactgcagcgaggagatgtacagactgatgctgcagtgctggaagcaggagcccgacaagagacccgtgttcgccgacatcagcaaggacctggagaagatgatggtgaagagaagagactacctggacctggccgccagcacccccagcgacagcctgatctacgacgacggcctgagcgaggaggagacccccctggtggactgcaacaacgcccccctgcccagagccctgcccagcacctggatcgagaacaagctgtacggcatgagcgaccccaactggcccggcgagagccccgtgcccctgaccagagccgacggcaccaacaccggcttccccagataccccaacgacagcgtgtacgccaactggatgctgagccccagcgccgccaagctgatggacaccttcgacagctag

SEQ ID NO: 96812 - DNA, 1377 bp, Artificial Sequence
  Description of Artificial Sequence: Synthetic coding sequence
atggccaaggccaccagcggcgccgccggcctgagactgctgctgctgctgctgctgcccctgctgggcaaggtggccctgggcctgtacttcagcagagacgcctactgggagaagctgtacgtggaccaggccgccggcacccccctgctgtacgtgcacgccctgagagacgcccccgaggaggtgcccagcttcagactgggccagcacctgtacggcacctacagaaccagactgcacgagaacaactggatctgcatccaggaggacaccggcctgctgtacctgaacagaagcctggaccacagcagctgggagaagctgagcgtgagaaacagaggcttccccctgctgaccgtgtacctgaaggtgttcctgagccccaccagcctgagagagggcgagtgccagtggcccggctgcgccagagtgtacttcagcttcttcaacaccagcttccccgcctgcagcagcctgaagcccagagagctgtgcttccccgagaccagacccagcttcagaatcagagagaacagaccccccggcaccttccaccagttcagactgctgcccgtgcagttcctgtgccccaacatcagcgtggcctacagactgctggagggcgagggcctgcccttcagatgcgcccccgacagcctggaggtgagcaccagatgggccctggacagagagcagagagagaagtacgagctggtggccgtgtgcaccgtgcacgccggcgccagagaggaggtggtgatggtgcccttccccgtgaccgtgtacgacgaggacgacagcgcccccaccttccccgccggcgtggacaccgccagcgccgtggtggagttcaagagaaaggaggacaccgtggtggccaccctgagagtgttcgacgccgacgtggtgcccgccagcggcgagctggtgagaagatacaccagcaccctgctgcccggcgacacctgggcccagcagaccttcagagtggagcactggcccaacgagaccagcgtgcaggccaacggcagcttcgtgagagccaccgtgcacgactacagactggtgctgaacagaaacctgagcatcagcgagaacagaaccatgcagctggccgtgctggtgaacgacagcgacttccagggccccggcgccggcgtgctgctgctgcacttcaacgtgagcgtgctgcccgtgagcctgcacctgcccagcacctacagcctgagcgtgagcagaagagccagaagattcgcccagatcggcaaggtgtgcgtggagaactgcctggccgacctgaccggcgacgccgtgagcggcagagacgaggccagaagcagcggcctgggcagccagaagcaccccggcagctag

SEQ ID NO: 96813 - DNA, 786 bp, Artificial Sequence
  Description of Artificial Sequence: Synthetic coding sequence
atggacgaggccctggagacccagctgaagaccagcagaggcagattcagcgccaccgagagcctgcccaccctggagctgctgagccaggtggacatggactgcagagtgcacatgagacccatcggcctgacctgggtgctgcagctgaccctggcctggatcctgctggaggcctgcggcggcagcagacccctgcaggccagaagccagcagcaccacggcctggccgccgacctgggcaagggcaagctgcacctggccggcccctgctgccccagcgagatggacaccaccgagaccagcggccccggcaaccaccccgagagatgcggcgtgcccagccccgagtgcgagagcttcctggagcacctgcagagagccctgagaagcagattcagactgagactgctgggcgtgagacaggcccagcccctgtgcgaggagctgtgccaggcctggttcgccaactgcgaggacgacatcacctgcggccccacctggctgcccctgagcgagaagagaggctgcgagcccagctgcctgacctacggccagaccttcgccgacggcaccgacctgtgcagaagcgccctgggccacgccctgcccgtggccgcccccggcgccagacactgcttcaacatcagcatcagcgccgtgcccagacccagacccggcagaagaggcagagaggcccccagcagaagaagcagaagccccagaaccagcatcctggacgccgccggcagcggcagcggcagcggcagcggcagcggcccctag

SEQ ID NO: 96814 - DNA, 675 bp, Artificial Sequence
  Description of Artificial Sequence: Synthetic coding sequence
atgggctggcagctgatctgggccaaggccagctgcacctggcaggacctggtggtgccccagagatggacccagcagagacacagagccctggagaccatccagaacgccgtggagtgcagagccctgaacgccaaccccagctggaacaccagcaacgtgcccttcgccgtggccagcgcctgcggctactggggctacgccagacacagcagaagcgccagaagcagcgccagacccggcagccccaccgccaagatgatcagccccgccgccagactgggcagccacagccagaagaagggcgccgtgagccccgccgccctgcccatggacagactggagtgcagcggcgccatcagcgccagatgcaacctgagactgagaggcagcagcgacagccccgccgccaccagcagaatcgccggcatcagcggcgcctgccaccacgcccagctgatcttcgtgttcctggtggagagcgccttccaccacgtgggccaggccggcttcgagctgctgaccagcggcgacccccccaccagcgccagccagagcgtgggcatcaccggcgtgagccacagacccagacccccccccagcagcttcctgccctgcctggaccccagagacagaatcggcaccccccaggtgcccgcccccaccctgccctag

SEQ ID NO: 96815 - DNA, 690 bp, Artificial Sequence
  Description of Artificial Sequence: Synthetic coding sequence
atggactgcagagtgcacatgagacccatcggcctgacctgggtgctgcagctgaccctggcctggatcctgctggaggcctgcggcggcagcagacccctgcaggccagaagccagcagcaccacggcctggccgccgacctgggcaagggcaagctgcacctggccggcccctgctgccccagcgagatggacaccaccgagaccagcggccccggcaaccaccccgagagatgcggcgtgcccagccccgagtgcgagagcttcctggagcacctgcagagagccctgagaagcagattcagactgagactgctgggcgtgagacaggcccagcccctgtgcgaggagctgtgccaggcctggttcgccaactgcgaggacgacatcacctgcggccccacctggctgcccctgagcgagaagagaggctgcgagcccagctgcctgacctacggccagaccttcgccgacggcaccgacctgtgcagaagcgccctgggccacgccctgcccgtggccgcccccggcgccagacactgcttcaacatcagcatcagcgccgtgcccagacccagacccggcagaagaggcagagaggcccccagcagaagaagcagaagccccagaaccagcatcctggacgccgccggcagcggcagcggcagcggcagcggcagcggcccctag

SEQ ID NO: 96816 - DNA, 618 bp, Artificial Sequence
  Description of Artificial Sequence: Synthetic coding sequence
atggacgaggccctggagacccagctgaagaccagcagaggcagattcagcgccaccgagagcctgcccaccctggagctgctgagccaggtggacatggactgcagagtgcacatgagacccatcggcctgacctgggtgctgcagctgaccctggcctggatcctgctggaggcctgcggcggcagcagacccctgcaggccagaagccagcagcaccacggcctggccgccgacctgggcaagggcaagctgcacctggccggcccctgctgccccagcgagatggacaccaccgagaccagcggccccggcaaccaccccgagagatgcggcgtgcccagccccgagtgcgagagcttcctggagcacctgcagagagccctgagaagcagattcagactgagactgctgggcgtgagacaggcccagcccctgtgcgaggagctgtgccaggcctggttcgccaactgcgaggacgacatcacctgcggccccacctggctgcccctgagcgagaagagaggctgcgagcccagctgcctgacctacggccaggccggcgtgcagtggagagacctgagcagcatgcagccccccccccccggcttcaagtag

SEQ ID NO: 96817 - DNA, 720 bp, Artificial Sequence
  Description of Artificial Sequence: Synthetic coding sequence
atggccagacagctgctgagccaggtggacatggactgcagagtgcacatgagacccatcggcctgacctgggtgctgcagctgaccctggcctggatcctgctggaggcctgcggcggcagcagacccctgcaggccagaagccagcagcaccacggcctggccgccgacctgggcaagggcaagctgcacctggccggcccctgctgccccagcgagatggacaccaccgagaccagcggccccggcaaccaccccgagagatgcggcgtgcccagccccgagtgcgagagcttcctggagcacctgcagagagccctgagaagcagattcagactgagactgctgggcgtgagacaggcccagcccctgtgcgaggagctgtgccaggcctggttcgccaactgcgaggacgacatcacctgcggccccacctggctgcccctgagcgagaagagaggctgcgagcccagctgcctgacctacggccagaccttcgccgacggcaccgacctgtgcagaagcgccctgggccacgccctgcccgtggccgcccccggcgccagacactgcttcaacatcagcatcagcgccgtgcccagacccagacccggcagaagaggcagagaggcccccagcagaagaagcagaagccccagaaccagcatcctggacgccgccggcagcggcagcggcagcggcagcggcagcggcccctag

SEQ ID NO: 96818 - DNA, 996 bp, Artificial Sequence
  Description of Artificial Sequence: Synthetic coding sequence
atggccagaggcggcagaggcagaagactgggcctggccctgggcctgctgctggccctggtgctggcccccagagtgctgagagccaagcccaccgtgagaaaggagagagtggtgagacccgacagcgagctgggcgagagaccccccgaggacaaccagagcttccagtacgaccacgaggccttcctgggcaaggaggacagcaagaccttcgaccagctgacccccgacgagagcaaggagagactgggcaagatcgtggacagaatcgacaacgacggcgacggcttcgtgaccaccgaggagctgaagacctggatcaagagagtgcagaagagatacatcttcgacaacgtggccaaggtgtggaaggactacgacagagacaaggacgacaagatcagctgggaggagtacaagcaggccacctacggctactacctgggcaaccccgccgagttccacgacagcagcgaccaccacaccttcaagaagatgctgcccagagacgagagaagattcaaggccgccgacctgaacggcgacctgaccgccaccagagaggagttcaccgccttcctgcaccccgaggagttcgagcacatgaaggagatcgtggtgctggagaccctggaggacatcgacaagaacggcgacggcttcgtggaccaggacgagtacatcgccgacatgttcagccacgaggagaacggccccgagcccgactgggtgctgagcgagagagagcagttcaacgagttcagagacctgaacaaggacggcaagctggacaaggacgagatcagacactggatcctgccccaggactacgaccacgcccaggccgaggccagacacctggtgtacgagagcgacaagaacaaggacgagaagctgaccaaggaggagatcctggagaactggaacatgttcgtgggcagccaggccaccaactacggcgaggacctgaccaagaaccacgacgagctgtag

SEQ ID NO: 96819 - DNA, 87 bp, Artificial Sequence
  Description of Artificial Sequence: Synthetic coding sequence
gagatcctggagaactggaacatgttcgtgggcagccaggccaccaactacggcgaggacctgaccaagaaccacgacgagctgtag

SEQ ID NO: 96820 - DNA, 954 bp, Artificial Sequence
  Description of Artificial Sequence: Synthetic coding sequence
atgagactgggccccagaaccgccgccctgggcctgctgctgctgtgcgccgccgccgccggcgccggcaaggccgaggagctgcactaccccctgggcgagagaagaagcgactacgacagagaggccctgctgggcgtgcaggaggacgtggacgagtacgtgaagctgggccacgaggagcagcagaagagactgcaggccatcatcaagaagatcgacctggacagcgacggcttcctgaccgagagcgagctgagcagctggatccagatgagcttcaagcactacgccatgcaggaggccaagcagcagttcgtggagtacgacaagaacagcgacgacaccgtgacctgggacgagtacaacatccagatgtacgacagagtgatcgacttcgacgagaacaccgccctggacgacgccgaggaggagagcttcagaaagctgcacctgaaggacaagaagagattcgagaaggccaaccaggacagcggccccggcctgagcctggaggagttcatcgccttcgagcaccccgaggaggtggactacatgaccgagttcgtgatccaggaggccctggaggagcacgacaagaacggcgacggcttcgtgagcctggaggagttcctgggcgactacagatgggaccccaccgccaacgaggaccccgagtggatcctggtggagaaggacagattcgtgaacgactacgacaaggacaacgacggcagactggacccccaggagctgctgccctgggtggtgcccaacaaccagggcatcgcccaggaggaggccctgcacctgatcgacgagatggacctgaacggcgacaagaagctgagcgaggaggagatcctggagaaccccgacctgttcctgaccagcgaggccaccgactacggcagacagctgcacgacgactacttctaccacgacgagctgtag

SEQ ID NO: 96821 - DNA, 2331 bp, Artificial Sequence
  Description of Artificial Sequence: Synthetic coding sequence
atggccgcccccggcgacccccaggacgagctgctgcccctggccggccccggcagccagtggctgagacacagaggcgagggcgagaacgaggccgtgacccccaagggcgccacccccgccccccaggccggcgagcccagccccggcctgggcgccagagccagagaggccgccagcagagaggccggcagcggccccgccagacagagccccgtggccatggagaccgccagcaccggcgtggccggcgtgagcagcgccatggaccacaccttcagcaccaccagcaaggacggcgagggcagctgctacaccagcctgatcagcgacatctgctaccccccccaggaggacagcacctacttcaccggcatcctgcagaaggagaacggccacgtgaccatcagcgagagccccgaggagctgggcacccccggccccagcctgcccgacgtgcccggcatcgagagcagaggcctgttcagcagcgacagcggcatcgagatgacccccgccgagagcaccgaggtgaacaagatcctggccgaccccctggaccagatgaaggccgaggcctacaagtacatcgacatcaccagacccgaggaggtgaagcaccaggagcagcaccaccccgagctggaggacaaggacctggacttcaagaacaaggacaccgacatcagcatcaagcccgagggcgtgagagagcccgacaagcccgcccccgtggagggcaagatcatcaaggaccacctgctggaggagagcaccttcgccccctacatcgacgacctgagcgaggagcagagaagagccccccagatcaccacccccgtgaagatcaccctgaccgagatcgagcccagcgtggagaccaccacccaggagaagacccccgagaagcaggacatctgcctgaagcccagccccgacaccgtgcccaccgtgaccgtgagcgagcccgaggacgacagccccggcagcatcaccccccccagcagcggcaccgagcccagcgccgccgagagccagggcaagggcagcatcagcgaggacgagctgatcaccgccatcaaggaggccaagggcctgagctacgagaccgccgagaaccccagacccgtgggccagctggccgacagacccgaggtgaaggccagaagcggcccccccaccatccccagccccctggaccacgaggccagcagcgccgagagcggcgacagcgagatcgagctggtgagcgaggaccccatggccgccgaggacgccctgcccagcggctacgtgagcttcggccacgtgggcggccccccccccagccccgccagccccagcatccagtacagcatcctgagagaggagagagaggccgagctggacagcgagctgatcatcgagagctgcgacgccagcagcgccagcgaggagagccccaagagagagcaggacagcccccccatgaagcccagcgccctggacgccatcagagaggagaccggcgtgagagccgaggagagagcccccagcagaagaggcctggccgagcccggcagcttcctggactaccccagcaccgagccccagcccggccccgagctgccccccggcgacggcgccctggagcccgagacccccatgctgcccagaaagcccgaggaggacagcagcagcaaccagagccccgccgccaccaagggccccggccccctgggccccggcgcccccccccccctgctgttcctgaacaagcagaaggccatcgacctgctgtactggagagacatcaagcagaccggcatcgtgttcggcagcttcctgctgctgctgttcagcctgacccagttcagcgtggtgagcgtggtggcctacctggccctggccgccctgagcgccaccatcagcttcagaatctacaagagcgtgctgcaggccgtgcagaagaccgacgagggccaccccttcaaggcctacctggagctggagatcaccctgagccaggagcagatccagaagtacaccgactgcctgcagttctacgtgaacagcaccctgaaggagctgagaagactgttcctggtgcaggacctggtggacagcctgaagttcgccgtgctgatgtggctgctgacctacgtgggcgccctgttcaacggcctgaccctgctgctgatggccgtggtgagcatgttcaccctgcccgtggtgtacgtgaagcaccaggcccagatcgaccagtacctgggcctggtgagaacccacatcaacgccgtggtggccaagatccaggccaagatccccggcgccaagagacacgccgagtag

SEQ ID NO: 96822 - DNA, 627 bp, Artificial Sequence
  Description of Artificial Sequence: Synthetic coding sequence
atgcaggccaccgccgacagcaccaagatggactgcgtgtggagcaactggaagagccaggccatcgacctgctgtactggagagacatcaagcagaccggcatcgtgttcggcagcttcctgctgctgctgttcagcctgacccagttcagcgtggtgagcgtggtggcctacctggccctggccgccctgagcgccaccatcagcttcagaatctacaagagcgtgctgcaggccgtgcagaagaccgacgagggccaccccttcaaggcctacctggagctggagatcaccctgagccaggagcagatccagaagtacaccgactgcctgcagttctacgtgaacagcaccctgaaggagctgagaagactgttcctggtgcaggacctggtggacagcctgaagttcgccgtgctgatgtggctgctgacctacgtgggcgccctgttcaacggcctgaccctgctgctgatggccgtggtgagcatgttcaccctgcccgtggtgtacgtgaagcaccaggcccagatcgaccagtacctgggcctggtgagaacccacatcaacgccgtggtggccaagatccaggccaagatccccggcgccaagagacacgccgagtag

SEQ ID NO: 96823 - DNA, 1071 bp, Artificial Sequence
  Description of Artificial Sequence: Synthetic coding sequence
atggccgccgaggacgccctgcccagcggctacgtgagcttcggccacgtgggcggccccccccccagccccgccagccccagcatccagtacagcatcctgagagaggagagagaggccgagctggacagcgagctgatcatcgagagctgcgacgccagcagcgccagcgaggagagccccaagagagagcaggacagcccccccatgaagcccagcgccctggacgccatcagagaggagaccggcgtgagagccgaggagagagcccccagcagaagaggcctggccgagcccggcagcttcctggactaccccagcaccgagccccagcccggccccgagctgccccccggcgacggcgccctggagcccgagacccccatgctgcccagaaagcccgaggaggacagcagcagcaaccagagccccgccgccaccaagggccccggccccctgggccccggcgcccccccccccctgctgttcctgaacaagcagaaggccatcgacctgctgtactggagagacatcaagcagaccggcatcgtgttcggcagcttcctgctgctgctgttcagcctgacccagttcagcgtggtgagcgtggtggcctacctggccctggccgccctgagcgccaccatcagcttcagaatctacaagagcgtgctgcaggccgtgcagaagaccgacgagggccaccccttcaaggcctacctggagctggagatcaccctgagccaggagcagatccagaagtacaccgactgcctgcagttctacgtgaacagcaccctgaaggagctgagaagactgttcctggtgcaggacctggtggacagcctgaagttcgccgtgctgatgtggctgctgacctacgtgggcgccctgttcaacggcctgaccctgctgctgatggccgtggtgagcatgttcaccctgcccgtggtgtacgtgaagcaccaggcccagatcgaccagtacctgggcctggtgagaacccacatcaacgccgtggtggccaagatccaggccaagatccccggcgccaagagacacgccgagtag

SEQ ID NO: 96824 - DNA, 2109 bp, Artificial Sequence
  Description of Artificial Sequence: Synthetic coding sequence
atggagaccgccagcaccggcgtggccggcgtgagcagcgccatggaccacaccttcagcaccaccagcaaggacggcgagggcagctgctacaccagcctgatcagcgacatctgctaccccccccaggaggacagcacctacttcaccggcatcctgcagaaggagaacggccacgtgaccatcagcgagagccccgaggagctgggcacccccggccccagcctgcccgacgtgcccggcatcgagagcagaggcctgttcagcagcgacagcggcatcgagatgacccccgccgagagcaccgaggtgaacaagatcctggccgaccccctggaccagatgaaggccgaggcctacaagtacatcgacatcaccagacccgaggaggtgaagcaccaggagcagcaccaccccgagctggaggacaaggacctggacttcaagaacaaggacaccgacatcagcatcaagcccgagggcgtgagagagcccgacaagcccgcccccgtggagggcaagatcatcaaggaccacctgctggaggagagcaccttcgccccctacatcgacgacctgagcgaggagcagagaagagccccccagatcaccacccccgtgaagatcaccctgaccgagatcgagcccagcgtggagaccaccacccaggagaagacccccgagaagcaggacatctgcctgaagcccagccccgacaccgtgcccaccgtgaccgtgagcgagcccgaggacgacagccccggcagcatcaccccccccagcagcggcaccgagcccagcgccgccgagagccagggcaagggcagcatcagcgaggacgagctgatcaccgccatcaaggaggccaagggcctgagctacgagaccgccgagaaccccagacccgtgggccagctggccgacagacccgaggtgaaggccagaagcggcccccccaccatccccagccccctggaccacgaggccagcagcgccgagagcggcgacagcgagatcgagctggtgagcgaggaccccatggccgccgaggacgccctgcccagcggctacgtgagcttcggccacgtgggcggccccccccccagccccgccagccccagcatccagtacagcatcctgagagaggagagagaggccgagctggacagcgagctgatcatcgagagctgcgacgccagcagcgccagcgaggagagccccaagagagagcaggacagcccccccatgaagcccagcgccctggacgccatcagagaggagaccggcgtgagagccgaggagagagcccccagcagaagaggcctggccgagcccggcagcttcctggactaccccagcaccgagccccagcccggccccgagctgccccccggcgacggcgccctggagcccgagacccccatgctgcccagaaagcccgaggaggacagcagcagcaaccagagccccgccgccaccaagggccccggccccctgggccccggcgcccccccccccctgctgttcctgaacaagcagaaggccatcgacctgctgtactggagagacatcaagcagaccggcatcgtgttcggcagcttcctgctgctgctgttcagcctgacccagttcagcgtggtgagcgtggtggcctacctggccctggccgccctgagcgccaccatcagcttcagaatctacaagagcgtgctgcaggccgtgcagaagaccgacgagggccaccccttcaaggcctacctggagctggagatcaccctgagccaggagcagatccagaagtacaccgactgcctgcagttctacgtgaacagcaccctgaaggagctgagaagactgttcctggtgcaggacctggtggacagcctgaagttcgccgtgctgatgtggctgctgacctacgtgggcgccctgttcaacggcctgaccctgctgctgatggccgtggtgagcatgttcaccctgcccgtggtgtacgtgaagcaccaggcccagatcgaccagtacctgggcctggtgagaacccacatcaacgccgtggtggccaagatccaggccaagatccccggcgccaagagacacgccgagtag

SEQ ID NO: 96825 - DNA, 1638 bp, Artificial Sequence
  Description of Artificial Sequence: Synthetic coding sequence
atgggccaggtgctgcccgtgttcgcccactgcaaggaggcccccagcaccgccagcagcacccccgacagcaccgagggcggcaacgacgacagcgacttcagagagctgcacaccgccagagagttcagcgaggaggacgaggaggagaccaccagccaggactggggcacccccagagagctgaccttcagctacatcgccttcgacggcgtggtgggcagcggcggcagaagagacagcaccgccagaagacccagaccccagggcagaagcgtgagcgagcccagagaccagcacccccagcccagcctgggcgacagcctggagagcatccccagcctgagccagagccccgagcccggcagaagaggcgaccccgacaccgccccccccagcgagagacccctggaggacctgagactgagactggaccacctgggctgggtggccagaggcaccggcagcggcgaggacagcagcaccagcagcagcacccccctggaggacgaggagccccaggagcccaacagactggagaccggcgaggccggcgaggagctggacctgagactgagactggcccagcccagcagccccgaggtgctgaccccccagctgagccccggcagcggcaccccccaggccggcacccccagccccagcagaagcagagacagcaacagcggccccgaggagcccctgctggaggaggaggagaagcagtggggccccctggagagagagcccgtgagaggccagtgcctggacagcaccgaccagctggagttcaccgtggagcccagactgctgggcaccgccatggagtggctgaagaccagcctgctgctggccgtgtacaagaccgtgcccatcctggagctgagcccccccctgtggaccgccatcggctgggtgcagagaggccccaccccccccacccccgtgctgagagtgctgctgaagtgggccaagagccccagaagcagcggcgtgcccagcctgagcctgggcgccgacatgggcagcaaggtggccgacctgctgtactggaaggacaccagaaccagcggcgtggtgttcaccggcctgatggtgagcctgctgtgcctgctgcacttcagcatcgtgagcgtggccgcccacctggccctgctgctgctgtgcggcaccatcagcctgagagtgtacagaaaggtgctgcaggccgtgcacagaggcgacggcgccaaccccttccaggcctacctggacgtggacctgaccctgaccagagagcagaccgagagactgagccaccagatcaccagcagagtggtgagcgccgccacccagctgagacacttcttcctggtggaggacctggtggacagcctgaagctggccctgctgttctacatcctgaccttcgtgggcgccatcttcaacggcctgaccctgctgatcctgggcgtgatcggcctgttcaccatccccctgctgtacagacagcaccaggcccagatcgaccagtacgtgggcctggtgaccaaccagctgagccacatcaaggccaagatcagagccaagatccccggcaccggcgccctggccagcgccgccgccgccgtgagcggcagcaaggccaaggccgagtag

SEQ ID NO: 96826 - DNA, 1419 bp, Artificial Sequence
  Description of Artificial Sequence: Synthetic coding sequence
atgggccaggtgctgcccgtgttcgcccactgcaaggaggcccccagcaccgccagcagcacccccgacagcaccgagggcggcaacgacgacagcgacttcagagagctgcacaccgccagagagttcagcgaggaggacgaggaggagaccaccagccaggactggggcacccccagagagctgaccttcagctacatcgccttcgacggcgtggtgggcagcggcggcagaagagacagcaccgccagaagacccagaccccagggcagaagcgtgagcgagcccagagaccagcacccccagcccagcctgggcgacagcctggagagcatccccagcctgagccagagccccgagcccggcagaagaggcgaccccgacaccgccccccccagcgagagacccctggaggacctgagactgagactggaccacctgggctgggtggccagaggcaccggcagcggcgaggacagcagcaccagcagcagcacccccctggaggacgaggagccccaggagcccaacagactggagaccggcgaggccggcgaggagctggacctgagactgagactggcccagcccagcagccccgaggtgctgaccccccagctgagccccggcagcggcaccccccaggccggcacccccagccccagcagaagcagagacagcaacagcggccccgaggagcccctgctggaggaggaggagaagcagtggggccccctggagagagagcccgtgagaggccagtgcctggacagcaccgaccagctggagttcaccgtggagcccagactgctggtggccgacctgctgtactggaaggacaccagaaccagcggcgtggtgttcaccggcctgatggtgagcctgctgtgcctgctgcacttcagcatcgtgagcgtggccgcccacctggccctgctgctgctgtgcggcaccatcagcctgagagtgtacagaaaggtgctgcaggccgtgcacagaggcgacggcgccaaccccttccaggcctacctggacgtggacctgaccctgaccagagagcagaccgagagactgagccaccagatcaccagcagagtggtgagcgccgccacccagctgagacacttcttcctggtggaggacctggtggacagcctgaagctggccctgctgttctacatcctgaccttcgtgggcgccatcttcaacggcctgaccctgctgatcctgggcgtgatcggcctgttcaccatccccctgctgtacagacagcaccaggcccagatcgaccagtacgtgggcctggtgaccaaccagctgagccacatcaaggccaagatcagagccaagatccccggcaccggcgccctggccagcgccgccgccgccgtgagcggcagcaaggccaaggccgagtag

SEQ ID NO: 96827 - DNA, 618 bp, Artificial Sequence
  Description of Artificial Sequence: Synthetic coding sequence
atgggcagcaaggtggccgacctgctgtactggaaggacaccagaaccagcggcgtggtgttcaccggcctgatggtgagcctgctgtgcctgctgcacttcagcatcgtgagcgtggccgcccacctggccctgctgctgctgtgcggcaccatcagcctgagagtgtacagaaaggtgctgcaggccgtgcacagaggcgacggcgccaaccccttccaggcctacctggacgtggacctgaccctgaccagagagcagaccgagagactgagccaccagatcaccagcagagtggtgagcgccgccacccagctgagacacttcttcctggtggaggacctggtggacagcctgaagctggccctgctgttctacatcctgaccttcgtgggcgccatcttcaacggcctgaccctgctgatcctgggcgtgatcggcctgttcaccatccccctgctgtacagacagcaccaggcccagatcgaccagtacgtgggcctggtgaccaaccagctgagccacatcaaggccaagatcagagccaagatccccggcaccggcgccctggccagcgccgccgccgccgtgagcggcagcaaggccaaggccgagtag

SEQ ID NO: 96828 - DNA, 3042 bp, Artificial Sequence
  Description of Artificial Sequence: Synthetic coding sequence
atggccgagcccagcgccgccacccagagccacagcatcagcagcagcagcttcggcgccgagcccagcgcccccggcggcggcggcagccccggcgcctgccccgccctgggcaccaagagctgcagcagcagctgcgccgagggcctgagcagcctgtgcagcgacgagcccagcagcgagatcatgaccagcagcttcctgagcagcagcgagatccacaacaccggcctgaccatcctgcacggcgagaagagccacgtgctgggcagccagcccatcctggccaaggagggcaaggaccacctggacctgctggacatgaagaagatggagaagccccagggcaccagcaacaacgtgagcgacagcagcgtgagcctggccgccggcgtgcactgcgacagacccagcatccccgccagcttccccgagcaccccgccttcctgagcaagaagatcggccaggtggaggagcagatcgacaaggagaccaagaaccccaacggcgtgagcagcagagaggccaagaccgccctggacgccgacgacagattcaccctgctgaccgcccagaagccccccaccgagtacagcaaggtggagggcatctacacctacagcctgagccccagcaaggtgagcggcgacgacgtgatcgagaaggacagccccgagagccccttcgaggtgatcatcgacaaggccgccttcgacaaggagttcaaggacagctacaaggagagcaccgacgacttcggcagctggagcgtgcacaccgacaaggagagcagcgaggacatcagcgagaccaacgacaagctgttccccctgagaaacaaggaggccggcagataccccatgagcgccctgctgagcagacagttcagccacaccaacgccgccctggaggaggtgagcagatgcgtgaacgacatgcacaacttcaccaacgagatcctgacctgggacctggtgccccaggtgaagcagcagaccgacaagagcagcgactgcatcaccaagaccaccggcctggacatgagcgagtacaacagcgagatccccgtggtgaacctgaagaccagcacccaccagaagacccccgtgtgcagcatcgacggcagcacccccatcaccaagagcaccggcgactgggccgaggccagcctgcagcaggagaacgccatcaccggcaagcccgtgcccgacagcctgaacagcaccaaggagttcagcatcaagggcgtgcagggcaacatgcagaagcaggacgacaccctggccgagctgcccggcagcccccccgagaagtgcgacagcctgggcagcggcgtggccaccgtgaaggtggtgctgcccgacgaccacctgaaggacgagatggactggcagagcagcgccctgggcgagatcaccgaggccgacagcagcggcgagagcgacgacaccgtgatcgaggacatcaccgccgacaccagcttcgagaacaacaagatccaggccgagaagcccgtgagcatccccagcgccgtggtgaagaccggcgagagagagatcaaggagatccccagctgcgagagagaggagaagaccagcaagaacttcgaggagctggtgagcgacagcgagctgcaccaggaccagcccgacatcctgggcagaagccccgccagcgaggccgcctgcagcaaggtgcccgacaccaacgtgagcctggaggacgtgagcgaggtggcccccgagaagcccatcaccaccgagaaccccaagctgcccagcaccgtgagccccaacgtgttcaacgagaccgagttcagcctgaacgtgaccaccagcgcctacctggagagcctgcacggcaagaacgtgaagcacatcgacgacagcagccccgaggacctgatcgccgccttcaccgagaccagagacaagggcatcgtggacagcgagagaaacgccttcaaggccatcagcgagaagatgaccgacttcaagaccaccccccccgtggaggtgctgcacgagaacgagagcggcggcagcgagatcaaggacatcggcagcaagtacagcgagcagagcaaggagaccaacggcagcgagcccctgggcgtgttccccacccagggcacccccgtggccagcctggacctggagcaggagcagctgaccatcaaggccctgaaggagctgggcgagagacaggtggagaagagcaccagcgcccagagagacgccgagctgcccagcgaggaggtgctgaagcagaccttcaccttcgcccccgagagctggccccagagaagctacgacatcctggagagaaacgtgaagaacggcagcgacctgggcatcagccagaagcccatcaccatcagagagaccaccagagtggacgccgtgagcagcctgagcaagaccgagctggtgaagaagcacgtgctggccagactgctgaccgacttcagcgtgcacgacctgatcttctggagagacgtgaagaagaccggcttcgtgttcggcaccaccctgatcatgctgctgagcctggccgccttcagcgtgatcagcgtggtgagctacctgatcctggccctgctgagcgtgaccatcagcttcagaatctacaagagcgtgatccaggccgtgcagaagagcgaggagggccaccccttcaaggcctacctggacgtggacatcaccctgagcagcgaggccttccacaactacatgaacgccgccatggtgcacatcaacagagccctgaagctgatcatcagactgttcctggtggaggacctggtggacagcctgaagctggccgtgttcatgtggctgatgacctacgtgggcgccgtgttcaacggcatcaccctgctgatcctggccgagctgctgatcttcagcgtgcccatcgtgtacgagaagtacaagacccagatcgaccactacgtgggcatcgccagagaccagaccaagagcatcgtggagaagatccaggccaagctgcccggcatcgccaagaagaaggccgagtag

SEQ ID NO: 96829 - DNA, 726 bp, Artificial Sequence
  Description of Artificial Sequence: Synthetic coding sequence
atggccgagcccagcgccgccacccagagccacagcatcagcagcagcagcttcggcgccgagcccagcgcccccggcggcggcggcagccccggcgcctgccccgccctgggcaccaagagctgcagcagcagctgcgccgtgcacgacctgatcttctggagagacgtgaagaagaccggcttcgtgttcggcaccaccctgatcatgctgctgagcctggccgccttcagcgtgatcagcgtggtgagctacctgatcctggccctgctgagcgtgaccatcagcttcagaatctacaagagcgtgatccaggccgtgcagaagagcgaggagggccaccccttcaaggcctacctggacgtggacatcaccctgagcagcgaggccttccacaactacatgaacgccgccatggtgcacatcaacagagccctgaagctgatcatcagactgttcctggtggaggacctggtggacagcctgaagctggccgtgttcatgtggctgatgacctacgtgggcgccgtgttcaacggcatcaccctgctgatcctggccgagctgctgatcttcagcgtgcccatcgtgtacgagaagtacaaggaccccagcaagaccccctggaacagacagaagaagggcagaatcagcacctggaagcccgagatgcagcagctgctgaagcaccacctgatcgtgatcaccagcctgctggtgctgtag

SEQ ID NO: 96830 - DNA, 645 bp, Artificial Sequence
  Description of Artificial Sequence: Synthetic coding sequence
atggccgagcccagcgccgccacccagagccacagcatcagcagcagcagcttcggcgccgagcccagcgcccccggcggcggcggcagccccggcgcctgccccgccctgggcaccaagagctgcagcagcagctgcgccgtgcacgacctgatcttctggagagacgtgaagaagaccggcttcgtgttcggcaccaccctgatcatgctgctgagcctggccgccttcagcgtgatcagcgtggtgagctacctgatcctggccctgctgagcgtgaccatcagcttcagaatctacaagagcgtgatccaggccgtgcagaagagcgaggagggccaccccttcaagcccagactgatcaccatgctggccagccccgagatcagacccagccagctgctgaagagaagcaagcagaacagcctggagagccccaagaagagacagaacaagtacatggagaccagaaacgccaccgtgaccaagacccccttcaacagctacaacgtggtgacctgcaccatgaaggagaacacccagtgccagctggagcccgccttccaggccttcttcctgatctggtgcttcctgcccagcttccccttcaacccccagtaccaggcccagaagctgatggactag

SEQ ID NO: 96831 - DNA, 768 bp, Artificial Sequence
  Description of Artificial Sequence: Synthetic coding sequence
atggccgagcccagcgccgccacccagagccacagcatcagcagcagcagcttcggcgccgagcccagcgcccccggcggcggcggcagccccggcgcctgccccgccctgggcaccaagagctgcagcagcagctgcgccgacagcttcgtgagcagcagcagcagccagcccgtgagcctgttcagcaccagccaggtgcacgacctgatcttctggagagacgtgaagaagaccggcttcgtgttcggcaccaccctgatcatgctgctgagcctggccgccttcagcgtgatcagcgtggtgagctacctgatcctggccctgctgagcgtgaccatcagcttcagaatctacaagagcgtgatccaggccgtgcagaagagcgaggagggccaccccttcaaggcctacctggacgtggacatcaccctgagcagcgaggccttccacaactacatgaacgccgccatggtgcacatcaacagagccctgaagctgatcatcagactgttcctggtggaggacctggtggacagcctgaagctggccgtgttcatgtggctgatgacctacgtgggcgccgtgttcaacggcatcaccctgctgatcctggccgagctgctgatcttcagcgtgcccatcgtgtacgagaagtacaagacccagatcgaccactacgtgggcatcgccagagaccagaccaagagcatcgtggagaagatccaggccaagctgcccggcatcgccaagaagaaggccgagtag

SEQ ID NO: 96832 - DNA, 3099 bp, Artificial Sequence
  Description of Artificial Sequence: Synthetic coding sequence
atggccgagcccagcgccgccacccagagccacagcatcagcagcagcagcttcggcgccgagcccagcgcccccggcggcggcggcagccccggcgcctgccccgccctgggcaccaagagctgcagcagcagctgcgccgacagcttcgtgagcagcagcagcagccagcccgtgagcctgttcagcaccagccaggagggcctgagcagcctgtgcagcgacgagcccagcagcgagatcatgaccagcagcttcctgagcagcagcgagatccacaacaccggcctgaccatcctgcacggcgagaagagccacgtgctgggcagccagcccatcctggccaaggagggcaaggaccacctggacctgctggacatgaagaagatggagaagccccagggcaccagcaacaacgtgagcgacagcagcgtgagcctggccgccggcgtgcactgcgacagacccagcatccccgccagcttccccgagcaccccgccttcctgagcaagaagatcggccaggtggaggagcagatcgacaaggagaccaagaaccccaacggcgtgagcagcagagaggccaagaccgccctggacgccgacgacagattcaccctgctgaccgcccagaagccccccaccgagtacagcaaggtggagggcatctacacctacagcctgagccccagcaaggtgagcggcgacgacgtgatcgagaaggacagccccgagagccccttcgaggtgatcatcgacaaggccgccttcgacaaggagttcaaggacagctacaaggagagcaccgacgacttcggcagctggagcgtgcacaccgacaaggagagcagcgaggacatcagcgagaccaacgacaagctgttccccctgagaaacaaggaggccggcagataccccatgagcgccctgctgagcagacagttcagccacaccaacgccgccctggaggaggtgagcagatgcgtgaacgacatgcacaacttcaccaacgagatcctgacctgggacctggtgccccaggtgaagcagcagaccgacaagagcagcgactgcatcaccaagaccaccggcctggacatgagcgagtacaacagcgagatccccgtggtgaacctgaagaccagcacccaccagaagacccccgtgtgcagcatcgacggcagcacccccatcaccaagagcaccggcgactgggccgaggccagcctgcagcaggagaacgccatcaccggcaagcccgtgcccgacagcctgaacagcaccaaggagttcagcatcaagggcgtgcagggcaacatgcagaagcaggacgacaccctggccgagctgcccggcagcccccccgagaagtgcgacagcctgggcagcggcgtggccaccgtgaaggtggtgctgcccgacgaccacctgaaggacgagatggactggcagagcagcgccctgggcgagatcaccgaggccgacagcagcggcgagagcgacgacaccgtgatcgaggacatcaccgccgacaccagcttcgagaacaacaagatccaggccgagaagcccgtgagcatccccagcgccgtggtgaagaccggcgagagagagatcaaggagatccccagctgcgagagagaggagaagaccagcaagaacttcgaggagctggtgagcgacagcgagctgcaccaggaccagcccgacatcctgggcagaagccccgccagcgaggccgcctgcagcaaggtgcccgacaccaacgtgagcctggaggacgtgagcgaggtggcccccgagaagcccatcaccaccgagaaccccaagctgcccagcaccgtgagccccaacgtgttcaacgagaccgagttcagcctgaacgtgaccaccagcgcctacctggagagcctgcacggcaagaacgtgaagcacatcgacgacagcagccccgaggacctgatcgccgccttcaccgagaccagagacaagggcatcgtggacagcgagagaaacgccttcaaggccatcagcgagaagatgaccgacttcaagaccaccccccccgtggaggtgctgcacgagaacgagagcggcggcagcgagatcaaggacatcggcagcaagtacagcgagcagagcaaggagaccaacggcagcgagcccctgggcgtgttccccacccagggcacccccgtggccagcctggacctggagcaggagcagctgaccatcaaggccctgaaggagctgggcgagagacaggtggagaagagcaccagcgcccagagagacgccgagctgcccagcgaggaggtgctgaagcagaccttcaccttcgcccccgagagctggccccagagaagctacgacatcctggagagaaacgtgaagaacggcagcgacctgggcatcagccagaagcccatcaccatcagagagaccaccagagtggacgccgtgagcagcctgagcaagaccgagctggtgaagaagcacgtgctggccagactgctgaccgacttcagcgtgcacgacctgatcttctggagagacgtgaagaagaccggcttcgtgttcggcaccaccctgatcatgctgctgagcctggccgccttcagcgtgatcagcgtggtgagctacctgatcctggccctgctgagcgtgaccatcagcttcagaatctacaagagcgtgatccaggccgtgcagaagagcgaggagggccaccccttcaaggcctacctggacgtggacatcaccctgagcagcgaggccttccacaactacatgaacgccgccatggtgcacatcaacagagccctgaagctgatcatcagactgttcctggtggaggacctggtggacagcctgaagctggccgtgttcatgtggctgatgacctacgtgggcgccgtgttcaacggcatcaccctgctgatcctggccgagctgctgatcttcagcgtgcccatcgtgtacgagaagtacaagacccagatcgaccactacgtgggcatcgccagagaccagaccaagagcatcgtggagaagatccaggccaagctgcccggcatcgccaagaagaaggccgagtag

SEQ ID NO: 96833 - DNA, 372 bp, Artificial Sequence
  Description of Artificial Sequence: Synthetic coding sequence
atggccgagcccagcgccgccacccagagccacagcatcagcagcagcagcttcggcgccgagcccagcgcccccggcggcggcggcagccccggcgcctgccccgccctgggcaccaagagctgcagcagcagctgcgccgtgcacgacctgatcttctggagagacgtgaagaagaccggcttcgtgttcggcaccaccctgatcatgctgctgagcctggccgccttcagcgtgatcagcgtggtgagctacctgatcctggccctgctgagcgtgaccatcagcttcagaatctacaagagcgtgatccaggccgtgcagaagagcgaggagggccaccccttcaactggctgagcagctgcggctag

SEQ ID NO: 96834 - DNA, 711 bp, Artificial Sequence
  Description of Artificial Sequence: Synthetic coding sequence
atggccgagcccagcgccgccacccagagccacagcatcagcagcagcagcttcggcgccgagcccagcgcccccggcggcggcggcagccccggcgcctgccccgccctgggcaccaagagctgcagcagcagctgcgccgtgcacgacctgatcttctggagagacgtgaagaagaccggcttcgtgttcggcaccaccctgatcatgctgctgagcctggccgccttcagcgtgatcagcgtggtgagctacctgatcctggccctgctgagcgtgaccatcagcttcagaatctacaagagcgtgatccaggccgtgcagaagagcgaggagggccaccccttcaaggcctacctggacgtggacatcaccctgagcagcgaggccttccacaactacatgaacgccgccatggtgcacatcaacagagccctgaagctgatcatcagactgttcctggtggaggacctggtggacagcctgaagctggccgtgttcatgtggctgatgacctacgtgggcgccgtgttcaacggcatcaccctgctgatcctggccgagctgctgatcttcagcgtgcccatcgtgtacgagaagtacaagacccagatcgaccactacgtgggcatcgccagagaccagaccaagagcatcgtggagaagatccaggccaagctgcccggcatcgccaagaagaaggccgagtag

SEQ ID NO: 96835 - DNA, 1122 bp, Artificial Sequence
  Description of Artificial Sequence: Synthetic coding sequence
atggaggacctggaccagagccccctggtgagcagcagcgacagcccccccagaccccagcccgccttcaagtaccagttcgtgagagagcccgaggacgaggaggaggaggaggaggaggaggaggaggacgaggacgaggacctggaggagctggaggtgctggagagaaagcccgccgccggcctgagcgccgcccccgtgcccaccgcccccgccgccggcgcccccctgatggacttcggcaacgacttcgtgccccccgcccccagaggccccctgcccgccgccccccccgtggcccccgagagacagcccagctgggaccccagccccgtgagcagcaccgtgcccgcccccagccccctgagcgccgccgccgtgagccccagcaagctgcccgaggacgacgagccccccgccagaccccccccccccccccccgccagcgtgagcccccaggccgagcccgtgtggaccccccccgcccccgcccccgccgccccccccagcacccccgccgcccccaagagaagaggcagcagcggcagcgtggtggtggacctgctgtactggagagacatcaagaagaccggcgtggtgttcggcgccagcctgttcctgctgctgagcctgaccgtgttcagcatcgtgagcgtgaccgcctacatcgccctggccctgctgagcgtgaccatcagcttcagaatctacaagggcgtgatccaggccatccagaagagcgacgagggccaccccttcagagcctacctggagagcgaggtggccatcagcgaggagctggtgcagaagtacagcaacagcgccctgggccacgtgaactgcaccatcaaggagctgagaagactgttcctggtggacgacctggtggacagcctgaagttcgccgtgctgatgtgggtgttcacctacgtgggcgccctgttcaacggcctgaccctgctgatcctggccctgatcagcctgttcagcgtgcccgtgatctacgagagacaccaggcccagatcgaccactacctgggcctggccaacaagaacgtgaaggacgccatggccaagatccaggccaagatccccggcctgaagagaaaggccgagtag

SEQ ID NO: 96836 - DNA, 3579 bp, Artificial Sequence
  Description of Artificial Sequence: Synthetic coding sequence
atggaggacctggaccagagccccctggtgagcagcagcgacagcccccccagaccccagcccgccttcaagtaccagttcgtgagagagcccgaggacgaggaggaggaggaggaggaggaggaggaggacgaggacgaggacctggaggagctggaggtgctggagagaaagcccgccgccggcctgagcgccgcccccgtgcccaccgcccccgccgccggcgcccccctgatggacttcggcaacgacttcgtgccccccgcccccagaggccccctgcccgccgccccccccgtggcccccgagagacagcccagctgggaccccagccccgtgagcagcaccgtgcccgcccccagccccctgagcgccgccgccgtgagccccagcaagctgcccgaggacgacgagccccccgccagaccccccccccccccccccgccagcgtgagcccccaggccgagcccgtgtggaccccccccgcccccgcccccgccgccccccccagcacccccgccgcccccaagagaagaggcagcagcggcagcgtggacgagaccctgttcgccctgcccgccgccagcgagcccgtgatcagaagcagcgccgagaacatggacctgaaggagcagcccggcaacaccatcagcgccggccaggaggacttccccagcgtgctgctggagaccgccgccagcctgcccagcctgagccccctgagcgccgccagcttcaaggagcacgagtacctgggcaacctgagcaccgtgctgcccaccgagggcaccctgcaggagaacgtgagcgaggccagcaaggaggtgagcgagaaggccaagaccctgctgatcgacagagacctgaccgagttcagcgagctggagtacagcgagatgggcagcagcttcagcgtgagccccaaggccgagagcgccgtgatcgtggccaaccccagagaggagatcatcgtgaagaacaaggacgaggaggagaagctggtgagcaacaacatcctgcacaaccagcaggagctgcccaccgccctgaccaagctggtgaaggaggacgaggtggtgagcagcgagaaggccaaggacagcttcaacgagaagagagtggccgtggaggcccccatgagagaggagtacgccgacttcaagcccttcgagagagtgtgggaggtgaaggacagcaaggaggacagcgacatgctggccgccggcggcaagatcgagagcaacctggagagcaaggtggacaagaagtgcttcgccgacagcctggagcagaccaaccacgagaaggacagcgagagcagcaacgacgacaccagcttccccagcacccccgagggcatcaaggacagaagcggcgcctacatcacctgcgcccccttcaaccccgccgccaccgagagcatcgccaccaacatcttccccctgctgggcgaccccaccagcgagaacaagaccgacgagaagaagatcgaggagaagaaggcccagatcgtgaccgagaagaacaccagcaccaagaccagcaaccccttcctggtggccgcccaggacagcgagaccgactacgtgaccaccgacaacctgaccaaggtgaccgaggaggtggtggccaacatgcccgagggcctgacccccgacctggtgcaggaggcctgcgagagcgagctgaacgaggtgaccggcaccaagatcgcctacgagaccaagatggacctggtgcagaccagcgaggtgatgcaggagagcctgtaccccgccgcccagctgtgccccagcttcgaggagagcgaggccacccccagccccgtgctgcccgacatcgtgatggaggcccccctgaacagcgccgtgcccagcgccggcgccagcgtgatccagcccagcagcagccccctggaggccagcagcgtgaactacgagagcatcaagcacgagcccgagaacccccccccctacgaggaggccatgagcgtgagcctgaagaaggtgagcggcatcaaggaggagatcaaggagcccgagaacatcaacgccgccctgcaggagaccgaggccccctacatcagcatcgcctgcgacctgatcaaggagaccaagctgagcgccgagcccgcccccgacttcagcgactacagcgagatggccaaggtggagcagcccgtgcccgaccacagcgagctggtggaggacagcagccccgacagcgagcccgtggacctgttcagcgacgacagcatccccgacgtgccccagaagcaggacgagaccgtgatgctggtgaaggagagcctgaccgagaccagcttcgagagcatgatcgagtacgagaacaaggagaagctgagcgccctgccccccgagggcggcaagccctacctggagagcttcaagctgagcctggacaacaccaaggacaccctgctgcccgacgaggtgagcaccctgagcaagaaggagaagatccccctgcagatggaggagctgagcaccgccgtgtacagcaacgacgacctgttcatcagcaaggaggcccagatcagagagaccgagaccttcagcgacagcagccccatcgagatcatcgacgagttccccaccctgatcagcagcaagaccgacagcttcagcaagctggccagagagtacaccgacctggaggtgagccacaagagcgagatcgccaacgcccccgacggcgccggcagcctgccctgcaccgagctgccccacgacctgagcctgaagaacatccagcccaaggtggaggagaagatcagcttcagcgacgacttcagcaagaacggcagcgccaccagcaaggtgctgctgctgccccccgacgtgagcgccctggccacccaggccgagatcgagagcatcgtgaagcccaaggtgctggtgaaggaggccgagaagaagctgcccagcgacaccgagaaggaggacagaagccccagcgccatcttcagcgccgagctgagcaagaccagcgtggtggacctgctgtactggagagacatcaagaagaccggcgtggtgttcggcgccagcctgttcctgctgctgagcctgaccgtgttcagcatcgtgagcgtgaccgcctacatcgccctggccctgctgagcgtgaccatcagcttcagaatctacaagggcgtgatccaggccatccagaagagcgacgagggccaccccttcagagcctacctggagagcgaggtggccatcagcgaggagctggtgcagaagtacagcaacagcgccctgggccacgtgaactgcaccatcaaggagctgagaagactgttcctggtggacgacctggtggacagcctgaagttcgccgtgctgatgtgggtgttcacctacgtgggcgccctgttcaacggcctgaccctgctgatcctggccctgatcagcctgttcagcgtgcccgtgatctacgagagacaccaggcccagatcgaccactacctgggcctggccaacaagaacgtgaaggacgccatggccaagatccaggccaagatccccggcctgaagagaaaggccgagtag

SEQ ID NO: 96837 - DNA, 2883 bp, Artificial Sequence
  Description of Artificial Sequence: Synthetic coding sequence
atggaggacctggaccagagccccctggtgagcagcagcgacagcccccccagaccccagcccgccttcaagtaccagttcgtgagagagcccgaggacgaggaggaggaggaggaggaggaggaggaggacgaggacgaggacctggaggagctggaggtgctggagagaaagcagttcagcgagctggagtacagcgagatgggcagcagcttcagcgtgagccccaaggccgagagcgccgtgatcgtggccaaccccagagaggagatcatcgtgaagaacaaggacgaggaggagaagctggtgagcaacaacatcctgcacaaccagcaggagctgcccaccgccctgaccaagctggtgaaggaggacgaggtggtgagcagcgagaaggccaaggacagcttcaacgagaagagagtggccgtggaggcccccatgagagaggagtacgccgacttcaagcccttcgagagagtgtgggaggtgaaggacagcaaggaggacagcgacatgctggccgccggcggcaagatcgagagcaacctggagagcaaggtggacaagaagtgcttcgccgacagcctggagcagaccaaccacgagaaggacagcgagagcagcaacgacgacaccagcttccccagcacccccgagggcatcaaggacagaagcggcgcctacatcacctgcgcccccttcaaccccgccgccaccgagagcatcgccaccaacatcttccccctgctgggcgaccccaccagcgagaacaagaccgacgagaagaagatcgaggagaagaaggcccagatcgtgaccgagaagaacaccagcaccaagaccagcaaccccttcctggtggccgcccaggacagcgagaccgactacgtgaccaccgacaacctgaccaaggtgaccgaggaggtggtggccaacatgcccgagggcctgacccccgacctggtgcaggaggcctgcgagagcgagctgaacgaggtgaccggcaccaagatcgcctacgagaccaagatggacctggtgcagaccagcgaggtgatgcaggagagcctgtaccccgccgcccagctgtgccccagcttcgaggagagcgaggccacccccagccccgtgctgcccgacatcgtgatggaggcccccctgaacagcgccgtgcccagcgccggcgccagcgtgatccagcccagcagcagccccctggaggccagcagcgtgaactacgagagcatcaagcacgagcccgagaacccccccccctacgaggaggccatgagcgtgagcctgaagaaggtgagcggcatcaaggaggagatcaaggagcccgagaacatcaacgccgccctgcaggagaccgaggccccctacatcagcatcgcctgcgacctgatcaaggagaccaagctgagcgccgagcccgcccccgacttcagcgactacagcgagatggccaaggtggagcagcccgtgcccgaccacagcgagctggtggaggacagcagccccgacagcgagcccgtggacctgttcagcgacgacagcatccccgacgtgccccagaagcaggacgagaccgtgatgctggtgaaggagagcctgaccgagaccagcttcgagagcatgatcgagtacgagaacaaggagaagctgagcgccctgccccccgagggcggcaagccctacctggagagcttcaagctgagcctggacaacaccaaggacaccctgctgcccgacgaggtgagcaccctgagcaagaaggagaagatccccctgcagatggaggagctgagcaccgccgtgtacagcaacgacgacctgttcatcagcaaggaggcccagatcagagagaccgagaccttcagcgacagcagccccatcgagatcatcgacgagttccccaccctgatcagcagcaagaccgacagcttcagcaagctggccagagagtacaccgacctggaggtgagccacaagagcgagatcgccaacgcccccgacggcgccggcagcctgccctgcaccgagctgccccacgacctgagcctgaagaacatccagcccaaggtggaggagaagatcagcttcagcgacgacttcagcaagaacggcagcgccaccagcaaggtgctgctgctgccccccgacgtgagcgccctggccacccaggccgagatcgagagcatcgtgaagcccaaggtgctggtgaaggaggccgagaagaagctgcccagcgacaccgagaaggaggacagaagccccagcgccatcttcagcgccgagctgagcaagaccagcgtggtggacctgctgtactggagagacatcaagaagaccggcgtggtgttcggcgccagcctgttcctgctgctgagcctgaccgtgttcagcatcgtgagcgtgaccgcctacatcgccctggccctgctgagcgtgaccatcagcttcagaatctacaagggcgtgatccaggccatccagaagagcgacgagggccaccccttcagagcctacctggagagcgaggtggccatcagcgaggagctggtgcagaagtacagcaacagcgccctgggccacgtgaactgcaccatcaaggagctgagaagactgttcctggtggacgacctggtggacagcctgaagttcgccgtgctgatgtgggtgttcacctacgtgggcgccctgttcaacggcctgaccctgctgatcctggccctgatcagcctgttcagcgtgcccgtgatctacgagagacaccaggcccagatcgaccactacctgggcctggccaacaagaacgtgaaggacgccatggccaagatccaggccaagatccccggcctgaagagaaaggccgagtag

SEQ ID NO: 96838 - DNA, 2961 bp, Artificial Sequence
  Description of Artificial Sequence: Synthetic coding sequence
atggacctgaaggagcagcccggcaacaccatcagcgccggccaggaggacttccccagcgtgctgctggagaccgccgccagcctgcccagcctgagccccctgagcgccgccagcttcaaggagcacgagtacctgggcaacctgagcaccgtgctgcccaccgagggcaccctgcaggagaacgtgagcgaggccagcaaggaggtgagcgagaaggccaagaccctgctgatcgacagagacctgaccgagttcagcgagctggagtacagcgagatgggcagcagcttcagcgtgagccccaaggccgagagcgccgtgatcgtggccaaccccagagaggagatcatcgtgaagaacaaggacgaggaggagaagctggtgagcaacaacatcctgcacaaccagcaggagctgcccaccgccctgaccaagctggtgaaggaggacgaggtggtgagcagcgagaaggccaaggacagcttcaacgagaagagagtggccgtggaggcccccatgagagaggagtacgccgacttcaagcccttcgagagagtgtgggaggtgaaggacagcaaggaggacagcgacatgctggccgccggcggcaagatcgagagcaacctggagagcaaggtggacaagaagtgcttcgccgacagcctggagcagaccaaccacgagaaggacagcgagagcagcaacgacgacaccagcttccccagcacccccgagggcatcaaggacagaagcggcgcctacatcacctgcgcccccttcaaccccgccgccaccgagagcatcgccaccaacatcttccccctgctgggcgaccccaccagcgagaacaagaccgacgagaagaagatcgaggagaagaaggcccagatcgtgaccgagaagaacaccagcaccaagaccagcaaccccttcctggtggccgcccaggacagcgagaccgactacgtgaccaccgacaacctgaccaaggtgaccgaggaggtggtggccaacatgcccgagggcctgacccccgacctggtgcaggaggcctgcgagagcgagctgaacgaggtgaccggcaccaagatcgcctacgagaccaagatggacctggtgcagaccagcgaggtgatgcaggagagcctgtaccccgccgcccagctgtgccccagcttcgaggagagcgaggccacccccagccccgtgctgcccgacatcgtgatggaggcccccctgaacagcgccgtgcccagcgccggcgccagcgtgatccagcccagcagcagccccctggaggccagcagcgtgaactacgagagcatcaagcacgagcccgagaacccccccccctacgaggaggccatgagcgtgagcctgaagaaggtgagcggcatcaaggaggagatcaaggagcccgagaacatcaacgccgccctgcaggagaccgaggccccctacatcagcatcgcctgcgacctgatcaaggagaccaagctgagcgccgagcccgcccccgacttcagcgactacagcgagatggccaaggtggagcagcccgtgcccgaccacagcgagctggtggaggacagcagccccgacagcgagcccgtggacctgttcagcgacgacagcatccccgacgtgccccagaagcaggacgagaccgtgatgctggtgaaggagagcctgaccgagaccagcttcgagagcatgatcgagtacgagaacaaggagaagctgagcgccctgccccccgagggcggcaagccctacctggagagcttcaagctgagcctggacaacaccaaggacaccctgctgcccgacgaggtgagcaccctgagcaagaaggagaagatccccctgcagatggaggagctgagcaccgccgtgtacagcaacgacgacctgttcatcagcaaggaggcccagatcagagagaccgagaccttcagcgacagcagccccatcgagatcatcgacgagttccccaccctgatcagcagcaagaccgacagcttcagcaagctggccagagagtacaccgacctggaggtgagccacaagagcgagatcgccaacgcccccgacggcgccggcagcctgccctgcaccgagctgccccacgacctgagcctgaagaacatccagcccaaggtggaggagaagatcagcttcagcgacgacttcagcaagaacggcagcgccaccagcaaggtgctgctgctgccccccgacgtgagcgccctggccacccaggccgagatcgagagcatcgtgaagcccaaggtgctggtgaaggaggccgagaagaagctgcccagcgacaccgagaaggaggacagaagccccagcgccatcttcagcgccgagctgagcaagaccagcgtggtggacctgctgtactggagagacatcaagaagaccggcgtggtgttcggcgccagcctgttcctgctgctgagcctgaccgtgttcagcatcgtgagcgtgaccgcctacatcgccctggccctgctgagcgtgaccatcagcttcagaatctacaagggcgtgatccaggccatccagaagagcgacgagggccaccccttcagagcctacctggagagcgaggtggccatcagcgaggagctggtgcagaagtacagcaacagcgccctgggccacgtgaactgcaccatcaaggagctgagaagactgttcctggtggacgacctggtggacagcctgaagttcgccgtgctgatgtgggtgttcacctacgtgggcgccctgttcaacggcctgaccctgctgatcctggccctgatcagcctgttcagcgtgcccgtgatctacgagagacaccaggcccagatcgaccactacctgggcctggccaacaagaacgtgaaggacgccatggccaagatccaggccaagatccccggcctgaagagaaaggccgagtag

SEQ ID NO: 96839 - DNA, 1179 bp, Artificial Sequence
  Description of Artificial Sequence: Synthetic coding sequence
atggaggacctggaccagagccccctggtgagcagcagcgacagcccccccagaccccagcccgccttcaagtaccagttcgtgagagagcccgaggacgaggaggaggaggaggaggaggaggaggaggacgaggacgaggacctggaggagctggaggtgctggagagaaagcccgccgccggcctgagcgccgcccccgtgcccaccgcccccgccgccggcgcccccctgatggacttcggcaacgacttcgtgccccccgcccccagaggccccctgcccgccgccccccccgtggcccccgagagacagcccagctgggaccccagccccgtgagcagcaccgtgcccgcccccagccccctgagcgccgccgccgtgagccccagcaagctgcccgaggacgacgagccccccgccagaccccccccccccccccccgccagcgtgagcccccaggccgagcccgtgtggaccccccccgcccccgcccccgccgccccccccagcacccccgccgcccccaagagaagaggcagcagcggcagcgtggacgagaccctgttcgccctgcccgccgccagcgagcccgtgatcagaagcagcgccgtggtggacctgctgtactggagagacatcaagaagaccggcgtggtgttcggcgccagcctgttcctgctgctgagcctgaccgtgttcagcatcgtgagcgtgaccgcctacatcgccctggccctgctgagcgtgaccatcagcttcagaatctacaagggcgtgatccaggccatccagaagagcgacgagggccaccccttcagagcctacctggagagcgaggtggccatcagcgaggagctggtgcagaagtacagcaacagcgccctgggccacgtgaactgcaccatcaaggagctgagaagactgttcctggtggacgacctggtggacagcctgaagttcgccgtgctgatgtgggtgttcacctacgtgggcgccctgttcaacggcctgaccctgctgatcctggccctgatcagcctgttcagcgtgcccgtgatctacgagagacaccaggcccagatcgaccactacctgggcctggccaacaagaacgtgaaggacgccatggccaagatccaggccaagatccccggcctgaagagaaaggccgagtag

SEQ ID NO: 96840 - DNA, 600 bp, Artificial Sequence
  Description of Artificial Sequence: Synthetic coding sequence
atggacggccagaagaagaactggaaggacaaggtggtggacctgctgtactggagagacatcaagaagaccggcgtggtgttcggcgccagcctgttcctgctgctgagcctgaccgtgttcagcatcgtgagcgtgaccgcctacatcgccctggccctgctgagcgtgaccatcagcttcagaatctacaagggcgtgatccaggccatccagaagagcgacgagggccaccccttcagagcctacctggagagcgaggtggccatcagcgaggagctggtgcagaagtacagcaacagcgccctgggccacgtgaactgcaccatcaaggagctgagaagactgttcctggtggacgacctggtggacagcctgaagttcgccgtgctgatgtgggtgttcacctacgtgggcgccctgttcaacggcctgaccctgctgatcctggccctgatcagcctgttcagcgtgcccgtgatctacgagagacaccaggcccagatcgaccactacctgggcctggccaacaagaacgtgaaggacgccatggccaagatccaggccaagatccccggcctgaagagaaaggccgagtag

SEQ ID NO: 96841 - DNA, 2961 bp, Artificial Sequence; identical to SEQ ID NO: 96838
  Description of Artificial Sequence: Synthetic coding sequence

SEQ ID NO: 96842 - DNA, 1038 bp, Artificial Sequence
  Description of Artificial Sequence: Synthetic coding sequence
atggagcccgaggacgaggaggaggaggaggaggaggaggaggaggacgaggacgaggacctggaggagctggaggtgctggagagaaagcccgccgccggcctgagcgccgcccccgtgcccaccgcccccgccgccggcgcccccctgatggacttcggcaacgacttcgtgccccccgcccccagaggccccctgcccgccgccccccccgtggcccccgagagacagcccagctgggaccccagccccgtgagcagcaccgtgcccgcccccagccccctgagcgccgccgccgtgagccccagcaagctgcccgaggacgacgagccccccgccagaccccccccccccccccccgccagcgtgagcccccaggccgagcccgtgtggaccccccccgcccccgcccccgccgccccccccagcacccccgccgcccccaagagaagaggcagcagcggcagcgtggtggtggacctgctgtactggagagacatcaagaagaccggcgtggtgttcggcgccagcctgttcctgctgctgagcctgaccgtgttcagcatcgtgagcgtgaccgcctacatcgccctggccctgctgagcgtgaccatcagcttcagaatctacaagggcgtgatccaggccatccagaagagcgacgagggccaccccttcagagcctacctggagagcgaggtggccatcagcgaggagctggtgcagaagtacagcaacagcgccctgggccacgtgaactgcaccatcaaggagctgagaagactgttcctggtggacgacctggtggacagcctgaagttcgccgtgctgatgtgggtgttcacctacgtgggcgccctgttcaacggcctgaccctgctgatcctggccctgatcagcctgttcagcgtgcccgtgatctacgagagacaccaggcccagatcgaccactacctgggcctggccaacaagaacgtgaaggacgccatggccaagatccaggccaagatccccggcctgaagagaaaggccgagtag

SEQ ID NO: 96843 - DNA, 2961 bp, Artificial Sequence; identical to SEQ ID NO: 96838
  Description of Artificial Sequence: Synthetic coding sequence

SEQ ID NO: 96844 - DNA, 2961 bp, Artificial Sequence; identical to SEQ ID NO: 96838
  Description of Artificial Sequence: Synthetic coding sequence

SEQ ID NO: 96845 - DNA, 276 bp, Artificial Sequence
  Description of Artificial Sequence: Synthetic coding sequence
atggacctgaaggagcagcccggcaacaccatcagcgccggccaggaggacttccccagcgtgctgctggagaccgccgccagcctgcccagcctgagccccctgagcgccgccagcttcaaggagcacgagtacctgggcaacctgagcaccgtgctgcccaccgagggcaccctgcaggagaacgtgagcgaggccagcaaggaggtgagcgagaaggccaagaccctgctgatcgacagagacctgaccgagttcagcgagctggagtactag

SEQ ID NO: 96846 - DNA, 1191 bp, Artificial Sequence
  Description of Artificial Sequence: Synthetic coding sequence
atggagttcctgaagacctgcgtgctgagaagaaacgcctgcaccgccgtgtgcttctggagaagcaaggtggtgcagaagcccagcgtgagaagaatcagcaccaccagccccagaagcaccgtgatgcccgcctgggtgatcgacaagtacggcaagaacgaggtgctgagattcacccagaacatgatgatgcccatcatccactaccccaacgaggtgatcgtgaaggtgcacgccgccagcgtgaaccccatcgacgtgaacatgagaagcggctacggcgccaccgccctgaacatgaagagagaccccctgcacgtgaagatcaagggcgaggagttccccctgaccctgggcagagacgtgagcggcgtggtgatggagtgcggcctggacgtgaagtacttcaagcccggcgacgaggtgtgggccgccgtgcccccctggaagcagggcaccctgagcgagttcgtggtggtgagcggcaacgaggtgagccacaagcccaagagcctgacccacacccaggccgccagcctgccctacgtggccctgaccgcctggagcgccatcaacaaggtgggcggcctgaacgacaagaactgcaccggcaagagagtgctgatcctgggcgccagcggcggcgtgggcaccttcgccatccaggtgatgaaggcctgggacgcccacgtgaccgccgtgtgcagccaggacgccagcgagctggtgagaaagctgggcgccgacgacgtgatcgactacaagagcggcagcgtggaggagcagctgaagagcctgaagcccttcgacttcatcctggacaacgtgggcggcagcaccgagacctgggcccccgacttcctgaagaagtggagcggcgccacctacgtgaccctggtgacccccttcctgctgaacatggacagactgggcatcgccgacggcatgctgcagaccggcgtgaccgtgggcagcaaggccctgaagcacttctggaagggcgtgcactacagatgggccttcttcatggccagcggcccctgcctggacgacatcgccgagctggtggacgccggcaagatcagacccgtgatcgagcagaccttccccttcagcaaggtgcccgaggccttcctgaaggtggagagaggccacgccagaggcaagaccgtgatcaacgtggtgtag

SEQ ID NO: 96847 - DNA, 681 bp, Artificial Sequence
  Description of Artificial Sequence: Synthetic coding sequence
atggagttcctgaagacctgcgtgctgagaagaaacgcctgcaccgccgtgtgcttctggagaagcaaggtggtgcagaagcccagcgtgagaagaatcagcaccaccagccccagaagcaccgtgatgcccgcctgggtgatcgacaagtacggcaagaacgaggtgctgagattcacccagaacatgatgatgcccatcatccactaccccaacgaggtgatcgtgaaggtgcacgccgccagcgtgaaccccatcgacgtgaacatgagaagcggctacggcgccaccgccctgaacatgaagagagaccccctgcacgtgaagatcaagggcgaggagttccccctgaccctgggcagagacgtgagcggcgtggtgatggagtgcggcctggacgtgaagtacttcaagcccggcgacgaggtgtgggccgccgtgcccccctggaagcagggcaccctgagcgagttcgtggtggtgagcggcaacgaggtgagccacaagcccaagagcctgacccacacccaggccgccagcctgccctacgtggccctgaccgcctggagcgccatcaacaaggtgggcggcctgaacgacaagaactgcaccggcaagagaatcagcggcaaggagagcatcatcgccggccacttcagctggcccgtggcccacgtgtag

SEQ ID NO: 96848 - DNA, 1422 bp, Artificial Sequence
  Description of Artificial Sequence: Synthetic coding sequence
atgaagagagccagcgccggcggcagcagactgctggcctgggtgctgtggctgcaggcctggcaggtggccgccccctgccccggcgcctgcgtgtgctacaacgagcccaaggtgaccaccagctgcccccagcagggcctgcaggccgtgcccgtgggcatccccgccgccagccagagaatcttcctgcacggcaacagaatcagccacgtgcccgccgccagcttcagagcctgcagaaacctgaccatcctgtggctgcacagcaacgtgctggccagaatcgacgccgccgccttcaccggcctggccctgctggagcagctggacctgagcgacaacgcccagctgagaagcgtggaccccgccaccttccacggcctgggcagactgcacaccctgcacctggacagatgcggcctgcaggagctgggccccggcctgttcagaggcctggccgccctgcagtacctgtacctgcaggacaacgccctgcaggccctgcccgacgacaccttcagagacctgggcaacctgacccacctgttcctgcacggcaacagaatcagcagcgtgcccgagagagccttcagaggcctgcacagcctggacagactgctgctgcaccagaacagagtggcccacgtgcacccccacgccttcagagacctgggcagactgatgaccctgtacctgttcgccaacaacctgagcgccctgcccaccgaggccctggcccccctgagagccctgcagtacctgagactgaacgacaacccctgggtgtgcgactgcagagccagacccctgtgggcctggctgcagaagttcagaggcagcagcagcgaggtgccctgcagcctgccccagagactggccggcagagacctgaagagactggccgccaacgacctgcagggctgcgccgtggccaccggcccctaccaccccatctggaccggcagagccaccgacgaggagcccctgggcctgcccaagtgctgccagcccgacgccgccgacaaggccagcgtgctggagcccggcagacccgccagcgccggcaacgccctgaagggcagagtgccccccggcgacagcccccccggcaacggcagcggccccagacacatcaacgacagccccttcggcaccctgcccggcagcgccgagccccccctgaccgccgtgagacccgagggcagcgagccccccggcttccccaccagcggccccagaagaagacccggctgcagcagaaagaacagaaccagaagccactgcagactgggccaggccggcagcggcggcggcggcaccggcgacagcgagggcagcggcgccctgcccagcctgacctgcagcctgacccccctgggcctggccctggtgctgtggaccgtgctgggcccctgctag

SEQ ID NO: 96849 - DNA, 1041 bp, Artificial Sequence
  Description of Artificial Sequence: Synthetic coding sequence
atgcacctgcccggctgcgcccccgccatggccgacggcagcttcagcctggccggccacctgctgagaagccccggcggcagcaccagcagactgcacagcatcgaggccatcctgggcttcaccaaggacgacggcatcctgggcaccttccccgccgagagaggcgccagaggcgccaaggagagagacagaagactgggcgccagacccgcctgccccaaggcccccgaggagggcagcgagcccagccccccccccgcccccgcccccgcccccgagtacgaggcccccagaccctactgccccaaggagcccggcgaggccagacccagccccggcctgcccgtgggccccgccaccggcgaggccaagctgagcgaggaggagcagcccaagaagaagcacagaagaaacagaaccaccttcaccacctaccagctgcacgagctggagagagccttcgagaagagccactaccccgacgtgtacagcagagaggagctggccggcaaggtgaacctgcccgaggtgagagtgcaggtgtggttccagaacagaagagccaagtggagaagacaggagaagctggaggtgagcagcatgaagctgcaggacagccccctgctgagcttcagcagaagcccccccagcgccaccctgagccccctgggcgccggccccggcagcggcggcggccccgccggcggcgccctgcccctggagagctggctgggcccccccctgcccggcggcggcgccaccgccctgcagagcctgcccggcttcggcccccccgcccagagcctgcccgccagctacacccccccccccccccccccccccttcctgaacagcccccccctgggccccggcctgcagcccctggccccccccccccccagctacccctgcggccccggcttcggcgacaagttccccctggacgaggccgaccccagaaacagcagcatcgccgccctgagactgaaggccaaggagcacatccaggccatcggcaagccctggcaggccctgtag

SEQ ID NO: 96850 - DNA, 225 bp, Artificial Sequence
  Description of Artificial Sequence: Synthetic coding sequence
atgcacctgcccggctgcgcccccgccatggccgacggcagcttcagcctggccggccacctgctgagaagccccggcggcagcaccagcagactgcacagcatcgaggccatcctgggcttcaccaaggacgacggcatcctgggcaccttccccgccgagagaggcgccagaggcgccaaggagagagacagaagactgggcgccagacccgcctgcccctag

SEQ ID NO: 96851 - DNA, 588 bp, Artificial Sequence
  Description of Artificial Sequence: Synthetic coding sequence
atgagcctgatcagctggctgagatggaacgaggcccccagcagactgagcaccagaagccccgccgagatggtgctggagaccctgatgatggagctgaccggccagatgagagaggccgagagacagcagagagagagaagcaacgccgtgagaaaggtgtgcaccggcgtggactacagctggctggccagcacccccagaagcacctacgacctgagccccatcgagagactgcagctggaggacgtgtgcgtgaagatccaccccagctactgcggccccgccatcctgagattcagacagctgctggccgagcaggagcccgaggtgcaggaggtgagccagctgttcagaagcgtgctgcaggaggtgctggagagaatgaagcaggaggaggaggcccacaagctgaccagacagtggagcctgagacccagaggcagcctggccaccttcaagaccagagccagaatcagccccttcgccagcgacatcagaaccatcagcgaggacgtggagagagacacccccccccccctgagaagctggagcatgcccgagttcagagcccccaaggccgactag

SEQ ID NO: 96852 - DNA, 762 bp, Artificial Sequence
  Description of Artificial Sequence: Synthetic coding sequence
atggccgagaccagcgccctgcccaccggcttcggcgagctggaggtgctggccgtgggcatggtgctgctggtggaggccctgagcggcctgagcctgaacaccctgaccatcttcagcttctgcaagacccccgagctgagaaccccctgccacctgctggtgctgagcctggccctggccgacagcggcatcagcctgaacgccctggtggccgccaccagcagcctgctgagaagatggccctacggcagcgacggctgccaggcccacggcttccagggcttcgtgaccgccctggccagcatctgcagcagcgccgccatcgcctggggcagataccaccactactgcaccagaagccagctggcctggaacagcgccgtgagcctggtgctgttcgtgtggctgagcagcgccttctgggccgccctgcccctgctgggctggggccactacgactacgagcccctgggcacctgctgcaccctggactacagcaagggcgacagaaacttcaccagcttcctgttcaccatgagcttcttcaacttcgccatgcccctgttcatcaccatcaccagctacagcctgatggagcagaagctgggcaagagcggccacctgcaggtgcccgccctgatcgccaagatggtgcccaccatcaacgccatcaactacgccctgggcaacgagatggtgtgcagaggcatctggcagtgcctgagcccccagaagagagagaaggacagaaccaagtag

SEQ ID NO: 96853 - DNA, 888 bp, Artificial Sequence
  Description of Artificial Sequence: Synthetic coding sequence
atggccgagaccagcgccctgcccaccggcttcggcgagctggaggtgctggccgtgggcatggtgctgctggtggaggccctgagcggcctgagcctgaacaccctgaccatcttcagcttctgcaagacccccgagctgagaaccccctgccacctgctggtgctgagcctggccctggccgacagcggcatcagcctgaacgccctggtggccgccaccagcagcctgctgagagtgagccacagaagatggccctacggcagcgacggctgccaggcccacggcttccagggcttcgtgaccgccctggccagcatctgcagcagcgccgccatcgcctggggcagataccaccactactgcaccagaagccagctggcctggaacagcgccgtgagcctggtgctgttcgtgtggctgagcagcgccttctgggccgccctgcccctgctgggctggggccactacgactacgagcccctgggcacctgctgcaccctggactacagcaagggcgacagaaacttcaccagcttcctgttcaccatgagcttcttcaacttcgccatgcccctgttcatcaccatcaccagctacagcctgatggagcagaagctgggcaagagcggccacctgcaggtgaacaccaccctgcccgccagaaccctgctgctgggctggggcccctacgccatcctgtacctgtacgccgtgatcgccgacgtgaccagcatcagccccaagctgcagatggtgcccgccctgatcgccaagatggtgcccaccatcaacgccatcaactacgccctgggcaacgagatggtgtgcagaggcatctggcagtgcctgagcccccagaagagagagaaggacagaaccaagtag

SEQ ID NO: 96854 - DNA, 363 bp, Artificial Sequence
  Description of Artificial Sequence: Synthetic coding sequence
atggccgagaccagcgccctgcccaccggcttcggcgagctggaggtgctggccgtgggcatggtgctgctggtggaggaccccggcgccgccgacagcctgccccccaccggcgccgagctgggcagctgcggccagtgggaccagcccgagtgccccagatgcagccacatccagcccagcccctgcctgccccaggccctggccctgagactgggcagactgcccggcagcagactgcccggcctgtgcgacagcgtgggccagcacctgcagcagtgcagccacagaatgggcgccctgagccccctgctgcacccccccaagtgctgccacagaagccaccacttcgagtggagatag

SEQ ID NO: 96855 - DNA, 1056 bp, Artificial Sequence
  Description of Artificial Sequence: Synthetic coding sequence
atggcccccgtgctgcccctggtgctgcccctgcagcccagaatcagactggcccagggcctgtggctgctgagctggctgctggccctggccggcggcgtgatcctgctgtgcagcggccacctgctggtgcagctgagacacctgggcaccttcctggcccccagctgccagttccccgtgctgccccaggccgccctggccgccggcgccgtggccctgggcaccggcctggtgggcgtgggcgccagcagagccagcctgaacgccgccctgtaccccccctggagaggcgtgctgggccccctgctggtggccggcaccgccggcggcggcggcctgctggtggtgggcctgggcctggccctggccctgcccggcagcctggacgaggccctggaggagggcctggtgaccgccctggcccactacaaggacaccgaggtgcccggccactgccaggccaagagactggtggacgagctgcagctgagataccactgctgcggcagacacggctacaaggactggttcggcgtgcagtgggtgagcagcagatacctggaccccggcgacagagacgtggccgacagaatccagagcaacgtggagggcctgtacctgaccgacggcgtgcccttcagctgctgcaacccccacagccccagaccctgcctgcagaacagactgagcgacagctacgcccaccccctgttcgaccccagacagcccaaccagaacctgtgggcccagggctgccacgaggtgctgctggagcacctgcaggacctggccggcaccctgggcagcatgctggccgtgaccttcctgctgcaggccctggtgctgctgggcctgagatacctgcagaccgccctggagggcctgggcggcgtgatcgacgccggcggcgagacccagggctacctgttccccagcggcctgaaggacatgctgaagaccgcctggctgcagggcggcgtggcctgcagacccgcccccgaggaggccccccccggcgaggccccccccaaggaggacctgagcgaggcctag

SEQ ID NO: 96856 - DNA, 1602 bp, Artificial Sequence
  Description of Artificial Sequence: Synthetic coding sequence
atgagcatccaggtggagcaccccgccggcggctacaagaagctgttcgagaccgtggaggagctgagcagccccctgaccgcccacgtgaccggcagaatccccctgtggctgaccggcagcctgctgagatgcggccccggcctgttcgaggtgggcagcgagcccttctaccacctgttcgacggccaggccctgctgcacaagttcgacttcaaggagggccacgtgacctaccacagaagattcatcagaaccgacgcctacgtgagagccatgaccgagaagagaatcgtgatcaccgagttcggcacctgcgccttccccgacccctgcaagaacatcttcagcagattcttcagctacttcagaggcgtggaggtgaccgacaacgccctggtgaacgtgtaccccgtgggcgaggactactacgcctgcaccgagaccaacttcatcaccaagatcaaccccgagaccctggagaccatcaagcaggtggacctgtgcaactacgtgagcgtgaacggcgccaccgcccacccccacatcgagaacgacggcaccgtgtacaacatcggcaactgcttcggcaagaacttcagcatcgcctacaacatcgtgaagatcccccccctgcaggccgacaaggaggaccccatcagcaagagcgagatcgtggtgcagttcccctgcagcgacagattcaagcccagctacgtgcacagcttcggcctgacccccaactacatcgtgttcgtggagacccccgtgaagatcaacctgttcaagttcctgagcagctggagcctgtggggcgccaactacatggactgcttcgagagcaacgagaccatgggcgtgtggctgcacatcgccgacaagaagagaaagaagtacctgaacaacaagtacagaaccagccccttcaacctgttccaccacatcaacacctacgaggacaacggcttcctgatcgtggacctgtgctgctggaagggcttcgagttcgtgtacaactacctgtacctggccaacctgagagagaactgggaggaggtgaagaagaacgccagaaaggccccccagcccgaggtgagaagatacgtgctgcccctgaacatcgacaaggccgacaccggcaagaacctggtgaccctgcccaacaccaccgccaccgccatcctgtgcagcgacgagaccatctggctggagcccgaggtgctgttcagcggccccagacaggccttcgagttcccccagatcaactaccagaagtactgcggcaagccctacacctacgcctacggcctgggcctgaaccacttcgtgcccgacagactgtgcaagctgaacgtgaagaccaaggagacctgggtgtggcaggagcccgacagctaccccagcgagcccatcttcgtgagccaccccgacgccctggaggaggacgacggcgtggtgctgagcgtggtggtgagccccggcgccggccagaagcccgcctacctgctgatcctgaacgccaaggacctgagcgaggtggccagagccgaggtggagatcaacatccccgtgaccttccacggcctgttcaagaagagctag

SEQ ID NO: 96857 - DNA, 954 bp, Artificial Sequence
  Description of Artificial Sequence: Synthetic coding sequence
atgagcgagggcgtgggcaccttcagaatggtgcccgaggaggagcaggagctgagagcccagctggagcagctgaccaccaaggaccacggccccgtgttcggcccctgcagccagctgcccagacacaccctgcagaaggccaaggacgagctgaacgagagagaggagaccagagaggaggccgtgagagagctgcaggagatggtgcaggcccaggccgccagcggcgaggagctggccgtggccgtggccgagagagtgcaggagaaggacagcggcttcttcctgagattcatcagagccagaaagttcaacgtgggcagagcctacgagctgctgagaggctacgtgaacttcagactgcagtaccccgagctgttcgacagcctgagccccgaggccgtgagatgcaccatcgaggccggctaccccggcgtgctgagcagcagagacaagtacggcagagtggtgatgctgttcaacatcgagaactggcagagccaggagatcaccttcgacgagatcctgcaggcctactgcttcatcctggagaagctgctggagaacgaggagacccagatcaacggcttctgcatcatcgagaacttcaagggcttcaccatgcagcaggccgccagcctgagaaccagcgacctgagaaagatggtggacatgctgcaggacagcttccccgccagattcaaggccatccacttcatccaccagccctggtacttcaccaccacctacaacgtggtgaagcccttcctgaagagcaagctgctggagagagtgttcgtgcacggcgacgacctgagcggcttctaccaggagatcgacgagaacatcctgcccagcgacttcggcggcaccctgcccaagtacgacggcaaggccgtggccgagcagctgttcggcccccaggcccaggccgagaacaccgccttctag

SEQ ID NO: 96858 - DNA, 807 bp, Artificial Sequence
  Description of Artificial Sequence: Synthetic coding sequence
atggccgagctggacatcggccagcactgccaggtggagcactgcagacagagagacttcctgcccttcgtgtgcgacgactgcagcggcatcttctgcctggagcacagaagcagagagagccacggctgccccgaggtgaccgtgatcaacgagagactgaagaccgaccagcacaccagctacccctgcagcttcaaggactgcgccgagagagagctggtggccgtgatctgcccctactgcgagaagaacttctgcctgagacacagacaccagagcgaccacgagtgcgagaagctggagatccccaagcccagaatggccgccacccagaagctggtgaaggacatcatcgacagcaagaccggcgagaccgccagcaagagatggaagggcgccaagaacagcgagaccgccgccaaggtggccctgatgaagctgaagatgcacgccgacggcgacaagagcctgccccagaccgagagaatctacttccaggtgttcctgcccaagggcagcaaggagaagagcaagcccatgttcttctgccacagatggagcatcggcaaggccatcgacttcgccgccagcctggccagactgaagaacgacaacaacaagttcaccgccaagaagctgagactgtgccacatcaccagcggcgaggccctgcccctggaccacaccctggagacctggatcgccaaggaggactgccccctgtacaacggcggcaacatcatcctggagtacctgaacgacgaggagcagttctgcaagaacgtggagagctacctggagtag

SEQ ID NO: 96859 - DNA, 2751 bp, Artificial Sequence
  Description of Artificial Sequence: Synthetic coding sequence
atgcagagacccgtggtgaagctgtacgccaccgacggcagaagagtgcccagcctgcaggccgtgatcctgagcagcggcgccgtggtggccgccggcagagagcccttcaagcccggcaactacgacatccagaagtacctgctgcccgccagactgcccggcatcagccagagagtgtaccccaagggcaacgccaagagcgagagcagaaagagcagcaactggaaggtgttcatcatcaccagcgacctgcccgacgccggcaccagcagccagatctacatcatcctgtacggccagcacagaagcagcgcccccatctacctgtacggcaccgacggcgccagattccaggtgggccacgaggacatcttcaccatcaccgtgggcgacatcggcgccctgttcaagatcagaatcggccacaccaacagcggcagcagccccagctggcactgcaaggagatccagctgcacaacatgaacagcggcaagcagttctacgtgcccgtgcagagatggctggccagagaccaggaggacggcgagatctgcagagagttccccctgctgagcaagggccagcccgtgctgcccgtgaccatctacgaggtgaacgtggccaccggcgagctgtggaacgccggcaccgtggccaacgtgtacatcagcatccacggcgagaagggcgacaccggcagcagacagctgttcagaagcaagagcagcttcaacttcctgagaggccagaccgacaccttcttcctggaggccgtgcacctgggcgacctgtgcaagatcgtgatcggccacgacggcctgggccccggcaacggctggttcctggacgacgtggtgatcaaggaccccaccaccaactacgagtacgccttcttctgccacagatggctggaccagggcgaggacgactgcaagatcgtgagagagctgtacgccagagacaacagcatcttcagcgccagacagaagctggagctgaagagaaaggagacctggaccgccgagagctggaagttcaccaagggcaacaccctgcagttctacaacaagctgaccggcggcttcgtgagactgcaccccgacggcaccgtggacgccatcggcgagaagaccgacaagtacggcgtgttcgacgtgatcttcaacaagagaaacatctgcatcttccagagccacgagatgagacacctgagcctggccctggacaacggcatcgtgaccggcatggtgagcggcgaggccaccaccgagctgagagtgctgtaccagcccaacagatgcgccctgctggagagcgccctggtgcccggccacaccgtggtgttcgacagacacggcaagatcgccgacgccagcagcgccggctacgccaacctgagcaaggagttcgtgatcttcgtgaagggcgtgttcctgaacagcgccgtggtgctgctggccaccagcctgtgccaggccctgtgcctgcagcccgacggcagctgcaccggcgtgggcagccagagcgagaagagctactggaaggtgcacaagatcagcagcggcatctgcatgttcgagagcgtgaagaacgcccagatgtacctgagaatcaaggacggcagatgcgacggcaccggcaccggcgacgtggactgccacttcaagatcaagaagaacctgaagaacgccagcatcagcctggagagcaccaagagccccggcctgttcgtgggcctgcagagcgacggccaggccaagcccatgatctacaccaaggacgagaacgtgtgcttctacccccaggtgatccagttcggcagagagaaccccatgggcatgagcgccacccccagccaggaggaggagaagatccacgagagcaagaagcagaagaagatcccccccgagagcgaggccagaagccccctgcccagcagcaccgccaaggagatcagacacttccagagcagcgagaccctgctgagcgaggacgagtggaaggtgctggtgctgaccggcaacaccggcacccaggccaacgtgaccctgtgggtgtacggcgacaagggcgtgaccggccccatcagcctgagaaaggacagcagcgagcagctgttcctgcccggccacgaggacgagttccaggtggagatcagaaacaccggcaacatctacaagatcagaatcggccacgacggcaccagcgagcagcccgagtggaacctgcagagagtgaccatgcagcacatgaagagcaagaagatcctggacttcgccgccaacgtgtggctgagcagaatccaggccgacggcgacgtggtgtgcgagctgcccgtggtgaagggcggccaggccatcttccccctggtgagataccaggtggacgtgtacaccggccagctgaagcacgccgagaccgagagcgaggtgttcctgtgcctgttcggcgagagaggcgacagcggcctgagacagctgtacaagagcaacatgcaggtgaagttccagagaggccagatcgacaagttccaggtggccgccgtgagcctgggcaagctgcagaaggtgctgctgagatgcgaggccagcgacaagagccagtactggtactgcgagcaggtgatcgtgagagagcccggcaccaccagcgagagcatcttcacctgccagagatggctgcccttcatgagccagggcatcatccacagcgagatcgagctgtacctgcagggcgaggactactag

SEQ ID NO: 96860 - DNA, 7203 bp, Artificial Sequence
  Description of Artificial Sequence: Synthetic coding sequence
atgaacagcacccccagaaacgcccaggcccccagccacagagagtgcttcctgcccagcgtggccagaacccccagcgtgaccaaggtgacccccgccaagaagatcaccttcctgaagagaggcgaccccagattcgccggcgtgagactggccgtgcaccagagagccttcaagaccttcagcgccctgatggacgagctgagccagagagtgcccctgagcttcggcgtgagaagcgtgaccacccccagaggcctgcacagcctgagcgccctggagcagctggaggacggcggctgctacctgtgcagcgacaagaagccccccaagacccccagcggccccggcagaccccaggagagaaaccccaccgcccagcagctgagagacgtggagggccagagagaggcccccggcaccagcagcagcagaaagagcctgaagacccccagaagaatcctgctgatcaagaacatggaccccagactgcagcagaccgtggtgctgagccacagaaacaccagaaacctggccgccttcctgggcaaggccagcgacctgctgagattccccgtgaagcagctgtacaccaccagcggcaagaaggtggacagcctgcaggccctgctgcacagccccagcgtgctggtgtgcgccggccacgaggccttcagaacccccgccatgaagaacgccagaagaagcgaggccgagaccctgagcggcctgaccagcagaaacaagaacggcagctggggccccaagaccaagcccagcgtgatccacagcagaagcccccccggcagcacccccagactgcccgagagacccggccccagcaacccccccgtgggccccgcccccggcagacacccccaggacacccccgcccagagcggccccctggtggccggcgacgacatgaagaagaaggtgagaatgaacgaggacggcagcctgagcgtggagatgaaggtgagattccacctggtgggcgaggacaccctgctgtggagcagaagaatgggcagagccagcgccctgaccgccgccagcggcgaggaccccgtgctgggcgaggtggaccccctgtgctgcgtgtgggagggctacccctggggcttcagcgagcccggcgtgtggggccccagaccctgcagagtgggctgcagagaggtgttcggcagaggcggccagcccggccccaagtacgagatctggaccaaccccctgcacgccagccagggcgagagagtggccgccagaaagagatggggcctggcccagcacgtgagatgcagcggcctgtggggccacggcaccgccggcagagagagatgcagccaggacagcgccagccccgccagcagcaccggcctgcccgagggcagcgagcccgagagcagctgctgccccagaacccccgaggacggcgtggacagcgccagccccagcgcccagatcggcgccgagagaaaggccggcggcagcctgggcgaggaccccggcctgtgcatcgacggcgccggcctgggcggccccgagcagggcggcagactgacccccagagccagaagcgaggagggcgccagcagcgacagcagcgccagcaccggcagccacgagggcagcagcgagtggggcggcagaccccagggctgccccggcaaggccagagccgagaccagccagcaggaggccagcgagggcggcgaccccgccagccccgccctgagcctgagcagcctgagaagcgacgacctgcaggccgagacccagggccagggcaccgagcaggccaccggcgccgccgtgaccagagagcccctggtgctgggcctgagctgcagctgggacagcgagggcgccagcagcacccccagcacctgcaccagcagccagcagggccagagaagacacagaagcagagccagcgccatgagcagccccagcagccccggcctgggcagagtggcccccagaggccaccccagacacagccactacagaaaggacacccacagccccctggacagcagcgtgaccaagcaggtgcccagaccccccgagagaagaagagcctgccaggacggcagcgtgcccagatacagcggcagcagcagcagcaccagaacccaggccagcggcaacctgagaccccccagcagcggcagcctgcccagccaggacctgctgggcaccagcagcgccaccgtgacccccgccgtgcacagcgacttcgtgagcggcgtgagcccccacaacgcccccagcgccggctgggccggcgacgccggcagcagaacctgcagccccgcccccatccccccccacaccagcgacagctgcagcaagagcggcgccgccagcctgggcgaggaggccagagacaccccccagcccagcagccccctggtgctgcaggtgggcagacccgagcagggcgccgtgggcccccacagaagccactgctgcagccagcccggcacccagcccgcccaggaggcccagagaggccccagccccgaggccagctggctgtgcggcagatactgccccaccccccccagaggcagaccctgcccccagagaagaagcagcagctgcggcagcaccggcagcagccaccagagcaccgccagaggccccggcggcagcccccaggagggcaccagacagcccggccccacccccagccccggccccaacagcggcgccagcagaagaagcagcgccagccagggcgccggcagcagaggcctgagcgaggagaagaccctgagaagcggcggcggcccccagggccaggaggaggccagcggcgtgagccccagcagcctgcccagaagcagccccgaggccgtggtgagagagtggctggacaacatccccgaggagcccatcctgatgacctacgagctggccgacgagaccaccggcgccgccggcggcggcctgagaggccccgaggtggaccccggcgacgaccacagcctggagggcctgggcgagcccgcccaggccggccagcagagcctggagggcgaccccggccaggaccccgagcccgagggcgccctgctgggcagcagcgacaccggcccccagagcggcgagggcgtgccccagggcgccgcccccgagggcgtgagcgaggcccccgccgaggccggcgccgacagagaggcccccgccggctgcagagtgagcctgagagccctgcccggcagagtgagcgccagcacccagatcatgagagccctgatgggcagcaagcagggcagacccagcagcgtgcccgaggtgagcagacccatggccagaagactgagctgcagcgccggcgccctgatcacctgcctggccagcctgcagctgttcgaggaggacctgggcagccccgccagcaaggtgagattcaaggacagccccagataccaggagctgctgagcatcagcaaggacctgtggcccggctgcgacgtgggcgaggaccagctggacagcggcctgtgggagctgacctggagccaggccctgcccgacctgggcagccacgccatgaccgagaacttcacccccaccagcagcagcggcgtggacatcagcagcggcagcggcggcagcggcgagagcagcgtgccctgcgccatggacggcaccctggtgacccagggcaccgagctgcccctgaagaccagcaaccagagacccgacagcagaacctacgagagccccggcgacctggagaaccagcagcagtgctgcttccccaccttcctgaacgccagagcctgcgcctgcgccaccaacgaggacgaggccgagagagacagcgaggagcagagagccagcagcaacctggagcagctggccgagaacaccgtgcaggaggaggtgcagctggaggagaccaaggagggcaccgagggcgagggcctgcaggaggaggccgtgcagctggaggagaccaagaccgaggagggcctgcaggaggagggcgtgcagctggaggagaccaaggagaccgagggcgagggccagcaggaggaggaggcccagctggaggagatcgaggagaccggcggcgagggcctgcaggaggagggcgtgcagctggaggaggtgaaggagggccccgagggcggcctgcagggcgaggccctggaggagggcctgaaggaggagggcctgcccgaggagggcagcgtgcacggccaggagctgagcgaggccagcagccccgacggcaagggcagccaggaggacgaccccgtgcaggaggaggaggccggcagagccagcgccagcgccgagccctgccccgccgagggcaccgaggagcccaccgagccccccagccacctgagcgagaccgaccccagcgccagcgagagacagagcggcagccagctggagcccggcctggagaagccccccggcgccaccatgatgggccaggagcacacccaggcccagcccacccagggcgccgccgagagaagcagcagcgtggcctgcagcgccgccctggactgcgaccccatctgggtgagcgtgctgctgaagaagaccgagaaggccttcctggcccacctggccagcgccgtggccgagctgagagccagatggggcctgcaggacaacgacctgctggaccagatggccgccgagctgcagcaggacgtggcccagagactgcaggacagcaccaagagagagctgcagaagctgcagggcagagccggcagaatggtgctggagccccccagagaggccctgaccggcgagctgctgctgcagacccagcagagaagacacagactgagaggcctgagaaacctgagcgccttcagcgagagaaccctgggcctgggccccctgagcttcaccctggaggacgagcccgccctgagcaccgccctgggcagccagctgggcgaggaggccgagggcgaggagttctgcccctgcgaggcctgcgtgagaaagaaggtgagccccatgagccccaaggccaccatgggcgccaccagaggccccatcaaggaggccttcgacctgcagcagatcctgcagagaaagagaggcgagcacaccgacggcgaggccgccgaggtggcccccggcaagacccacaccgaccccaccagcaccagaaccgtgcagggcgccgagggcggcctgggccccggcctgagccagggccccggcgtggacgagggcgaggacggcgagggcagccagagactgaacagagacaaggaccccaagctgggcgaggccgagggcgacgccatggcccaggagagagagggcaagacccacaacagcgagaccagcgccggcagcgagctgggcgaggccgagcaggagggcgagggcatcagcgagagaggcgagaccggcggccagggcagcggccacgaggacaacctgcagggcgaggccgccgccggcggcgaccaggaccccggccagagcgacggcgccgagggcatcgaggcccccgaggccgagggcgaggcccagcccgagagcgagggcgtggaggcccccgaggccgagggcgacgcccaggaggccgagggcgaggcccagcccgagagcgaggacgtggaggcccccgaggccgagggcgaggcccagcccgagagcgaggacgtggagacccccgaggccgagtgggaggtgcagcccgagagcgagggcgccgaggcccccgaggccgagaaggaggcccagcccgagaccgagagcgtggaggccctggagaccgagggcgaggacgagcccgagagcgagggcgccgaggcccaggaggccgaggaggccgcccaggaggccgagggccagacccagcccgagagcgaggtgatcgagagccaggaggccgaggaggaggcccagcccgagagcgaggacgtggaggccctggaggtggaggtggagacccaggaggccgagggcgaggcccagcccgagagcgaggacgtggaggcccccgaggccgagggcgagatgcaggaggccgaggaggaggcccagcccgagagcgacggcgtggaggcccagcccaagagcgagggcgaggaggcccaggaggtggagggcgagacccagaagaccgagggcgacgcccagcccgagagcgacggcgtggaggcccccgaggccgaggaggaggcccaggaggccgagggcgaggtgcaggaggccgagggcgaggcccaccccgagagcgaggacgtggacgcccaggaggccgagggcgaggcccagcccgagagcgagggcgtggaggcccccgaggccgagggcgaggcccagaaggccgagggcatcgaggcccccgagaccgagggcgaggcccagcccgagagcgagggcatcgaggcccccgaggccgagggcgaggcccagcccgagagcgagggcgtggaggcccaggacgccgagggcgaggcccagcccgagagcgagggcatcgaggcccaggaggccgaggaggaggcccagcccgagctggagggcgtggaggcccccgaggccgagggcgaggcccagcccgagagcgagggcatcgaggcccccgaggccgagggcgaggcccagcccgagctggagggcgtggaggcccccgaggccgaggaggaggcccagcccgagcccgagggcgtggagacccccgaggccgagggcgaggcccagcccgagagcgagggcgagacccagggcgagaagaagggcagcccccaggtgagcctgggcgacggccagagcgaggaggccagcgagagcagcagccccgtgcccgaggacagacccacccccccccccagccccggcggcgacaccccccaccagagacccggcagccagaccggccccagcagcagcagagccagcagctggggcaactgctggcagaaggacagcgagaacgaccacgtgctgggcgacaccagaagccccgacgccaagagcaccggcaccccccacgccgagagaaaggccaccagaatgtaccccgagagcagcaccagcgagcaggaggaggcccccctgggcagcagaacccccgagcagggcgccagcgagggctacgacctgcaggaggaccaggccctgggcagcctggcccccaccgaggccgtgggcagagccgacggcttcggccaggacgacctggacttctag

SEQ ID NO: 96861 - DNA, 5019 bp, Artificial Sequence
  Description of Artificial Sequence: Synthetic coding sequence
atgaaggtggacagaaccaagctgaagaagacccccaccgaggcccccgccgactgcagagccctgatcgacaagctgaaggtgtgcaacgacgagcagctgctgctggagctgcagcagatcaagacctggaacatcggcaagtgcgagctgtaccactgggtggacctgctggacagattcgacggcatcctggccgacgccggccagaccgtggagaacatgagctggatgctggtgtgcgacagacccgagagagagcagctgaagatgctgctgctggccgtgctgaacttcaccgccctgctgatcgagtacagcttcagcagacacctgtacagcagcatcgagcacctgaccaccctgctggccagcagcgacatgcaggtggtgctggccgtgctgaacctgctgtacgtgttcagcaagagaagcaactacatcaccagactgggcagcgacaagagaacccccctgctgaccagactgcagcacctggccgagagctggggcggcaaggagaacggcttcggcctggccgagtgctgcagagacctgcacatgatgaagtacccccccagcgccaccaccctgcacttcgagttctacgccgaccccggcgccgaggtgaagatcgagaagagaaccaccagcaacaccctgcactacatccacatcgagcagctggacaagatcagcgagagccccagcgagatcatggagagcctgaccaagatgtacagcatccccaaggacaagcagatgctgctgttcacccacatcagactggcccacggcttcagcaaccacagaaagagactgcaggccgtgcaggccagactgcacgccatcagcatcctggtgtacagcaacgccctgcaggagagcgccaacagcatcctgtacaacggcctgatcgaggagctggtggacgtgctgcagatcaccgacaagcagctgatggagatcaaggccgccagcctgagaaccctgaccagcatcgtgcacctggagagaacccccaagctgagcagcatcatcgactgcaccggcaccgccagctaccacggcttcctgcccgtgctggtgagaaactgcatccaggccatgatcgaccccagcatggacccctacccccaccagttcgccaccgccctgttcagcttcctgtaccacctggccagctacgacgccggcggcgaggccctggtgagctgcggcatgatggaggccctgctgaaggtgatcaagttcctgggcgacgagcaggaccagatcaccttcgtgaccagagccgtgagagtggtggacctgatcaccaacctggacatggccgccttccagagccacagcggcctgagcatcttcatctacagactggagcacgaggtggacctgtgcagaaaggagtgccccttcgtgatcaagcccaagatccagagacccaacaccacccaggagggcgaggagatggagaccgacatggacggcgtgcagtgcatcccccagagagccgccctgctgaagagcatgctgaacttcctgaagaaggccatccaggaccccgccttcagcgacggcatcagacacgtgatggacggcagcctgcccaccagcctgaagcacatcatcagcaacgccgagtactacggccccagcctgttcctgctggccaccgaggtggtgaccgtgttcgtgttccaggagcccagcctgctgagcagcctgcaggacaacggcctgaccgacgtgatgctgcacgccctgctgatcaaggacgtgcccgccaccagagaggtgctgggcagcctgcccaacgtgttcagcgccctgtgcctgaacgccagaggcctgcagagcttcgtgcagtgccagcccttcgagagactgttcaaggtgctgctgagccccgactacctgcccgccatgagaagaagaagaagcagcgaccccctgggcgacaccgccagcaacctgggcagcgccgtggacgagctgatgagacaccagcccaccctgaagaccgacgccaccaccgccatcatcaagctgctggaggagatctgcaacctgggcagagaccccaagtacatctgccagaagcccagcatccagaaggccgacggcaccgccaccgcccccccccccagaagcaaccacgccgccgaggaggccagcagcgaggacgaggaggaggaggaggtgcaggccatgcagagcttcaacagcacccagcagaacgagaccgagcccaaccagcaggtggtgggcaccgaggagagaatccccatccccctgatggactacatcctgaacgtgatgaagttcgtggagagcatcctgagcaacaacaccaccgacgaccactgccaggagttcgtgaaccagaagggcctgctgcccctggtgaccatcctgggcctgcccaacctgcccatcgacttccccaccagcgccgcctgccaggccgtggccggcgtgtgcaagagcatcctgaccctgagccacgagcccaaggtgctgcaggagggcctgctgcagctggacagcatcctgagcagcctggagcccctgcacagacccatcgagagccccggcggcagcgtgctgctgagagagctggcctgcgccggcaacgtggccgacgccaccctgagcgcccaggccacccccctgctgcacgccctgaccgccgcccacgcctacatcatgatgttcgtgcacacctgcagagtgggccagagcgagatcagaagcatcagcgtgaaccagtggggcagccagctgggcctgagcgtgctgagcaagctgagccagctgtactgcagcctggtgtgggagagcaccgtgctgctgagcctgtgcacccccaacagcctgcccagcggctgcgagttcggccaggccgacatgcagaagctggtgcccaaggacgagaaggccggcaccacccagggcggcaagagaagcgacggcgagcaggacggcgccgccggcagcatggacgccagcacccagggcctgctggagggcatcggcctggacggcgacaccctggcccccatggagaccgacgagcccaccgccagcgacagcaagggcaagagcaagatcacccccgccatggccgccagaatcaagcagatcaagcccctgctgagcgccagcagcagactgggcagagccctggccgagctgttcggcctgctggtgaagctgtgcgtgggcagccccgtgagacagagaagaagccaccacgccgccagcaccaccaccgcccccacccccgccgccagaagcaccgccagcgccctgaccaagctgctgaccaagggcctgagctggcagccccccccctacacccccacccccagattcagactgaccttcttcatctgcagcgtgggcttcaccagccccatgctgttcgacgagagaaagtacccctaccacctgatgctgcagaagttcctgtgcagcggcggccacaacgccctgttcgagaccttcaactgggccctgagcatgggcggcaaggtgcccgtgagcgagggcctggagcacagcgacctgcccgacggcaccggcgagttcctggacgcctggctgatgctggtggagaagatggtgaaccccaccaccgtgctggagagcccccacagcctgcccgccaagctgcccggcggcgtgcagaacttcccccagttcagcgccctgagattcctggtggtgacccagaaggccgccttcacctgcatcaagaacctgtggaacagaaagcccctgaaggtgtacggcggcagaatggccgagagcatgctggccatcctgtgccacatcctgagaggcgagcccgtgatcagagagagactgagcaaggagaaggagggcagcagaggcgaggaggacaccggccaggaggagggcggcagcagaagagagccccaggtgaaccagcagcagctgcagcagctgatggacatgggcttcaccagagagcacgccatggaggccctgctgaacaccagcaccatggagcaggccaccgagtacctgctgacccaccccccccccatcatgggcggcgtggtgagagacctgagcatgagcgaggaggaccagatgatgagagccatcgccatgagcctgggccaggacatccccatggaccagagagccgagagccccgaggaggtggcctgcagaaaggaggaggaggagagaaaggccagagagaagcaggaggaggaggaggccaagtgcctggagaagttccaggacgccgaccccctggagcaggacgagctgcacaccttcaccgacaccatgctgcccggctgcttccacctgctggacgagctgcccgacaccgtgtacagagtgtgcgacctgatcatgaccgccatcaagagaaacggcgccgactacagagacatgatcctgaagcaggtggtgaaccaggtgtgggaggccgccgacgtgctgatcaaggccgccctgcccctgaccaccagcgacaccaagaccgtgagcgagtggatcagccagatggccaccctgccccaggccagcaacctggccaccagaatcctgctgctgaccctgctgttcgaggagctgaagctgccctgcgcctgggtggtggagagcagcggcatcctgaacgtgctgatcaagctgctggaggtggtgcagccctgcctgcaggccgccaaggagcagaaggaggtgcagacccccaagtggatcacccccgtgctgctgctgatcgacttctacgagaagaccgccatcagcagcaagagaagagcccagatgaccaagtacctgcagagcaacagcaacaactggagatggttcgacgacagaagcggcagatggtgcagctacagcgccagcaacaacagcaccatcgacagcgcctggaagagcggcgagaccagcgtgagattcaccgccggcagaagaagatacaccgtgcagttcaccaccatggtgcagggcaccagcgccgagtag

SEQ ID NO: 96862 - DNA, 666 bp, Artificial Sequence
  Description of Artificial Sequence: Synthetic coding sequence
atgagcagcagacccggcagagaggacgtgggcgccgccggcgccagaagacccagagagccccccgagcaggagctgcagagaagaagagagcagaagagaagaagacacgacgcccagcagctgcagcagctgaagcacctggagagcttctacgagaagcccccccccggcctgatcaaggaggacgagaccaagcccgaggactgcatccccgacgtgcccggcaacgagcacgccagagagttcctggcccacgcccccaccaagggcctgtggatgcccctgggcaaggaggtgaaggtgatgcagtgctggagatgcaagagatacggccacagaaccggcgacaaggagtgccccttcttcatcaagggcaaccagaagctggagcagttcagagtggcccacgaggaccccatgtacgacatcatcagagacaacaagagacacgagaaggacgtgagaatccagcagctgaagcagctgctggaggacagcaccagcgacgaggacagaagcagcagcagcagcagcgagggcaaggagaagcacaagaagaagaagaagaaggagaagcacaagaagagaaagaaggagaagaagaagaagaagaagagaaagcacaagagcagcaagagcaacgagggcagcgacagcgagtag

SEQ ID NO: 96863 - DNA, 2262 bp, Artificial Sequence
  Description of Artificial Sequence: Synthetic coding sequence
atgagagagcccgaggagctgatgcccgacagcggcgccgtgttcaccttcggcaagagcaagttcgccgagaacaaccccggcaagttctggttcaagaacgacgtgcccgtgcacctgagctgcggcgacgagcacagcgccgtggtgaccggcaacaacaagctgtacatgttcggcagcaacaactggggccagctgggcctgggcagcaagagcgccatcagcaagcccacctgcgtgaaggccctgaagcccgagaaggtgaagctggccgcctgcggcagaaaccacaccctggtgagcaccgagggcggcaacgtgtacgccaccggcggcaacaacgagggccagctgggcctgggcgacaccgaggagagaaacaccttccacgtgatcagcttcttcaccagcgagcacaagatcaagcagctgagcgccggcagcaacaccagcgccgccctgaccgaggacggcagactgttcatgtggggcgacaacagcgagggccagatcggcctgaagaacgtgagcaacgtgtgcgtgccccagcaggtgaccatcggcaagcccgtgagctggatcagctgcggctactaccacagcgccttcgtgaccaccgacggcgagctgtacgtgttcggcgagcccgagaacggcaagctgggcctgcccaaccagctgctgggcaaccacagaaccccccagctggtgagcgagatccccgagaaggtgatccaggtggcctgcggcggcgagcacaccgtggtgctgaccgagaacgccgtgtacaccttcggcctgggccagttcggccagctgggcctgggcaccttcctgttcgagaccagcgagcccaaggtgatcgagaacatcagagaccagaccatcagctacatcagctgcggcgagaaccacaccgccctgatcaccgacatcggcctgatgtacaccttcggcgacggcagacacggcaagctgggcctgggcctggagaacttcaccaaccacttcatccccaccctgtgcagcaacttcctgagattcatcgtgaagctggagagaagccccgacagcttcagcatgagaagaaccctgccccccatcgagggcaccctgggcctgagcgcctgcttcctgcccaacagcgtgttccccagatgcagcgagagaaacctgcaggagagcgtgctgagcgagcaggacctgatgcagcccgaggagcccgactacctgctggacgagatgaccaaggaggccgagatcgacaacagcagcaccgtggagagcctgggcgagaccaccgacatcctgaacatgacccacatcatgagcctgaacagcaacgagaagagcctgaagctgagccccgtgcagaagcagaagaagcagcagaccatcggcgagctgacccaggacaccgccctgaccgagaacgacgacagcgacgagtacgaggagatgagcgagatgaaggagggcaaggcctgcaagcagcacgtgagccagggcatcttcatgacccagcccgccaccaccatcgaggccttcagcgacgaggaggtggagatccccgaggagaaggagggcgccgaggacagcaagggcaacggcatcgaggagcaggaggtggaggccaacgaggagaacgtgaaggtgcacggcggcagaaaggagaagaccgagatcctgagcgacgacctgaccgacaaggccgaggaccacgagttcagcaagaccgaggagctgaagctggaggacgtggacgaggagatcaacgccgagaacgtggagagcaagaagaagaccgtgggcgacgacgagagcgtgcccaccggctaccacagcaagaccgagggcgccgagagaaccaacgacgacagcagcgccgagaccatcgagaagaaggagaaggccaacctggaggagagagccatctgcgagtacaacgagaaccccaagggctacatgctggacgacgccgacagcagcagcctggagatcctggagaacagcgagaccacccccagcaaggacatgaagaagaccaagaagatcttcctgttcaagagagtgcccagcatcaaccagaagatcgtgaagaacaacaacgagcccctgcccgagatcaagagcatcggcgaccagatcatcctgaagagcgacaacaaggacgccgaccagaaccacatgagccagaaccaccagaacatcccccccaccaacaccgagagaagaagcaagagctgcaccatcctgtag

SEQ ID NO: 96864 - DNA, 2448 bp, Artificial Sequence
  Description of Artificial Sequence: Synthetic coding sequence
atgagagagcccgaggagctgatgcccgacagcggcgccgtgttcaccttcggcaagagcaagttcgccgagaacaaccccggcaagttctggttcaagaacgacgtgcccgtgcacctgagctgcggcgacgagcacagcgccgtggtgaccggcaacaacaagctgtacatgttcggcagcaacaactggggccagctgggcctgggcagcaagagcgccatcagcaagcccacctgcgtgaaggccctgaagcccgagaaggtgaagctggccgcctgcggcagaaaccacaccctggtgagcaccgagggcggcaacgtgtacgccaccggcggcaacaacgagggccagctgggcctgggcgacaccgaggagagaaacaccttccacgtgatcagcttcttcaccagcgagcacaagatcaagcagctgagcgccggcagcaacaccagcgccgccctgaccgaggacggcagactgttcatgtggggcgacaacagcgagggccagatcggcctgaagaacgtgagcaacgtgtgcgtgccccagcaggtgaccatcggcaagcccgtgagctggatcagctgcggctactaccacagcgccttcgtgaccaccgacggcgagctgtacgtgttcggcgagcccgagaacggcaagctgggcctgcccaaccagctgctgggcaaccacagaaccccccagctggtgagcgagatccccgagaaggtgatccaggtggcctgcggcggcgagcacaccgtggtgctgaccgagaacgccgtgtacaccttcggcctgggccagttcggccagctgggcctgggcaccttcctgttcgagaccagcgagcccaaggtgatcgagaacatcagagaccagaccatcagctacatcagctgcggcgagaaccacaccgccctgatcaccgacatcggcctgatgtacaccttcggcgacggcagacacggcaagctgggcctgggcctggagaacttcaccaaccacttcatccccaccctgtgcagcaacttcctgagattcatcgtgaagctggtggcctgcggcggctgccacatggtggtgttcgccgccccccacagaggcgtggccaaggagatcgagttcgacgagatcaacgacacctgcctgagcgtggccaccttcctgccctacagcagcctgaccagcggcaacgtgctgcagagaaccctgagcgccagaatgagaagaagagagagagagagaagccccgacagcttcagcatgagaagaaccctgccccccatcgagggcaccctgggcctgagcgcctgcttcctgcccaacagcgtgttccccagatgcagcgagagaaacctgcaggagagcgtgctgagcgagcaggacctgatgcagcccgaggagcccgactacctgctggacgagatgaccaaggaggccgagatcgacaacagcagcaccgtggagagcctgggcgagaccaccgacatcctgaacatgacccacatcatgagcctgaacagcaacgagaagagcctgaagctgagccccgtgcagaagcagaagaagcagcagaccatcggcgagctgacccaggacaccgccctgaccgagaacgacgacagcgacgagtacgaggagatgagcgagatgaaggagggcaaggcctgcaagcagcacgtgagccagggcatcttcatgacccagcccgccaccaccatcgaggccttcagcgacgaggaggtggagatccccgaggagaaggagggcgccgaggacagcaagggcaacggcatcgaggagcaggaggtggaggccaacgaggagaacgtgaaggtgcacggcggcagaaaggagaagaccgagatcctgagcgacgacctgaccgacaaggccgaggaccacgagttcagcaagaccgaggagctgaagctggaggacgtggacgaggagatcaacgccgagaacgtggagagcaagaagaagaccgtgggcgacgacgagagcgtgcccaccggctaccacagcaagaccgagggcgccgagagaaccaacgacgacagcagcgccgagaccatcgagaagaaggagaaggccaacctggaggagagagccatctgcgagtacaacgagaaccccaagggctacatgctggacgacgccgacagcagcagcctggagatcctggagaacagcgagaccacccccagcaaggacatgaagaagaccaagaagatcttcctgttcaagagagtgcccagcatcaaccagaagatcgtgaagaacaacaacgagcccctgcccgagatcaagagcatcggcgaccagatcatcctgaagagcgacaacaaggacgccgaccagaaccacatgagccagaaccaccagaacatcccccccaccaacaccgagagaagaagcaagagctgcaccatcctgtag

SEQ ID NO: 96865 - DNA, 1443 bp, Artificial Sequence
  Description of Artificial Sequence: Synthetic coding sequence
atgagagagcccgaggagctgatgcccgacagcggcgccgtgttcaccttcggcaagagcaagttcgccgagaacaaccccggcaagttctggttcaagaacgacgtgcccgtgcacctgagctgcggcgacgagcacagcgccgtggtgaccggcaacaacaagctgtacatgttcggcagcaacaactggggccagctgggcctgggcagcaagagcgccatcagcaagcccacctgcgtgaaggccctgaagcccgagaaggtgaagctggccgcctgcggcagaaaccacaccctggtgagcaccgagggcggcaacgtgtacgccaccggcggcaacaacgagggccagctgggcctgggcgacaccgaggagagaaacaccttccacgtgatcagcttcttcaccagcgagcacaagatcaagcagctgagcgccggcagcaacaccagcgccgccctgaccgaggacggcagactgttcatgtggggcgacaacagcgagggccagatcggcctgaagaacgtgagcaacgtgtgcgtgccccagcaggtgaccatcggcaagcccgtgagctggatcagctgcggctactaccacagcgccttcgtgaccaccgacggcgagctgtacgtgttcggcgagcccgagaacggcaagctgggcctgcccaaccagctgctgggcaaccacagaaccccccagctggtgagcgagatccccgagaaggtgatccaggtggcctgcggcggcgagcacaccgtggtgctgaccgagaacgccgtgtacaccttcggcctgggccagttcggccagctgggcctgggcaccttcctgttcgagaccagcgagcccaaggtgatcgagaacatcagagaccagaccatcagctacatcagctgcggcgagaaccacaccgccctgatcaccgacatcggcctgatgtacaccttcggcgacggcagacacggcaagctgggcctgggcctggagaacttcaccaaccacttcatccccaccctgtgcagcaacttcctgagattcatcgtgaagctggtggcctgcggcggctgccacatggtggtgttcgccgccccccacagaggcgtggccaaggagatcgagttcgacgagatcaacgacacctgcctgagcgtggccaccttcctgccctacagcagcctgaccagcggcaacgtgctgcagagaaccctgagcgccagaatgagaagaagagagagagagagaagccccgacagcttcagcatgagaagaaccctgccccccatcgagggcaccctgggcctgagcgcctgcttcctgcccaacagcgtgttccccagatgcagcgagagaaacctgcaggagagcgtgctgagcgagcaggacctgatgcagcccgaggagcccgacacccaccacgagcccgagttccagtag

SEQ ID NO: 96866 - DNA, 3063 bp, Artificial Sequence
  Description of Artificial Sequence: Synthetic coding sequence
atgagagagcccgaggagctgatgcccgacagcggcgccgtgttcaccttcggcaagagcaagttcgccgagaacaaccccggcaagttctggttcaagaacgacgtgcccgtgcacctgagctgcggcgacgagcacagcgccgtggtgaccggcaacaacaagctgtacatgttcggcagcaacaactggggccagctgggcctgggcagcaagagcgccatcagcaagcccacctgcgtgaaggccctgaagcccgagaaggtgaagctggccgcctgcggcagaaaccacaccctggtgagcaccgagggcggcaacgtgtacgccaccggcggcaacaacgagggccagctgggcctgggcgacaccgaggagagaaacaccttccacgtgatcagcttcttcaccagcgagcacaagatcaagcagctgagcgccggcagcaacaccagcgccgccctgaccgaggacggcagactgttcatgtggggcgacaacagcgagggccagatcggcctgaagaacgtgagcaacgtgtgcgtgccccagcaggtgaccatcggcaagcccgtgagctggatcagctgcggctactaccacagcgccttcgtgaccaccgacggcgagctgtacgtgttcggcgagcccgagaacggcaagctgggcctgcccaaccagctgctgggcaaccacagaaccccccagctggtgagcgagatccccgagaaggtgatccaggtggcctgcggcggcgagcacaccgtggtgctgaccgagaacgccgtgtacaccttcggcctgggccagttcggccagctgggcctgggcaccttcctgttcgagaccagcgagcccaaggtgatcgagaacatcagagaccagaccatcagctacatcagctgcggcgagaaccacaccgccctgatcaccgacatcggcctgatgtacaccttcggcgacggcagacacggcaagctgggcctgggcctggagaacttcaccaaccacttcatccccaccctgtgcagcaacttcctgagattcatcgtgaagctggtggcctgcggcggctgccacatggtggtgttcgccgccccccacagaggcgtggccaaggagatcgagttcgacgagatcaacgacacctgcctgagcgtggccaccttcctgccctacagcagcctgaccagcggcaacgtgctgcagagaaccctgagcgccagaatgagaagaagagagagagagagaagccccgacagcttcagcatgagaagaaccctgccccccatcgagggcaccctgggcctgagcgcctgcttcctgcccaacagcgtgttccccagatgcagcgagagaaacctgcaggagagcgtgctgagcgagcaggacctgatgcagcccgaggagcccgactacctgctggacgagatgaccaaggaggccgagatcgacaacagcagcaccgtggagagcctgggcgagaccaccgacatcctgaacatgacccacatcatgagcctgaacagcaacgagaagagcctgaagctgagccccgtgcagaagcagaagaagcagcagaccatcggcgagctgacccaggacaccgccctgaccgagaacgacgacagcgacgagtacgaggagatgagcgagatgaaggagggcaaggcctgcaagcagcacgtgagccagggcatcttcatgacccagcccgccaccaccatcgaggccttcagcgacgaggaggtgggcaacgacaccggccaggtgggcccccaggccgacaccgacggcgagggcctgcagaaggaggtgtacagacacgagaacaacaacggcgtggaccagctggacgccaaggagatcgagaaggagagcgacggcggccacagccagaaggagagcgaggccgaggagatcgacagcgagaaggagaccaagctggccgagatcgccggcatgaaggacctgagagagagagagaagagcaccaagaagatgagccccttcttcggcaacctgcccgacagaggcatgaacaccgagagcgaggagaacaaggacttcgtgaagaagagagagagctgcaagcaggacgtgatcttcgacagcgagagagagagcgtggagaagcccgacagctacatggagggcgccagcgagagccagcagggcatcgccgacggcttccagcagcccgaggccatcgagttcagcagcggcgagaaggaggacgacgaggtggagaccgaccagaacatcagatacggcagaaagctgatcgagcagggcaacgagaaggagaccaagcccatcatcagcaagagcatggccaagtacgacttcaagtgcgacagactgagcgagatccccgaggagaaggagggcgccgaggacagcaagggcaacggcatcgaggagcaggaggtggaggccaacgaggagaacgtgaaggtgcacggcggcagaaaggagaagaccgagatcctgagcgacgacctgaccgacaaggccgaggaccacgagttcagcaagaccgaggagctgaagctggaggacgtggacgaggagatcaacgccgagaacgtggagagcaagaagaagaccgtgggcgacgacgagagcgtgcccaccggctaccacagcaagaccgagggcgccgagagaaccaacgacgacagcagcgccgagaccatcgagaagaaggagaaggccaacctggaggagagagccatctgcgagtacaacgagaaccccaagggctacatgctggacgacgccgacagcagcagcctggagatcctggagaacagcgagaccacccccagcaaggacatgaagaagaccaagaagatcttcctgttcaagagagtgcccagcatcaaccagaagatcgtgaagaacaacaacgagcccctgcccgagatcaagagcatcggcgaccagatcatcctgaagagcgacaacaaggacgccgaccagaaccacatgagccagaaccaccagaacatcccccccaccaacaccgagagaagaagcaagagctgcaccatcctgtag

SEQ ID NO: 96867 - DNA, 1941 bp, Artificial Sequence
  Description of Artificial Sequence: Synthetic coding sequence
atgagagagcccgaggagctgatgcccgacagcggcgccgtgttcaccttcggcaagagcaagttcgccgagaacaaccccggcaagttctggttcaagaacgacgtgcccgtgcacctgagctgcggcgacgagcacagcgccgtggtgaccggcaacaacaagctgtacatgttcggcagcaacaactggggccagctgggcctgggcagcaagagcgccatcagcaagcccacctgcgtgaaggccctgaagcccgagaaggtgaagctggccgcctgcggcagaaaccacaccctggtgagcaccgagggcggcaacgtgtacgccaccggcggcaacaacgagggccagctgggcctgggcgacaccgaggagagaaacaccttccacgtgatcagcttcttcaccagcgagcacaagatcaagcagctgagcgccggcagcaacaccagcgccgccctgaccgaggacggcagactgttcatgtggggcgacaacagcgagggccagatcggcctgaagaacgtgagcaacgtgtgcgtgccccagcaggtgaccatcggcaagcccgtgagctggatcagctgcggctactaccacagcgccttcgtgaccaccgacggcgagctgtacgtgttcggcgagcccgagaacggcaagctgggcctgcccaaccagctgctgggcaaccacagaaccccccagctggtgagcgagatccccgagaaggtgatccaggtggcctgcggcggcgagcacaccgtggtgctgaccgagaacgccgtgtacaccttcggcctgggccagttcggccagctgggcctgggcaccttcctgttcgagaccagcgagcccaaggtgatcgagaacatcagagaccagaccatcagctacatcagctgcggcgagaaccacaccgccctgatcaccgacatcggcctgatgtacaccttcggcgacggcagacacggcaagctgggcctgggcctggagaacttcaccaaccacttcatccccaccctgtgcagcaacttcctgagattcatcgtgaagctggtggcctgcggcggctgccacatggtggtgttcgccgccccccacagaggcgtggccaaggagatcgagttcgacgagatcaacgacacctgcctgagcgtggccaccttcctgccctacagcagcctgaccagcggcaacgtgctgcagagaaccctgagcgccagaatgagaagaagagagagagagagaagccccgacagcttcagcatgagaagaaccctgccccccatcgagggcaccctgggcctgagcgcctgcttcctgcccaacagcgtgttccccagatgcagcgagagaaacctgcaggagagcgtgctgagcgagcaggacctgatgcagcccgaggagcccgactacctgctggacgagatgaccaaggaggccgagatcgacaacagcagcaccgtggagagcctgggcgagaccaccgacatcctgaacatgacccacatcatgagcctgaacagcaacgagaagagcctgaagctgagccccgtgcagaagcagaagaagcagcagaccatcggcgagctgacccaggacaccgccctgaccgagaacgacgacagcgacgagtacgaggagatgagcgagatgaaggagggcaaggcctgcaagcagcacgtgagccagggcatcttcatgacccagcccgccaccaccatcgaggccttcagcgacgaggaggtggagatccccgaggagaaggagggcgccgaggacagcaagggcaacggcatcgaggagcaggaggtggaggccaacgaggagaacgtgaaggtgcacggcggcagaaaggagaagaccgagatcctgagcgacgacctgaccgacaaggccgagtacagcgccagccacagccagatcgtgagcgtgtag

SEQ ID NO: 96868 - DNA, 3459 bp, Artificial Sequence
  Description of Artificial Sequence: Synthetic coding sequence
atgagagagcccgaggagctgatgcccgacagcggcgccgtgttcaccttcggcaagagcaagttcgccgagaacaaccccggcaagttctggttcaagaacgacgtgcccgtgcacctgagctgcggcgacgagcacagcgccgtggtgaccggcaacaacaagctgtacatgttcggcagcaacaactggggccagctgggcctgggcagcaagagcgccatcagcaagcccacctgcgtgaaggccctgaagcccgagaaggtgaagctggccgcctgcggcagaaaccacaccctggtgagcaccgagggcggcaacgtgtacgccaccggcggcaacaacgagggccagctgggcctgggcgacaccgaggagagaaacaccttccacgtgatcagcttcttcaccagcgagcacaagatcaagcagctgagcgccggcagcaacaccagcgccgccctgaccgaggacggcagactgttcatgtggggcgacaacagcgagggccagatcggcctgaagaacgtgagcaacgtgtgcgtgccccagcaggtgaccatcggcaagcccgtgagctggatcagctgcggctactaccacagcgccttcgtgaccaccgacggcgagctgtacgtgttcggcgagcccgagaacggcaagctgggcctgcccaaccagctgctgggcaaccacagaaccccccagctggtgagcgagatccccgagaaggtgatccaggtggcctgcggcggcgagcacaccgtggtgctgaccgagaacgccgtgtacaccttcggcctgggccagttcggccagctgggcctgggcaccttcctgttcgagaccagcgagcccaaggtgatcgagaacatcagagaccagaccatcagctacatcagctgcggcgagaaccacaccgccctgatcaccgacatcggcctgatgtacaccttcggcgacggcagacacggcaagctgggcctgggcctggagaacttcaccaaccacttcatccccaccctgtgcagcaacttcctgagattcatcgtgaagctggtggcctgcggcggctgccacatggtggtgttcgccgccccccacagaggcgtggccaaggagatcgagttcgacgagatcaacgacacctgcctgagcgtggccaccttcctgccctacagcagcctgaccagcggcaacgtgctgcagagaaccctgagcgccagaatgagaagaagagagagagagagaagccccgacagcttcagcatgagaagaaccctgccccccatcgagggcaccctgggcctgagcgcctgcttcctgcccaacagcgtgttccccagatgcagcgagagaaacctgcaggagagcgtgctgagcgagcaggacctgatgcagcccgaggagcccgactacctgctggacgagatgaccaaggaggccgagatcgacaacagcagcaccgtggagagcctgggcgagaccaccgacatcctgaacatgacccacatcatgagcctgaacagcaacgagaagagcctgaagctgagccccgtgcagaagcagaagaagcagcagaccatcggcgagctgacccaggacaccgccctgaccgagaacgacgacagcgacgagtacgaggagatgagcgagatgaaggagggcaaggcctgcaagcagcacgtgagccagggcatcttcatgacccagcccgccaccaccatcgaggccttcagcgacgaggaggtggagatccccgaggagaaggagggcgccgaggacagcaagggcaacggcatcgaggagcaggaggtggaggccaacgaggagaacgtgaaggtgcacggcggcagaaaggagaagaccgagatcctgagcgacgacctgaccgacaaggccgaggtgagcgagggcaaggccaagagcgtgggcgaggccgaggacggccccgagggcagaggcgacggcacctgcgaggagggcagcagcggcgccgagcactggcaggacgaggagagagagaagggcgagaaggacaagggcagaggcgagatggagagacccggcgagggcgagaaggagctggccgagaaggaggagtggaagaagagagacggcgaggagcaggagcagaaggagagagagcagggccaccagaaggagagaaaccaggagatggaggagggcggcgaggaggagcacggcgagggcgaggaggaggagggcgacagagaggaggaggaggagaaggagggcgagggcaaggaggagggcgagggcgaggaggtggagggcgagagagagaaggaggagggcgagagaaagaaggaggagagagccggcaaggaggagaagggcgaggaggagggcgaccagggcgagggcgaggaggaggagaccgagggcagaggcgaggagaaggaggagggcggcgaggtggagggcggcgaggtggaggagggcaagggcgagagagaggaggaggaggaggagggcgagggcgaggaggaggagggcgagggcgaggaggaggagggcgagggcgaggaggaggagggcgagggcaagggcgaggaggagggcgaggagggcgagggcgaggaggagggcgaggagggcgagggcgagggcgaggaggaggagggcgagggcgagggcgaggaggagggcgagggcgagggcgaggaggaggagggcgagggcgagggcgaggaggagggcgagggcgagggcgaggaggaggagggcgagggcaagggcgaggaggagggcgaggagggcgagggcgagggcgaggaggaggagggcgagggcgagggcgaggacggcgagggcgagggcgaggaggaggagggcgagtgggagggcgaggaggaggagggcgagggcgagggcgaggaggagggcgagggcgagggcgaggagggcgagggcgagggcgaggaggaggagggcgagggcgagggcgaggaggaggagggcgaggaggagggcgaggaggagggcgagggcgaggaggagggcgagggcgagggcgaggaggaggaggagggcgaggtggagggcgaggtggagggcgaggagggcgagggcgagggcgaggaggaggagggcgaggaggagggcgaggagagagagaaggagggcgagggcgaggagaacagaagaaacagagaggaggaggaggaggaggagggcaagtaccaggagaccggcgaggaggagaacgagagacaggacggcgaggagtacaagaaggtgagcaagatcaagggcagcgtgaagtacggcaagcacaagacctaccagaagaagagcgtgaccaacacccagggcaacggcaaggagcagagaagcaagatgcccgtgcagagcaagagactgctgaagaacggccccagcggcagcaagaagttctggaacaacgtgctgccccactacctggagctgaagtag

SEQ ID NO: 96869 - DNA, 2121 bp, Artificial Sequence
  Description of Artificial Sequence: Synthetic coding sequence
atgaacgagagcaagcccggcgacagccagaacctggcctgcgtgttctgcagaaagcacgacgactgccccaacaagtacggcgagaagaagaccaaggagaagtggaacctgaccgtgcactactactgcctgctgatgagcagcggcatctggcagagaggcaaggaggaggagggcgtgtacggcttcctgatcgaggacatcagaaaggaggtgaacagagccagcaagctgaagtgctgcgtgtgcaagaagaacggcgccagcatcggctgcgtggcccccagatgcaagagaagctaccacttcccctgcggcctgcagagagagtgcatcttccagttcaccggcaacttcgccagcttctgctgggaccacagacccgtgcagatcatcaccagcaacaactacagagagagcctgccctgcaccatctgcctggagttcatcgagcccatccccagctacaacatcctgagaagcccctgctgcaagaacgcctggttccacagagactgcctgcaggtgcaggccatcaacgccggcgtgttcttcttcagatgcaccatctgcaacaacagcgacatcttccagaaggagatgctgagaatgggcatccacatccccgagaaggacgccagctgggagctggaggagaacgcctaccaggagctgctgcagcactacgagagatgcgacgtgagaagatgcagatgcaaggagggcagagactacaacgcccccgacagcaagtgggagatcaagagatgccagtgctgcggcagcagcggcacccacctggcctgcagcagcctgagaagctgggagcagaactgggagtgcctggagtgcagaggcatcatctacaacagcggcgagttccagaaggccaagaagcacgtgctgcccaacagcaacaacgtgggcatcaccgactgcctgctggaggagagcagccccaagctgcccagacagagccccggcagccagagcaaggacctgctgagacagggcagcaagttcagaagaaacgtgagcaccctgctgatcgagctgggcttccagatcaagaagaagaccaagagactgtacatcaacaaggccaacatctggaacagcgccctggacgccttcagaaacagaaacttcaaccccagctacgccatcgaggtggcctacgtgatcgagaacgacaacttcggcagcgagcaccccggcagcaagcaggagttcctgagcctgctgatgcagcacctggagaacagcagcctgttcgagggcagcctgagcaagaacctgagcctgaacagccaggccctgaaggagaacctgtactacgaggccggcaagatgctggccatcagcctggtgcacggcggccccagccccggcttcttcagcaagaccctgttcaactgcctggtgtacggccccgagaacacccagcccatcctggacgacgtgagcgacttcgacgtggcccagatcatcatcagaatcaacaccgccaccaccgtggccgacctgaagagcatcatcaacgagtgctacaactacctggagctgatcggctgcctgagactgatcaccaccctgagcgacaagtacatgctggtgaaggacatcctgggctaccacgtgatccagagagtgcacacccccttcgagagcttcaagcagggcctgaagaccctgggcgtgctggagaagatccaggcctaccccgaggccttctgcagcatcctgtgccacaagcccgagagcctgagcgccaagatcctgagcgagctgttcaccgtgcacaccctgcccgacgtgaaggccctgggcttctggaacagctacctgcaggccgtggaggacggcaagagcaccaccaccatggaggacatcctgatcttcgccaccggctgcagcagcatcccccccgccggcttcaagcccacccccagcatcgagtgcctgcacgtggacttccccgtgggcaacaagtgcaacaactgcctggccatccccatcaccaacacctacaaggagttccaggagaacatggacttcaccatcagaaacaccctgagactggagaaggaggagagcagccactacatcggccactag

SEQ ID NO: 96870 - DNA, 1938 bp, Artificial Sequence
  Description of Artificial Sequence: Synthetic coding sequence
atgctgctgatggcccccgacagatgcagatacgtgtggaagcactgccagcccatggagatgagaatcaagtggatcttcctgtgctgcatcagacccctgtacgacttcaccagccagtacgtgatggagaccgacagcctgttcctgcactacctgcaggaggccagcgccagactggacatccaccaggccatggccagcgagcacagcaccctggccgccggctggatctgcttcgacagagtgctggagaccgtggagaaggtgcacggcctggccaccctgatcggcgccggcggcgaggagttcggcgtgctggagtactggatgagactgagattccccatcaagcccagcctgcaggcctgcaacaagagaaagaaggcccaggtgtacctgagcaccgacgtgctgggcggcagaaaggcccaggaggaggagttcagaagcgagagctgggagccccagaacgagctgtggatcgagatcaccaagtgctgcggcctgagaagcagatggctgggcacccagcccagcccctacgccgtgtacagattcttcaccttcagcgaccacgacaccgccatcatccccgccagcaacaacccctacttcagagaccaggccagattccccgtgctggtgaccagcgacctggaccactacctgagaagagaggccctgagcatccacgtgttcgacgacgaggacctggagcccggcagctacctgggcagagccagagtgcccctgctgcccctggccaagaacgagagcatcaagggcgacttcaacctgaccgaccccgccgagaagcccaacggcagcatccaggtgcagctggactggaagttcccctacatcccccccgagagcttcctgaagcccgaggcccagaccaagggcaaggacaccaaggacagcagcaagatcagcagcgaggaggagaaggccagcttccccagccaggaccagatggccagccccgaggtgcccatcgaggccggccagtacagaagcaagagaaagcccccccacggcggcgagagaaaggagaaggagcaccaggtggtgagctacagcagaagaaagcacggcaagagaatcggcgtgcagggcaagaacagaatggagtacctgagcctgaacatcctgaacggcaacacccccgagcaggtgaactacaccgagtggaagttcagcgagaccaacagcttcatcggcgacggcttcaagaaccagcacgaggaggaggagatgaccctgagccacagcgccctgaagcagaaggagcccctgcaccccgtgaacgacaaggagagcagcgagcagggcagcgaggtgagcgaggcccagaccaccgacagcgacgacgtgatcgtgccccccatgagccagaagtaccccaaggccgacagcgagaagatgtgcatcgagatcgtgagcctggccttctaccccgaggccgaggtgatgagcgacgagaacatcaagcaggtgtacgtggagtacaagttctacgacctgcccctgagcgagaccgagacccccgtgagcctgagaaagcccagagccggcgaggagatccacttccacttcagcaaggtgatcgacctggacccccaggagcagcagggcagaagaagattcctgttcgacatgctgaacggccaggaccccgaccagggccacctgaagttcaccgtggtgagcgaccccctggacgaggagaagaaggagtgcgaggaggtgggctacgcctacctgcagctgtggcagatcctggagagcggcagagacatcctggagcaggagctggacatcgtgagccccgaggacctggccacccccatcggcagactgaaggtgagcctgcaggccgccgccgtgctgcacgccatctacaaggagatgaccgaggacctgttcagctag

SEQ ID NO: 96871 - DNA, 1839 bp, Artificial Sequence
  Description of Artificial Sequence: Synthetic coding sequence
atgctgaagctggacaacaaggacgtgatcagccaccccctgggctaccccagcgagagcctgctgagcatcgccagcatgctggacagcagcgacagcagcagccagccccactggagcaacgagctgatcgccgagcagctgcagcagcaggtgagccagctgcaggaccagctggacgccgagctggaggacaagagaaaggtgctgctggagctgagcagagagaaggcccagaacgaggacctgaagctggaggtgaccaacatcctgcagaagcacaagcaggaggtggagctgctgcagaacgccgccaccatcagccagccccccgacagacagagcgagcccgccacccaccccgccgtgctgcaggagaacacccagatcgagcccagcgagcccaagaaccaggaggagaagaagctgagccaggtgctgaacgagctgcaggtgagccacgccgagaccaccctggagctggagaagaccagagacatgctgatcctgcagagaaagatcaacgtgtgctaccaggaggagctggaggccatgatgaccaaggccgacaacgacaacagagaccacaaggagaagctggagagactgaccagactgctggacctgaagaacaacagaatcaagcagctggagggcatcctgagaagccacgacctgcccaccagcggcgacttcaacctgaccgaccccgccgagaagcccaacggcagcatccaggtgcagctggactggaagttcccctacatcccccccgagagcttcctgaagcccgaggcccagaccaagggcaaggacaccaaggacagcagcaagatcagcagcgaggaggagaaggccagcttccccagccaggaccagatggccagccccgaggtgcccatcgaggccggccagtacagaagcaagagaaagcccccccacggcggcgagagaaaggagaaggagcaccaggtggtgagctacagcagaagaaagcacggcaagagaatcggcgtgcagggcaagaacagaatggagtacctgagcctgaacatcctgaacggcaacacccccgagcaggtgaactacaccgagtggaagttcagcgagaccaacagcttcatcggcgacggcttcaagaaccagcacgaggaggaggagatgaccctgagccacagcgccctgaagcagaaggagcccctgcaccccgtgaacgacaaggagagcagcgagcagggcagcgaggtgagcgaggcccagaccaccgacagcgacgacgtgatcgtgccccccatgagccagaagtaccccaaggccgacagcgagaagatgtgcatcgagatcgtgagcctggccttctaccccgaggccgaggtgatgagcgacgagaacatcaagcaggtgtacgtggagtacaagttctacgacctgcccctgagcgagaccgagacccccgtgagcctgagaaagcccagagccggcgaggagatccacttccacttcagcaaggtgatcgacctggacccccaggagcagcagggcagaagaagattcctgttcgacatgctgaacggccaggaccccgaccagggccacctgaagttcaccgtggtgagcgaccccctggacgaggagaagaaggagtgcgaggaggtgggctacgcctacctgcagctgtggcagatcctggagagcggcagagacatcctggagcaggagctggacatcgtgagccccgaggacctggccacccccatcggcagactgaaggtgagcctgcaggccgccgccgtgctgcacgccatctacaaggagatgaccgaggacctgttcagctag

SEQ ID NO: 96872 - DNA, 3861 bp, Artificial Sequence
  Description of Artificial Sequence: Synthetic coding sequence
atgagccacctggtggaccccaccagcggcgacctgcccgtgagagacatcgacgccatccccctggtgctgcccgccagcaagggcaagaacatgaagacccagccccccctgagcagaatgaacagagaggagctggaggacagcttcttcagactgagagaggaccacatgctggtgaaggagctgagctggaagcagcaggacgagatcaagagactgagaaccaccctgctgagactgaccgccgccggcagagacctgagagtggccgaggaggccgcccccctgagcgagaccgccagaagaggccagaaggccggctggagacagagactgagcatgcaccagagaccccagatgcacagactgcagggccacttccactgcgtgggccccgccagccccagaagagcccagcccagagtgcaggtgggccacagacagctgcacaccgccggcgcccccgtgcccgagaagcccaagagaggccccagagacagactgagctacaccgccccccccagcttcaaggagcacgccaccaacgagaacagaggcgaggtggccagcaagcccagcgagctggtgagcggcagcaacagcatcatcagcttcagcagcgtgatcagcatggccaagcccatcggcctgtgcatgcccaacagcgcccacatcatggccagcaacaccatgcaggtggaggagccccccaagagccccgagaagatgtggcccaaggacgagaacttcgagcagagaagcagcctggagtgcgcccagaaggccgccgagctgagagccagcatcaaggagaaggtggagctgatcagactgaagaagctgctgcacgagagaaacgccagcctggtgatgaccaaggcccagctgaccgaggtgcaggaggcctacgagaccctgctgcagaagaaccagggcatcctgagcgccgcccacgaggccctgctgaagcaggtgaacgagctgagagccgagctgaaggaggagagcaagaaggccgtgagcctgaagagccagctggaggacgtgagcatcctgcagatgaccctgaaggagttccaggagagagtggaggacctggagaaggagagaaagctgctgaacgacaactacgacaagctgctggagagcatgctggacagcagcgacagcagcagccagccccactggagcaacgagctgatcgccgagcagctgcagcagcaggtgagccagctgcaggaccagctggacgccgagctggaggacaagagaaaggtgctgctggagctgagcagagagaaggcccagaacgaggacctgaagctggaggtgaccaacatcctgcagaagcacaagcaggaggtggagctgctgcagaacgccgccaccatcagccagccccccgacagacagagcgagcccgccacccaccccgccgtgctgcaggagaacacccagatcgagcccagcgagcccaagaaccaggaggagaagaagctgagccaggtgctgaacgagctgcaggtgagccacgccgagaccaccctggagctggagaagaccagagacatgctgatcctgcagagaaagatcaacgtgtgctaccaggaggagctggaggccatgatgaccaaggccgacaacgacaacagagaccacaaggagaagctggagagactgaccagactgctggacctgaagaacaacagaatcaagcagctggagggcatcctgagaagccacgacctgcccaccagcgagcagctgaaggacgtggcctacggcaccagacccctgagcctgtgcctggagaccctgcccgcccacggcgacgaggacaaggtggacatcagcctgctgcaccagggcgagaacctgttcgagctgcacatccaccaggccttcctgaccagcgccgccctggcccaggccggcgacacccagcccaccaccttctgcacctacagcttctacgacttcgagacccactgcacccccctgagcgtgggcccccagcccctgtacgacttcaccagccagtacgtgatggagaccgacagcctgttcctgcactacctgcaggaggccagcgccagactggacatccaccaggccatggccagcgagcacagcaccctggccgccggctggatctgcttcgacagagtgctggagaccgtggagaaggtgcacggcctggccaccctgatcggcgccggcggcgaggagttcggcgtgctggagtactggatgagactgagattccccatcaagcccagcctgcaggcctgcaacaagagaaagaaggcccaggtgtacctgagcaccgacgtgctgggcggcagaaaggcccaggaggaggagttcagaagcgagagctgggagccccagaacgagctgtggatcgagatcaccaagtgctgcggcctgagaagcagatggctgggcacccagcccagcccctacgccgtgtacagattcttcaccttcagcgaccacgacaccgccatcatccccgccagcaacaacccctacttcagagaccaggccagattccccgtgctggtgaccagcgacctggaccactacctgagaagagaggccctgagcatccacgtgttcgacgacgaggacctggagcccggcagctacctgggcagagccagagtgcccctgctgcccctggccaagaacgagagcatcaagggcgacttcaacctgaccgaccccgccgagaagcccaacggcagcatccaggtgcagctggactggaagttcccctacatcccccccgagagcttcctgaagcccgaggcccagaccaagggcaaggacaccaaggacagcagcaagatcagcagcgaggaggagaaggccagcttccccagccaggaccagatggccagccccgaggtgcccatcgaggccggccagtacagaagcaagagaaagcccccccacggcggcgagagaaaggagaaggagcaccaggtggtgagctacagcagaagaaagcacggcaagagaatcggcgtgcagggcaagaacagaatggagtacctgagcctgaacatcctgaacggcaacacccccgagcaggtgaactacaccgagtggaagttcagcgagaccaacagcttcatcggcgacggcttcaagaaccagcacgaggaggaggagatgaccctgagccacagcgccctgaagcagaaggagcccctgcaccccgtgaacgacaaggagagcagcgagcagggcagcgaggtgagcgaggcccagaccaccgacagcgacgacgtgatcgtgccccccatgagccagaagtaccccaaggccgacagcgagaagatgtgcatcgagatcgtgagcctggccttctaccccgaggccgaggtgatgagcgacgagaacatcaagcaggtgtacgtggagtacaagttctacgacctgcccctgagcgagaccgagacccccgtgagcctgagaaagcccagagccggcgaggagatccacttccacttcagcaaggtgatcgacctggacccccaggagcagcagggcagaagaagattcctgttcgacatgctgaacggccaggaccccgaccagggccacctgaagttcaccgtggtgagcgaccccctggacgaggagaagaaggagtgcgaggaggtgggctacgcctacctgcagctgtggcagatcctggagagcggcagagacatcctggagcaggagctggacatcgtgagccccgaggacctggccacccccatcggcagactgaaggtgagcctgcaggccgccgccgtgctgcacgccatctacaaggagatgaccgaggacctgttcagctag

SEQ ID NO: 96873 - DNA, 1617 bp, Artificial Sequence
  Description of Artificial Sequence: Synthetic coding sequence
atgaacctggagctgctggagagcttcggccagaactaccccgaggaggccgacggcaccctggactgcatcagcatggccctgacctgcaccttcaacagatggggcaccctgctggccgtgggctgcaacgacggcagaatcgtgatctgggacttcctgaccagaggcatcgccaagatcatcagcgcccacatccaccccgtgtgcagcctgtgctggagcagagacggccacaagctggtgagcgccagcaccgacaacatcgtgagccagtgggacgtgctgagcggcgactgcgaccagagattcagattccccagccccatcctgaaggtgcagtaccaccccagagaccagaacaaggtgctggtgtgccccatgaagagcgcccccgtgatgctgaccctgagcgacagcaagcacgtggtgctgcccgtggacgacgacagcgacctgaacgtggtggccagcttcgacagaagaggcgagtacatctacaccggcaacgccaagggcaagatcctggtgctgaagaccgacagccaggacctggtggccagcttcagagtgaccaccggcaccagcaacaccaccgccatcaagagcatcgagttcgccagaaagggcagctgcttcctgatcaacaccgccgacagaatcatcagagtgtacgacggcagagagatcctgacctgcggcagagacggcgagcccgagcccatgcagaagctgcaggacctggtgaacagaaccccctggaagaagtgctgcttcagcggcgacggcgagtacatcgtggccggcagcgccagacagcacgccctgtacatctgggagaagagcatcggcaacctggtgaagatcctgcacggcaccagaggcgagctgctgctggacgtggcctggcaccccgtgagacccatcatcgccagcatcagcagcggcgtggtgagcatctgggcccagaaccaggtggagaactggagcgccttcgcccccgacttcaaggagctggacgagaacgtggagtacgaggagagagagagcgagttcgacatcgaggacgaggacaagagcgagcccgagcagaccggcgccgacgccgccgaggacgaggaggtggacgtgaccagcgtggaccccatcgccgccttctgcagcagcgacgaggagctggaggacagcaaggccctgctgtacctgcccatcgcccccgaggtggaggaccccgaggagaacccctacggccccccccccgacgccgtgcagaccagcctgatggacgagggcgccagcagcgagaagaagagacagagcagcgccgacggcagccagccccccaagaagaagcccaagaccaccaacatcgagctgcagggcgtgcccaacgacgaggtgcaccccctgctgggcgtgaagggcgacggcaagagcaagaagaagcaggccggcagacccaagggcagcaagggcaaggagaaggacagccccttcaagcccaagctgtacaagggcgacagaggcctgcccctggagggcagcgccaagggcaaggtgcaggccgagctgagccagcccctgaccgccggcggcgccatcagcgagctgctgtag

SEQ ID NO: 96874 - DNA, 1503 bp, Artificial Sequence
  Description of Artificial Sequence: Synthetic coding sequence
atgaacctggagctgctggagagcttcggccagaactaccccgaggaggccgacggcaccctggactgcatcagcatggccctgacctgcaccttcaacagatggggcaccctgctggccgtgggctgcaacgacggcagaatcgtgatctgggacttcctgaccagaggcatcgccaagatcatcagcgcccacatccaccccgtgtgcagcctgtgctggagcagagacggccacaagctggtgagcgccagcaccgacaacatcgtgagccagtgggacgtgctgagcggcgactgcgaccagagattcagattccccagccccatcctgaaggtgcagtaccaccccagagaccagaacaaggtgctggtgtgccccatgaagagcgcccccgtgatgctgaccctgagcgacagcaagcacgtggtgctgcccgtggacgacgacagcgacctgaacgtggtggccagcttcgacagaagaggcgagtacatctacaccggcaacgccaagggcaagatcctggtgctgaagaccgacagccaggacctggtggccagcttcagagtgaccaccggcaccagcaacaccaccgccatcaagagcatcgagttcgccagaaagggcagctgcttcctgatcaacaccgccgacagaatcatcagagtgtacgacggcagagagatcctgacctgcggcagagacggcgagcccgagcccatgcagaagctgcaggacctggtgaacagaaccccctggaagaagtgctgcttcagcggcgacggcgagtacatcgtggccggcagcgccagacagcacgccctgtacatctgggagaagagcatcggcaacctggtgaagatcctgcacggcaccagaggcgagctgctgctggacgtggcctggcaccccgtgagacccatcatcgccagcatcagcagcggcgtggtgagcatctgggcccagaaccaggtggagaactggagcgccttcgcccccgacttcaaggagctggacgagaacgtggagtacgaggagagagagagcgagttcgacatcgaggacgaggacaagagcgagcccgagcagaccggcgccgacgccgccgaggacgaggaggtggacgtgaccagcgtggaccccatcgccgccttctgcagcagcgacgaggagctggaggacagcaaggccctgctgtacctgcccatcgcccccgaggtggaggaccccgaggagaacccctacggccccccccccgacgccgtgcagaccagcctgatggacgagggcgccagcagcgagaagaagagacagagcagcgccgacggcagccagccccccaagaagaagcccaagaccaccaacatcgagctgcagggcgtgcccaacgacgaggtgcaccccctgctgggcgtgaagggcgacggcaagagcaagaagaagcaggccggcagacccaagggcagcaaggccggcggcgccatcagcgagctgctgtag

SEQ ID NO: 96875 - DNA, 5379 bp, Artificial Sequence
  Description of Artificial Sequence: Synthetic coding sequence
atgagctgcgtgcactacaagttcagcagcaagctgaactacgacaccgtgaccttcgacggcctgcacatcagcctgtgcgacctgaagaagcagatcatgggcagagagaagctgaaggccgccgactgcgacctgcagatcaccaacgcccagaccaaggaggagtacaccgacgacaacgccctgatccccaagaacagcagcgtgatcgtgagaagaatccccatcggcggcgtgaagagcaccagcaagacctacgtgatcagcagaaccgagcccgccatggccaccaccaaggccatcgacgacagcagcgccagcatcagcctggcccagctgaccaagaccgccaacctggccgaggccaacgccagcgaggaggacaagatcaaggccatgatgagccagagcggccacgagtacgaccccatcaactacatgaagaagcccctgggcccccccccccccagctacacctgcttcagatgcggcaagcccggccactacatcaagaactgccccaccaacggcgacaagaacttcgagagcggccccagaatcaagaagagcaccggcatccccagaagcttcatgatggaggtgaaggaccccaacatgaagggcgccatgctgaccaacaccggcaagtacgccatccccaccatcgacgccgaggcctacgccatcggcaagaaggagaagccccccttcctgcccgaggagcccagcagcagcagcgaggaggacgaccccatccccgacgagctgctgtgcctgatctgcaaggacatcatgaccgacgccgtggtgatcccctgctgcggcaacagctactgcgacgagtgcatcagaaccgccctgctggagagcgacgagcacacctgccccacctgccaccagaacgacgtgagccccgacgccctgatcgccaacaagttcctgagacaggccgtgaacaacttcaagaacgagaccggctacaccaagagactgagaaagcagctgccccccccccccccccccatccccccccccagacccctgatccagagaaacctgcagcccctgatgagaagccccatcagcagacagcaggaccccctgatgatccccgtgaccagcagcagcacccaccccgcccccagcatcagcagcctgaccagcaaccagagcagcctggccccccccgtgagcggcaaccccagcagcgcccccgcccccgtgcccgacatcaccgccaccgtgagcatcagcgtgcacagcgagaagagcgacggccccttcagagacagcgacaacaagatcctgcccgccgccgccctggccagcgagcacagcaagggcaccagcagcatcgccatcaccgccctgatggaggagaagggctaccaggtgcccgtgctgggcacccccagcctgctgggccagagcctgctgcacggccagctgatccccaccaccggccccgtgagaatcaacaccgccagacccggcggcggcagacccggctgggagcacagcaacaagctgggctacctggtgagccccccccagcagatcagaagaggcgagagaagctgctacagaagcatcaacagaggcagacaccacagcgagagaagccagagaacccagggccccagcctgcccgccacccccgtgttcgtgcccgtgccccccccccccctgtaccccccccccccccacaccctgcccctgccccccggcgtgccccccccccagttcagcccccagttcccccccggccagcccccccccgccggctacagcgtgcccccccccggcttcccccccgcccccgccaacctgagcaccccctgggtgagcagcggcgtgcagaccgcccacagcaacaccatccccaccacccaggccccccccctgagcagagaggagttctacagagagcagagaagactgaaggaggaggagaagaagaagagcaagctggacgagttcaccaacgacttcgccaaggagctgatggagtacaagaagatccagaaggagagaagaagaagcttcagcagaagcaagagcccctacagcggcagcagctacagcagaagcagctacacctacagcaagagcagaagcggcagcaccagaagcagaagctacagcagaagcttcagcagaagccacagcagaagctacagcagaagccccccctaccccagaagaggcagaggcaagagcagaaactacagaagcagaagcagaagccacggctaccacagaagcagaagcagaagccccccctacagaagataccacagcagaagcagaagcccccaggccttcagaggccagagccccaacaagagaaacgtgccccagggcgagaccgagagagagtacttcaacagatacagagaggtgccccccccctacgacatgaaggcctactacggcagaagcgtggacttcagagaccccttcgagaaggagagatacagagagtgggagagaaagtacagagagtggtacgagaagtactacaagggctacgccgccggcgcccagcccagacccagcgccaacagagagaacttcagccccgagagattcctgcccctgaacatcagaaacagccccttcaccagaggcagaagagaggactacgtgggcggccagagccacagaagcagaaacatcggcagcaactaccccgagaagctgagcgccagagacggccacaaccagaaggacaacaccaagagcaaggagaaggagagcgagaacgcccccggcgacggcaagggcaacaagcacaagaagcacagaaagagaagaaagggcgaggagagcgagggcttcctgaaccccgagctgctggagaccagcagaaagagcagagagcccaccggcgtggaggagaacaagaccgacagcctgttcgtgctgcccagcagagacgacgccacccccgtgagagacgagcccatggacgccgagagcatcaccttcaagagcgtgagcgagaaggacaagagagagagagacaagcccaaggccaagggcgacaagaccaagagaaagaacgacggcagcgccgtgagcaagaaggagaacatcgtgaagcccgccaagggcccccaggagaaggtggacggcgagagagagagaagccccagaagcgagccccccatcaagaaggccaaggaggagacccccaagaccgacaacaccaagagcagcagcagcagccagaaggacgagaagatcaccggcacccccagaaaggcccacagcaagagcgccaaggagcaccaggagaccaagcccgtgaaggaggagaaggtgaagaaggactacagcaaggacgtgaagagcgagaagctgaccaccaaggaggagaaggccaagaagcccaacgagaagaacaagcccctggacaacaagggcgagaagagaaagagaaagaccgaggagaagggcgtggacaaggacttcgagagcagcagcatgaagatcagcaagctggaggtgaccgagatcgtgaagcccagccccaagagaaagatggagcccgacaccgagaagatggacagaacccccgagaaggacaagatcagcctgagcgcccccgccaagaagatcaagctgaacagagagaccggcaagaagatcggcagcaccgagaacatcagcaacaccaaggagcccagcgagaagctggagagcaccagcagcaaggtgaagcaggagaaggtgaagggcaaggtgagaagaaaggtgaccggcaccgagggcagcagcagcaccctggtggactacaccagcaccagcagcaccggcggcagccccgtgagaaagagcgaggagaagaccgacaccaagagaaccgtgatcaagaccatggaggagtacaacaacgacaacaccgcccccgccgaggacgtgatcatcatgatccaggtgccccagagcaagtgggacaaggacgacttcgagagcgaggaggaggacgtgaagagcacccagcccatcagcagcgtgggcaagcccgccagcgtgatcaagaacgtgagcaccaagcccagcaacatcgtgaagtaccccgagaaggagagcgagcccagcgagaagatccagaagttcaccaaggacgtgagccacgagatcatccagcacgaggtgaagagcagcaagaacagcgccagcagcgagaagggcaagaccaaggacagagactacagcgtgctggagaaggagaaccccgagaagagaaagaacagcacccagcccgagaaggagagcaacctggacagactgaacgagcagggcaacttcaagagcctgagccagagcagcaaggaggccagaaccagcgacaagcacgacagcaccagagccagcagcaacaaggacttcacccccaacagagacaagaagaccgactacgacaccagagagtacagcagcagcaagagaagagacgagaagaacgagctgaccagaagaaaggacagccccagcagaaacaaggacagcgccagcggccagaagaacaagcccagagaggagagagacctgcccaagaagggcaccggcgacagcaagaagagcaacagcagccccagcagagacagaaagccccacgaccacaaggccacctacgacaccaagagacccaacgaggagaccaagagcgtggacaagaacccctgcaaggacagagagaagcacgtgctggaggccagaaacaacaaggagagcagcggcaacaagctgctgtacatcctgaacccccccgagacccaggtggagaaggagcagatcaccggccagatcgacaagagcaccgtgaagcccaagccccagctgagccacagcagcagactgagcagcgacctgaccagagagaccgacgaggccgccttcgagcccgactacaacgagagcgacagcgagagcaacgtgagcgtgaaggaggaggagagcagcggcaacatcagcaaggacctgaaggacaagatcgtggagaaggccaaggagagcctggacaccgccgccgtggtgcaggtgggcatcagcagaaaccagagccacagcagccccagcgtgagccccagcagaagccacagccccagcggcagccagaccagaagccacagcagcagcgccagcagcgccgagagccaggacagcaagaagaagaagaagaagaaggagaagaagaagcacaagaagcacaagaagcacaagaagcacaagaagcacgccggcaccgaggtggagctggagaagagccagaagcacaagcacaagaagaagaagagcaagaagaacaaggacaaggagaaggagaaggagaaggacgaccagaaggtgaagagcgtgaccgtgtag

SEQ ID NO: 96876 - DNA, 5277 bp, Artificial Sequence
  Description of Artificial Sequence: Synthetic coding sequence
atgagctgcgtgcactacaagttcagcagcaagctgaactacgacaccgtgaccttcgacggcctgcacatcagcctgtgcgacctgaagaagcagatcatgggcagagagaagctgaaggccgccgactgcgacctgcagatcaccaacgcccagaccaaggaggagtacaccgacgacaacgccctgatccccaagaacagcagcgtgatcgtgagaagaatccccatcggcggcgtgaagagcaccagcaagacctacgtgatcagcagaaccgagcccgccatggccaccaccaaggccatcgacgacagcagcgccagcatcagcctggcccagctgaccaagaccgccaacctggccgaggccaacgccagcgaggaggacaagatcaaggccatgatgagccagagcggccacgagtacgaccccatcaactacatgaagaagcccctgggcccccccccccccagctacacctgcttcagatgcggcaagcccggccactacatcaagaactgccccaccaacggcgacaagaacttcgagagcggccccagaatcaagaagagcaccggcatccccagaagcttcatgatggaggtgaaggaccccaacatgaagggcgccatgctgaccaacaccggcaagtacgccatccccaccatcgacgccgaggcctacgccatcggcaagaaggagaagccccccttcctgcccgaggagcccagcagcagcagcgaggaggacgaccccatccccgacgagctgctgtgcctgatctgcaaggacatcatgaccgacgccgtggtgatcccctgctgcggcaacagctactgcgacgagtgcatcagaaccgccctgctggagagcgacgagcacacctgccccacctgccaccagaacgacgtgagccccgacgccctgatcgccaacaagttcctgagacaggccgtgaacaacttcaagaacgagaccggctacaccaagagactgagaaagcagctgccccccccccccccccccatccccccccccagacccctgatccagagaaacctgcagcccctgatgagaagccccatcagcagacagcaggaccccctgatgatccccgtgaccagcagcagcacccaccccgcccccagcatcagcagcctgaccagcaaccagagcagcctggccccccccgtgagcggcaaccccagcagcgcccccgcccccgtgcccgacatcaccgccaccgtgagcatcagcgtgcacagcgagaagagcgacggccccttcagagacagcgacaacaagatcctgcccgccgccgccctggccagcgagcacagcaagggcaccagcagcatcgccatcaccgccctgatggaggagaagggctaccaggtgcccgtgctgggcacccccagcctgctgggccagagcctgctgcacggccagctgatccccaccaccggccccgtgagaatcaacaccgccagacccggcggcggcagacccggctgggagcacagcaacaagctgggctacctggtgagccccccccagcagatcagaagaggcgagagaagctgctacagaagcatcaacagaggcagacaccacagcgagagaagccagagaacccagggccccagcctgcccgccacccccgtgttcgtgcccgtgccccccccccccctgtaccccccccccccccacaccctgcccctgccccccggcgtgccccccccccagttcagcccccagttcccccccggccagcccccccccgccggctacagcgtgcccccccccggcttcccccccgcccccgccaacctgagcaccccctgggtgagcagcggcgtgcagaccgcccacagcaacaccatccccaccacccaggccccccccctgagcagagaggagttctacagagagcagagaagactgaaggaggagagcaagagcccctacagcggcagcagctacagcagaagcagctacacctacagcaagagcagaagcggcagcaccagaagcagaagctacagcagaagcttcagcagaagccacagcagaagctacagcagaagccccccctaccccagaagaggcagaggcaagagcagaaactacagaagcagaagcagaagccacggctaccacagaagcagaagcagaagccccccctacagaagataccacagcagaagcagaagcccccaggccttcagaggccagagccccaacaagagaaacgtgccccagggcgagaccgagagagagtacttcaacagatacagagaggtgccccccccctacgacatgaaggcctactacggcagaagcgtggacttcagagaccccttcgagaaggagagatacagagagtgggagagaaagtacagagagtggtacgagaagtactacaagggctacgccgccggcgcccagcccagacccagcgccaacagagagaacttcagccccgagagattcctgcccctgaacatcagaaacagccccttcaccagaggcagaagagaggactacgtgggcggccagagccacagaagcagaaacatcggcagcaactaccccgagaagctgagcgccagagacggccacaaccagaaggacaacaccaagagcaaggagaaggagagcgagaacgcccccggcgacggcaagggcaacaagcacaagaagcacagaaagagaagaaagggcgaggagagcgagggcttcctgaaccccgagctgctggagaccagcagaaagagcagagagcccaccggcgtggaggagaacaagaccgacagcctgttcgtgctgcccagcagagacgacgccacccccgtgagagacgagcccatggacgccgagagcatcaccttcaagagcgtgagcgagaaggacaagagagagagagacaagcccaaggccaagggcgacaagaccaagagaaagaacgacggcagcgccgtgagcaagaaggagaacatcgtgaagcccgccaagggcccccaggagaaggtggacggcgagagagagagaagccccagaagcgagccccccatcaagaaggccaaggaggagacccccaagaccgacaacaccaagagcagcagcagcagccagaaggacgagaagatcaccggcacccccagaaaggcccacagcaagagcgccaaggagcaccaggagaccaagcccgtgaaggaggagaaggtgaagaaggactacagcaaggacgtgaagagcgagaagctgaccaccaaggaggagaaggccaagaagcccaacgagaagaacaagcccctggacaacaagggcgagaagagaaagagaaagaccgaggagaagggcgtggacaaggacttcgagagcagcagcatgaagatcagcaagctggaggtgaccgagatcgtgaagcccagccccaagagaaagatggagcccgacaccgagaagatggacagaacccccgagaaggacaagatcagcctgagcgcccccgccaagaagatcaagctgaacagagagaccggcaagaagatcggcagcaccgagaacatcagcaacaccaaggagcccagcgagaagctggagagcaccagcagcaaggtgaagcaggagaaggtgaagggcaaggtgagaagaaaggtgaccggcaccgagggcagcagcagcaccctggtggactacaccagcaccagcagcaccggcggcagccccgtgagaaagagcgaggagaagaccgacaccaagagaaccgtgatcaagaccatggaggagtacaacaacgacaacaccgcccccgccgaggacgtgatcatcatgatccaggtgccccagagcaagtgggacaaggacgacttcgagagcgaggaggaggacgtgaagagcacccagcccatcagcagcgtgggcaagcccgccagcgtgatcaagaacgtgagcaccaagcccagcaacatcgtgaagtaccccgagaaggagagcgagcccagcgagaagatccagaagttcaccaaggacgtgagccacgagatcatccagcacgaggtgaagagcagcaagaacagcgccagcagcgagaagggcaagaccaaggacagagactacagcgtgctggagaaggagaaccccgagaagagaaagaacagcacccagcccgagaaggagagcaacctggacagactgaacgagcagggcaacttcaagagcctgagccagagcagcaaggaggccagaaccagcgacaagcacgacagcaccagagccagcagcaacaaggacttcacccccaacagagacaagaagaccgactacgacaccagagagtacagcagcagcaagagaagagacgagaagaacgagctgaccagaagaaaggacagccccagcagaaacaaggacagcgccagcggccagaagaacaagcccagagaggagagagacctgcccaagaagggcaccggcgacagcaagaagagcaacagcagccccagcagagacagaaagccccacgaccacaaggccacctacgacaccaagagacccaacgaggagaccaagagcgtggacaagaacccctgcaaggacagagagaagcacgtgctggaggccagaaacaacaaggagagcagcggcaacaagctgctgtacatcctgaacccccccgagacccaggtggagaaggagcagatcaccggccagatcgacaagagcaccgtgaagcccaagccccagctgagccacagcagcagactgagcagcgacctgaccagagagaccgacgaggccgccttcgagcccgactacaacgagagcgacagcgagagcaacgtgagcgtgaaggaggaggagagcagcggcaacatcagcaaggacctgaaggacaagatcgtggagaaggccaaggagagcctggacaccgccgccgtggtgcaggtgggcatcagcagaaaccagagccacagcagccccagcgtgagccccagcagaagccacagccccagcggcagccagaccagaagccacagcagcagcgccagcagcgccgagagccaggacagcaagaagaagaagaagaagaaggagaagaagaagcacaagaagcacaagaagcacaagaagcacaagaagcacgccggcaccgaggtggagctggagaagagccagaagcacaagcacaagaagaagaagagcaagaagaacaaggacaaggagaaggagaaggagaaggacgaccagaaggtgaagagcgtgaccgtgtag

SEQ ID NO: 96877 - DNA, 2859 bp, Artificial Sequence
  Description of Artificial Sequence: Synthetic coding sequence
atgagctgcgtgcactacaagttcagcagcaagctgaactacgacaccgtgaccttcgacggcctgcacatcagcctgtgcgacctgaagaagcagatcatgggcagagagaagctgaaggccgccgactgcgacctgcagatcaccaacgcccagaccaaggaggagtacaccgacgacaacgccctgatccccaagaacagcagcgtgatcgtgagaagaatccccatcggcggcgtgaagagcaccagcaagacctacgtgatcagcagaaccgagcccgccatggccaccaccaaggccatcgacgacagcagcgccagcatcagcctggcccagctgaccaagaccgccaacctggccgaggccaacgccagcgaggaggacaagatcaaggccatgatgagccagagcggccacgagtacgaccccatcaactacatgaagaagcccctgggcccccccccccccagctacacctgcttcagatgcggcaagcccggccactacatcaagaactgccccaccaacggcgacaagaacttcgagagcggccccagaatcaagaagagcaccggcatccccagaagcttcatgatggaggtgaaggaccccaacatgaagggcgccatgctgaccaacaccggcaagtacgccatccccaccatcgacgccgaggcctacgccatcggcaagaaggagaagccccccttcctgcccgaggagcccagcagcagcagcgaggaggacgaccccatccccgacgagctgctgtgcctgatctgcaaggacatcatgaccgacgccgtggtgatcccctgctgcggcaacagctactgcgacgagtgcatcagaaccgccctgctggagagcgacgagcacacctgccccacctgccaccagaacgacgtgagccccgacgccctgatcgccaacaagttcctgagacaggccgtgaacaacttcaagaacgagaccggctacaccaagagactgagaaagcagctgccccccccccccccccccatccccccccccagacccctgatccagagaaacctgcagcccctgatgagaagccccatcagcagacagcaggaccccctgatgatccccgtgaccagcagcagcacccaccccgcccccagcatcagcagcctgaccagcaaccagagcagcctggccccccccgtgagcggcaaccccagcagcgcccccgcccccgtgcccgacatcaccgccaccgtgagcatcagcgtgcacagcgagaagagcgacggccccttcagaaccagcagcaccggcggcagccccgtgagaaagagcgaggagaagaccgacaccaagagaaccgtgatcaagaccatggaggagtacaacaacgacaacaccgcccccgccgaggacgtgatcatcatgatccaggtgccccagagcaagtgggacaaggacgacttcgagagcgaggaggaggacgtgaagagcacccagcccatcagcagcgtgggcaagcccgccagcgtgatcaagaacgtgagcaccaagcccagcaacatcgtgaagtaccccgagaaggagagcgagcccagcgagaagatccagaagttcaccaaggacgtgagccacgagatcatccagcacgaggtgaagagcagcaagaacagcgccagcagcgagaagggcaagaccaaggacagagactacagcgtgctggagaaggagaaccccgagaagagaaagaacagcacccagcccgagaaggagagcaacctggacagactgaacgagcagggcaacttcaagagcctgagccagagcagcaaggaggccagaaccagcgacaagcacgacagcaccagagccagcagcaacaaggacttcacccccaacagagacaagaagaccgactacgacaccagagagtacagcagcagcaagagaagagacgagaagaacgagctgaccagaagaaaggacagccccagcagaaacaaggacagcgccagcggccagaagaacaagcccagagaggagagagacctgcccaagaagggcaccggcgacagcaagaagagcaacagcagccccagcagagacagaaagccccacgaccacaaggccacctacgacaccaagagacccaacgaggagaccaagagcgtggacaagaacccctgcaaggacagagagaagcacgtgctggaggccagaaacaacaaggagagcagcggcaacaagctgctgtacatcctgaacccccccgagacccaggtggagaaggagcagatcaccggccagatcgacaagagcaccgtgaagcccaagccccagctgagccacagcagcagactgagcagcgacctgaccagagagaccgacgaggccgccttcgagcccgactacaacgagagcgacagcgagagcaacgtgagcgtgaaggaggaggagagcagcggcaacatcagcaaggacctgaaggacaagatcgtggagaaggccaaggagagcctggacaccgccgccgtggtgcaggtgggcatcagcagaaaccagagccacagcagccccagcgtgagccccagcagaagccacagccccagcggcagccagaccagaagccacagcagcagcgccagcagcgccgagagccaggacagcaagaagaagaagaagaagaaggagaagaagaagcacaagaagcacaagaagcacaagaagcacaagaagcacgccggcaccgaggtggagctggagaagagccagaagcacaagcacaagaagaagaagagcaagaagaacaaggacaaggagaaggagaaggagaaggacgaccagaaggtgaagagcgtgaccgtgtag

SEQ ID NO: 96878 - DNA, 357 bp, Artificial Sequence
  Description of Artificial Sequence: Synthetic coding sequence
atgagctgcgtgcactacaagttcagcagcaagctgaactacgacaccgtgaccttcgacggcctgcacatcagcctgtgcgacctgaagaagcagatcatgggcagagagaagctgaaggccgccgactgcgacctgcagatcaccaacgcccagaccaaggaggagtacaccgacgacaacgccctgatccccaagaacagcagcgtgatcgtgagaagaatccccatcggcggcgtgaagagcaccagcaagacctacgtgatcagcagaaccgagcccgccatggccaccaccaaggccgtgtgcaagaacaccatcagccacttcttctacaccctgctgctgcccctgtag

SEQ ID NO: 96879 - DNA, 1410 bp, Artificial Sequence
  Description of Artificial Sequence: Synthetic coding sequence
atggccgccgaggccggcgtggtgggcgccggcgccagccccgacggcgactggagagaccaggcctgcggcctgctgctgcacgtgcacctgagcagcagactgggcagagccgcccccgtgagaaccggcagacacctgagaaccgtgttcgaggacaccgtggaggagagagtgatcaacgaggagtacaagatctggaagaagaacacccccttcctgtacgacctggtgatgacccacgccctgcagtggcccagcctgaccgtgcagtggctgcccgaggtgaccaagcccgagggcaaggactacgccctgcactggctggtgctgggcacccacaccagcgacgagcagaaccacctggtggtggccagagtgcacatccccaacgacgacgcccagttcgacgccagccactgcgacagcgacaagggcgagttcggcggcttcggcagcgtgaccggcaagatcgagtgcgagatcaagatcaaccacgagggcgaggtgaacagagccagatacatgccccagaacccccacatcatcgccaccaagacccccagcagcgacgtgctggtgttcgactacaccaagcaccccgccaagcccgaccccagcggcgagtgcaaccccgacctgagactgagaggccaccagaaggagggctacggcctgagctggaacagcaacctgagcggccacctgctgagcgccagcgacgaccacaccgtgtgcctgtgggacatcaacgccggccccaaggagggcaagatcgtggacgccaaggccatcttcaccggccacagcgccgtggtggaggacgtggcctggcacctgctgcacgagagcctgttcggcagcgtggccgacgaccagaagctgatgatctgggacaccagaagcaacaccaccagcaagcccagccacctggtggacgcccacaccgccgaggtgaactgcctgagcttcaacccctacagcgagttcatcctggccaccggcagcgccgacaagaccgtggccctgtgggacctgagaaacctgaagctgaagctgcacaccttcgagagccacaaggacgagatcttccaggtgcactggagcccccacaacgagaccatcctggccagcagcggcaccgacagaagactgaacgtgtgggacctgagcaagatcggcgaggagcagagcgccgaggacgccgaggacggcccccccgagctgctgttcatccacggcggccacaccgccaagatcagcgacttcagctggaaccccaacgagccctgggtgatctgcagcgtgagcgaggacaacatcatgcagatctggcagatggccgagaacatctacaacgacgaggagagcgacgtgaccaccagcgagctggagggccagggcagctag

SEQ ID NO: 96880 - DNA, 1278 bp, Artificial Sequence
  Description of Artificial Sequence: Synthetic coding sequence
atggccagcaaggagatgttcgaggacaccgtggaggagagagtgatcaacgaggagtacaagatctggaagaagaacacccccttcctgtacgacctggtgatgacccacgccctgcagtggcccagcctgaccgtgcagtggctgcccgaggtgaccaagcccgagggcaaggactacgccctgcactggctggtgctgggcacccacaccagcgacgagcagaaccacctggtggtggccagagtgcacatccccaacgacgacgcccagttcgacgccagccactgcgacagcgacaagggcgagttcggcggcttcggcagcgtgaccggcaagatcgagtgcgagatcaagatcaaccacgagggcgaggtgaacagagccagatacatgccccagaacccccacatcatcgccaccaagacccccagcagcgacgtgctggtgttcgactacaccaagcaccccgccaagcccgaccccagcggcgagtgcaaccccgacctgagactgagaggccaccagaaggagggctacggcctgagctggaacagcaacctgagcggccacctgctgagcgccagcgacgaccacaccgtgtgcctgtgggacatcaacgccggccccaaggagggcaagatcgtggacgccaaggccatcttcaccggccacagcgccgtggtggaggacgtggcctggcacctgctgcacgagagcctgttcggcagcgtggccgacgaccagaagctgatgatctgggacaccagaagcaacaccaccagcaagcccagccacctggtggacgcccacaccgccgaggtgaactgcctgagcttcaacccctacagcgagttcatcctggccaccggcagcgccgacaagaccgtggccctgtgggacctgagaaacctgaagctgaagctgcacaccttcgagagccacaaggacgagatcttccaggtgcactggagcccccacaacgagaccatcctggccagcagcggcaccgacagaagactgaacgtgtgggacctgagcaagatcggcgaggagcagagcgccgaggacgccgaggacggcccccccgagctgctgttcatccacggcggccacaccgccaagatcagcgacttcagctggaaccccaacgagccctgggtgatctgcagcgtgagcgaggacaacatcatgcagatctggcagatggccgagaacatctacaacgacgaggagagcgacgtgaccaccagcgagctggagggccagggcagctag

SEQ ID NO: 96881 - DNA, 1251 bp, Artificial Sequence
  Description of Artificial Sequence: Synthetic coding sequence
atggccagcaaggagatgttcgaggacaccgtggaggagagagtgatcaacgaggagtacaagatctggaagaagaacacccccttcctgtacgacctggtgatgacccacgccctgcagtggcccagcctgaccgtgcagtggctgcccgaggtgaccaagcccgagggcaaggactacgccctgcactggctggtgctgggcacccacaccagcgacgagcagaaccacctggtggtggccagagtgcacatccccaacgacgacgcccagttcgacgccagccactgcgacagcgacaagggcggcaagatcgagtgcgagatcaagatcaaccacgagggcgaggtgaacagagccagatacatgccccagaacccccacatcatcgccaccaagacccccagcagcgacgtgctggtgttcgactacaccaagcaccccgccaagcccgaccccagcggcgagtgcaaccccgacctgagactgagaggccaccagaaggagggctacggcctgagctggaacagcaacctgagcggccacctgctgagcgccagcgacgaccacaccgtgtgcctgtgggacatcaacgccggccccaaggagggcaagatcgtggacgccaaggccatcttcaccggccacagcgccgtggtggaggacgtggcctggcacctgctgcacgagagcctgttcggcagcgtggccgacgaccagaagctgatgatctgggacaccagaagcaacaccaccagcaagcccagccacctggtggacgcccacaccgccgaggtgaactgcctgagcttcaacccctacagcgagttcatcctggccaccggcagcgccgacaagaccgtggccctgtgggacctgagaaacctgaagctgaagctgcacaccttcgagagccacaaggacgagatcttccaggtgcactggagcccccacaacgagaccatcctggccagcagcggcaccgacagaagactgaacgtgtgggacctgagcaagatcggcgaggagcagagcgccgaggacgccgaggacggcccccccgagctgctgttcatccacggcggccacaccgccaagatcagcgacttcagctggaaccccaacgagccctgggtgatctgcagcgtgagcgaggacaacatcatgcagatctggcagatggccgagaacatctacaacgacgaggagagcgacgtgaccaccagcgagctggagggccagggcagctag

SEQ ID NO: 96882 - DNA, 561 bp, Artificial Sequence
  Description of Artificial Sequence: Synthetic coding sequence
atggccagccccagcaaggccgtgatcgtgcccggcaacggcggcggcgacgtgaccacccacggctggtacggctgggtgaagaaggagctggagaagatccccggcttccagtgcctggccaagaacatgcccgaccccatcaccgccagagagagcatctggctgcccttcatggagaccgagctgcactgcgacgagaagaccatcatcatcggccacagcagcggcgccatcgccgccatgagatacgccgagacccacagagtgtacgccatcgtgctggtgagcgcctacaccagcgacctgggcgacgagaacgagagagccagcggctacttcaccagaccctggcagtgggagaagatcaaggccaactgcccctacatcgtgcagttcggcagcaccgacgaccccttcctgccctggaaggagcagcaggaggtggccgacagactggagaccaagctgcacaagttcaccgactgcggccacttccagaacaccgagttccacgagctgatcaccgtggtgaagagcctgctgaaggtgcccgcctag

SEQ ID NO: 96883 - DNA, 519 bp, Artificial Sequence
  Description of Artificial Sequence: Synthetic coding sequence
atggccagccccagcaaggccgtgatcgtgcccggcaacggcggcggcgacgtgaccacccacggctggtacggctgggtgaagaaggagctggagaagatccccggcttccagtgcctggccaagaacatgcccgaccccatcaccgccagagagagcatctggctgcccttcatggagaccgagctgcactgcgacgagaagaccatcatcatcggccacagcagcggcgccatcgccgccatgagatacgccgagacccacagagtgtacgccatcgtgctggtgagcgcctacaccagcgacctgggcgacgagaacgagagagccagcggctacttcaccagaccctggcagtgggagaagatcaaggccaactgcccctacatcgtgcagttcggcagcaccgacgaccccttcctgccctggaaggagcagcaggaggtggccgactggaagcccaactgcaccaacagcctgaccgtggccaccttcagaacccagagcttcatgaactag

SEQ ID NO: 96884 - DNA, 741 bp, Artificial Sequence
  Description of Artificial Sequence: Synthetic coding sequence
atggccgccgccgccatccccgccctgctgctgtgcctgcccctgctgttcctgctgttcggctggagcagagccagaagagacgacccccacagcctgtgctacgacatcaccgtgatccccaagttcagacccggccccagatggtgcgccgtgcagggccaggtggacgagaagaccttcctgcactacgactgcggcaacaagaccgtgacccccgtgagccccctgggcaagaagctgaacgtgaccatggcctggaaggcccagaaccccgtgctgagagaggtggtggacatcctgaccgagcagctgctggacatccagctggagaactacacccccaaggagcccctgaccctgcaggccagaatgagctgcgagcagaaggccgagggccacagcagcggcagctggcagttcagcatcgacggccagaccttcctgctgttcgacagcgagaagagaatgtggaccaccgtgcaccccggcgccagaaagatgaaggagaagtgggagaacgacaaggacgtggccatgagcttccactacatcagcatgggcgactgcatcggctggctggaggacttcctgatgggcatggacagcaccctggagcccagcgccggcgcccccctggccatgagcagcggcaccacccagctgagagccaccgccaccaccctgatcctgtgctgcctgctgatcatcctgccctgcttcatcctgcccggcatctag

SEQ ID NO: 96885 - DNA, 741 bp, Artificial Sequence; identical to SEQ ID NO: 96884
  Description of Artificial Sequence: Synthetic coding sequence

SEQ ID NO: 96886 - DNA, 4923 bp, Artificial Sequence
  Description of Artificial Sequence: Synthetic coding sequence
atgcagagcttcagagagagatgcggcttccacggcaagcagcagaactaccagcagaccagccaggagaccagcagactggagaactacagacagcccagccaggccggcctgagctgcgacagacagagactgctggccaaggactactacaacccccagccctaccccagctacgagggcggcgccggcacccccagcggcaccgccgccgccgtggccgccgacaagtaccacagaggcagcaaggccctgcccacccagcagggcctgcagggcagacccgccttccccggctacggcgtgcaggacagcagcccctaccccggcagatacgccggcgaggagagcctgcaggcctggggcgccccccagcccccccccccccagccccagcccctgcccgccggcgtggccaagtacgacgagaacctgatgaagaagaccgccgtgccccccagcagacagtacgccgagcagggcgcccaggtgcccttcagaacccacagcctgcacgtgcagcagcccccccccccccagcagcccctggcctaccccaagctgcagagacagaagctgcagaacgacatcgccagccccctgcccttcccccagggcacccacttcccccagcacagccagagcttccccaccagcagcacctacagcagcagcgtgcagggcggcggccagggcgcccacagctacaagagctgcaccgcccccaccgcccagccccacgacagacccctgaccgccagcagcagcctggcccccggccagagagtgcagaacctgcacgcctaccagagcggcagactgagctacgaccagcagcagcagcagcagcagcagcagcagcagcagcagcaggccctgcagagcagacaccacgcccaggagaccctgcactaccagaacctggccaagtaccagcactacggccagcagggccagggctactgccagcccgacgccgccgtgagaacccccgagcagtactaccagaccttcagccccagcagcagccacagccccgccagaagcgtgggcagaagccccagctacagcagcacccccagccccctgatgcccaacctggagaacttcccctacagccagcagcccctgagcaccggcgccttccccgccggcatcaccgaccacagccacttcatgcccctgctgaaccccagccccaccgacgccaccagcagcgtggacacccaggccggcaactgcaagcccctgcagaaggacaagctgcccgagaacctgctgagcgacctgagcctgcagagcctgaccgccctgaccagccaggtggagaacatcagcaacaccgtgcagcagctgctgctgagcaaggccgccgtgccccagaagaagggcgtgaagaacctggtgagcagaacccccgagcagcacaagagccagcactgcagccccgagggcagcggctacagcgccgagcccgccggcacccccctgagcgagccccccagcagcaccccccagagcacccacgccgagccccaggaggccgactacctgagcggcagcgaggaccccctggagagaagcttcctgtactgcaaccaggccagaggcagccccgccagagtgaacagcaacagcaaggccaagcccgagagcgtgagcacctgcagcgtgaccagccccgacgacatgagcaccaagagcgacgacagcttccagagcctgcacggcagcctgcccctggacagcttcagcaagttcgtggccggcgagagagactgccccagactgctgctgagcgccctggcccaggaggacctggccagcgagatcctgggcctgcaggaggccatcggcgagaaggccgacaaggcctgggccgaggcccccagcctggtgaaggacagcagcaagccccccttcagcctggagaaccacagcgcctgcctggacagcgtggccaagagcgcctggcccagacccggcgagcccgaggccctgcccgacagcctgcagctggacaagggcggcaacgccaaggacttcagccccggcctgttcgaggaccccagcgtggccttcgccacccccgaccccaagaagaccaccggccccctgagcttcggcaccaagcccaccctgggcgtgcccgcccccgaccccaccaccgccgccttcgactgcttccccgacaccaccgccgccagcagcgccgacagcgccaaccccttcgcctggcccgaggagaacctgggcgacgcctgccccagatggggcctgcaccccggcgagctgaccaagggcctggagcagggcggcaaggccagcgacggcatcagcaagggcgacacccacgaggccagcgcctgcctgggcttccaggaggaggacccccccggcgagaaggtggccagcctgcccggcgacttcaagcaggaggaggtgggcggcgtgaaggaggaggccggcggcctgctgcagtgccccgaggtggccaaggccgacagatggctggaggacagcagacactgctgcagcaccgccgacttcggcgacctgcccctgctgccccccaccagcagaaaggaggacctggaggccgaggaggagtacagcagcctgtgcgagctgctgggcagccccgagcagagacccggcatgcaggaccccctgagccccaaggcccccctgatctgcaccaaggaggaggtggaggaggtgctggacagcaaggccggctggggcagcccctgccacctgagcggcgagagcgtgatcctgctgggccccaccgtgggcaccgagagcaaggtgcagagctggttcgagagcagcctgagccacatgaagcccggcgaggagggccccgacggcgagagagcccccggcgacagcaccaccagcgacgccagcctggcccagaagcccaacaagcccgccgtgcccgaggcccccatcgccaagaaggagcccgtgcccagaggcaagagcctgagaagcagaagagtgcacagaggcctgcccgaggccgaggacagcccctgcagagcccccgtgctgcccaaggacctgctgctgcccgagagctgcaccggccccccccagggccagatggagggcgccggcgcccccggcagaggcgccagcgagggcctgcccagaatgtgcaccagaagcctgaccgccctgagcgagcccagaacccccggcccccccggcctgaccaccacccccgccccccccgacaagctgggcggcaagcagagagccgccttcaagagcggcaagagagtgggcaagcccagccccaaggccgccagcagccccagcaaccccgccgccctgcccgtggccagcgacagcagccccatgggcagcaagaccaaggagaccgacagccccagcacccccggcaaggaccagagaagcatgatcctgagaagcagaaccaagacccaggagatcttccacagcaagagaagaagacccagcgagggcagactgcccaactgcagagccaccaagaagctgctggacaacagccacctgcccgccaccttcaaggtgagcagcagcccccagaaggagggcagagtgagccagagagccagagtgcccaagcccggcgccggcagcaagctgagcgacagacccctgcacgccctgaagagaaagagcgccttcatggcccccgtgcccaccaagaagagaaacctggtgctgagaagcagaagcagcagcagcagcaacgccagcggcaacggcggcgacggcaaggaggagagacccgagggcagccccaccctgttcaagagaatgagcagccccaagaaggccaagcccaccaagggcaacggcgagcccgccaccaagctgcccccccccgagacccccgacgcctgcctgaagctggccagcagagccgccttccagggcgccatgaagaccaaggtgctgccccccagaaagggcagaggcctgaagctggaggccatcgtgcagaagatcaccagccccagcctgaagaagttcgcctgcaaggcccccggcgccagccccggcaaccccctgagccccagcctgagcgacaaggacagaggcctgaagggcgccggcggcagccccgtgggcgtggaggagggcctggtgaacgtgggcaccggccagaagctgcccaccagcggcgccgaccccctgtgcagaaaccccaccaacagaagcctgaagggcaagctgatgaacagcaagaagctgagcagcaccgactgcttcaagaccgaggccttcaccagccccgaggccctgcagcccggcggcaccgccctggcccccaagaagagaagcagaaagggcagagccggcgcccacggcctgagcaagggccccctggagaagagaccctacctgggccccgccctgctgctgacccccagagacagagccagcggcacccagggcgccagcgaggacaacagcggcggcggcggcaagaagcccaagatggaggagctgggcctggccagccagccccccgagggcagaccctgccagccccagaccagagcccagaagcagcccggccacaccaactacagcagctacagcaagagaaagagactgaccagaggcagagccaagaacaccaccagcagcccctgcaagggcagagccaagagaagaagacagcagcaggtgctgcccctggaccccgccgagcccgagatcagactgaagtacatcagcagctgcaagagactgagaagcgacagcagaacccccgccttcagccccttcgagcccagcctgggcgcccagaaccccagaagcggccagaacgccccccccgcccccgccgacgccagacccctgtgcaccaccagagacagaagagcctacagcgccagagagcagggccagagatag

SEQ ID NO: 96887 - DNA, 5589 bp, Artificial Sequence
  Description of Artificial Sequence: Synthetic coding sequence
atgcagagcttcagagagagatgcggcttccacggcaagcagcagaactaccagcagaccagccaggagaccagcagactggagaactacagacagcccagccaggccggcctgagctgcgacagacagagactgctggccaaggactactacaacccccagccctaccccagctacgagggcggcgccggcacccccagcggcaccgccgccgccgtggccgccgacaagtaccacagaggcagcaaggccctgcccacccagcagggcctgcagggcagacccgccttccccggctacggcgtgcaggacagcagcccctaccccggcagatacgccggcgaggagagcctgcaggcctggggcgccccccagcccccccccccccagccccagcccctgcccgccggcgtggccaagtacgacgagaacctgatgaagaagaccgccgtgccccccagcagacagtacgccgagcagggcgcccaggtgcccttcagaacccacagcctgcacgtgcagcagcccccccccccccagcagcccctggcctaccccaagctgcagagacagaagctgcagaacgacatcgccagccccctgcccttcccccagggctggtgggccggccacagctacaagagctgcaccgcccccaccgcccagccccacgacagacccctgaccgccagcagcagcctggcccccggccagagagtgcagaacctgcacgcctaccagagcggcagactgagctacgaccagcagcagcagcagcagcagcagcagcagcagcagcagcaggccctgcagagcagacaccacgcccaggagaccctgcactaccagaacctggccaagtaccagcactacggccagcagggccagggctactgccagcccgacgccgccgtgagaacccccgagcagtactaccagaccttcagccccagcagcagccacagccccgccagaagcgtgggcagaagccccagctacagcagcacccccagccccctgatgcccaacctggagaacttcccctacagccagcagcccctgagcaccggcgccttccccgccggcatcaccgaccacagccacttcatgcccctgctgaaccccagccccaccgacgccaccagcagcgtggacagcctgaccgccctgaccagccaggtggagaacatcagcaacaccgtgcagcagctgctgctgagcaaggccgccgtgccccagaagaagggcgtgaagaacctggtgagcagaacccccgagcagcacaagagccagcactgcagccccgagggcagcggctacagcgccgagcccgccggcacccccctgagcgagccccccagcagcaccccccagagcacccacgccgagccccaggaggccgactacctgagcggcagcgaggaccccctggagagaagcttcctgtactgcaaccaggccagaggcagccccgccagagtgaacagcaacagcaaggccaagcccgagagcgtgagcacctgcagcgtgaccagccccgacgacatgagcaccaagagcgacgacagcttccagagcctgcacggcagcctgcccctggacagcttcagcaagttcgtggccggcgagagagactgccccagactgctgctgagcgccctggcccaggaggacctggccagcgagatcctgggcctgcaggaggccatcggcgagaaggccgacaaggcctgggccgaggcccccagcctggtgaaggacagcagcaagccccccttcagcctggagaaccacagcgcctgcctggacagcgtggccaagagcgcctggcccagacccggcgagcccgaggccctgcccgacagcctgcagctggacaagggcggcaacgccaaggacttcagccccggcctgttcgaggaccccagcgtggccttcgccacccccgaccccaagaagaccaccggccccctgagcttcggcaccaagcccaccctgggcgtgcccgcccccgaccccaccaccgccgccttcgactgcttccccgacaccaccgccgccagcagcgccgacagcgccaaccccttcgcctggcccgaggagaacctgggcgacgcctgccccagatggggcctgcaccccggcgagctgaccaagggcctggagcagggcggcaaggccagcgacggcatcagcaagggcgacacccacgaggccagcgcctgcctgggcttccaggaggaggacccccccggcgagaaggtggccagcctgcccggcgacttcaagcaggaggaggtgggcggcgtgaaggaggaggccggcggcctgctgcagtgccccgaggtggccaaggccgacagatggctggaggacagcagacactgctgcagcaccgccgacttcggcgacctgcccctgctgccccccaccagcagaaaggaggacctggaggccgaggaggagtacagcagcctgtgcgagctgctgggcagccccgagcagagacccggcatgcaggaccccctgagccccaaggcccccctgatctgcaccaaggaggaggtggaggaggtgctggacagcaaggccggctggggcagcccctgccacctgagcggcgagagcgtgatcctgctgggccccaccgtgggcaccgagagcaaggtgcagagctggttcgagagcagcctgagccacatgaagcccggcgaggagggccccgacggcgagagagcccccggcgacagcaccaccagcgacgccagcctggcccagaagcccaacaagcccgccgtgcccgaggcccccatcgccaagaaggagcccgtgcccagaggcaagagcctgagaagcagaagagtgcacagaggcctgcccgaggccgaggacagcccctgcagagcccccgtgctgcccaaggacctgctgctgcccgagagctgcaccggccccccccagggccagatggagggcgccggcgcccccggcagaggcgccagcgagggcctgcccagaatgtgcaccagaagcctgaccgccctgagcgagcccagaacccccggcccccccggcctgaccaccacccccgccccccccgacaagctgggcggcaagcagagagccgccttcaagagcggcaagagagtgggcaagcccagccccaaggccgccagcagccccagcaaccccgccgccctgcccgtggccagcgacagcagccccatgggcagcaagaccaaggagaccgacagccccagcacccccggcaaggaccagagaagcatgatcctgagaagcagaaccaagacccaggagatcttccacagcaagagaagaagacccagcgagggcagactgcccaactgcagagccaccaagaagctgctggacaacagccacctgcccgccaccttcaaggtgagcagcagcccccagaaggagggcagagtgagccagagagccagagtgcccaagcccggcgccggcagcaagctgagcgacagacccctgcacgccctgaagagaaagagcgccttcatggcccccgtgcccaccaagaagagaaacctggtgctgagaagcagaagcagcagcagcagcaacgccagcggcaacggcggcgacggcaaggaggagagacccgagggcagccccaccctgttcaagagaatgagcagccccaagaaggccaagcccaccaagggcaacggcgagcccgccaccaagctgcccccccccgagacccccgacgcctgcctgaagctggccagcagagccgccttccagggcgccatgaagaccaaggtgctgccccccagaaagggcagaggcctgaagctggaggccatcgtgcagaagatcaccagccccagcctgaagaagttcgcctgcaaggcccccggcgccagccccggcaaccccctgagccccagcctgagcgacaaggacagaggcctgaagggcgccggcggcagccccgtgggcgtggaggagggcctggtgaacgtgggcaccggccagaagctgcccaccagcggcgccgaccccctgtgcagaaaccccaccaacagaagcctgaagggcaagctgatgaacaacagagccagcggcacccagggcgccagcgaggacaacagcggcggcggcggcaagaagcccaagatggaggagctgggcctggccagccagccccccgagggcagaccctgccagccccagaccagagcccagaagcagcccggccacaccaactacagcagctacagcaagagaaagagactgaccagaggcagagccaagaacaccaccagcagcccctgcaagggcagagccaagagaagaagacagcagcaggtgctgcccctggaccccgccgagcccgagatcagactgaagtacatcagcagctgcaagagactgagaagcgacagcagaacccccgccttcagccccttcgtgagagtggagaagagagacgccttcaccaccatctgcaccgtggtgaacagccccggcgacgcccccaagccccacagaaagcccagcagcagcgccagcagcagcagcagcagcagcagcttcagcctggacgccgccggcgccagcctggccaccctgcccggcggcagcatcctgcagcccagacccagcctgcccctgagcagcaccatgcacctgggccccgtggtgagcaaggccctgagcaccagctgcctggtgtgctgcctgtgccagaaccccgccaacttcaaggacctgggcgacctgtgcggcccctactaccccgagcactgcctgcccaagaagaagcccaagctgaaggagaaggtgagacccgagggcacctgcgaggaggccagcctgcccctggagagaaccctgaagggccccgagtgcgccgccgccgccaccgccggcaagccccccagacccgacggccccgccgaccccgccaagcagggccccctgagaaccagcgccagaggcctgagcagaagactgcagagctgctactgctgcgacggcagagaggacggcggcgaggaggccgcccccgccgacaagggccactgggtgcacgaggcctgcgccgtgtggaccggcggcgtgtacctggtggccggcaagctgttcggcctgcaggaggccatgaaggtggccgtggacatgcacggcggcaccgtggccctggcccccggcgacttcagcctgcccggcctgagattcgccagcctgttccagggccccagctggtgcgactgccccgtgctggccaccagcacccccagcagctggagcagatgcgtgcccgccgccaagaagcccggcccccccctgggcgccgccaccaaggacgccagcacccccaccaccaccagagtgcccgccatgcaggtgagagccagacccggcaccggcggccactggagccccagcaagcagagcagaggcaccctgcccggccacagcagccccaaccccggccccatcagcctgttcagcttcccccccctgctgccccagcagttcttctaccccagcgtgtgcctggacctgtgctgggccatgcccggcacctggaagtag

SEQ ID NO: 96888 - DNA, 5721 bp, Artificial Sequence
  Description of Artificial Sequence: Synthetic coding sequence
atgcagagcttcagagagagatgcggcttccacggcaagcagcagaactaccagcagaccagccaggagaccagcagactggagaactacagacagcccagccaggccggcctgagctgcgacagacagagactgctggccaaggactactacaacccccagccctaccccagctacgagggcggcgccggcacccccagcggcaccgccgccgccgtggccgccgacaagtaccacagaggcagcaaggccctgcccacccagcagggcctgcagggcagacccgccttccccggctacggcgtgcaggacagcagcccctaccccggcagatacgccggcgaggagagcctgcaggcctggggcgccccccagcccccccccccccagccccagcccctgcccgccggcgtggccaagtacgacgagaacctgatgaagaagaccgccgtgccccccagcagacagtacgccgagcagggcgcccaggtgcccttcagaacccacagcctgcacgtgcagcagcccccccccccccagcagcccctggcctaccccaagctgcagagacagaagctgcagaacgacatcgccagccccctgcccttcccccagggcacccacttcccccagcacagccagagcttccccaccagcagcacctacagcagcagcgtgcagggcggcggccagggcgcccacagctacaagagctgcaccgcccccaccgcccagccccacgacagacccctgaccgccagcagcagcctggcccccggccagagagtgcagaacctgcacgcctaccagagcggcagactgagctacgaccagcagcagcagcagcagcagcagcagcagcagcagcagcaggccctgcagagcagacaccacgcccaggagaccctgcactaccagaacctggccaagtaccagcactacggccagcagggccagggctactgccagcccgacgccgccgtgagaacccccgagcagtactaccagaccttcagccccagcagcagccacagccccgccagaagcgtgggcagaagccccagctacagcagcacccccagccccctgatgcccaacctggagaacttcccctacagccagcagcccctgagcaccggcgccttccccgccggcatcaccgaccacagccacttcatgcccctgctgaaccccagccccaccgacgccaccagcagcgtggacacccaggccggcaactgcaagcccctgcagaaggacaagctgcccgagaacctgctgagcgacctgagcctgcagagcctgaccgccctgaccagccaggtggagaacatcagcaacaccgtgcagcagctgctgctgagcaaggccgccgtgccccagaagaagggcgtgaagaacctggtgagcagaacccccgagcagcacaagagccagcactgcagccccgagggcagcggctacagcgccgagcccgccggcacccccctgagcgagccccccagcagcaccccccagagcacccacgccgagccccaggaggccgactacctgagcggcagcgaggaccccctggagagaagcttcctgtactgcaaccaggccagaggcagccccgccagagtgaacagcaacagcaaggccaagcccgagagcgtgagcacctgcagcgtgaccagccccgacgacatgagcaccaagagcgacgacagcttccagagcctgcacggcagcctgcccctggacagcttcagcaagttcgtggccggcgagagagactgccccagactgctgctgagcgccctggcccaggaggacctggccagcgagatcctgggcctgcaggaggccatcggcgagaaggccgacaaggcctgggccgaggcccccagcctggtgaaggacagcagcaagccccccttcagcctggagaaccacagcgcctgcctggacagcgtggccaagagcgcctggcccagacccggcgagcccgaggccctgcccgacagcctgcagctggacaagggcggcaacgccaaggacttcagccccggcctgttcgaggaccccagcgtggccttcgccacccccgaccccaagaagaccaccggccccctgagcttcggcaccaagcccaccctgggcgtgcccgcccccgaccccaccaccgccgccttcgactgcttccccgacaccaccgccgccagcagcgccgacagcgccaaccccttcgcctggcccgaggagaacctgggcgacgcctgccccagatggggcctgcaccccggcgagctgaccaagggcctggagcagggcggcaaggccagcgacggcatcagcaagggcgacacccacgaggccagcgcctgcctgggcttccaggaggaggacccccccggcgagaaggtggccagcctgcccggcgacttcaagcaggaggaggtgggcggcgtgaaggaggaggccggcggcctgctgcagtgccccgaggtggccaaggccgacagatggctggaggacagcagacactgctgcagcaccgccgacttcggcgacctgcccctgctgccccccaccagcagaaaggaggacctggaggccgaggaggagtacagcagcctgtgcgagctgctgggcagccccgagcagagacccggcatgcaggaccccctgagccccaaggcccccctgatctgcaccaaggaggaggtggaggaggtgctggacagcaaggccggctggggcagcccctgccacctgagcggcgagagcgtgatcctgctgggccccaccgtgggcaccgagagcaaggtgcagagctggttcgagagcagcctgagccacatgaagcccggcgaggagggccccgacggcgagagagcccccggcgacagcaccaccagcgacgccagcctggcccagaagcccaacaagcccgccgtgcccgaggcccccatcgccaagaaggagcccgtgcccagaggcaagagcctgagaagcagaagagtgcacagaggcctgcccgaggccgaggacagcccctgcagagcccccgtgctgcccaaggacctgctgctgcccgagagctgcaccggccccccccagggccagatggagggcgccggcgcccccggcagaggcgccagcgagggcctgcccagaatgtgcaccagaagcctgaccgccctgagcgagcccagaacccccggcccccccggcctgaccaccacccccgccccccccgacaagctgggcggcaagcagagagccgccttcaagagcggcaagagagtgggcaagcccagccccaaggccgccagcagccccagcaaccccgccgccctgcccgtggccagcgacagcagccccatgggcagcaagaccaaggagaccgacagccccagcacccccggcaaggaccagagaagcatgatcctgagaagcagaaccaagacccaggagatcttccacagcaagagaagaagacccagcgagggcagactgcccaactgcagagccaccaagaagctgctggacaacagccacctgcccgccaccttcaaggtgagcagcagcccccagaaggagggcagagtgagccagagagccagagtgcccaagcccggcgccggcagcaagctgagcgacagacccctgcacgccctgaagagaaagagcgccttcatggcccccgtgcccaccaagaagagaaacctggtgctgagaagcagaagcagcagcagcagcaacgccagcggcaacggcggcgacggcaaggaggagagacccgagggcagccccaccctgttcaagagaatgagcagccccaagaaggccaagcccaccaagggcaacggcgagcccgccaccaagctgcccccccccgagacccccgacgcctgcctgaagctggccagcagagccgccttccagggcgccatgaagaccaaggtgctgccccccagaaagggcagaggcctgaagctggaggccatcgtgcagaagatcaccagccccagcctgaagaagttcgcctgcaaggcccccggcgccagccccggcaaccccctgagccccagcctgagcgacaaggacagaggcctgaagggcgccggcggcagccccgtgggcgtggaggagggcctggtgaacgtgggcaccggccagaagctgcccaccagcggcgccgaccccctgtgcagaaaccccaccaacagaagcctgaagggcaagctgatgaacagcaagaagctgagcagcaccgactgcttcaagaccgaggccttcaccagccccgaggccctgcagcccggcggcaccgccctggcccccaagaagagaagcagaaagggcagagccggcgcccacggcctgagcaagggccccctggagaagagaccctacctgggccccgccctgctgctgacccccagagacagagccagcggcacccagggcgccagcgaggacaacagcggcggcggcggcaagaagcccaagatggaggagctgggcctggccagccagccccccgagggcagaccctgccagccccagaccagagcccagaagcagcccggccacaccaactacagcagctacagcaagagaaagagactgaccagaggcagagccaagaacaccaccagcagcccctgcaagggcagagccaagagaagaagacagcagcaggtgctgcccctggaccccgccgagcccgagatcagactgaagtacatcagcagctgcaagagactgagaagcgacagcagaacccccgccttcagccccttcgtgagagtggagaagagagacgccttcaccaccatctgcaccgtggtgaacagccccggcgacgcccccaagccccacagaaagcccagcagcagcgccagcagcagcagcagcagcagcagcttcagcctggacgccgccggcgccagcctggccaccctgcccggcggcagcatcctgcagcccagacccagcctgcccctgagcagcaccatgcacctgggccccgtggtgagcaaggccctgagcaccagctgcctggtgtgctgcctgtgccagaaccccgccaacttcaaggacctgggcgacctgtgcggcccctactaccccgagcactgcctgcccaagaagaagcccaagctgaaggagaaggtgagacccgagggcacctgcgaggaggccagcctgcccctggagagaaccctgaagggccccgagtgcgccgccgccgccaccgccggcaagccccccagacccgacggccccgccgaccccgccaagcagggccccctgagaaccagcgccagaggcctgagcagaagactgcagagctgctactgctgcgacggcagagaggacggcggcgaggaggccgcccccgccgacaagggcagaaagcacgagtgcagcaaggaggcccccgccgagcccggcggcgaggcccaggagcactgggtgcacgaggcctgcgccgtgtggaccggcggcgtgtacctggtggccggcaagctgttcggcctgcaggaggccatgaaggtggccgtggacatgatgtgcagcagctgccaggaggccggcgccaccatcggctgctgccacaagggctgcctgcacacctaccactacccctgcgccagcgacgccggctgcatcttcatcgaggagaacttcagcctgaagtgccccaagcacaagagactgccctag

SEQ ID NO: 96889 - DNA, 2901 bp, Artificial Sequence
  Description of Artificial Sequence: Synthetic coding sequence
atgcagagcttcagagagagatgcggcttccacggcaagcagcagaactaccagcagaccagccaggagaccagcagactggagaactacagacagcccagccaggccggcctgagctgcgacagacagagactgctggccaaggactactacaacccccagccctaccccagctacgagggcggcgccggcacccccagcggcaccgccgccgccgtggccgccgacaagtaccacagaggcagcaaggccctgcccacccagcagggcctgcagggcagacccgccttccccggctacggcgtgcaggacagcagcccctaccccggcagatacgccggcgaggagagcctgcaggcctggggcgccccccagcccccccccccccagccccagcccctgcccgccggcgtggccaagtacgacgagaacctgatgaagaagaccgccgtgccccccagcagacagtacgccgagcagggcgcccaggtgcccttcagaacccacagcctgcacgtgcagcagcccccccccccccagcagcccctggcctaccccaagctgcagagacagaagctgcagaacgacatcgccagccccctgcccttcccccagggcacccacttcccccagcacagccagagcttccccaccagcagcacctacagcagcagcgtgcagggcggcggccagggcgcccacagctacaagagctgcaccgcccccaccgcccagccccacgacagacccctgaccgccagcagcagcctggcccccggccagagagtgcagaacctgcacgcctaccagagcggcagactgagctacgaccagcagcagcagcagcagcagcagcagcagcagcagcagcaggccctgcagagcagacaccacgcccaggagaccctgcactaccagaacctggccaagtaccagcactacggccagcagggccagggctactgccagcccgacgccgccgtgagaacccccgagcagtactaccagaccttcagccccagcagcagccacagccccgccagaagcgtgggcagaagccccagctacagcagcacccccagccccctgatgcccaacctggagaacttcccctacagccagcagcccctgagcaccggcgccttccccgccggcatcaccgaccacagccacttcatgcccctgctgaaccccagccccaccgacgccaccagcagcgtggacacccaggccggcaactgcaagcccctgcagaaggacaagctgcccgagaacctgctgagcgacctgagcctgcagagcctgaccgccctgaccagccaggtggagaacatcagcaacaccgtgcagcagctgctgctgagcaaggccgccgtgccccagaagaagggcgtgaagaacctggtgagcagaacccccgagcagcacaagagccagcactgcagccccgagggcagcggctacagcgccgagcccgccggcacccccctgagcgagccccccagcagcaccccccagagcacccacgccgagccccaggaggccgactacctgagcggcagcgaggaccccctggagagaagcttcctgtactgcaaccaggccagaggcagccccgccagagtgaacagcaacagcaaggccaagcccgagagcgtgagcacctgcagcgtgaccagccccgacgacatgagcaccaagagcgacgacagcttccagagcctgcacggcagcctgcccctggacagcttcagcaagttcgtggccggcgagagagactgccccagactgctgctgagcgccctggcccaggaggacctggccagcgagatcctgggcctgcaggaggccatcggcgagaaggccgacaaggcctgggccgaggcccccagcctggtgaaggacagcagcaagccccccttcagcctggagaaccacagcgcctgcctggacagcgtggccaagagcgcctggcccagacccggcgagcccgaggccctgcccgacagcctgcagctggacaagggcggcaacgccaaggacttcagccccggcctgttcgaggaccccagcgtggccttcgccacccccgaccccaagaagaccaccggccccctgagcttcggcaccaagcccaccctgggcgtgcccgcccccgaccccaccaccgccgccttcgactgcttccccgacaccaccgccgccagcagcgccgacagcgccaaccccttcgcctggcccgaggagaacctgggcgacgcctgccccagatggggcctgcaccccggcgagctgaccaagggcctggagcagggcggcaaggccagcgacggcatcagcaagggcgacacccacgaggccagcgcctgcctgggcttccaggaggaggacccccccggcgagaaggtggccagcctgcccggcgacttcaagcaggaggaggtgggcggcgtgaaggaggaggccggcggcctgctgcagtgccccgaggtggccaaggccgacagatggctggaggacagcagacactgctgcagcaccgccgacttcggcgacctgcccctgctgccccccaccagcagaaaggaggacctggaggccgaggaggagtacagcagcctgtgcgagctgctgggcagccccgagcagagacccggcatgcaggaccccctgagccccaaggcccccctgatctgcaccaaggaggaggtggaggaggtgctggacagcaaggccggctggggcagcccctgccacctgagcggcgagagcgtgatcctgctgggccccaccgtgggcaccgagagcaaggtgcagagctggttcgaggccagcctgtacagcgtgtacatctgcatccacatccacatctacaacatctacgaggactgcaagtgctag

SEQ ID NO: 96890 - DNA, 2829 bp, Artificial Sequence
  Description of Artificial Sequence: Synthetic coding sequence
atgcagagcttcagagagagatgcggcttccacggcaagcagcagaactaccagcagaccagccaggagaccagcagactggagaactacagacagcccagccaggccggcctgagctgcgacagacagagactgctggccaaggactactacaacccccagccctaccccagctacgagggcggcgccggcacccccagcggcaccgccgccgccgtggccgccgacaagtaccacagaggcagcaaggccctgcccacccagcagggcctgcagggcagacccgccttccccggctacggcgtgcaggacagcagcccctaccccggcagatacgccggcgaggagagcctgcaggcctggggcgccccccagcccccccccccccagccccagcccctgcccgccggcgtggccaagtacgacgagaacctgatgaagaagaccgccgtgccccccagcagacagtacgccgagcagggcgcccaggtgcccttcagaacccacagcctgcacgtgcagcagcccccccccccccagcagcccctggcctaccccaagctgcagagacagaagctgcagaacgacatcgccagccccctgcccttcccccagggcacccacttcccccagcacagccagagcttccccaccagcagcacctacagcagcagcgtgcagggcggcggccagggcgcccacagctacaagagctgcaccgcccccaccgcccagccccacgacagacccctgaccgccagcagcagcctggcccccggccagagagtgcagaacctgcacgcctaccagagcggcagactgagctacgaccagcagcagcagcagcagcagcagcagcagcagcagcagcaggccctgcagagcagacaccacgcccaggagaccctgcactaccagaacctggccaagtaccagcactacggccagcagggccagggctactgccagcccgacgccgccgtgagaacccccgagcagtactaccagaccttcagccccagcagcagccacagccccgccagaagcgtgggcagaagccccagctacagcagcacccccagccccctgatgcccaacctggagaacttcccctacagccagcagcccctgagcaccggcgccttccccgccggcatcaccgaccacagccacttcatgcccctgctgaaccccagccccaccgacgccaccagcagcgtggacacccaggccggcaactgcaagcccctgcagaaggacaagctgcccgagaacctgctgagcgacctgagcctgcagagcctgaccgccctgaccagccaggtggagaacatcagcaacaccgtgcagcagctgctgctgagcaaggccgccgtgccccagaagaagggcgtgaagaacctggtgagcagaacccccgagcagcacaagagccagcactgcagccccgagggcagcggctacagcgccgagcccgccggcacccccctgagcgagccccccagcagcaccccccagagcacccacgccgagccccaggaggccgactacctgagcggcagcgaggaccccctggagagaagcttcctgtactgcaaccaggccagaggcagccccgccagagtgaacagcaacagcaaggccaagcccgagagcgtgagcacctgcagcgtgaccagccccgacgacatgagcaccaagagcgacgacagcttccagagcctgcacggcagcctgcccctggacagcttcagcaagttcgtggccggcgagagagactgccccagactgctgctgagcgccctggcccaggaggacctggccagcgagatcctgggcctgcaggaggccatcggcgagaaggccgacaaggcctgggccgaggcccccagcctggtgaaggacagcagcaagccccccttcagcctggagaaccacagcgcctgcctggacagcgtggccaagagcgcctggcccagacccggcgagcccgaggccctgcccgacagcctgcagctggacaagggcggcaacgccaaggacttcagccccggcctgttcgaggaccccagcgtggccttcgccacccccgaccccaagaagaccaccggccccctgagcttcggcaccaagcccaccctgggcgtgcccgcccccgaccccaccaccgccgccttcgactgcttccccgacaccaccgccgccagcagcgccgacagcgccaaccccttcgcctggcccgaggagaacctgggcgacgcctgccccagatggggcctgcaccccggcgagctgaccaagggcctggagcagggcggcaaggccagcgacggcatcagcaagggcgacacccacgaggccagcgcctgcctgggcttccaggaggaggacccccccggcgagaaggtggccagcctgcccggcgacttcaagcaggaggaggtgggcggcgtgaaggaggaggccggcggcctgctgcagtgccccgaggtggccaaggccgacagatggctggaggacagcagacactgctgcagcaccgccgacttcggcgacctgcccctgctgccccccaccagcagaaaggaggacctggaggccgaggaggagtacagcagcctgtgcgagctgctgggcagccccgagcagagacccggcatgcaggaccccctgagccccaaggcccccctgatctgcaccaaggaggaggtggaggaggtgctggacagcaaggccggctggggcagcccctgccacctgagcggcgagagcgtgatcctgctgggccccaccgtgggcaccgagagcaaggtgcagagctggttctag

SEQ ID NO: 96891 - DNA, 5982 bp, Artificial Sequence
  Description of Artificial Sequence: Synthetic coding sequence
atgcagagcttcagagagagatgcggcttccacggcaagcagcagaactaccagcagaccagccaggagaccagcagactggagaactacagacagcccagccaggccggcctgagctgcgacagacagagactgctggccaaggactactacaacccccagccctaccccagctacgagggcggcgccggcacccccagcggcaccgccgccgccgtggccgccgacaagtaccacagaggcagcaaggccctgcccacccagcagggcctgcagggcagacccgccttccccggctacggcgtgcaggacagcagcccctaccccggcagatacgccggcgaggagagcctgcaggcctggggcgccccccagcccccccccccccagccccagcccctgcccgccggcgtggccaagtacgacgagaacctgatgaagaagaccgccgtgccccccagcagacagtacgccgagcagggcgcccaggtgcccttcagaacccacagcctgcacgtgcagcagcccccccccccccagcagcccctggcctaccccaagctgcagagacagaagctgcagaacgacatcgccagccccctgcccttcccccagggcacccacttcccccagcacagccagagcttccccaccagcagcacctacagcagcagcgtgcagggcggcggccagggcgcccacagctacaagagctgcaccgcccccaccgcccagccccacgacagacccctgaccgccagcagcagcctggcccccggccagagagtgcagaacctgcacgcctaccagagcggcagactgagctacgaccagcagcagcagcagcagcagcagcagcagcagcagcagcaggccctgcagagcagacaccacgcccaggagaccctgcactaccagaacctggccaagtaccagcactacggccagcagggccagggctactgccagcccgacgccgccgtgagaacccccgagcagtactaccagaccttcagccccagcagcagccacagccccgccagaagcgtgggcagaagccccagctacagcagcacccccagccccctgatgcccaacctggagaacttcccctacagccagcagcccctgagcaccggcgccttccccgccggcatcaccgaccacagccacttcatgcccctgctgaaccccagccccaccgacgccaccagcagcgtggacacccaggccggcaactgcaagcccctgcagaaggacaagctgcccgagaacctgctgagcgacctgagcctgcagagcctgaccgccctgaccagccaggtggagaacatcagcaacaccgtgcagcagctgctgctgagcaaggccgccgtgccccagaagaagggcgtgaagaacctggtgagcagaacccccgagcagcacaagagccagcactgcagccccgagggcagcggctacagcgccgagcccgccggcacccccctgagcgagccccccagcagcaccccccagagcacccacgccgagccccaggaggccgactacctgagcggcagcgaggaccccctggagagaagcttcctgtactgcaaccaggccagaggcagccccgccagagtgaacagcaacagcaaggccaagcccgagagcgtgagcacctgcagcgtgaccagccccgacgacatgagcaccaagagcgacgacagcttccagagcctgcacggcagcctgcccctggacagcttcagcaagttcgtggccggcgagagagactgccccagactgctgctgagcgccctggcccaggaggacctggccagcgagatcctgggcctgcaggaggccatcggcgagaaggccgacaaggcctgggccgaggcccccagcctggtgaaggacagcagcaagccccccttcagcctggagaaccacagcgcctgcctggacagcgtggccaagagcgcctggcccagacccggcgagcccgaggccctgcccgacagcctgcagctggacaagggcggcaacgccaaggacttcagccccggcctgttcgaggaccccagcgtggccttcgccacccccgaccccaagaagaccaccggccccctgagcttcggcaccaagcccaccctgggcgtgcccgcccccgaccccaccaccgccgccttcgactgcttccccgacaccaccgccgccagcagcgccgacagcgccaaccccttcgcctggcccgaggagaacctgggcgacgcctgccccagatggggcctgcaccccggcgagctgaccaagggcctggagcagggcggcaaggccagcgacggcatcagcaagggcgacacccacgaggccagcgcctgcctgggcttccaggaggaggacccccccggcgagaaggtggccagcctgcccggcgacttcaagcaggaggaggtgggcggcgtgaaggaggaggccggcggcctgctgcagtgccccgaggtggccaaggccgacagatggctggaggacagcagacactgctgcagcaccgccgacttcggcgacctgcccctgctgccccccaccagcagaaaggaggacctggaggccgaggaggagtacagcagcctgtgcgagctgctgggcagccccgagcagagacccggcatgcaggaccccctgagccccaaggcccccctgatctgcaccaaggaggaggtggaggaggtgctggacagcaaggccggctggggcagcccctgccacctgagcggcgagagcgtgatcctgctgggccccaccgtgggcaccgagagcaaggtgcagagctggttcgagagcagcctgagccacatgaagcccggcgaggagggccccgacggcgagagagcccccggcgacagcaccaccagcgacgccagcctggcccagaagcccaacaagcccgccgtgcccgaggcccccatcgccaagaaggagcccgtgcccagaggcaagagcctgagaagcagaagagtgcacagaggcctgcccgaggccgaggacagcccctgcagagcccccgtgctgcccaaggacctgctgctgcccgagagctgcaccggccccccccagggccagatggagggcgccggcgcccccggcagaggcgccagcgagggcctgcccagaatgtgcaccagaagcctgaccgccctgagcgagcccagaacccccggcccccccggcctgaccaccacccccgccccccccgacaagctgggcggcaagcagagagccgccttcaagagcggcaagagagtgggcaagcccagccccaaggccgccagcagccccagcaaccccgccgccctgcccgtggccagcgacagcagccccatgggcagcaagaccaaggagaccgacagccccagcacccccggcaaggaccagagaagcatgatcctgagaagcagaaccaagacccaggagatcttccacagcaagagaagaagacccagcgagggcagactgcccaactgcagagccaccaagaagctgctggacaacagccacctgcccgccaccttcaaggtgagcagcagcccccagaaggagggcagagtgagccagagagccagagtgcccaagcccggcgccggcagcaagctgagcgacagacccctgcacgccctgaagagaaagagcgccttcatggcccccgtgcccaccaagaagagaaacctggtgctgagaagcagaagcagcagcagcagcaacgccagcggcaacggcggcgacggcaaggaggagagacccgagggcagccccaccctgttcaagagaatgagcagccccaagaaggccaagcccaccaagggcaacggcgagcccgccaccaagctgcccccccccgagacccccgacgcctgcctgaagctggccagcagagccgccttccagggcgccatgaagaccaaggtgctgccccccagaaagggcagaggcctgaagctggaggccatcgtgcagaagatcaccagccccagcctgaagaagttcgcctgcaaggcccccggcgccagccccggcaaccccctgagccccagcctgagcgacaaggacagaggcctgaagggcgccggcggcagccccgtgggcgtggaggagggcctggtgaacgtgggcaccggccagaagctgcccaccagcggcgccgaccccctgtgcagaaaccccaccaacagaagcctgaagggcaagctgatgaacagcaagaagctgagcagcaccgactgcttcaagaccgaggccttcaccagccccgaggccctgcagcccggcggcaccgccctggcccccaagaagagaagcagaaagggcagagccggcgcccacggcctgagcaagggccccctggagaagagaccctacctgggccccgccctgctgctgacccccagagacagagccagcggcacccagggcgccagcgaggacaacagcggcggcggcggcaagaagcccaagatggaggagctgggcctggccagccagccccccgagggcagaccctgccagccccagaccagagcccagaagcagcccggccacaccaactacagcagctacagcaagagaaagagactgaccagaggcagagccaagaacaccaccagcagcccctgcaagggcagagccaagagaagaagacagcagcaggtgctgcccctggaccccgccgagcccgagatcagactgaagtacatcagcagctgcaagagactgagaagcgacagcagaacccccgccttcagccccttcgtgagagtggagaagagagacgccttcaccaccatctgcaccgtggtgaacagccccggcgacgcccccaagccccacagaaagcccagcagcagcgccagcagcagcagcagcagcagcagcttcagcctggacgccgccggcgccagcctggccaccctgcccggcggcagcatcctgcagcccagacccagcctgcccctgagcagcaccatgcacctgggccccgtggtgagcaaggccctgagcaccagctgcctggtgtgctgcctgtgccagaaccccgccaacttcaaggacctgggcgacctgtgcggcccctactaccccgagcactgcctgcccaagaagaagcccaagctgaaggagaaggtgagacccgagggcacctgcgaggaggccagcctgcccctggagagaaccctgaagggccccgagtgcgccgccgccgccaccgccggcaagccccccagacccgacggccccgccgaccccgccaagcagggccccctgagaaccagcgccagaggcctgagcagaagactgcagagctgctactgctgcgacggcagagaggacggcggcgaggaggccgcccccgccgacaagggcagaaagcacgagtgcagcaaggaggcccccgccgagcccggcggcgaggcccaggagcactgggtgcacgaggcctgcgccgtgtggaccggcggcgtgtacctggtggccggcaagctgttcggcctgcaggaggccatgaaggtggccgtggacatgcacggcggcaccgtggccctggcccccggcgacttcagcctgcccggcctgagattcgccagcctgttccagggccccagctggtgcgactgccccgtgctggccaccagcacccccagcagctggagcagatgcgtgcccgccgccaagaagcccggcccccccctgggcgccgccaccaaggacgccagcacccccaccaccaccagagtgcccgccatgcaggtgagagccagacccggcaccggcggccactggagccccagcaagcagagcagaggcaccctgcccggccacagcagccccaaccccggccccatcagcctgttcagcttcccccccctgctgccccagcagttcttctaccccagcgtgtgcctggacctgtgctgggccatgcccggcacctggaagtag

SEQ ID NO: 96892 - DNA, 2943 bp, Artificial Sequence
  Description of Artificial Sequence: Synthetic coding sequence
atgaagagcctgaaggccaagttcagaaagagcgacaccaacgagtggaacaagaacgacgacagactgctgcaggccgtggagaacggcgacgccgagaaggtggccagcctgctgggcaagaagggcgccagcgccaccaagcacgacagcgagggcaagaccgccttccacctggccgccgccaagggccacgtggagtgcctgagagtgatgatcacccacggcgtggacgtgaccgcccaggacaccaccggccacagcgccctgcacctggccgccaagaacagccaccacgagtgcatcagaaagctgctgcagagcaagtgccccgccgagagcgtggacagcagcggcaagaccgccctgcactacgccgccgcccagggctgcctgcaggccgtgcagatcctgtgcgagcacaagagccccatcaacctgaaggacctggacggcaacatccccctgctgctggccgtgcagaacggccacagcgagatctgccacttcctgctggaccacggcgccgacgtgaacagcagaaacaagagcggcagaaccgccctgatgctggcctgcgagatcggcagcagcaacgccgtggaggccctgatcaagaagggcgccgacctgaacctggtggacagcctgggctacaacgccctgcactacagcaagctgagcgagaacgccggcatccagagcctgctgctgagcaagatcagccaggacgccgacctgaagacccccaccaagcccaagcagcacgaccaggtgagcaagatcagcagcgagagaagcggcacccccaagaagagaaaggccccccccccccccatcagccccacccagctgagcgacgtgagcagccccagaagcatcaccagcacccccctgagcggcaaggagagcgtgttcttcgccgagccccccttcaaggccgagatcagcagcatcagagagaacaaggacagactgagcgacagcaccaccggcgccgacagcctgctggacatcagcagcgaggccgaccagcaggacctgctgagcctgctgcaggccaaggtggccagcctgaccctgcacaacaaggagctgcaggacaagctgcaggccaagagccccaaggaggccgaggccgacctgagcttcgacagctaccacagcacccagaccgacctgggccccagcctgggcaagcccggcgagaccagcccccccgacagcaagagcagccccagcgtgctgatccacagcctgggcaagagcaccaccgacaacgacgtgagaatccagcagctgcaggagatcctgcaggacctgcagaagagactggagagcagcgaggccgagagaaagcagctgcaggtggagctgcagagcagaagagccgagctggtgtgcctgaacaacaccgagatcagcgagaacagcagcgacctgagccagaagctgaaggagacccagagcaagtacgaggaggccatgaaggaggtgctgagcgtgcagaagcagatgaagctgggcctggtgagccccgagagcatggacaactacagccacttccacgagctgagagtgaccgaggaggagatcaacgtgctgaagcaggacctgcagaacgccctggaggagagcgagagaaacaaggagaaggtgagagagctggaggagaagctggtggagagagagaagggcaccgtgatcaagccccccgtggaggagtacgaggagatgaagagcagctactgcagcgtgatcgagaacatgaacaaggagaaggccttcctgttcgagaagtaccaggaggcccaggaggagatcatgaagctgaaggacaccctgaagagccagatgacccaggaggccagcgacgaggccgaggacatgaaggaggccatgaacagaatgatcgacgagctgaacaagcaggtgagcgagctgagccagctgtacaaggaggcccaggccgagctggaggactacagaaagagaaagagcctggaggacgtgaccgccgagtacatccacaaggccgagcacgagaagctgatgcagctgaccaacgtgagcagagccaaggccgaggacgccctgagcgagatgaagagccagtacagcaaggtgctgaacgagctgacccagctgaagcagctggtggacgcccagaaggagaacagcgtgagcatcaccgagcacctgcaggtgatcaccaccctgagaaccgccgccaaggagatggaggagaagatcagcaacctgaaggagcacctggccagcaaggaggtggaggtggccaagctggagaagcagctgctggaggagaaggccgccatgaccgacgccatggtgcccagaagcagctacgagaagctgcagagcagcctggagagcgaggtgagcgtgctggccagcaagctgaaggagagcgtgaaggagaaggagaaggtgcacagcgaggtggtgcagatcagaagcgaggtgagccaggtgaagagagagaaggagaacatccagaccctgctgaagagcaaggagcaggaggtgaacgagctgctgcagaagttccagcaggcccaggaggagctggccgagatgaagagatacgccgagagcagcagcaagctggaggaggacaaggacaagaagatcaacgagatgagcaaggaggtgaccaagctgaaggaggccctgaacagcctgagccagctgagctacagcaccagcagcagcaagagacagagccagcagctggaggccctgcagcagcaggtgaagcagctgcagaaccagctggccgagtgcaagaagcagcaccaggaggtgatcagcgtgtacagaatgcacctgctgtacgccgtgcagggccagatggacgaggacgtgcagaaggtgctgaagcagatcctgaccatgtgcaagaaccagagccagaagaagtag

SEQ ID NO: 96893 - DNA, 2922 bp, Artificial Sequence
  Description of Artificial Sequence: Synthetic coding sequence
atggtgaagggcaagaccaacgagtggaacaagaacgacgacagactgctgcaggccgtggagaacggcgacgccgagaaggtggccagcctgctgggcaagaagggcgccagcgccaccaagcacgacagcgagggcaagaccgccttccacctggccgccgccaagggccacgtggagtgcctgagagtgatgatcacccacggcgtggacgtgaccgcccaggacaccaccggccacagcgccctgcacctggccgccaagaacagccaccacgagtgcatcagaaagctgctgcagagcaagtgccccgccgagagcgtggacagcagcggcaagaccgccctgcactacgccgccgcccagggctgcctgcaggccgtgcagatcctgtgcgagcacaagagccccatcaacctgaaggacctggacggcaacatccccctgctgctggccgtgcagaacggccacagcgagatctgccacttcctgctggaccacggcgccgacgtgaacagcagaaacaagagcggcagaaccgccctgatgctggcctgcgagatcggcagcagcaacgccgtggaggccctgatcaagaagggcgccgacctgaacctggtggacagcctgggctacaacgccctgcactacagcaagctgagcgagaacgccggcatccagagcctgctgctgagcaagatcagccaggacgccgacctgaagacccccaccaagcccaagcagcacgaccaggtgagcaagatcagcagcgagagaagcggcacccccaagaagagaaaggccccccccccccccatcagccccacccagctgagcgacgtgagcagccccagaagcatcaccagcacccccctgagcggcaaggagagcgtgttcttcgccgagccccccttcaaggccgagatcagcagcatcagagagaacaaggacagactgagcgacagcaccaccggcgccgacagcctgctggacatcagcagcgaggccgaccagcaggacctgctgagcctgctgcaggccaaggtggccagcctgaccctgcacaacaaggagctgcaggacaagctgcaggccaagagccccaaggaggccgaggccgacctgagcttcgacagctaccacagcacccagaccgacctgggccccagcctgggcaagcccggcgagaccagcccccccgacagcaagagcagccccagcgtgctgatccacagcctgggcaagagcaccaccgacaacgacgtgagaatccagcagctgcaggagatcctgcaggacctgcagaagagactggagagcagcgaggccgagagaaagcagctgcaggtggagctgcagagcagaagagccgagctggtgtgcctgaacaacaccgagatcagcgagaacagcagcgacctgagccagaagctgaaggagacccagagcaagtacgaggaggccatgaaggaggtgctgagcgtgcagaagcagatgaagctgggcctggtgagccccgagagcatggacaactacagccacttccacgagctgagagtgaccgaggaggagatcaacgtgctgaagcaggacctgcagaacgccctggaggagagcgagagaaacaaggagaaggtgagagagctggaggagaagctggtggagagagagaagggcaccgtgatcaagccccccgtggaggagtacgaggagatgaagagcagctactgcagcgtgatcgagaacatgaacaaggagaaggccttcctgttcgagaagtaccaggaggcccaggaggagatcatgaagctgaaggacaccctgaagagccagatgacccaggaggccagcgacgaggccgaggacatgaaggaggccatgaacagaatgatcgacgagctgaacaagcaggtgagcgagctgagccagctgtacaaggaggcccaggccgagctggaggactacagaaagagaaagagcctggaggacgtgaccgccgagtacatccacaaggccgagcacgagaagctgatgcagctgaccaacgtgagcagagccaaggccgaggacgccctgagcgagatgaagagccagtacagcaaggtgctgaacgagctgacccagctgaagcagctggtggacgcccagaaggagaacagcgtgagcatcaccgagcacctgcaggtgatcaccaccctgagaaccgccgccaaggagatggaggagaagatcagcaacctgaaggagcacctggccagcaaggaggtggaggtggccaagctggagaagcagctgctggaggagaaggccgccatgaccgacgccatggtgcccagaagcagctacgagaagctgcagagcagcctggagagcgaggtgagcgtgctggccagcaagctgaaggagagcgtgaaggagaaggagaaggtgcacagcgaggtggtgcagatcagaagcgaggtgagccaggtgaagagagagaaggagaacatccagaccctgctgaagagcaaggagcaggaggtgaacgagctgctgcagaagttccagcaggcccaggaggagctggccgagatgaagagatacgccgagagcagcagcaagctggaggaggacaaggacaagaagatcaacgagatgagcaaggaggtgaccaagctgaaggaggccctgaacagcctgagccagctgagctacagcaccagcagcagcaagagacagagccagcagctggaggccctgcagcagcaggtgaagcagctgcagaaccagctggccgagtgcaagaagcagcaccaggaggtgatcagcgtgtacagaatgcacctgctgtacgccgtgcagggccagatggacgaggacgtgcagaaggtgctgaagcagatcctgaccatgtgcaagaaccagagccagaagaagtag

SEQ ID NO: 96894 - DNA, 2943 bp, Artificial Sequence; identical to SEQ ID NO: 96892
  Description of Artificial Sequence: Synthetic coding sequence

SEQ ID NO: 96895 - DNA, 2943 bp, Artificial Sequence; identical to SEQ ID NO: 96892
  Description of Artificial Sequence: Synthetic coding sequence

SEQ ID NO: 96896 - DNA, 345 bp, Artificial Sequence
  Description of Artificial Sequence: Synthetic coding sequence
atgaagagcctgaaggccaagttcagaaagagcgacaccaacgagtggaacaagaacgacgacagactgctgcaggccgtggagaacggcgacgccgagaaggtggccagcctgctgggcaagaagggcgccagcgccaccaagcacgacagcgagggcaagaccgccttccacctggccgccgccaagggccacgtggagtgcctgagagtgatgatcacccacggcgtggacgtgaccgcccaggacaccaccggccacagcgccctgcacctggccgccaagaacagccaccacgagtgcatcagaaagctgctgcagagcaagtgccccgccgagagctag

SEQ ID NO: 96897 - DNA, 2919 bp, Artificial Sequence
  Description of Artificial Sequence: Synthetic coding sequence
atggaggccaagaccaacgagtggaacaagaacgacgacagactgctgcaggccgtggagaacggcgacgccgagaaggtggccagcctgctgggcaagaagggcgccagcgccaccaagcacgacagcgagggcaagaccgccttccacctggccgccgccaagggccacgtggagtgcctgagagtgatgatcacccacggcgtggacgtgaccgcccaggacaccaccggccacagcgccctgcacctggccgccaagaacagccaccacgagtgcatcagaaagctgctgcagagcaagtgccccgccgagagcgtggacagcagcggcaagaccgccctgcactacgccgccgcccagggctgcctgcaggccgtgcagatcctgtgcgagcacaagagccccatcaacctgaaggacctggacggcaacatccccctgctgctggccgtgcagaacggccacagcgagatctgccacttcctgctggaccacggcgccgacgtgaacagcagaaacaagagcggcagaaccgccctgatgctggcctgcgagatcggcagcagcaacgccgtggaggccctgatcaagaagggcgccgacctgaacctggtggacagcctgggctacaacgccctgcactacagcaagctgagcgagaacgccggcatccagagcctgctgctgagcaagatcagccaggacgccgacctgaagacccccaccaagcccaagcagcacgaccaggtgagcaagatcagcagcgagagaagcggcacccccaagaagagaaaggccccccccccccccatcagccccacccagctgagcgacgtgagcagccccagaagcatcaccagcacccccctgagcggcaaggagagcgtgttcttcgccgagccccccttcaaggccgagatcagcagcatcagagagaacaaggacagactgagcgacagcaccaccggcgccgacagcctgctggacatcagcagcgaggccgaccagcaggacctgctgagcctgctgcaggccaaggtggccagcctgaccctgcacaacaaggagctgcaggacaagctgcaggccaagagccccaaggaggccgaggccgacctgagcttcgacagctaccacagcacccagaccgacctgggccccagcctgggcaagcccggcgagaccagcccccccgacagcaagagcagccccagcgtgctgatccacagcctgggcaagagcaccaccgacaacgacgtgagaatccagcagctgcaggagatcctgcaggacctgcagaagagactggagagcagcgaggccgagagaaagcagctgcaggtggagctgcagagcagaagagccgagctggtgtgcctgaacaacaccgagatcagcgagaacagcagcgacctgagccagaagctgaaggagacccagagcaagtacgaggaggccatgaaggaggtgctgagcgtgcagaagcagatgaagctgggcctggtgagccccgagagcatggacaactacagccacttccacgagctgagagtgaccgaggaggagatcaacgtgctgaagcaggacctgcagaacgccctggaggagagcgagagaaacaaggagaaggtgagagagctggaggagaagctggtggagagagagaagggcaccgtgatcaagccccccgtggaggagtacgaggagatgaagagcagctactgcagcgtgatcgagaacatgaacaaggagaaggccttcctgttcgagaagtaccaggaggcccaggaggagatcatgaagctgaaggacaccctgaagagccagatgacccaggaggccagcgacgaggccgaggacatgaaggaggccatgaacagaatgatcgacgagctgaacaagcaggtgagcgagctgagccagctgtacaaggaggcccaggccgagctggaggactacagaaagagaaagagcctggaggacgtgaccgccgagtacatccacaaggccgagcacgagaagctgatgcagctgaccaacgtgagcagagccaaggccgaggacgccctgagcgagatgaagagccagtacagcaaggtgctgaacgagctgacccagctgaagcagctggtggacgcccagaaggagaacagcgtgagcatcaccgagcacctgcaggtgatcaccaccctgagaaccgccgccaaggagatggaggagaagatcagcaacctgaaggagcacctggccagcaaggaggtggaggtggccaagctggagaagcagctgctggaggagaaggccgccatgaccgacgccatggtgcccagaagcagctacgagaagctgcagagcagcctggagagcgaggtgagcgtgctggccagcaagctgaaggagagcgtgaaggagaaggagaaggtgcacagcgaggtggtgcagatcagaagcgaggtgagccaggtgaagagagagaaggagaacatccagaccctgctgaagagcaaggagcaggaggtgaacgagctgctgcagaagttccagcaggcccaggaggagctggccgagatgaagagatacgccgagagcagcagcaagctggaggaggacaaggacaagaagatcaacgagatgagcaaggaggtgaccaagctgaaggaggccctgaacagcctgagccagctgagctacagcaccagcagcagcaagagacagagccagcagctggaggccctgcagcagcaggtgaagcagctgcagaaccagctggccgagtgcaagaagcagcaccaggaggtgatcagcgtgtacagaatgcacctgctgtacgccgtgcagggccagatggacgaggacgtgcagaaggtgctgaagcagatcctgaccatgtgcaagaaccagagccagaagaagtag

SEQ ID NO: 96898 - DNA, 378 bp, Artificial Sequence
  Description of Artificial Sequence: Synthetic coding sequence
atgaagagcctgaaggccaagttcagaaagagcgacaccaacgagtggaacaagaacgacgacagactgctgcaggccgtggagaacggcgacgccgagaaggtggccagcctgctgggcaagaagggcgccagcgccaccaagcacgacagcgagggcaagaccgccttccacctggccgccgccaagggccacgtggagtgcctgagagtgatgatcacccacggcgtggacgtgaccgcccaggacaccaccggccacagcgccctgcacctggccgccaagaacagccaccacgagtgcatcagaaagctgctgcagagcaagtgccccgccgagagcgtggacagcagcggcaagaccgccctgcactactag

SEQ ID NO: 96899 - DNA, 324 bp, Artificial Sequence
  Description of Artificial Sequence: Synthetic coding sequence
atgaagagcctgaaggccaagttcagaaagagcgacaccaacgagtggaacaagaacgacgacagactgctgcaggccgtggagaacggcgacgccgagaaggtggccagcctgctgggcaagaagggcgccagcgccaccaagcacgacagcgagggcaagaccgccttccacctggccgccgccaagggccacgtggagtgcctgagagtgatgatcacccacggcgtggacgtgaccgcccaggacaccaccggccacagcgccctgcacctggccgccaagaacagccaccacgagtgcatcagaaagctgctgcagtag

SEQ ID NO: 96900 - DNA, 453 bp, Artificial Sequence
  Description of Artificial Sequence: Synthetic coding sequence
atgaagagcctgaaggccaagttcagaaagagcgacaccaacgagtggaacaagaacgacgacagactgctgcaggccgtggagaacggcgacgccgagaaggtggccagcctgctgggcaagaagggcgccagcgccaccaagcacgacagcgagggcaagaccgccttccacctggccgccgccaagggccacgtggagtgcctgagagtgatgatcacccacggcgtggacgtgaccgcccaggacaccaccggccacagcgccctgcacctggccgccaagaacagccaccacgagtgcatcagaaagctgctgcagagcaagtgccccgccgagagcgtggacagcagcggcaagaccgccctgcactacgccgccgcccagggctgcctgcaggccgtgcagatcctgtgcgagcacaagagccccatcaacctgaaggacctgtag

SEQ ID NO: 96901 - DNA, 381 bp, Artificial Sequence
  Description of Artificial Sequence: Synthetic coding sequence
atgaagagcctgaaggccaagttcagaaagagcgacaccaacgagtggaacaagaacgacgacagactgctgcaggccgtggagaacggcgacgccgagaaggtggccagcctgctgggcaagaagggcgccagcgccaccaagcacgacagcgagggcaagaccgccttccacctggccgccgccaagggccacgtggagtgcctgagagtgatgatcacccacggcgtggacgtgaccgcccaggacaccaccggccacagcgccctgcacctggccgccaagaacagccaccacgagtgcatcagaaagctgctgcagagcaagtgccccgccgagagcgtggacagcagcggcaagaccgccctgcactacgcctag

SEQ ID NO: 96902 - DNA, 315 bp, Artificial Sequence
  Description of Artificial Sequence: Synthetic coding sequence
atgaagagcctgaaggccaagttcagaaagagcgacaccaacgagtggaacaagaacgacgacagactgctgcaggccgtggagaacggcgacgccgagaaggtggccagcctgctgggcaagaagggcgccagcgccaccaagcacgacagcgagggcaagaccgccttccacctggccgccgccaagggccacgtggagtgcctgagagtgatgatcacccacggcgtggacgtgaccgcccaggacaccaccggccacagcgccctgcacctggccgccaagaacagccaccacgagtgcatcagaaagtag

SEQ ID NO: 96903 - DNA, 420 bp, Artificial Sequence
  Description of Artificial Sequence: Synthetic coding sequence
atgaagagcctgaaggccaagttcagaaagagcgacaccaacgagtggaacaagaacgacgacagactgctgcaggccgtggagaacggcgacgccgagaaggtggccagcctgctgggcaagaagggcgccagcgccaccaagcacgacagcgagggcaagaccgccttccacctggccgccgccaagggccacgtggagtgcctgagagtgatgatcacccacggcgtggacgtgaccgcccaggacaccaccggccacagcgccctgcacctggccgccaagaacagccaccacgagtgcatcagaaagctgctgcagagcaagtgccccgccgagagcgtggacagcagcggcaagaccgccctgcactacgccgccgcccagggctgcctgcaggccgtgcagatcctgtgctag

SEQ ID NO: 96904 - DNA, 381 bp, Artificial Sequence; identical to SEQ ID NO: 96901
  Description of Artificial Sequence: Synthetic coding sequence

SEQ ID NO: 96905 - DNA, 2952 bp, Artificial Sequence
  Description of Artificial Sequence: Synthetic coding sequence
atgcagcccacctacctgccctggctgagcgccaaggagaagaagaccaacgagtggaacaagaacgacgacagactgctgcaggccgtggagaacggcgacgccgagaaggtggccagcctgctgggcaagaagggcgccagcgccaccaagcacgacagcgagggcaagaccgccttccacctggccgccgccaagggccacgtggagtgcctgagagtgatgatcacccacggcgtggacgtgaccgcccaggacaccaccggccacagcgccctgcacctggccgccaagaacagccaccacgagtgcatcagaaagctgctgcagagcaagtgccccgccgagagcgtggacagcagcggcaagaccgccctgcactacgccgccgcccagggctgcctgcaggccgtgcagatcctgtgcgagcacaagagccccatcaacctgaaggacctggacggcaacatccccctgctgctggccgtgcagaacggccacagcgagatctgccacttcctgctggaccacggcgccgacgtgaacagcagaaacaagagcggcagaaccgccctgatgctggcctgcgagatcggcagcagcaacgccgtggaggccctgatcaagaagggcgccgacctgaacctggtggacagcctgggctacaacgccctgcactacagcaagctgagcgagaacgccggcatccagagcctgctgctgagcaagatcagccaggacgccgacctgaagacccccaccaagcccaagcagcacgaccaggtgagcaagatcagcagcgagagaagcggcacccccaagaagagaaaggccccccccccccccatcagccccacccagctgagcgacgtgagcagccccagaagcatcaccagcacccccctgagcggcaaggagagcgtgttcttcgccgagccccccttcaaggccgagatcagcagcatcagagagaacaaggacagactgagcgacagcaccaccggcgccgacagcctgctggacatcagcagcgaggccgaccagcaggacctgctgagcctgctgcaggccaaggtggccagcctgaccctgcacaacaaggagctgcaggacaagctgcaggccaagagccccaaggaggccgaggccgacctgagcttcgacagctaccacagcacccagaccgacctgggccccagcctgggcaagcccggcgagaccagcccccccgacagcaagagcagccccagcgtgctgatccacagcctgggcaagagcaccaccgacaacgacgtgagaatccagcagctgcaggagatcctgcaggacctgcagaagagactggagagcagcgaggccgagagaaagcagctgcaggtggagctgcagagcagaagagccgagctggtgtgcctgaacaacaccgagatcagcgagaacagcagcgacctgagccagaagctgaaggagacccagagcaagtacgaggaggccatgaaggaggtgctgagcgtgcagaagcagatgaagctgggcctggtgagccccgagagcatggacaactacagccacttccacgagctgagagtgaccgaggaggagatcaacgtgctgaagcaggacctgcagaacgccctggaggagagcgagagaaacaaggagaaggtgagagagctggaggagaagctggtggagagagagaagggcaccgtgatcaagccccccgtggaggagtacgaggagatgaagagcagctactgcagcgtgatcgagaacatgaacaaggagaaggccttcctgttcgagaagtaccaggaggcccaggaggagatcatgaagctgaaggacaccctgaagagccagatgacccaggaggccagcgacgaggccgaggacatgaaggaggccatgaacagaatgatcgacgagctgaacaagcaggtgagcgagctgagccagctgtacaaggaggcccaggccgagctggaggactacagaaagagaaagagcctggaggacgtgaccgccgagtacatccacaaggccgagcacgagaagctgatgcagctgaccaacgtgagcagagccaaggccgaggacgccctgagcgagatgaagagccagtacagcaaggtgctgaacgagctgacccagctgaagcagctggtggacgcccagaaggagaacagcgtgagcatcaccgagcacctgcaggtgatcaccaccctgagaaccgccgccaaggagatggaggagaagatcagcaacctgaaggagcacctggccagcaaggaggtggaggtggccaagctggagaagcagctgctggaggagaaggccgccatgaccgacgccatggtgcccagaagcagctacgagaagctgcagagcagcctggagagcgaggtgagcgtgctggccagcaagctgaaggagagcgtgaaggagaaggagaaggtgcacagcgaggtggtgcagatcagaagcgaggtgagccaggtgaagagagagaaggagaacatccagaccctgctgaagagcaaggagcaggaggtgaacgagctgctgcagaagttccagcaggcccaggaggagctggccgagatgaagagatacgccgagagcagcagcaagctggaggaggacaaggacaagaagatcaacgagatgagcaaggaggtgaccaagctgaaggaggccctgaacagcctgagccagctgagctacagcaccagcagcagcaagagacagagccagcagctggaggccctgcagcagcaggtgaagcagctgcagaaccagctggccgagtgcaagaagcagcaccaggaggtgatcagcgtgtacagaatgcacctgctgtacgccgtgcagggccagatggacgaggacgtgcagaaggtgctgaagcagatcctgaccatgtgcaagaaccagagccagaagaagtag

SEQ ID NO: 96906 - DNA, 2856 bp, Artificial Sequence
  Description of Artificial Sequence: Synthetic coding sequence
atgaagagcctgaaggccaagttcagaaagagcgacaccaacgagtggaacaagaacgacgacagactgctgcaggccgtggagaacggcgacgccgagaaggtggccagcctgctgggcaagaagggcgccagcgccaccaagcacgacagcgagggcaagaccgccttccacctggccgccgccaagggccacgtggagtgcctgagagtgatgatcacccacggcgtggacgtgaccgcccaggacaccaccggccacagcgccctgcacctggccgccaagaacagccaccacgagtgcatcagaaagctgctgcagagcaagtgccccgccgagagcgtggacagcagcggcaagaccgccctgcactacgccgccgcccagggctgcctgcaggccgtgcagatcctgtgcgagcacaagagccccatcaacctgaaggacctggacggcaacatccccctgctgctggccgtgcagaacggccacagcgagatctgccacttcctgctggaccacggcgccgacgtgaacagcagaaacaagagcggcagaaccgccctgatgctggcctgcgagatcggcagcagcaacgccgtggaggccctgatcaagaagggcgccgacctgaacctggtggacagcctgggctacaacgccctgcactacagcaagctgagcgagaacgccggcatccagagcctgctgctgagcaagatcagccaggacgccgacctgaagacccccaccaagcccaagcagctgagcgacgtgagcagccccagaagcatcaccagcacccccctgagcggcaaggagagcgtgttcttcgccgagccccccttcaaggccgagatcagcagcatcagagagaacaaggacagactgagcgacagcaccaccggcgccgacagcctgctggacatcagcagcgaggccgaccagcaggacctgctgagcctgctgcaggccaaggtggccagcctgaccctgcacaacaaggagctgcaggacaagctgcaggccaagagccccaaggaggccgaggccgacctgagcttcgacagctaccacagcacccagaccgacctgggccccagcctgggcaagcccggcgagaccagcccccccgacagcaagagcagccccagcgtgctgatccacagcctgggcaagagcaccaccgacaacgacgtgagaatccagcagctgcaggagatcctgcaggacctgcagaagagactggagagcagcgaggccgagagaaagcagctgcaggtggagctgcagagcagaagagccgagctggtgtgcctgaacaacaccgagatcagcgagaacagcagcgacctgagccagaagctgaaggagacccagagcaagtacgaggaggccatgaaggaggtgctgagcgtgcagaagcagatgaagctgggcctggtgagccccgagagcatggacaactacagccacttccacgagctgagagtgaccgaggaggagatcaacgtgctgaagcaggacctgcagaacgccctggaggagagcgagagaaacaaggagaaggtgagagagctggaggagaagctggtggagagagagaagggcaccgtgatcaagccccccgtggaggagtacgaggagatgaagagcagctactgcagcgtgatcgagaacatgaacaaggagaaggccttcctgttcgagaagtaccaggaggcccaggaggagatcatgaagctgaaggacaccctgaagagccagatgacccaggaggccagcgacgaggccgaggacatgaaggaggccatgaacagaatgatcgacgagctgaacaagcaggtgagcgagctgagccagctgtacaaggaggcccaggccgagctggaggactacagaaagagaaagagcctggaggacgtgaccgccgagtacatccacaaggccgagcacgagaagctgatgcagctgaccaacgtgagcagagccaaggccgaggacgccctgagcgagatgaagagccagtacagcaaggtgctgaacgagctgacccagctgaagcagctggtggacgcccagaaggagaacagcgtgagcatcaccgagcacctgcaggtgatcaccaccctgagaaccgccgccaaggagatggaggagaagatcagcaacctgaaggagcacctggccagcaaggaggtggaggtggccaagctggagaagcagctgctggaggagaaggccgccatgaccgacgccatggtgcccagaagcagctacgagaagctgcagagcagcctggagagcgaggtgagcgtgctggccagcaagctgaaggagagcgtgaaggagaaggagaaggtgcacagcgaggtggtgcagatcagaagcgaggtgagccaggtgaagagagagaaggagaacatccagaccctgctgaagagcaaggagcaggaggtgaacgagctgctgcagaagttccagcaggcccaggaggagctggccgagatgaagagatacgccgagagcagcagcaagctggaggaggacaaggacaagaagatcaacgagatgagcaaggaggtgaccaagctgaaggaggccctgaacagcctgagccagctgagctacagcaccagcagcagcaagagacagagccagcagctggaggccctgcagcagcaggtgaagcagctgcagaaccagctggccgagtgcaagaagcagcaccaggaggtgatcagcgtgtacagaatgcacctgctgtacgccgtgcagggccagatggacgaggacgtgcagaaggtgctgaagcagatcctgaccatgtgcaagaaccagagccagaagaagtag

SEQ ID NO: 96907 - DNA, 1593 bp, Artificial Sequence
  Description of Artificial Sequence: Synthetic coding sequence
atggacgacctgcagagccagaacctgagcatggacatgaccgacagcccccccgccctggccaacaacagactggagaacggcatggcccagctgatcaccaccgaggcctggaacatcaacagcaccgacctggtgaagaaggccctggtgaccgtgcccgcccccagcatcctgaacccccccgccgagagccagagcggcatggccctgaaggtggccgccaccgtgctgcagcccctgtgcctgggcgagagccccgtggtgatgcccatccacatgcaggtggagggcagcagcgcccccgagctgaaccccaacggcaacgccacctacgtgatgaccacccagggccccgtgcagctgcccgtggtgctggagcagcacgtgttccagcacctgaacagccccctggtgctgccccaggaggccccctgcagcagcagcaccatccacaacaacctgttccagggcgccgaggaccccgaggcccagccccagctgctggacctgagaatccccagccagccccaggagcccaccctgcccttcgaggccgtgctgcagaacctgttccccagccagggcaccctgggcccccccccctgccagcccccccccggctacgcccccgtgcccccccagcccttcagcagccccctgagccccctggtgccccccgccaccctgctggtgccctaccccgtgatcgtgcccctgcccgtgcccgtgcccatccccatccccatccccatgccccagagcagcgagagcaagttcagcagcagcttccccaagccccccagcagcttcggcctgcaccccttcaagggcacccagacccccctggagaaggacgagctgaagcccttcgacatcctgcagcccaaggagtacttccagctgagcagacacaccgtgatcaagatgggcagcgagaacgaggccctggacctgagcatgaagagcgtgccctggctgaaggccggcgaggtgagcccccccatcttccaggaggacgccgccctggacctgagcgtggccgcccacagaaagagcgagcccccccccgagaccctgtacgacagcggcgccagcgtggacagcagcggccacaccgtgatggagaagctgcccagcggcatggagatcagcttcgcccccgccaccagccacgaggcccccgccatgatggacagccacatcagcagcagcgacgccgccaccgagatgctgagccagcccaaccaccccagcggcgaggtgaaggccgagaacaacatcgagatggtgggcgagagccaggccgccaaggtgatcgtgagcgtggaggacgccgtgcccaccatcttctgcggcaagatcaagggcctgagcggcgtgagcaccaagaacttcagcttcaagagagaggacagcgtgctgcagggctacgacatcaacagccagggcgaggagagcatgggcaacgccgagcccctgagaaagcccatcaagaacagaagcatcaagctgaagaaggtgaacagccaggagatccacatgctgcccatcaagaagcagagactggccaccttcttccccagaaagtag

SEQ ID NO: 96908 - DNA, 1593 bp, Artificial Sequence; identical to SEQ ID NO: 96907
  Description of Artificial Sequence: Synthetic coding sequence

SEQ ID NO: 96909 - DNA, 1443 bp, Artificial Sequence
  Description of Artificial Sequence: Synthetic coding sequence
atggacgacctgcagagccagaacctgagcatggacatgaccgacagcccccccgccctggccaacaacagactggagaacggcatggcccagctgatcaccaccgaggcctggaacatcaacagcaccgacctggtggagggcagcagcgcccccgagctgaaccccaacggcaacgccacctacgtgatgaccacccagggccccgtgcagctgcccgtggtgctggagcagcacgtgttccagcacctgaacagccccctggtgctgccccaggaggccccctgcagcagcagcaccatccacaacaacctgttccagggcgccgaggaccccgaggcccagccccagctgctggacctgagaatccccagccagccccaggagcccaccctgcccttcgaggccgtgctgcagaacctgttccccagccagggcaccctgggcccccccccctgccagcccccccccggctacgcccccgtgcccccccagcccttcagcagccccctgagccccctggtgccccccgccaccctgctggtgccctaccccgtgatcgtgcccctgcccgtgcccgtgcccatccccatccccatccccatgccccagagcagcgagagcaagttcagcagcagcttccccaagccccccagcagcttcggcctgcaccccttcaagggcacccagacccccctggagaaggacgagctgaagcccttcgacatcctgcagcccaaggagtacttccagctgagcagacacaccgtgatcaagatgggcagcgagaacgaggccctggacctgagcatgaagagcgtgccctggctgaaggccggcgaggtgagcccccccatcttccaggaggacgccgccctggacctgagcgtggccgcccacagaaagagcgagcccccccccgagaccctgtacgacagcggcgccagcgtggacagcagcggccacaccgtgatggagaagctgcccagcggcatggagatcagcttcgcccccgccaccagccacgaggcccccgccatgatggacagccacatcagcagcagcgacgccgccaccgagatgctgagccagcccaaccaccccagcggcgaggtgaaggccgagaacaacatcgagatggtgggcgagagccaggccgccaaggtgatcgtgagcgtggaggacgccgtgcccaccatcttctgcggcaagatcaagggcctgagcggcgtgagcaccaagaacttcagcttcaagagagaggacagcgtgctgcagggctacgacatcaacagccagggcgaggagagcatgggcaacgccgagcccctgagaaagcccatcaagaacagaagcatcaagctgaagaaggtgaacagccaggagatccacatgctgcccatcaagaagcagagactggccaccttcttccccagaaagtag

SEQ ID NO: 96910 - DNA, 1593 bp, Artificial Sequence; identical to SEQ ID NO: 96907
  Description of Artificial Sequence: Synthetic coding sequence

SEQ ID NO: 96911 - DNA, 1593 bp, Artificial Sequence; identical to SEQ ID NO: 96907
  Description of Artificial Sequence: Synthetic coding sequence

SEQ ID NO: 96912 - DNA, 885 bp, Artificial Sequence
  Description of Artificial Sequence: Synthetic coding sequence
atgcagcccagaagacagagactgcccgccccctggagcggccccagaggccccagacccaccgcccccctgctggccctgctgctgctgctggcccccgtggccgcccccgccggcagcggcgaccccgacgaccccggccagccccaggacgccggcgtgcccagaagactgctgcagcaggccgccagagccgccctgcacttcttcaacttcagaagcggcagccccagcgccctgagagtgctggccgaggtgcaggagggcagagcctggatcaaccccaaggagggctgcaaggtgcacgtggtgttcagcaccgagagatacaaccccgagagcctgctgcaggagggcgagggcagactgggcaagtgcagcgccagagtgttcttcaagaaccagaagcccagacccaccatcaacgtgacctgcaccagactgatcgagaagaagaagagacagcaggaggactacctgctgtacaagcagatgaagcagctgaagaaccccctggagatcgtgagcatccccgacaaccacggccacatcgaccccagcctgagactgatctgggacctggccttcctgggcagcagctacgtgatgtgggagatgaccacccaggtgagccactactacctggcccagctgaccagcgtgagacagtggaagaccaacgacgacaccatcgacttcgactacaccgtgctgctgcacgagctgagcacccaggagatcatcccctgcagaatccacctggtgtggtaccccggcaagcccctgaaggtgaagtaccactgccaggagctgcagacccccgaggaggccagcggcaccgaggagggcagcgccgtggtgcccaccgagctgagcaacttctag

SEQ ID NO: 96913 - DNA, 687 bp, Artificial Sequence
  Description of Artificial Sequence: Synthetic coding sequence
atgcagcccagaagacagagactgcccgccccctggagcggccccagaggccccagacccaccgcccccctgctggccctgctgctgctgctggcccccgtggccgcccccgccggcagcggcgaccccgacgaccccggccagccccaggacgccggcgtgcccagaagactgctgcagcaggccgccagagccgccctgcacttcttcaacttcagaagcggcagccccagcgccctgagagtgctggccgaggtgcaggagggcagagcctggatcaaccccaaggagggctgcaaggtgcacgtggtgttcagcaccgagagatacaaccccgagagcctgctgcaggagggcgagggcagactgggcaagtgcagcgccagagtgttcttcaagaaccagaagcccagacccaccatcaacgtgacctgcaccagactgatcgagaagaagaagagacagcaggaggactacctgctgtacaagcagatgaagcagctgaagaaccccctggagatcgtgagcatccccgacaaccacggccacatcgaccccagcctgagactgatctgggacctggccttcctgggcagcagctacgtgatgtgggagatgaccacccaggtgagccactactacctggcccagctgaccagcgtgagacagtgggtgagaaagacctag

SEQ ID NO: 96914 - DNA, 1008 bp, Artificial Sequence
  Description of Artificial Sequence: Synthetic coding sequence
atggtgagaagagacagactgagaagaatgagagagtggtgggtgcaggtgggcctgctggccgtgcccctgctggccgcctacctgcacatcccccccccccagctgagccccgccctgcacagctggaagagcagcggcaagttcttcacctacaagggcctgagaatcttctaccaggacagcgtgggcgtggtgggcagccccgagatcgtggtgctgctgcacggcttccccaccagcagctacgactggtacaagatctgggagggcctgaccctgagattccacagagtgatcgccctggacttcctgggcttcggcttcagcgacaagcccagaccccaccactacagcatcttcgagcaggccagcatcgtggaggccctgctgagacacctgggcctgcagaacagaagaatcaacctgctgagccacgactacggcgacatcgtggcccaggagctgctgtacagatacaagcagaacagaagcggcagactgaccatcaagagcctgtgcctgagcaacggcggcatcttccccgagacccacagacccctgctgctgcagaagctgctgaaggacggcggcgtgctgagccccatcctgaccagactgatgaacttcttcgtgttcagcagaggcctgacccccgtgttcggcccctacaccagacccagcgagagcgagctgtgggacatgtgggccggcatcagaaacaacgacggcaacctggtgatcgacagcctgctgcagtacatcaaccagagaaagaagttcagaagaagatgggtgggcgccctggccagcgtgaccatccccatccacttcatctacggccccctggaccccgtgaacccctaccccgagttcctggagctgtacagaaagaccctgcccagaagcaccgtgagcatcctggacgaccacatcagccactacccccagctggaggaccccatgggcttcctgaacgcctacatgggcttcatcaacagcttctag

SEQ ID NO: 96915 - DNA, 492 bp, Artificial Sequence
  Description of Artificial Sequence: Synthetic coding sequence
atgagaagactgctgatccccctggccctgtggctgggcgccgtgggcgtgggcgtggccgagctgaccgaggcccagagaagaggcctgcaggtggccctggaggagttccacaagcacccccccgtgcagtgggccttccaggagaccagcgtggagagcgccgtggacacccccttccccgccggcatcttcgtgagactggagttcaagctgcagcagaccagctgcagaaagagagactggaagaagcccgagtgcaaggtgagacccaacggcagaaagagaaagtgcctggcctgcatcaagctgggcagcgaggacaaggtgctgggcagactggtgcactgccccatcgagacccaggtgctgagagaggccgaggagcaccaggagacccagtgcctgagagtgcagagagccggcgaggacccccacagcttctacttccccggccagttcgccttcagcaaggccctgcccagaagctag

SEQ ID NO: 96916 - DNA, 492 bp, Artificial Sequence; identical to SEQ ID NO: 96915
  Description of Artificial Sequence: Synthetic coding sequence

SEQ ID NO: 96917 - DNA, 495 bp, Artificial Sequence
  Description of Artificial Sequence: Synthetic coding sequence
atggccagcccccaccaggagcccaagcccggcgacctgatcgagatcttcagactgggctacgagcactgggccctgtacatcggcgacggctacgtgatccacctggccccccccagcgagtaccccggcgccggcagcagcagcgtgttcagcgtgctgagcaacagcgccgaggtgaagagagagagactggaggacgtggtgggcggctgctgctacagagtgaacaacagcctggaccacgagtaccagcccagacccgtggaggtgatcatcagcagcgccaaggagatggtgggccagaagatgaagtacagcatcgtgagcagaaactgcgagcacttcgtgacccagctgagatacggcaagagcagatgcaagcaggtggagaaggccaaggtggaggtgggcgtggccaccgccctgggcatcctggtggtggccggctgcagcttcgccatcagaagataccagaagaaggccaccgcctag

SEQ ID NO: 96918 - DNA, 495 bp, Artificial Sequence
  Description of Artificial Sequence: Synthetic coding sequence
atgggcctgcccgagcccaagcccaagcccggcgacctgatcgagatcttcagactgggctacgagcactgggccctgtacatcggcgacggctacgtgatccacctggccccccccagcgagtaccccggcgccggcagcagcagcgtgttcagcgtgctgagcaacagcgccgaggtgaagagagagagactggaggacgtggtgggcggctgctgctacagagtgaacaacagcctggaccacgagtaccagcccagacccgtggaggtgatcatcagcagcgccaaggagatggtgggccagaagatgaagtacagcatcgtgagcagaaactgcgagcacttcgtgacccagctgagatacggcaagagcagatgcaagcaggtggagaaggccaaggtggaggtgggcgtggccaccgccctgggcatcctggtggtggccggctgcagcttcgccatcagaagataccagaagaaggccaccgcctag

SEQ ID NO: 96919 - DNA, 1389 bp, Artificial Sequence
  Description of Artificial Sequence: Synthetic coding sequence
atggccagcaacagcagcagctgccccacccccggcggcggccacctgaacggctaccccgtgcccccctacgccttcttcttcccccccatgctgggcggcctgagcccccccggcgccctgaccaccctgcagcaccagctgcccgtgagcggctacagcacccccagccccgccaccatcgagacccagagcagcagcagcgaggagatcgtgcccagcccccccagccccccccccctgcccagaatctacaagccctgcttcgtgtgccaggacaagagcagcggctaccactacggcgtgagcgcctgcgagggctgcaagggcttcttcagaagaagcatccagaagaacatggtgtacacctgccacagagacaagaactgcatcatcaacaaggtgaccagaaacagatgccagtactgcagactgcagaagtgcttcgaggtgggcatgagcaaggagagcgtgagaaacgacagaaacaagaagaagaaggaggtgcccaagcccgagtgcagcgagagctacaccctgacccccgaggtgggcgagctgatcgagaaggtgagaaaggcccaccaggagaccttccccgccctgtgccagctgggcaagtacaccaccaacaacagcagcgagcagagagtgagcctggacatcgacctgtgggacaagttcagcgagctgagcaccaagtgcatcatcaagaccgtggagttcgccaagcagctgcccggcttcaccaccctgaccatcgccgaccagatcaccctgctgaaggccgcctgcctggacatcctgatcctgagaatctgcaccagatacacccccgagcaggacaccatgaccttcagcgacggcctgaccctgaacagaacccagatgcacaacgccggcttcggccccctgaccgacctggtgttcgccttcgccaaccagctgctgcccctggagatggacgacgccgagaccggcctgctgagcgccatctgcctgatctgcggcgacagacaggacctggagcagcccgacagagtggacatgctgcaggagcccctgctggaggccctgaaggtgtacgtgagaaagagaagacccagcagaccccacatgttccccaagatgctgatgaagatcaccgacctgagaagcatcagcgccaagggcgccgagagagtgatcaccctgaagatggagatccccggcagcatgccccccctgatccaggagatgctggagaacagcgagggcctggacaccctgagcggccagcccggcggcggcggcagagacggcggcggcctggcccccccccccggcagctgcagccccagcctgagccccagcagcaacagaagcagccccgccacccacagcccctag

SEQ ID NO: 96920 - DNA, 1902 bp, Artificial Sequence
  Description of Artificial Sequence: Synthetic coding sequence
atgtacgagagcgtggaggtgggcggccccacccccaaccccttcctggtggtggacttctacaaccagaacagagcctgcctgctgcccgagaagggcctgcccgcccccggcccctacagcacccccctgagaacccccctgtggaacggcagcaaccacagcatcgagacccagagcagcagcagcgaggagatcgtgcccagcccccccagccccccccccctgcccagaatctacaagccctgcttcgtgtgccaggacaagagcagcggctaccactacggcgtgagcgcctgcgagggctgcaagggcttcttcagaagaagcatccagaagaacatggtgtacacctgccacagagacaagaactgcatcatcaacaaggtgaccagaaacagatgccagtactgcagactgcagaagtgcttcgaggtgggcatgagcaaggagagcgtgagaaacgacagaaacaagaagaagaaggaggtgcccaagcccgagtgcagcgagagctacaccctgacccccgaggtgggcgagctgatcgagtgcgccaagagaaccagaaagcccagcctgcccagcgccagctgggccaacaccctgagaaccaccgcccagaacaacgtgagcctgtggaccctgaccagcggcaccagcagcgtgaacagccccaagtgcatcatcaagaccgtggagttcgccaagcagctgcccggcttcaccaccctgaccatcgccgaccagatcaccctgctgaaggccgcctgcctggacatcctgatcctgagaatctgcaccagatacacccccgagcaggacaccatgaccttcagcgacggcctgaccctgaacagaacccagatgcacaacgccggcttcggccccctgaccgacctggtgttcgccttcgccaaccagctgctgcccctggagatggacgacgccgagaccggcctgctgagcgccatctgcctgatctgcggcgacagacaggacctggagcagcccgacagagtggacatgctgcaggagcccctgctggaggccctgaaggtgtacgtgagaaagagaagacccagcagaccccacatgttccccaagatgctgatgaagatcaccgacctgagaagcatcagcgccaagggcgccgagagagtgatcaccctgaagatggagatccccggcagcatgccccccctgatccaggagatgctggagaacagcgagggcctggacaccctgagcggccagcccggcggcggcggcagagacggcggcggcctgcccagacaggccgccgtggcccccgccagcgcccccgcccccaccgaggccgccagaccccccacccccagagacagacccagacacatggacaccgccctggccctgagacccggcttcagcctgcccttctacagaccctgcgaccccgcccccgccctgcccccccccgccctgcccggcagcaccggcgacctgccctggggcaccggcagagaggaggccgccaccccctggaccgaggcctgggccctgagcggcctgcccgcccccaccgcctgggccgacgtgagaggcagaggccaggagctgagcgaggcccccggccccggcagccaggacggcagctggggccccagagtgcaccaggacacccccctgcccagcagcccccacctgcaccaccagcagacccccggcctgggcagccccatcctgagaacccacaagcccctgctgcccagctggggcaccagcaccagccccctgcccagactggtgaccgagggcgtgggccagggcagaggcgtgccccccgtgcacaccctgccctaccagccccaggtgctgatcctggccggcttcgtgttcatcctgatcttcctgttctag

SEQ ID NO: 96921 - DNA, 1374 bp, Artificial Sequence
  Description of Artificial Sequence: Synthetic coding sequence
atgtacgagagcgtggaggtgggcggccccacccccaaccccttcctggtggtggacttctacaaccagaacagagcctgcctgctgcccgagaagggcctgcccgcccccggcccctacagcacccccctgagaacccccctgtggaacggcagcaaccacagcatcgagacccagagcagcagcagcgaggagatcgtgcccagcccccccagccccccccccctgcccagaatctacaagccctgcttcgtgtgccaggacaagagcagcggctaccactacggcgtgagcgcctgcgagggctgcaagggcttcttcagaagaagcatccagaagaacatggtgtacacctgccacagagacaagaactgcatcatcaacaaggtgaccagaaacagatgccagtactgcagactgcagaagtgcttcgaggtgggcatgagcaaggagagcgtgagaaacgacagaaacaagaagaagaaggaggtgcccaagcccgagtgcagcgagagctacaccctgacccccgaggtgggcgagctgatcgagaaggtgagaaaggcccaccaggagaccttccccgccctgtgccagctgggcaagtacaccaccaacaacagcagcgagcagagagtgagcctggacatcgacctgtgggacaagttcagcgagctgagcaccaagtgcatcatcaagaccgtggagttcgccaagcagctgcccggcttcaccaccctgaccatcgccgaccagatcaccctgctgaaggccgcctgcctggacatcctgatcctgagaatctgcaccagatacacccccgagcaggacaccatgaccttcagcgacggcctgaccctgaacagaacccagatgcacaacgccggcttcggccccctgaccgacctggtgttcgccttcgccaaccagctgctgcccctggagatggacgacgccgagaccggcctgctgagcgccatctgcctgatctgcggcgacagacaggacctggagcagcccgacagagtggacatgctgcaggagcccctgctggaggccctgaaggtgtacgtgagaaagagaagacccagcagaccccacatgttccccaagatgctgatgaagatcaccgacctgagaagcatcagcgccaagggcgccgagagagtgatcaccctgaagatggagatccccggcagcatgccccccctgatccaggagatgctggagaacagcgagggcctggacaccctgagcggccagcccggcggcggcggcagagacggcggcggcctggcccccccccccggcagctgcagccccagcctgagccccagcagcaacagaagcagccccgccacccacagcccctag

SEQ ID NO: 96922 - DNA, 1437 bp, Artificial Sequence
  Description of Artificial Sequence: Synthetic coding sequence
atgatgagccagaccatgacccaggccggcgtgagcttcagacacagcgtgagagccgcccagtgccacaccagagtgcccaacacctggcccagagccaccagaccctacgccagctgcagaagaagccccagactgagaggcagatggcccggcagcgccggccagggcgccggcggcagagcccccagagccggctggagagccggcgacgtgaccggcagcgccatcgagacccagagcagcagcagcgaggagatcgtgcccagcccccccagccccccccccctgcccagaatctacaagccctgcttcgtgtgccaggacaagagcagcggctaccactacggcgtgagcgcctgcgagggctgcaagggcttcttcagaagaagcatccagaagaacatggtgtacacctgccacagagacaagaactgcatcatcaacaaggtgaccagaaacagatgccagtactgcagactgcagaagtgcttcgaggtgggcatgagcaaggagagcgtgagaaacgacagaaacaagaagaagaaggaggtgcccaagcccgagtgcagcgagagctacaccctgacccccgaggtgggcgagctgatcgagaaggtgagaaaggcccaccaggagaccttccccgccctgtgccagctgggcaagtacaccaccaacaacagcagcgagcagagagtgagcctggacatcgacctgtgggacaagttcagcgagctgagcaccaagtgcatcatcaagaccgtggagttcgccaagcagctgcccggcttcaccaccctgaccatcgccgaccagatcaccctgctgaaggccgcctgcctggacatcctgatcctgagaatctgcaccagatacacccccgagcaggacaccatgaccttcagcgacggcctgaccctgaacagaacccagatgcacaacgccggcttcggccccctgaccgacctggtgttcgccttcgccaaccagctgctgcccctggagatggacgacgccgagaccggcctgctgagcgccatctgcctgatctgcggcgacagacaggacctggagcagcccgacagagtggacatgctgcaggagcccctgctggaggccctgaaggtgtacgtgagaaagagaagacccagcagaccccacatgttccccaagatgctgatgaagatcaccgacctgagaagcatcagcgccaagggcgccgagagagtgatcaccctgaagatggagatccccggcagcatgccccccctgatccaggagatgctggagaacagcgagggcctggacaccctgagcggccagcccggcggcggcggcagagacggcggcggcctggcccccccccccggcagctgcagccccagcctgagccccagcagcaacagaagcagccccgccacccacagcccctag

SEQ ID NO: 96923 - DNA, 1389 bp, Artificial Sequence; identical to SEQ ID NO: 96919
  Description of Artificial Sequence: Synthetic coding sequence

SEQ ID NO: 96924 - DNA, 1041 bp, Artificial Sequence
  Description of Artificial Sequence: Synthetic coding sequence
atgggccaggagatcctgcccgccagaagccccaccctgagactgggcagccccaccccccacctgccccaggagctgctgagagccagccccaagggcccccccggcagactgcagctgggcggcctggccgtgagaaacgacagaaacaagaagaagaaggaggtgcccaagcccgagtgcagcgagagctacaccctgacccccgaggtgggcgagctgatcgagaaggtgagaaaggcccaccaggagaccttccccgccctgtgccagctgggcaagtacaccaccaacaacagcagcgagcagagagtgagcctggacatcgacctgtgggacaagttcagcgagctgagcaccaagtgcatcatcaagaccgtggagttcgccaagcagctgcccggcttcaccaccctgaccatcgccgaccagatcaccctgctgaaggccgcctgcctggacatcctgatcctgagaatctgcaccagatacacccccgagcaggacaccatgaccttcagcgacggcctgaccctgaacagaacccagatgcacaacgccggcttcggccccctgaccgacctggtgttcgccttcgccaaccagctgctgcccctggagatggacgacgccgagaccggcctgctgagcgccatctgcctgatctgcggcgacagacaggacctggagcagcccgacagagtggacatgctgcaggagcccctgctggaggccctgaaggtgtacgtgagaaagagaagacccagcagaccccacatgttccccaagatgctgatgaagatcaccgacctgagaagcatcagcgccaagggcgccgagagagtgatcaccctgaagatggagatccccggcagcatgccccccctgatccaggagatgctggagaacagcgagggcctggacaccctgagcggccagcccggcggcggcggcagagacggcggcggcctggcccccccccccggcagctgcagccccagcctgagccccagcagcaacagaagcagccccgccacctag

SEQ ID NO: 96925 - DNA, 1098 bp, Artificial Sequence
  Description of Artificial Sequence: Synthetic coding sequence
atggccagcaacagcagcagctgccccacccccggcggcggccacctgaacggctaccccgtgcccccctacgccttcttcttcccccccatgctgggcggcctgagcccccccggcgccctgaccaccctgcagcaccagctgcccgtgagcggctacagcacccccagccccgccaccgtgagaaacgacagaaacaagaagaagaaggaggtgcccaagcccgagtgcagcgagagctacaccctgacccccgaggtgggcgagctgatcgagaaggtgagaaaggcccaccaggagaccttccccgccctgtgccagctgggcaagtacaccaccaacaacagcagcgagcagagagtgagcctggacatcgacctgtgggacaagttcagcgagctgagcaccaagtgcatcatcaagaccgtggagttcgccaagcagctgcccggcttcaccaccctgaccatcgccgaccagatcaccctgctgaaggccgcctgcctggacatcctgatcctgagaatctgcaccagatacacccccgagcaggacaccatgaccttcagcgacggcctgaccctgaacagaacccagatgcacaacgccggcttcggccccctgaccgacctggtgttcgccttcgccaaccagctgctgcccctggagatggacgacgccgagaccggcctgctgagcgccatctgcctgatctgcggcgacagacaggacctggagcagcccgacagagtggacatgctgcaggagcccctgctggaggccctgaaggtgtacgtgagaaagagaagacccagcagaccccacatgttccccaagatgctgatgaagatcaccgacctgagaagcatcagcgccaagggcgccgagagagtgatcaccctgaagatggagatccccggcagcatgccccccctgatccaggagatgctggagaacagcgagggcctggacaccctgagcggccagcccggcggcggcggcagagacggcggcggcctggcccccccccccggcagctgcagccccagcctgagccccagcagcaacagaagcagccccgccacccacagcccctag

SEQ ID NO: 96926 - DNA, 1149 bp, Artificial Sequence
  Description of Artificial Sequence: Synthetic coding sequence
atggtgcccagcagccccagccccccccccccccccagagtgtacaagccctgcttcgtgtgcaacgacaagagcagcggctaccactacggcgtgagcagctgcgagggctgcaagggcttcttcagaagaagcatccagaagaacatggtgtacacctgccacagagacaagaactgcatcatcaacaaggtgaccagaaacagatgccagtactgcagactgcagaagtgcttcgaggtgggcatgagcaaggaggccgtgagaaacgacagaaacaagaagaagaaggaggtgaaggaggagggcagccccgacagctacgagctgagcccccagctggaggagctgatcaccaaggtgagcaaggcccaccaggagaccttccccagcctgtgccagctgggcaagtacaccaccaacagcagcgccgaccacagagtgcagctggacctgggcctgtgggacaagttcagcgagctggccaccaagtgcatcatcaagatcgtggagttcgccaagagactgcccggcttcaccggcctgagcatcgccgaccagatcaccctgctgaaggccgcctgcctggacatcctgatgctgagaatctgcaccagatacacccccgagcaggacaccatgaccttcagcgacggcctgaccctgaacagaacccagatgcacaacgccggcttcggccccctgaccgacctggtgttcgccttcgccggccagctgctgcccctggagatggacgacaccgagaccggcctgctgagcgccatctgcctgatctgcggcgacagaatggacctggaggagcccgagaaggtggacaagctgcaggagcccctgctggaggccctgagactgtacgccagaagaagaagacccagccagccctacatgttccccagaatgctgatgaagatcaccgacctgagaggcatcagcaccaagggcgccgagagagccatcaccctgaagatggagatccccggccccatgccccccctgatcagagagatgctggagaaccccgagatgttcgaggacgacagcagccagcccggcccccaccccaacgccagcagcgaggacgaggtgcccggcggccagggcaagggcggcctgaagagccccgcctag

SEQ ID NO: 96927 - DNA, 1332 bp, Artificial Sequence
  Description of Artificial Sequence: Synthetic coding sequence
atgtacgactgcatggagaccttcgcccccggccccagaagactgtacggcgccgccggccccggcgccggcctgctgagaagagccaccggcggcagctgcttcgccggcctggagagcttcgcctggccccagcccgccagcctgcagagcgtggagacccagagcaccagcagcgaggagatggtgcccagcagccccagccccccccccccccccagagtgtacaagccctgcttcgtgtgcaacgacaagagcagcggctaccactacggcgtgagcagctgcgagggctgcaagggcttcttcagaagaagcatccagaagaacatggtgtacacctgccacagagacaagaactgcatcatcaacaaggtgaccagaaacagatgccagtactgcagactgcagaagtgcttcgaggtgggcatgagcaaggaggccgtgagaaacgacagaaacaagaagaagaaggaggtgaaggaggagggcagccccgacagctacgagctgagcccccagctggaggagctgatcaccaaggtgagcaaggcccaccaggagaccttccccagcctgtgccagctgggcaagtacaccaccaacagcagcgccgaccacagagtgcagctggacctgggcctgtgggacaagttcagcgagctggccaccaagtgcatcatcaagatcgtggagttcgccaagagactgcccggcttcaccggcctgagcatcgccgaccagatcaccctgctgaaggccgcctgcctggacatcctgatgctgagaatctgcaccagatacacccccgagcaggacaccatgaccttcagcgacggcctgaccctgaacagaacccagatgcacaacgccggcttcggccccctgaccgacctggtgttcgccttcgccggccagctgctgcccctggagatggacgacaccgagaccggcctgctgagcgccatctgcctgatctgcggcgacagaatggacctggaggagcccgagaaggtggacaagctgcaggagcccctgctggaggccctgagactgtacgccagaagaagaagacccagccagccctacatgttccccagaatgctgatgaagatcaccgacctgagaggcatcagcaccaagggcgccgagagagccatcaccctgaagatggagatccccggccccatgccccccctgatcagagagatgctggagaaccccgagatgttcgaggacgacagcagccagcccggcccccaccccaacgccagcagcgaggacgaggtgcccggcggccagggcaagggcggcctgaagagccccgcctag

SEQ ID NO: 96928 - DNA, 1365 bp, Artificial Sequence
  Description of Artificial Sequence: Synthetic coding sequence
atggccaccaacaaggagagactgttcgccgccggcgccctgggccccggcagcggctaccccggcgccggcttccccttcgccttccccggcgccctgagaggcagcccccccttcgagatgctgagccccagcttcagaggcctgggccagcccgacctgcccaaggagatggccagcctgagcgtggagacccagagcaccagcagcgaggagatggtgcccagcagccccagccccccccccccccccagagtgtacaagccctgcttcgtgtgcaacgacaagagcagcggctaccactacggcgtgagcagctgcgagggctgcaagggcttcttcagaagaagcatccagaagaacatggtgtacacctgccacagagacaagaactgcatcatcaacaaggtgaccagaaacagatgccagtactgcagactgcagaagtgcttcgaggtgggcatgagcaaggaggccgtgagaaacgacagaaacaagaagaagaaggaggtgaaggaggagggcagccccgacagctacgagctgagcccccagctggaggagctgatcaccaaggtgagcaaggcccaccaggagaccttccccagcctgtgccagctgggcaagtacaccaccaacagcagcgccgaccacagagtgcagctggacctgggcctgtgggacaagttcagcgagctggccaccaagtgcatcatcaagatcgtggagttcgccaagagactgcccggcttcaccggcctgagcatcgccgaccagatcaccctgctgaaggccgcctgcctggacatcctgatgctgagaatctgcaccagatacacccccgagcaggacaccatgaccttcagcgacggcctgaccctgaacagaacccagatgcacaacgccggcttcggccccctgaccgacctggtgttcgccttcgccggccagctgctgcccctggagatggacgacaccgagaccggcctgctgagcgccatctgcctgatctgcggcgacagaatggacctggaggagcccgagaaggtggacaagctgcaggagcccctgctggaggccctgagactgtacgccagaagaagaagacccagccagccctacatgttccccagaatgctgatgaagatcaccgacctgagaggcatcagcaccaagggcgccgagagagccatcaccctgaagatggagatccccggccccatgccccccctgatcagagagatgctggagaaccccgagatgttcgaggacgacagcagccagcccggcccccaccccaacgccagcagcgaggacgaggtgcccggcggccagggcaagggcggcctgaagagccccgcctag

SEQ ID NO: 96929 - DNA, 1365 bp, Artificial Sequence; identical to SEQ ID NO: 96928
  Description of Artificial Sequence: Synthetic coding sequence

SEQ ID NO: 96930 - DNA, 306 bp, Artificial Sequence
  Description of Artificial Sequence: Synthetic coding sequence
caccaccaggacgagttcgccaagagactgcccggcttcaccggcctgagcatcgccgaccagatcaccctgctgaaggccgcctgcctggacatcctgatgctgagaatctgcaccagatacacccccgagcaggacaccatgaccttcagcgacggcctgaccctgaacagaacccagatgcacaacgccggcttcggccccctgaccgacctggtgttcgccttcgccggccagctgctgcccctggagatggacgacaccgagaccggcctgctgagcgccatctgcctgatctgcggctag

SEQ ID NO: 96931 - DNA, 1299 bp, Artificial Sequence
  Description of Artificial Sequence: Synthetic coding sequence
atgctggccctgcccctgcccccctgctggagcggcgccccccccggcgaggagggcgagagcgccgccggcccctggtgcttccagcaccccgtgagcctgcaggccggcagcagatgcaccaccgtgtggaagagactgcccagagtgagagacggctgcaccggcagacccggccccggccccgcctgctgcgccgagccccccgccgcccccgtgagccccgacctgaacctgctgcccggcagaaacccccccgcctgcaacggcttcttcagaagaagcatccagaagaacatggtgtacacctgccacagagacaagaactgcatcatcaacaaggtgaccagaaacagatgccagtactgcagactgcagaagtgcttcgaggtgggcatgagcaaggaggccgtgagaaacgacagaaacaagaagaagaaggaggtgaaggaggagggcagccccgacagctacgagctgagcccccagctggaggagctgatcaccaaggtgagcaaggcccaccaggagaccttccccagcctgtgccagctgggcaagtacaccaccaacagcagcgccgaccacagagtgcagctggacctgggcctgtgggacaagttcagcgagctggccaccaagtgcatcatcaagatcgtggagttcgccaagagactgcccggcttcaccggcctgagcatcgccgaccagatcaccctgctgaaggccgcctgcctggacatcctgatgctgagaatctgcaccagatacacccccgagcaggacaccatgaccttcagcgacggcctgaccctgaacagaacccagatgcacaacgccggcttcggccccctgaccgacctggtgttcgccttcgccggccagctgctgcccctggagatggacgacaccgagaccggcctgctgagcgccatctgcctgatctgcggcgacagaatggacctggaggagcccgagaaggtggacaagctgcaggagcccctgctggaggccctgagactgtacgccagaagaagaagacccagccagccctacatgttccccagaatgctgatgaagatcaccgacctgagaggcatcagcaccaagggcgccgagagagccatcaccctgaagatggagatccccggccccatgccccccctgatcagagagatgctggagaaccccgagatgttcgaggacgacagcagccagcccggcccccaccccaacgccagcagcgaggacgaggtgcccggcggccagggcaagggcggcctgaagagccccgcctag

SEQ ID NO: 96932 - DNA, 1389 bp, Artificial Sequence
  Description of Artificial Sequence: Synthetic coding sequence
atggacaccaagcacttcctgcccctggacttcagcacccaggtgaacagcagcctgaccagccccaccggcagaggcagcatggccgcccccagcctgcaccccagcctgggccccggcatcggcagccccggccagctgcacagccccatcagcaccctgagcagccccatcaacggcatgggcccccccttcagcgtgatcagcagccccatgggcccccacagcatgagcgtgcccaccacccccaccctgggcttcagcaccggcagcccccagctgagcagccccatgaaccccgtgagcagcagcgaggacatcaagccccccctgggcctgaacggcgtgctgaaggtgcccgcccaccccagcggcaacatggccagcttcaccaagcacatctgcgccatctgcggcgacagaagcagcggcaagcactacggcgtgtacagctgcgagggctgcaagggcttcttcaagagaaccgtgagaaaggacctgacctacacctgcagagacaacaaggactgcctgatcgacaagagacagagaaacagatgccagtactgcagataccagaagtgcctggccatgggcatgaagagagaggccgtgcaggaggagagacagagaggcaaggacagaaacgagaacgaggtggagagcaccagcagcgccaacgaggacatgcccgtggagagaatcctggaggccgagctggccgtggagcccaagaccgagacctacgtggaggccaacatgggcctgaaccccagcagccccaacgaccccgtgaccaacatctgccaggccgccgacaagcagctgttcaccctggtggagtgggccaagagaatcccccacttcagcgagctgcccctggacgaccaggtgatcctgctgagagccggctggaacgagctgctgatcgccagcttcagccacagaagcatcgccgtgaaggacggcatcctgctggccaccggcctgcacgtgcacagaaacagcgcccacagcgccggcgtgggcgccatcttcgacagagtgctgaccgagctggtgagcaagatgagagacatgcagatggacaagaccgagctgggctgcctgagagccatcgtgctgttcaaccccgacagcaagggcctgagcaaccccgccgaggtggaggccctgagagagaaggtgtacgccagcctggaggcctactgcaagcacaagtaccccgagcagcccggcagattcgccaagctgctgctgagactgcccgccctgagaagcatcggcctgaagtgcctggagcacctgttcttcttcaagctgatcggcgacacccccatcgacaccttcctgatggagatgctggaggccccccaccagatgacctag

SEQ ID NO: 96933 - DNA, 1098 bp, Artificial Sequence
  Description of Artificial Sequence: Synthetic coding sequence
atgaaccccgtgagcagcagcgaggacatcaagccccccctgggcctgaacggcgtgctgaaggtgcccgcccaccccagcggcaacatggccagcttcaccaagcacatctgcgccatctgcggcgacagaagcagcggcaagcactacggcgtgtacagctgcgagggctgcaagggcttcttcaagagaaccgtgagaaaggacctgacctacacctgcagagacaacaaggactgcctgatcgacaagagacagagaaacagatgccagtactgcagataccagaagtgcctggccatgggcatgaagagagaggccgtgcaggaggagagacagagaggcaaggacagaaacgagaacgaggtggagagcaccagcagcgccaacgaggacatgcccgtggagagaatcctggaggccgagctggccgtggagcccaagaccgagacctacgtggaggccaacatgggcctgaaccccagcagccccaacgaccccgtgaccaacatctgccaggccgccgacaagcagctgttcaccctggtggagtgggccaagagaatcccccacttcagcgagctgcccctggacgaccaggtgatcctgctgagagccggctggaacgagctgctgatcgccagcttcagccacagaagcatcgccgtgaaggacggcatcctgctggccaccggcctgcacgtgcacagaaacagcgcccacagcgccggcgtgggcgccatcttcgacagagtgctgaccgagctggtgagcaagatgagagacatgcagatggacaagaccgagctgggctgcctgagagccatcgtgctgttcaaccccgacagcaagggcctgagcaaccccgccgaggtggaggccctgagagagaaggtgtacgccagcctggaggcctactgcaagcacaagtaccccgagcagcccggcagattcgccaagctgctgctgagactgcccgccctgagaagcatcggcctgaagtgcctggagcacctgttcttcttcaagctgatcggcgacacccccatcgacaccttcctgatggagatgctggaggccccccaccagatgacctag

SEQ ID NO: 96934 - DNA, 1602 bp, Artificial Sequence
  Description of Artificial Sequence: Synthetic coding sequence
atgagctgggccgccagaccccccttcctgccccagagacacgccgccggccagtgcggccccgtgggcgtgagaaaggagatgcactgcggcgtggccagcagatggagaagaagaagaccctggctggaccccgccgccgccgccgccgccgccgtggccggcggcgagcagcagacccccgagcccgagcccggcgaggccggcagagacggcatgggcgacagcggcagagacagcagaagccccgacagcagcagccccaaccccctgccccagggcgtgcccccccccagcccccccggcccccccctgccccccagcaccgcccccagcctgggcggcagcggcgcccccccccccccccccatgccccccccccccctgggcagccccttccccgtgatcagcagcagcatgggcagccccggcctgcccccccccgccccccccggcttcagcggccccgtgagcagcccccagatcaacagcaccgtgagcctgcccggcggcggcagcggcccccccgaggacgtgaagccccccgtgctgggcgtgagaggcctgcactgcccccccccccccggcggccccggcgccggcaagagactgtgcgccatctgcggcgacagaagcagcggcaagcactacggcgtgtacagctgcgagggctgcaagggcttcttcaagagaaccatcagaaaggacctgacctacagctgcagagacaacaaggactgcaccgtggacaagagacagagaaacagatgccagtactgcagataccagaagtgcctggccaccggcatgaagagagaggccgtgcaggaggagagacagagaggcaaggacaaggacggcgacggcgagggcgccggcggcgcccccgaggagatgcccgtggacagaatcctggaggccgagctggccgtggagcagaagagcgaccagggcgtggagggccccggcggcaccggcggcagcggcagcagccccaacgaccccgtgaccaacatctgccaggccgccgacaagcagctgttcaccctggtggagtgggccaagagaatcccccacttcagcagcctgcccctggacgaccaggtgatcctgctgagagccggctggaacgagctgctgatcgccagcttcagccacagaagcatcgacgtgagagacggcatcctgctggccaccggcctgcacgtgcacagaaacagcgcccacagcgccggcgtgggcgccatcttcgacagagtgctgaccgagctggtgagcaagatgagagacatgagaatggacaagaccgagctgggctgcctgagagccatcatcctgttcaaccccgacgccaagggcctgagcaaccccagcgaggtggaggtgctgagagagaaggtgtacgccagcctggagacctactgcaagcagaagtaccccgagcagcagggcagattcgccaagctgctgctgagactgcccgccctgagaagcatcggcctgaagtgcctggagcacctgttcttcttcaagctgatcggcgacacccccatcgacaccttcctgatggagatgctggaggccccccaccagctggcctag

SEQ ID NO: 96935 - DNA, 1614 bp, Artificial Sequence
  Description of Artificial Sequence: Synthetic coding sequence
atgagctgggccgccagaccccccttcctgccccagagacacgccgccggccagtgcggccccgtgggcgtgagaaaggagatgcactgcggcgtggccagcagatggagaagaagaagaccctggctggaccccgccgccgccgccgccgccgccgtggccggcggcgagcagcagacccccgagcccgagcccggcgaggccggcagagacggcatgggcgacagcggcagagacagcagaagccccgacagcagcagccccaaccccctgccccagggcgtgcccccccccagcccccccggcccccccctgccccccagcaccgcccccagcctgggcggcagcggcgcccccccccccccccccatgccccccccccccctgggcagccccttccccgtgatcagcagcagcatgggcagccccggcctgcccccccccgccccccccggcttcagcggccccgtgagcagcccccagatcaacagcaccgtgagcctgcccggcggcggcagcggcccccccgaggacgtgaagccccccgtgctgggcgtgagaggcctgcactgcccccccccccccggcggccccggcgccggcaagagactgtgcgccatctgcggcgacagaagcagcggcaagcactacggcgtgtacagctgcgagggctgcaagggcttcttcaagagaaccatcagaaaggacctgacctacagctgcagagacaacaaggactgcaccgtggacaagagacagagaaacagatgccagtactgcagataccagaagtgcctggccaccggcatgaagagagaggccgtgcaggaggagagacagagaggcaaggacaaggacggcgacggcgagggcgccggcggcgcccccgaggagatgcccgtggacagaatcctggaggccgagctggccgtggagcagaagagcgaccagggcgtggagggccccggcggcaccggcggcagcggcagcagccccaacgaccccgtgaccaacatctgccaggccgccgacaagcagctgttcaccctggtggagtgggccaagagaatcccccacttcagcagcctgcccctggacgaccaggtgatcctgctgagagccggctggaacgagctgctgatcgccagcttcagccacagaagcatcgacgtgagagacggcatcctgctggccaccggcctgcacgtgcacagaaacagcgcccacagcgccggcgtgggcgccatcttcgacagaagcctgagcagagtgctgaccgagctggtgagcaagatgagagacatgagaatggacaagaccgagctgggctgcctgagagccatcatcctgttcaaccccgacgccaagggcctgagcaaccccagcgaggtggaggtgctgagagagaaggtgtacgccagcctggagacctactgcaagcagaagtaccccgagcagcagggcagattcgccaagctgctgctgagactgcccgccctgagaagcatcggcctgaagtgcctggagcacctgttcttcttcaagctgatcggcgacacccccatcgacaccttcctgatggagatgctggaggccccccaccagctggcctag

SEQ ID NO: 96936 - DNA, 1614 bp, Artificial Sequence; identical to SEQ ID NO: 96935
  Description of Artificial Sequence: Synthetic coding sequence

SEQ ID NO: 96937 - DNA, 1602 bp, Artificial Sequence; identical to SEQ ID NO: 96934
  Description of Artificial Sequence: Synthetic coding sequence

SEQ ID NO: 96938 - DNA, 861 bp, Artificial Sequence
  Description of Artificial Sequence: Synthetic coding sequence
atgccccagggcagcgtgggcagatggggctgcgagaagaagtgcatcgtgggcagcagacccggcggcggcggcgacggccccggctggatcccccagagaagaagaagaagaagatggcaggccgagaacaacaagcccagaagcagaagccagggcagactggacggcaccggctgggccaccgccggcggcatcaacagcaccgtgagcctgcccggcggcggcagcggcccccccgaggacgtgaagccccccgtgctgggcgtgagaggcctgcactgcccccccccccccggcggccccggcgccggcaagagactgtgcgccatctgcggcgacagaagcagcggcaagcactacggcgtgtacagctgcgagggctgcaagggcttcttcaagagaaccatcagaaaggacctgacctacagctgcagagacaacaaggactgcaccgtggacaagagacagagaaacagatgccagtactgcagataccagaagtgcctggccaccggcatgaagagagaggccgtgcaggaggagagacagagaggcaaggacaaggacggcgacggcgagggcgccggcggcgcccccgaggagatgcccgtggacagaatcctggaggccgagctggccgtggagcagaagagcgaccagggcgtggagggccccggcggcaccggcggcagcggcagcagcgtgagcgtgggcgtgaaccccctgagcttcgtgatgggcgtgggcggcggcagcctgggcctgttctacatccccagccccagcttccccctgatcaccttcctgaccctgctgggcaccggcggcgccgccaagcagggcctgagcaacatctag

SEQ ID NO: 96939 - DNA, 1602 bp, Artificial Sequence; identical to SEQ ID NO: 96934
  Description of Artificial Sequence: Synthetic coding sequence

SEQ ID NO: 96940 - DNA, 291 bp, Artificial Sequence
  Description of Artificial Sequence: Synthetic coding sequence
tgaagccccaacgaccccgtgaccaacatctgccaggccgccgacaagcagctgttcaccctggtggagtgggccaagagaatcccccacttcagcagcctgcccctggacgaccaggtgatcctgctgagagccggcctgcacgtgcacagaaacagcgcccacagcgccggcgtgggcgccatcttcgacagagtgctgaccgagctggtgagcaagatgagagacatgagaatggacaagaccgagctgggctgcctgagagccatcatcctgttcaaccccgactag

SEQ ID NO: 96941 - DNA, 1602 bp, Artificial Sequence; identical to SEQ ID NO: 96934
  Description of Artificial Sequence: Synthetic coding sequence

SEQ ID NO: 96942 - DNA, 291 bp, Artificial Sequence; identical to SEQ ID NO: 96940
  Description of Artificial Sequence: Synthetic coding sequence

SEQ ID NO: 96943 - DNA, 1614 bp, Artificial Sequence; identical to SEQ ID NO: 96935
  Description of Artificial Sequence: Synthetic coding sequence

SEQ ID NO: 96944 - DNA, 1602 bp, Artificial Sequence; identical to SEQ ID NO: 96934
  Description of Artificial Sequence: Synthetic coding sequence

SEQ ID NO: 96945 - DNA, 1602 bp, Artificial Sequence; identical to SEQ ID NO: 96934
  Description of Artificial Sequence: Synthetic coding sequence

SEQ ID NO: 96946 - DNA, 291 bp, Artificial Sequence; identical to SEQ ID NO: 96940
  Description of Artificial Sequence: Synthetic coding sequence

SEQ ID NO: 96947 - DNA, 291 bp, Artificial Sequence; identical to SEQ ID NO: 96940
  Description of Artificial Sequence: Synthetic coding sequence

SEQ ID NO: 96948 - DNA, 1614 bp, Artificial Sequence; identical to SEQ ID NO: 96935
  Description of Artificial Sequence: Synthetic coding sequence

SEQ ID NO: 96949 - DNA, 291 bp, Artificial Sequence; identical to SEQ ID NO: 96940
  Description of Artificial Sequence: Synthetic coding sequence

SEQ ID NO: 96950 - DNA, 1614 bp, Artificial Sequence; identical to SEQ ID NO: 96935
  Description of Artificial Sequence: Synthetic coding sequence

SEQ ID NO: 96951 - DNA, 1614 bp, Artificial Sequence; identical to SEQ ID NO: 96935
  Description of Artificial Sequence: Synthetic coding sequence

SEQ ID NO: 96952 - DNA, 1044 bp, Artificial Sequence
  Description of Artificial Sequence: Synthetic coding sequence
atgagagagtgcggcggcggccccggcgccggcaagagactgtgcgccatctgcggcgacagaagcagcggcaagcactacggcgtgtacagctgcgagggctgcaagggcttcttcaagagaaccatcagaaaggacctgacctacagctgcagagacaacaaggactgcaccgtggacaagagacagagaaacagatgccagtactgcagataccagaagtgcctggccaccggcatgaagagagaggccgtgcaggaggagagacagagaggcaaggacaaggacggcgacggcgagggcgccggcggcgcccccgaggagatgcccgtggacagaatcctggaggccgagctggccgtggagcagaagagcgaccagggcgtggagggccccggcggcaccggcggcagcggcagcagccccaacgaccccgtgaccaacatctgccaggccgccgacaagcagctgttcaccctggtggagtgggccaagagaatcccccacttcagcagcctgcccctggacgaccaggtgatcctgctgagagccggctggaacgagctgctgatcgccagcttcagccacagaagcatcgacgtgagagacggcatcctgctggccaccggcctgcacgtgcacagaaacagcgcccacagcgccggcgtgggcgccatcttcgacagaagcctgagcagagtgctgaccgagctggtgagcaagatgagagacatgagaatggacaagaccgagctgggctgcctgagagccatcatcctgttcaaccccgacgccaagggcctgagcaaccccagcgaggtggaggtgctgagagagaaggtgtacgccagcctggagacctactgcaagcagaagtaccccgagcagcagggcagattcgccaagctgctgctgagactgcccgccctgagaagcatcggcctgaagtgcctggagcacctgttcttcttcaagctgatcggcgacacccccatcgacaccttcctgatggagatgctggaggccccccaccagctggcctag

SEQ ID NO: 96953 - DNA, 1179 bp, Artificial Sequence
  Description of Artificial Sequence: Synthetic coding sequence
atgggcagccccggcctgcccccccccgccccccccggcttcagcggccccgtgagcagcccccagatcaacagcaccgtgagcctgcccggcggcggcagcggcccccccgaggacgtgaagccccccgtgctgggcgtgagaggcctgcactgcccccccccccccggcggccccggcgccggcaagagactgtgcgccatctgcggcgacagaagcagcggcaagcactacggcgtgtacagctgcgagggctgcaagggcttcttcaagagaaccatcagaaaggacctgacctacagctgcagagacaacaaggactgcaccgtggacaagagacagagaaacagatgccagtactgcagataccagaagtgcctggccaccggcatgaagagagaggccgtgcaggaggagagacagagaggcaaggacaaggacggcgacggcgagggcgccggcggcgcccccgaggagatgcccgtggacagaatcctggaggccgagctggccgtggagcagaagagcgaccagggcgtggagggccccggcggcaccggcgcccccagccccaacgaccccgtgaccaacatctgccaggccgccgacaagcagctgttcaccctggtggagtgggccaagagaatcccccacttcagcagcctgcccctggacgaccaggtgatcctgctgagagccggctggaacgagctgctgatcgccagcttcagccacagaagcatcgacgtgagagacggcatcctgctggccaccggcctgcacgtgcacagaaacagcgcccacagcgccggcgtgggcgccatcttcgacagagtgctgaccgagctggtgagcaagatgagagacatgagaatggacaagaccgagctgggctgcctgagagccatcatcctgttcaaccccgacgccaagggcctgagcaaccccagcgaggtggaggtgctgagagagaaggtgtacgccagcctggagacctactgcaagcagaagtaccccgagcagcagggcagattcgccaagctgctgctgagactgcccgccctgagaagcatcggcctgaagtgcctggagcacctgttcttcttcaagctgatcggcgacacccccatcgacaccttcctgatggagatgctggaggccccccaccagctggcctag

SEQ ID NO: 96954 - DNA, 1170 bp, Artificial Sequence
  Description of Artificial Sequence: Synthetic coding sequence
atgggcagccccggcctgcccccccccgccccccccggcttcagcggccccgtgagcagcccccagatcaacagcaccgtgagcctgcccggcggcggcagcggcccccccgaggacgtgaagccccccgtgctgggcgtgagaggcctgcactgcccccccccccccggcggccccggcgccggcaagagactgtgcgccatctgcggcgacagaagcagcggcaagcactacggcgtgtacagctgcgagggctgcaagggcttcttcaagagaaccatcagaaaggacctgacctacagctgcagagacaacaaggactgcaccgtggacaagagacagagaaacagatgccagtactgcagataccagaagtgcctggccaccggcatgaagagagaggccgtgcaggaggagagacagagaggcaaggacaaggacggcgacggcgagggcgccggcggcgcccccgaggagatgcccgtggacagaatcctggaggccgagctggccgtggagcagaagagcgaccagggcggcagccagcacatcagcaagagccccaacgaccccgtgaccaacatctgccaggccgccgacaagcagctgttcaccctggtggagtgggccaagagaatcccccacttcagcagcctgcccctggacgaccaggtgatcctgctgagagccggctggaacgagctgctgatcgccagcttcagccacagaagcatcgacgtgagagacggcatcctgctggccaccggcctgcacgtgcacagaaacagcgcccacagcgccggcgtgggcgccatcttcgacagagtgctgaccgagctggtgagcaagatgagagacatgagaatggacaagaccgagctgggctgcctgagagccatcatcctgttcaaccccgacgccaagggcctgagcaaccccagcgaggtggaggtgctgagagagaaggtgtacgccagcctggagacctactgcaagcagaagtaccccgagcagcagggcagattcgccaagctgctgctgagactgcccgccctgagaagcatcggcctgaagtgcctggagcacctgttcttcttcaagctgatcggcgacacccccatcgacaccttcctgatggagatgctggaggccccccaccagctggcctag

SEQ ID NO: 96955 - DNA, 1044 bp, Artificial Sequence; identical to SEQ ID NO: 96952
  Description of Artificial Sequence: Synthetic coding sequence

SEQ ID NO: 96956 - DNA, 1179 bp, Artificial Sequence; identical to SEQ ID NO: 96953
  Description of Artificial Sequence: Synthetic coding sequence

SEQ ID NO: 96957 - DNA, 1170 bp, Artificial Sequence; identical to SEQ ID NO: 96954
  Description of Artificial Sequence: Synthetic coding sequence

SEQ ID NO: 96958 - DNA, 861 bp, Artificial Sequence; identical to SEQ ID NO: 96938
  Description of Artificial Sequence: Synthetic coding sequence

SEQ ID NO: 96959 - DNA, 1170 bp, Artificial Sequence; identical to SEQ ID NO: 96954
  Description of Artificial Sequence: Synthetic coding sequence

SEQ ID NO: 96960 - DNA, 861 bp, Artificial Sequence; identical to SEQ ID NO: 96938
  Description of Artificial Sequence: Synthetic coding sequence

SEQ ID NO: 96961 - DNA, 1179 bp, Artificial Sequence; identical to SEQ ID NO: 96953
  Description of Artificial Sequence: Synthetic coding sequence

SEQ ID NO: 96962 - DNA, 1044 bp, Artificial Sequence; identical to SEQ ID NO: 96952
  Description of Artificial Sequence: Synthetic coding sequence

SEQ ID NO: 96963 - DNA, 1179 bp, Artificial Sequence; identical to SEQ ID NO: 96953
  Description of Artificial Sequence: Synthetic coding sequence

SEQ ID NO: 96964 - DNA, 1179 bp, Artificial Sequence; identical to SEQ ID NO: 96953
  Description of Artificial Sequence: Synthetic coding sequence

SEQ ID NO: 96965 - DNA, 861 bp, Artificial Sequence; identical to SEQ ID NO: 96938
  Description of Artificial Sequence: Synthetic coding sequence

SEQ ID NO: 96966 - DNA, 1170 bp, Artificial Sequence; identical to SEQ ID NO: 96954
  Description of Artificial Sequence: Synthetic coding sequence

SEQ ID NO: 96967 - DNA, 1044 bp, Artificial Sequence; identical to SEQ ID NO: 96952
  Description of Artificial Sequence: Synthetic coding sequence

SEQ ID NO: 96968 - DNA, 1170 bp, Artificial Sequence; identical to SEQ ID NO: 96954
  Description of Artificial Sequence: Synthetic coding sequence

SEQ ID NO: 96969 - DNA, 1044 bp, Artificial Sequence; identical to SEQ ID NO: 96952
  Description of Artificial Sequence: Synthetic coding sequence

SEQ ID NO: 96970 - DNA, 861 bp, Artificial Sequence; identical to SEQ ID NO: 96938
  Description of Artificial Sequence: Synthetic coding sequence

SEQ ID NO: 96971 - DNA, 1392 bp, Artificial Sequence
  Description of Artificial Sequence: Synthetic coding sequence
atgtacggcaactacagccacttcatgaagttccccgccggctacggcggcagccccggccacaccggcagcaccagcatgagccccagcgccgccctgagcaccggcaagcccatggacagccaccccagctacaccgacacccccgtgagcgcccccagaaccctgagcgccgtgggcacccccctgaacgccctgggcagcccctacagagtgatcaccagcgccatgggcccccccagcggcgccctggccgccccccccggcatcaacctggtggccccccccagcagccagctgaacgtggtgaacagcgtgagcagcagcgaggacatcaagcccctgcccggcctgcccggcatcggcaacatgaactaccccagcaccagccccggcagcctggtgaagcacatctgcgccatctgcggcgacagaagcagcggcaagcactacggcgtgtacagctgcgagggctgcaagggcttcttcaagagaaccatcagaaaggacctgatctacacctgcagagacaacaaggactgcctgatcgacaagagacagagaaacagatgccagtactgcagataccagaagtgcctggtgatgggcatgaagagagaggccgtgcaggaggagagacagagaagcagagagagagccgagagcgaggccgagtgcgccaccagcggccacgaggacatgcccgtggagagaatcctggaggccgagctggccgtggagcccaagaccgagagctacggcgacatgaacatggagaacagcaccaacgaccccgtgaccaacatctgccacgccgccgacaagcagctgttcaccctggtggagtgggccaagagaatcccccacttcagcgacctgaccctggaggaccaggtgatcctgctgagagccggctggaacgagctgctgatcgccagcttcagccacagaagcgtgagcgtgcaggacggcatcctgctggccaccggcctgcacgtgcacagaagcagcgcccacagcgccggcgtgggcagcatcttcgacagagtgctgaccgagctggtgagcaagatgaaggacatgcagatggacaagagcgagctgggctgcctgagagccatcgtgctgttcaaccccgacgccaagggcctgagcaaccccagcgaggtggagaccctgagagagaaggtgtacgccaccctggaggcctacaccaagcagaagtaccccgagcagcccggcagattcgccaagctgctgctgagactgcccgccctgagaagcatcggcctgaagtgcctggagcacctgttcttcttcaagctgatcggcgacacccccatcgacaccttcctgatggagatgctggagacccccctgcagatcacctag

SEQ ID NO: 96972 - DNA, 2619 bp, Artificial Sequence
  Description of Artificial Sequence: Synthetic coding sequence
atggccaccgcctgcaagagaagcggcgagccccagagcgacgacatcgaggccagcagaatgaagagagccgccgccaagcacctgatcgagagatactaccaccagctgaccgagggctgcggcaacgaggcctgcaccaacgagttctgcgccagctgccccaccttcctgagaatggacaacaacgccgccgccatcaaggccctggagctgtacaagatcaacgccaagctgtgcgacccccaccccagcaagaagggcgccagcagcgcctacctggagaacagcaagggcgcccccaacaacagctgcagcgagatcaagatgaacaagaagggcgccagaatcgacttcaaggacgtgacctacctgaccgaggagaaggtgtacgagatcctggagctgtgcagagagagagaggactacagccccctgatcagagtgatcggcagagtgttcagcagcgccgaggccctggtgcagagcttcagaaaggtgaagcagcacaccaaggaggagctgaagagcctgcaggccaaggacgaggacaaggacgaggacgagaaggagaaggccgcctgcagcgccgccgccatggaggaggacagcgaggccagcagcagcagaatcggcgacagcagccagggcgacaacaacctgcagaagctgggccccgacgacgtgagcgtggacatcgacgccatcagaagagtgtacaccagactgctgagcaacgagaagatcgagaccgccttcctgaacgccctggtgtacctgagccccaacgtggagtgcgacctgacctaccacaacgtgtacagcagagaccccaactacctgaacctgttcatcatcgtgatggagaacagaaacctgcacagccccgagtacctggagatggccctgcccctgttctgcaaggccatgagcaagctgcccctggccgcccagggcaagctgatcagactgtggagcaagtacaacgccgaccagatcagaagaatgatggagaccttccagcagctgatcacctacaaggtgatcagcaacgagttcaacagcagaaacctggtgaacgacgacgacgccatcgtggccgccagcaagtgcctgaagatggtgtactacgccaacgtggtgggcggcgaggtggacaccaaccacaacgaggaggacgacgaggagcccatccccgagagcagcgagctgaccctgcaggagctgctgggcgaggagagaagaaacaagaagggccccagagtggaccccctggagaccgagctgggcgtgaagaccctggactgcagaaagcccctgatccccttcgaggagttcatcaacgagcccctgaacgaggtgctggagatggacaaggactacaccttcttcaaggtggagaccgagaacaagttcagcttcatgacctgccccttcatcctgaacgccgtgaccaagaacctgggcctgtactacgacaacagaatcagaatgtacagcgagagaagaatcaccgtgctgtacagcctggtgcagggccagcagctgaacccctacctgagactgaaggtgagaagagaccacatcatcgacgacgccctggtgagactggagatgatcgccatggagaaccccgccgacctgaagaagcagctgtacgtggagttcgagggcgagcagggcgtggacgagggcggcgtgagcaaggagttcttccagctggtggtggaggagatcttcaaccccgacatcggcatgttcacctacgacgagagcaccaagctgttctggttcaaccccagcagcttcgagaccgagggccagttcaccctgatcggcatcgtgctgggcctggccatctacaacaactgcatcctggacgtgcacttccccatggtggtgtacagaaagctgatgggcaagaagggcaccttcagagacctgggcgacagccaccccgtgctgtaccagagcctgaaggacctgctggagtacgagggcaacgtggaggacgacatgatgatcaccttccagatcagccagaccgacctgttcggcaaccccatgatgtacgacctgaaggagaacggcgacaagatccccatcaccaacgagaacagaaaggagttcgtgaacctgtacagcgactacatcctgaacaagagcgtggagaagcagttcaaggccttcagaagaggcttccacatggtgaccaacgagagccccctgaagtacctgttcagacccgaggagatcgagctgctgatctgcggcagcagaaacctggacttccaggccctggaggagaccaccgagtacgacggcggctacaccagagacagcgtgctgatcagagagttctgggagatcgtgcacagcttcaccgacgagcagaagagactgttcctgcagttcaccaccggcaccgacagagcccccgtgggcggcctgggcaagctgaagatgatcatcgccaagaacggccccgacaccgagagactgcccaccagccacacctgcttcaacgtgctgctgctgcccgagtacagcagcaaggagaagctgaaggagagactgctgaaggccatcacctacgccaagggcttcggcatgctgtag

SEQ ID NO: 96973 - DNA, 75 bp, Artificial Sequence
  Description of Artificial Sequence: Synthetic coding sequence
atgaccagagaccagaacggcacctgggagatggagagcaacgagaacttcgagggctacatgaaggccctgtag

SEQ ID NO: 96974 - DNA, 312 bp, Artificial Sequence
  Description of Artificial Sequence: Synthetic coding sequence
atgaccagagaccagaacggcacctgggagatggagagcaacgagaacttcgagggctacatgaaggccctggacatcgacttcgccaccagaaagatcgccgtgagactgacccagaccaaggtgatcgaccaggacggcgacaacttcaagaccaagaccaccagcaccttcagaaactacgacgtggacttcaccgtgggcgtggagttcgacgagtacaccaagagcctggacaacagacacgtgaaggccctggtgacctgggagggcgacgtgctggtgtgcgtgcagaagggcgagaaggagtag

SEQ ID NO: 96975 - DNA, 1494 bp, Artificial Sequence
  Description of Artificial Sequence: Synthetic coding sequence
atgggcctgcccgccctgctggccagcgccctgtgcaccttcgtgctgcccctgctgctgttcctggccgccatcaagctgtgggacctgtactgcgtgagcggcagagacagaagctgcgccctgcccctgccccccggcaccatgggcttccccttcttcggcgagaccctgcagatggtgctgcagagaagaaagttcctgcagatgaagagaagaaagtacggcttcatctacaagacccacctgttcggcagacccaccgtgagagtgatgggcgccgacaacgtgagaagaatcctgctgggcgagcacagactggtgagcgtgcactggcccgccagcgtgagaaccatcctgggcagcggctgcctgagcaacctgcacgacagcagccacaagcagagaaagaaggtgatcatgagagccttcagcagagaggccctggagtgctacgtgcccgtgatcaccgaggaggtgggcagcagcctggagcagtggctgagctgcggcgagagaggcctgctggtgtaccccgaggtgaagagactgatgttcagaatcgccatgagaatcctgctgggctgcgagccccagctggccggcgacggcgacagcgagcagcagctggtggaggccttcgaggagatgaccagaaacctgttcagcctgcccatcgacgtgcccttcagcggcctgtacagaggcatgaaggccagaaacctgatccacgccagaatcgagcagaacatcagagccaagatctgcggcctgagagccagcgaggccggccagggctgcaaggacgccctgcagctgctgatcgagcacagctgggagagaggcgagagactggacatgcaggccctgaagcagagcagcaccgagctgctgttcggcggccacgagaccaccgccagcgccgccaccagcctgatcacctacctgggcctgtacccccacgtgctgcagaaggtgagagaggagctgaagagcaagggcctgctgtgcaagagcaaccaggacaacaagctggacatggagatcctggagcagctgaagtacatcggctgcgtgatcaaggagaccctgagactgaacccccccgtgcccggcggcttcagagtggccctgaagaccttcgagctgaacggctaccagatccccaagggctggaacgtgatctacagcatctgcgacacccacgacgtggccgagatcttcaccaacaaggaggagttcaaccccgacagattcatgctgccccaccccgaggacgccagcagattcagcttcatccccttcggcggcggcctgagaagctgcgtgggcaaggagttcgccaagatcctgctgaagatcttcaccgtggagctggccagacactgcgactggcagctgctgaacggcccccccaccatgaagaccagccccaccgtgtaccccgtggacaacctgcccgccagattcacccacttccacggcgagatctag

SEQ ID NO: 96976 - DNA, 600 bp, Artificial Sequence
  Description of Artificial Sequence: Synthetic coding sequence
atgaactacagcaagatccccgcccaggtggacctgagaagacagaccgagagagactgcagagtgagcagcttcagagtgaaggagaacttcgacaaggccagattcagcggcacctggtacgccatggccaagaaggaccccgagggcctgttcctgcaggacaacatcgtggccgagttcagcgtggacgagaccggccagatgagcgccaccgccaagggcagagtgagactgctgaacaactgggacgtgtgcgccgacatggtgggcaccttcaccgacaccgaggaccccgccaagttcaagatgaagtactggggcgtggccagcttcctgcagaagggcaacgacgaccactggatcgtggacaccgactacgacacctacgccgtgcagtacagctgcagactgctgaacctggacggcacctgcgccgacagctacagcttcgtgttcagcagagaccccaacggcctgccccccgaggcccagaagatcgtgagacagagacaggaggagctgtgcctggccagacagtacagactgatcgtgcacaacggctactgcgacggcagaagcgagagaaacctgctgtag

SEQ ID NO: 96977 - DNA, 606 bp, Artificial Sequence
  Description of Artificial Sequence: Synthetic coding sequence
atgaagtgggtgtgggccctgctgctgctggccgccctgggcagcggcagagccgagagagactgcagagtgagcagcttcagagtgaaggagaacttcgacaaggccagattcagcggcacctggtacgccatggccaagaaggaccccgagggcctgttcctgcaggacaacatcgtggccgagttcagcgtggacgagaccggccagatgagcgccaccgccaagggcagagtgagactgctgaacaactgggacgtgtgcgccgacatggtgggcaccttcaccgacaccgaggaccccgccaagttcaagatgaagtactggggcgtggccagcttcctgcagaagggcaacgacgaccactggatcgtggacaccgactacgacacctacgccgtgcagtacagctgcagactgctgaacctggacggcacctgcgccgacagctacagcttcgtgttcagcagagaccccaacggcctgccccccgaggcccagaagatcgtgagacagagacaggaggagctgtgcctggccagacagtacagactgatcgtgcacaacggctactgcgacggcagaagcgagagaaacctgctgtag

SEQ ID NO: 96978 - DNA, 606 bp, Artificial Sequence; identical to SEQ ID NO: 96977
  Description of Artificial Sequence: Synthetic coding sequence

SEQ ID NO: 96979 - DNA, 600 bp, Artificial Sequence
  Description of Artificial Sequence: Synthetic coding sequence
atgaactacagcaagatccccgcccaggtggacctgagaagacaggccgagagagactgcagagtgagcagcttcagagtgaaggagaacttcgacaaggccagattcagcggcacctggtacgccatggccaagaaggaccccgagggcctgttcctgcaggacaacatcgtggccgagttcagcgtggacgagaccggccagatgagcgccaccgccaagggcagagtgagactgctgaacaactgggacgtgtgcgccgacatggtgggcaccttcaccgacaccgaggaccccgccaagttcaagatgaagtactggggcgtggccagcttcctgcagaagggcaacgacgaccactggatcgtggacaccgactacgacacctacgccgtgcagtacagctgcagactgctgaacctggacggcacctgcgccgacagctacagcttcgtgttcagcagagaccccaacggcctgccccccgaggcccagaagatcgtgagacagagacaggaggagctgtgcctggccagacagtacagactgatcgtgcacaacggctactgcgacggcagaagcgagagaaacctgctgtag

SEQ ID NO: 96980 - DNA, 408 bp, Artificial Sequence
  Description of Artificial Sequence: Synthetic coding sequence
atgccccccaacctgaccggctactacagattcgtgagccagaagaacatggaggactacctgcaggccctgaacatcagcctggccgtgagaaagatcgccctgctgctgaagcccgacaaggagatcgagcaccagggcaaccacatgaccgtgagaaccctgagcaccttcagaaactacaccgtgcagttcgacgtgggcgtggagttcgaggaggacctgagaagcgtggacggcagaaagtgccagaccatcgtgacctgggaggaggagcacctggtgtgcgtgcagaagggcgaggtgcccaacagaggctggagacactggctggagggcgagatgctgtacctggagctgaccgccagagacgccgtgtgcgagcaggtgttcagaaaggtgagatag

SEQ ID NO: 96981 - DNA, 1026 bp, Artificial Sequence
  Description of Artificial Sequence: Synthetic coding sequence
atgaacatcgtggtggagttcttcgtggtgaccttcaaggtgctgtgggccttcgtgctggccgccgccagatggctggtgagacccaaggagaagagcgtggccggccaggtgtgcctgatcaccggcgccggcagcggcctgggcagactgttcgccctggagttcgccagaagaagagccctgctggtgctgtgggacatcaacacccagagcaacgaggagaccgccggcatggtgagacacatctacagagacctggaggccgccgacgccgccgccctgcaggccggcaacggcgaggaggagatcctgccccactgcaacctgcaggtgttcacctacacctgcgacgtgggcaagagagagaacgtgtacctgaccgccgagagagtgagaaaggaggtgggcgaggtgagcgtgctggtgaacaacgccggcgtggtgagcggccaccacctgctggagtgccccgacgagctgatcgagagaaccatgatggtgaactgccacgcccacttctggaccaccaaggccttcctgcccaccatgctggagatcaaccacggccacatcgtgaccgtggccagcagcctgggcctgttcagcaccgccggcgtggaggactactgcgccagcaagttcggcgtggtgggcttccacgagagcctgagccacgagctgaaggccgccgagaaggacggcatcaagaccaccctggtgtgcccctacctggtggacaccggcatgttcagaggctgcagaatcagaaaggagatcgagcccttcctgccccccctgaagcccgactactgcgtgaagcaggccatgaaggccatcctgaccgaccagcccatgatctgcacccccagactgatgtacatcgtgaccttcatgaagagcatcctgcccttcgaggccgtggtgtgcatgtacagattcctgggcgccgacaagtgcatgtaccccttcatcgcccagagaaagcaggccaccaacaacaacgaggccaagaacggcatctag

SEQ ID NO: 96982 - DNA, 957 bp, Artificial Sequence
  Description of Artificial Sequence: Synthetic coding sequence
atggtggagctgatgttccccctgctgctgctgctgctgcccttcctgctgtacatggccgccccccagatcagaaagatgctgagcagcggcgtgtgcaccagcaccgtgcagctgcccggcaaggtggtggtggtgaccggcgccaacaccggcatcggcaaggagaccgccaaggagctggcccagagaggcgccagagtgtacctggcctgcagagacgtggagaagggcgagctggtggccaaggagatccagaccaccaccggcaaccagcaggtgctggtgagaaagctggacctgagcgacaccaagagcatcagagccttcgccaagggcttcctggccgaggagaagcacctgcacgtgctgatcaacaacgccggcgtgatgatgtgcccctacagcaagaccgccgacggcttcgagatgcacatcggcgtgaaccacctgggccacttcctgctgacccacctgctgctggagaagctgaaggagagcgcccccagcagaatcgtgaacgtgagcagcctggcccaccacctgggcagaatccacttccacaacctgcagggcgagaagttctacaacgccggcctggcctactgccacagcaagctggccaacatcctgttcacccaggagctggccagaagactgaagggcagcggcgtgaccacctacagcgtgcaccccggcaccgtgcagagcgagctggtgagacacagcagcttcatgagatggatgtggtggctgttcagcttcttcatcaagaccccccagcagggcgcccagaccagcctgcactgcgccctgaccgagggcctggagatcctgagcggcaaccacttcagcgactgccacgtggcctgggtgagcgcccaggccagaaacgagaccatcgccagaagactgtgggacgtgagctgcgacctgctgggcctgcccatcgactag

SEQ ID NO: 96983 - DNA, 918 bp, Artificial Sequence
  Description of Artificial Sequence: Synthetic coding sequence
atggtggagctgatgttccccctgctgctgctgctgctgcccttcctgctgtacatggccgccccccagatcagaaagatgctgagcagcggcgtgtgcaccagcaccgtgcagctgcccggcaaggtggtggtggtgaccggcgccaacaccggcgccagagtgtacctggcctgcagagacgtggagaagggcgagctggtggccaaggagatccagaccaccaccggcaaccagcaggtgctggtgagaaagctggacctgagcgacaccaagagcatcagagccttcgccaagggcttcctggccgaggagaagcacctgcacgtgctgatcaacaacgccggcgtgatgatgtgcccctacagcaagaccgccgacggcttcgagatgcacatcggcgtgaaccacctgggccacttcctgctgacccacctgctgctggagaagctgaaggagagcgcccccagcagaatcgtgaacgtgagcagcctggcccaccacctgggcagaatccacttccacaacctgcagggcgagaagttctacaacgccggcctggcctactgccacagcaagctggccaacatcctgttcacccaggagctggccagaagactgaagggcagcggcgtgaccacctacagcgtgcaccccggcaccgtgcagagcgagctggtgagacacagcagcttcatgagatggatgtggtggctgttcagcttcttcatcaagaccccccagcagggcgcccagaccagcctgcactgcgccctgaccgagggcctggagatcctgagcggcaaccacttcagcgactgccacgtggcctgggtgagcgcccaggccagaaacgagaccatcgccagaagactgtgggacgtgagctgcgacctgctgggcctgcccatcgactag

SEQ ID NO: 96984 - DNA, 951 bp, Artificial Sequence
  Description of Artificial Sequence: Synthetic coding sequence
atgctggtgaccctgggcctgctgaccagcttcttcagcttcctgtacatggtggcccccagcatcagaaagttcttcgccggcggcgtgtgcagaaccaacgtgcagctgcccggcaaggtggtggtgatcaccggcgccaacaccggcatcggcaaggagaccgccagagagctggccagcagaggcgccagagtgtacatcgcctgcagagacgtgctgaagggcgagagcgccgccagcgagatcagagtggacaccaagaacagccaggtgctggtgagaaagctggacctgagcgacaccaagagcatcagagccttcgccgagggcttcctggccgaggagaagcagctgcacatcctgatcaacaacgccggcgtgatgatgtgcccctacagcaagaccgccgacggcttcgagacccacctgggcgtgaaccacctgggccacttcctgctgacctacctgctgctggagagactgaaggtgagcgcccccgccagagtggtgaacgtgagcagcgtggcccaccacatcggcaagatccccttccacgacctgcagagcgagaagagatacagcagaggcttcgcctactgccacagcaagctggccaacgtgctgttcaccagagagctggccaagagactgcagggcaccggcgtgaccacctacgccgtgcaccccggcgtggtgagaagcgagctggtgagacacagcagcctgctgtgcctgctgtggagactgttcagccccttcgtgaagaccgccagagagggcgcccagaccagcctgcactgcgccctggccgagggcctggagcccctgagcggcaagtacttcagcgactgcaagagaacctgggtgagccccagagccagaaacaacaagaccgccgagagactgtggaacgtgagctgcgagctgctgggcatcagatgggagtag

SEQ ID NO: 96985 - DNA, 951 bp, Artificial Sequence; identical to SEQ ID NO: 96984
  Description of Artificial Sequence: Synthetic coding sequence

SEQ ID NO: 96986 - DNA, 951 bp, Artificial Sequence; identical to SEQ ID NO: 96984
  Description of Artificial Sequence: Synthetic coding sequence

SEQ ID NO: 96987 - DNA, 957 bp, Artificial Sequence
  Description of Artificial Sequence: Synthetic coding sequence
atgtggctgcccctgctgctgggcgccctgctgtgggccgtgctgtggctgctgagagacagacagagcctgcccgccagcaacgccttcgtgttcatcaccggctgcgacagcggcttcggcagactgctggccctgcagctggaccagagaggcttcagagtgctggccagctgcctgacccccagcggcgccgaggacctgcagagagtggccagcagcagactgcacaccaccctgctggacatcaccgacccccagagcgtgcagcaggccgccaagtgggtggagatgcacgtgaaggaggccggcctgttcggcctggtgaacaacgccggcgtggccggcatcatcggccccaccccctggctgaccagagacgacttccagagagtgctgaacgtgaacaccatgggccccatcggcgtgaccctggccctgctgcccctgctgcagcaggccagaggcagagtgatcaacatcaccagcgtgctgggcagactggccgccaacggcggcggctactgcgtgagcaagttcggcctggaggccttcagcgacagcctgagaagagacgtggcccacttcggcatcagagtgagcatcgtggagcccggcttcttcagaacccccgtgaccaacctggagagcctggagaagaccctgcaggcctgctgggccagactgccccccgccacccaggcccactacggcggcgccttcctgaccaagtacctgaagatgcagcagagaatcatgaacctgatctgcgaccccgacctgaccaaggtgagcagatgcctggagcacgccctgaccgccagacaccccagaaccagatacagccccggctgggacgccaagctgctgtggctgcccgccagctacctgcccgccagcctggtggacgccgtgctgacctgggtgctgcccaagcccgcccaggccgtgtactag

SEQ ID NO: 96988 - DNA, 957 bp, Artificial Sequence; identical to SEQ ID NO: 96987
  Description of Artificial Sequence: Synthetic coding sequence

SEQ ID NO: 96989 - DNA, 936 bp, Artificial Sequence
  Description of Artificial Sequence: Synthetic coding sequence
atggccgccgcccccagaaccgtgctgatcagcggctgcagcagcggcatcggcctggagctggccgtgcagctggcccacgaccccaagaagagataccaggtggtggccaccatgagagacctgggcaagaaggagaccctggaggccgccgccggcgaggccctgggccagaccctgaccgtggcccagctggacgtgtgcagcgacgagagcgtggcccagtgcctgagctgcatccagggcgaggtggacgtgctggtgaacaacgccggcatgggcctggtgggccccctggagggcctgagcctggccgccatgcagaacgtgttcgacaccaacttcttcggcgccgtgagactggtgaaggccgtgctgcccggcatgaagagaagaagacagggccacatcgtggtgatcagcagcgtgatgggcctgcagggcgtgatcttcaacgacgtgtacgccgccagcaagttcgccctggagggcttcttcgagagcctggccatccagctgctgcagttcaacatcttcatcagcctggtggagcccggccccgtggtgaccgagttcgagggcaagctgctggcccaggtgagcatggccgagttccccggcaccgaccccgagaccctgcactacttcagagacctgtacctgcccgccagcagaaagctgttctgcagcgtgggccagaacccccaggacgtggtgcaggccatcgtgaacgtgatcagcagcaccagaccccccctgagaagacagaccaacatcagatacagccccctgaccaccctgaagaccgtggacagcagcggcagcctgtacgtgagaaccacccacagactgctgttcagatgccccagactgctgaacctgggcctgcagtgcctgagctgcggctgcctgcccaccagagtgagacccagatag

SEQ ID NO: 96990 - DNA, 675 bp, Artificial Sequence
  Description of Artificial Sequence: Synthetic coding sequence
atgagcagaaagatcgagggcttcctgctgctgctgctgttcggctacgaggccaccctgggcctgagcagcaccgaggacgagggcgaggacccctggtaccagaaggcctgcaagtgcgactgccagggcggccccaacgccctgtggagcgccggcgccaccagcctggactgcatccccgagtgcccctaccacaagcccctgggcttcgagagcggcgaggtgacccccgaccagatcacctgcagcaaccccgagcagtacgtgggctggtacagcagctggaccgccaacaaggccagactgaacagccagggcttcggctgcgcctggctgagcaagttccaggacagcagccagtggctgcagatcgacctgaaggagatcaaggtgatcagcggcatcctgacccagggcagatgcgacatcgacgagtggatgaccaagtacagcgtgcagtacagaaccgacgagagactgaactggatctactacaaggaccagaccggcaacaacagagtgttctacggcaacagcgacagaaccagcaccgtgcagaacctgctgagaccccccatcatcagcagattcatcagactgatccccctgggctggcacgtgagaatcgccatcagaatggagctgctggagtgcgtgagcaagtgcgcctag

SEQ ID NO: 96991 - DNA, 4077 bp, Artificial Sequence
  Description of Artificial Sequence: Synthetic coding sequence
atgatcgagcccagcgaggacagcttcgagaccatgatggagcacaagaaccccagcagcaagcagatggagagcagcgagggcagcagcaacaccaccgaggccaccagcggcagcggcgtgagaggcgaggccggccccgccagcggccccgcccaggagaagaaggagccccccagcggccccctgcaggagatggaggagctgcccaccgacctgctgcaggacatggaggagcccagcagcggccccagaaaggagatcgaggacccccccaacgacctgctgcaggacctggaggagagctgcaacggcagccaccaggccagaggcgaccccctgagcggcgccagcgacagaatgaaggaggccagcgtgaaccccagcggcgccagagaggagcaggaggcccacaccgacctgaaggagagcggcagagaggagaccccccaggagcagaaccagaccgagcacagcaccgccgagctgatggccatggtgagaagcatcatcagcctgtacttcagaatgcaggacctgaaggagcagcagagagtggccgaggagatcctgatcaagggcatcaacgccggccagctgcccgcccccaagcacttcagcggcgacagaagagagttccacgagttcatcgtgctgtgccagctgaccctgcagagctaccccagaatgttctacaacgacagactgagagtgggctacgtgatcaaccacctgagcggcctggccctggagtgggccaaggccctgctgcaggagaacagccccctgatcggcgacttccccgccttcctggaggccatgagcgaggtgttcgagtacagacaggccctgagagtggccgaggaggccatgttcaccatcagacagggcggcagaagcgccaccgagtacatcgacgagttccagagcctggtgcccatcctgggctggcccgacgaggtgctgcaggcccacctgtgccagggcctgaacgaggagatcagacactacctgttcagagtgccccagcccgacagcctggacagcctgatcgtgctgatcctgcagatcgaggagaagctggccgagagaagagccatgctgagactgccccccgaggccagacccagaaacctgacctggatcgacagccccgcccccgagagatggatggtgagcagctggctgcccagcgaggtgcaccccgacatcaacagagcccacctgttcctgctgctgatggtgagagtgaacccctaccacagcgtggccgtgcaggccctggtggacagcggcgccgacggcaacttcatggacgagaagttcgcccaggagcactacgtggagctgtacgagaagccctacccccagcccgtgcagagcgtggacggcagcctgatcggcaacgagcccgtgtggctgtacaccgagcccctggtgtgcatccaccagaaccaccaggagagcatcgagttcgacatcgtgcccagccccaacttcagcgtggtgctgggcatcagatggctgagagtgcacgcccccgaggtggactggatcaagggcagatgcaccttccacagcccctactgcctgaagaactgcttcagacccccccccccctgcatcgccctggagagacacggcatgagcctgctgcccggcctgccccacccctacagcgacctggccgacgtgttcaaccccaaggaggccgacgacgagaccagcgaccagcccagcagcgacggcagcgacgacctgagcgagagcgagcccagcgagctgcagcaggccggcgacagcgaccacagcgagaccttctacgagtgccccagcaccgccccctgggagcccgtgggcgccagaatgcaggagagagccagactgcaggaggagtactgggacctgcaggacatgctgaccaacagacaggactacatccagatgatccccgagctgttcgaccagctgcacggcgccgagtggttcaccaagctggagctgagaggcaccatcgtggaggagagcgtgaacggccacagaaccgaggacgtgtggaaggccgccttcggcctggagctggaggagatgaagagctaccagcccttcgccctgagccccgaccccatcatcccccagaacgtgatccacttcatcctgaaggacatgctgggcttcttcgtgctgagctacggccaggaggtgctgatctacagcatgagccaggaggagcacctgcaccacgtgagacaggtgctggtgagattcagacaccacaacgtgtactgcagcctggacaagagccagttccacagacagaccgtggagttcctgggcttcgtggtgacccccaagggcgtgaagctgaacaagaacgtgatgaccatcatcaccggctaccccacccccggcagcaagctgagcctgagaaacttcatcgagttcgtgttcccctacagacacttcgtggagagattcagcatcatcgccgagcccctggtgagacagctgctgagcagctaccagttctactggggcgtggaggagcaggaggccttcgagtgcctgaagagagccttcagaaaggcccccctgctgcaccaccccaagccccagaaccccttctacctggagaccggcgtgaccggcaccgccctgcacgccagcctgatccagatcgacgaccagaccggcaagagagcctgctgcgccttctacagcagaaacatcagccccatcgaggtggagtacagccaggccgagatgaagatcctgcccatcagagccgccttcatggtgtggtgcagatacctggagaacaccgaggagcccatcatgatcctgctgaacaccgaggacctggccagcctgaacaacgacagactgaccgtgctgctgcccggccactgggtgttcttcttcagccacttcaacttcgacgtgatggagctgcccgagcaggacggcggcagagccctgccccccgtgagaaacctgagatggagaagagccttccagagaaacaccgccgccagacagaccctgctgctggccagcagaggcttccccagagaccccagcaccgagagcggcgaggaggagaacgaggagcaggacgagctgaacgagcagatcctgagacaggagctgctggccatgatccccatcgaccagatcctgaacagcttcctggcccacttcagcatggcccagatcagagccgtgatcctgcacttcttcagaggcctgctgtactggaagaacaccctggccctggccgccatcctggtgctgctgagagtgagacagtgcctgagcctgagacccgcccccgccatgagagtggccagaccccagccccagagaagcctgagactgatcctggacagcagcctgatcgccggcagcagcatcaccaccgccatcacccagctgctgacccagatgcccgccctggtgggcgccaacaccatccccgcccaggagctggccgagctgttcctgggccccggcagatggcagagaaacgccctgcacagccaggcccacagaggcctgcagttcacccccggcttctggctgaccctgtgcgagttcttcggcgtgagagtgaccccccaggagggccacctgcccgccctgagacagaacagatacctggagctgcacgtggtgggcgacgaggacgtggtgctgagagaggccctgcaggacgacctgcagagatacagacagtgcggcctgcacgacggcctgcaggacaccagccaggacaagcaggacaacgacgtgcaggaggccccccccagccacaccgccgccacccacccccccagacccagacacctgatggacccccaggtgctggagttcctgggcagcagactgctgcacatccacagcgccgacggccagctgcacctgctgagcagagagcaggccgccagagccctgagccagttcctgaccctgatctacagaagagccctgcccatccccgcctgggagagccagcccagagagcaggccagactggaggagctgcccgacgaggacgaggacgccaacctggactag

SEQ ID NO: 96992 - DNA, 9393 bp, Artificial Sequence
  Description of Artificial Sequence: Synthetic coding sequence
atgttcagcgtgagaatcgtgaccgccgactactacatggccagccccctgcagggcctggacacctgccagagccccctgacccaggcccccgtgaagaaggtgcccgtggtgagagtgttcggcgccacccccgccggccagaagacctgcctgcacctgcacggcatcttcccctacctgtacgtgccctacgacggctacggccagcagcccgagagctacctgagccagatggccttcagcatcgacagagccctgaacgtggccctgggcaaccccagcagcaccgcccagcacgtgttcaaggtgagcctggtgagcggcatgcccttctacggctaccacgagaaggagagacacttcatgaagatctacctgtacaaccccaccatggtgaagagaatctgcgagctgctgcagagcggcgccatcatgaacaagttctaccagccccacgaggcccacatcccctacctgctgcagctgttcatcgactacaacctgtacggcatgaacctgatcaacctggccgccgtgaagttcagaaaggccagaagaaagagcaacaccctgcacgccaccggcagctgcaagaaccacctgagcggcaacagcctggccgacaccctgttcagatgggagcaggacgagatccccagcagcctgatcctggagggcgtggagccccagagcacctgcgagctggaggtggacgccgtggccgccgacatcctgaacagactggacatcgaggcccagatcggcggcaaccccggcctgcaggccatctgggaggacgagaagcagagaagaagaaacagaaacgagaccagccagatgagccagcccgagagccaggaccacagattcgtgcccgccaccgagagcgagaagaagttccagaagagactgcaggagatcctgaagcagaacgacttcagcgtgaccctgagcggcagcgtggactacagcgacggcagccaggagttcagcgccgagctgaccctgcacagcgaggtgctgagccccgagatgctgcagtgcacccccgccaacatggtggaggtgcacaaggacaaggagagcagcaagggccacaccagacacaaggtggaggaggccctgatcaacgaggaggccatcctgaacctgatggagaacagccagaccttccagcccctgacccagagactgagcgagagccccgtgttcatggacagcagccccgacgaggccctggtgcacctgctggccggcctggagagcgacggctacagaggcgagagaaacagaatgcccagcccctgcagaagcttcggcaacaacaagtacccccagaacagcgacgacgaggagaacgagccccagatcgagaaggaggagatggagctgagcctggtgatgagccagagatgggacagcaacatcgaggagcactgcgccaagaagagaagcctgtgcagaaacacccacagaagcagcaccgaggacgacgacagcagcagcggcgaggagatggagtggagcgacaacagcctgctgctggccagcctgagcatcccccagctggacggcaccgccgacgagaacagcgacaaccccctgaacaacgagaacagcagaacccacagcagcgtgatcgccaccagcaagctgagcgtgaagcccagcatcttccacaaggacgccgccaccctggagcccagcagcagcgccaagatcaccttccagtgcaagcacaccagcgccctgagcagccacgtgctgaacaaggaggacctgatcgaggacctgagccagaccaacaagaacaccgagaagggcctggacaacagcgtgaccagcttcaccaacgagagcacctacagcatgaagtaccccggcagcctgagcagcaccgtgcacagcgagaacagccacaaggagaacagcaagaaggagatcctgcccgtgagcagctgcgagagcagcatcttcgactacgaggaggacatccccagcgtgaccagacaggtgcccagcagaaagtacaccaacatcagaaagatcgagaaggacagccccttcatccacatgcacagacaccccaacgagaacaccctgggcaagaacagcttcaacttcagcgacctgaaccacagcaagaacaaggtgagcagcgagggcaacgagaagggcaacagcaccgccctgagcagcctgttccccagcagcttcaccgagaactgcgagctgctgagctgcagcggcgagaacagaaccatggtgcacagcctgaacagcaccgccgacgagagcggcctgaacaagctgaagatcagatacgaggagttccaggagcacaagaccgagaagcccagcctgagccagcaggccgcccactacatgttcttccccagcgtggtgctgagcaactgcctgaccagaccccagaagctgagccccgtgacctacaagctgcagcccggcaacaagcccagcagactgaagctgaacaagagaaagctggccggccaccaggagaccagcaccaagagcagcgagaccggcagcaccaaggacaacttcatccagaacaacccctgcaacagcaaccccgagaaggacaacgccctggccagcgacctgaccaagaccaccagaggcgccttcgagaacaagacccccaccgacggcttcatcgactgccacttcggcgacggcaccctggagaccgagcagagcttcggcctgtacggcaacaagtacaccctgagagccaagagaaaggtgaactacgagaccgaggacagcgagagcagcttcgtgacccacaacagcaagatcagcctgccccaccccatggagatcggcgagagcctggacggcaccctgaagagcagaaagagaagaaagatgagcaagaagctgccccccgtgatcatcaagtacatcatcatcaacagattcagaggcagaaagaacatgctggtgaagctgggcaagatcgacagcaaggagaagcaggtgatcctgaccgaggagaagatggagctgtacaagaagctggcccccctgaaggacttctggcccaaggtgcccgacagccccgccaccaagtaccccatctaccccctgacccccaagaagagccacagaagaaagagcaagcacaagagcgccaagaagaagaccggcaagcagcagagaaccaacaacgagaacatcaagagaaccctgagcttcagaaagaagagaagccacgccatcctgagcccccccagccccagctacaacgccgagaccgaggactgcgacctgaactacagcgacgtgatgagcaagctgggcttcctgagcgagagaagcaccagccccatcaacagcagcccccccagatgctggagccccaccgaccccagagccgaggagatcatggccgccgccgagaaggaggccatgctgttcaagggccccaacgtgtacaagaagaccgtgaacagcagaatcggcaagaccagcagagccagagcccagatcaagaagagcaaggccaagctggccaaccccagcatcgtgaccaagaagagaaacaagagaaaccagaccaacaagctggtggacgacggcaagaagaagcccagagccaagcagaagaccaacgagaagggcaccagcagaaagcacaccaccctgaaggacgagaagatcaagagccagagcggcgccgaggtgaagttcgtgctgaagcaccagaacgtgagcgagttcgccagcagcagcggcggcagccagctgctgttcaagcagaaggacatgcccctgatgggcagcgccgtggaccaccccctgagcgccagcctgcccaccggcatcaacgcccagcagaagctgagcggctgcttcagcagcttcctggagagcaagaagagcgtggacctgcagaccttccccagcagcagagacgacctgcaccccagcgtggtgtgcaacagcatcggccccggcgtgagcaagatcaacgtgcagagaccccacaaccagagcgccatgttcaccctgaaggagagcaccctgatccagaagaacatcttcgacctgagcaaccacctgagccaggtggcccagaacacccagatcagcagcggcatgagcagcaagatcgaggacaacgccaacaacatccagagaaactacctgagcagcatcggcaagctgagcgagtacagaaacagcctggagagcaagctggaccaggcctacacccccaacttcctgcactgcaaggacagccagcagcagatcgtgtgcatcgccgagcagagcaagcacagcgagacctgcagccccggcaacaccgccagcgaggagagccagatgcccaacaactgcttcgtgaccagcctgagaagccccatcaagcagatcgcctgggagcagaagcagagaggcttcatcctggacatgagcaacttcaagcccgagagagtgaagcccagaagcctgagcgaggccatcagccagaccaaggccctgagccagtgcaagaacagaaacgtgagcacccccagcgccttcggcgagggccagagcggcctggccgtgctgaaggagctgctgcagaagagacagcagaaggcccagaacgccaacaccacccaggaccccctgagcaacaagcaccagcccaacaagaacatcagcggcagcctggagcacaacaaggccaacaagagaaccagaagcgtgaccagccccagaaagcccagaacccccagaagcaccaagcagaaggagaagatccccaagctgctgaaggtggacagcctgaacctgcagaacagcagccagctggacaacagcgtgagcgacgacagccccatcttcttcagcgaccccggcttcgagagctgctacagcctggaggacagcctgagccccgagcacaactacaacttcgacatcaacaccatcggccagaccggcttctgcagcttctacagcggcagccagttcgtgcccgccgaccagaacctgccccagaagttcctgagcgacgccgtgcaggacctgttccccggccaggccatcgagaagaacgagttcctgagccacgacaaccagaagtgcgacgaggacaagcaccacaccaccgacagcgccagctggatcagaagcggcaccctgagccccgagatcttcgagaagagcaccatcgacagcaacgagaacagaagacacaaccagtggaagaacagcttccaccccctgaccaccagaagcaacagcatcatggacagcttctgcgtgcagcaggccgaggactgcctgagcgagaagagcagactgaacagaagcagcgtgagcaaggaggtgttcctgagcctgccccagcccaacaacagcgactggatccagggccacaccagaaaggagatgggccagagcctggacagcgccaacaccagcttcaccgccatcctgagcagccccgacggcgagctggtggacgtggcctgcgaggacctggagctgtacgtgagcagaaacaacgacatgctgacccccacccccgacagcagccccagaagcaccagcagccccagccagagcaagaacggcagcttcacccccagaaccgccaacatcctgaagcccctgatgagcccccccagcagagaggagatcatggccaccctgctggaccacgacctgagcgagaccatctaccaggagcccttctgcagcaaccccagcgacgtgcccgagaagcccagagagatcggcggcagactgctgatggtggagaccagactggccaacgacctggccgagttcgagggcgacttcagcctggagggcctgagactgtggaagaccgccttcagcgccatgacccagaaccccagacccggcagccccctgagaagcggccagggcgtggtgaacaagggcagcagcaacagccccaagatggtggaggacaagaagatcgtgatcatgccctgcaagtgcgcccccagcagacagctggtgcaggtgtggctgcaggccaaggaggagtacgagagaagcaagaagctgcccaagaccaagcccaccggcgtggtgaagagcgccgagaacttcagcagcagcgtgaaccccgacgacaagcccgtggtgccccccaagatggacgtgagcccctgcatcctgcccaccaccgcccacaccaaggaggacgtggacaacagccagatcgccctgcaggcccccaccaccggctgcagccagaccgccagcgagagccagatgctgccccccgtggccagcgccagcgaccccgagaaggacgaggacgacgacgacaactactacatcagctacagcagccccgacagccccgtgatccccccctggcagcagcccatcagccccgacagcaaggccctgaacggcgacgacagacccagcagccccgtggaggagctgcccagcctggccttcgagaacttcctgaagcccatcaaggacggcatccagaagagcccctgcagcgagccccaggagcccctggtgatcagccccatcaacaccagagccagaaccggcaagtgcgagagcctgtgcttccacagcacccccatcatccagagaaagctgctggagagactgcccgaggcccccggcctgagccccctgagcaccgagcccaagacccagaagctgagcaacaagaagggcagcaacaccgacaccctgagaagagtgctgctgacccaggccaagaaccagttcgccgccgtgaacaccccccagaaggagaccagccagatcgacggccccagcctgaacaacacctacggcttcaaggtgagcatccagaacctgcaggaggccaaggccctgcacgagatccagaacctgaccctgatcagcgtggagctgcacgccagaaccagaagagacctggagcccgaccccgagttcgaccccatctgcgccctgttctactgcatcagcagcgacacccccctgcccgacaccgagaagaccgagctgaccggcgtgatcgtgatcgacaaggacaagaccgtgttcagccaggacatcagataccagacccccctgctgatcagaagcggcatcaccggcctggaggtgacctacgccgccgacgagaaggccctgttccacgagatcgccaacatcatcaagagatacgaccccgacatcctgctgggctacgagatccagatgcacagctggggctacctgctgcagagagccgccgccctgagcatcgacctgtgcagaatgatcagcagagtgcccgacgacaagatcgagaacagattcgccgccgagagagacgagtacggcagctacaccatgagcgagatcaacatcgtgggcagaatcaccctgaacctgtggagaatcatgagaaacgaggtggccctgaccaactacaccttcgagaacgtgagcttccacgtgctgcaccagagattccccctgttcaccttcagagtgctgagcgactggttcgacaacaagaccgacctgtacagatggaagatggtggaccactacgtgagcagagtgagaggcaacctgcagatgctggagcagctggacctgatcggcaagaccagcgagatggccagactgttcggcatccagttcctgcacgtgctgaccagaggcagccagtacagagtggagagcatgatgctgagaatcgccaagcccatgaactacatccccgtgacccccagcgtgcagcagagaagccagatgagagccccccagtgcgtgcccctgatcatggagcccgagagcagattctacagcaacagcgtgctggtgctggacttccagagcctgtaccccagcatcgtgatcgcctacaactactgcttcagcacctgcctgggccacgtggagaacctgggcaagtacgacgagttcaagttcggctgcaccagcctgagagtgccccccgacctgctgtaccaggtgagacacgacatcaccgtgagccccaacggcgtggccttcgtgaagcccagcgtgagaaagggcgtgctgcccagaatgctggaggagatcctgaagaccagattcatggtgaagcagagcatgaaggcctacaagcaggacagagccctgagcagaatgctggacgccagacagctgggcctgaagctgatcgccaacgtgaccttcggctacaccagcgccaacttcagcggcagaatgccctgcatcgaggtgggcgacagcatcgtgcacaaggccagagagaccctggagagagccatcaagctggtgaacgacaccaagaagtggggcgccagagtggtgtacggcgacaccgacagcatgttcgtgctgctgaagggcgccaccaaggagcagagcttcaagatcggccaggagatcgccgaggccgtgaccgccaccaaccccaagcccgtgaagctgaagttcgagaaggtgtacctgccctgcgtgctgcagaccaagaagagatacgtgggctacatgtacgagaccctggaccagaaggaccccgtgttcgacgccaagggcatcgagaccgtgagaagagacagctgccccgccgtgagcaagatcctggagagaagcctgaagctgctgttcgagaccagagacatcagcctgatcaagcagtacgtgcagagacagtgcatgaagctgctggagggcaaggccagcatccaggacttcatcttcgccaaggagtacagaggcagcttcagctacaagcccggcgcctgcgtgcccgccctggagctgaccagaaagatgctgacctacgacagaagaagcgagccccaggtgggcgagagagtgccctacgtgatcatctacggcacccccggcgtgcccctgatccagctggtgagaagacccgtggaggtgctgcaggaccccaccctgagactgaacgccacctactacatcaccaagcagatcctgccccccctggccagaatcttcagcctgatcggcatcgacgtgttcagctggtaccacgagctgcccagaatccacaaggccaccagcagcagcagaagcgagcccgagggcagaaagggcaccatcagccagtacttcaccaccctgcactgccccgtgtgcgacgacctgacccagcacggcatctgcagcaagtgcagaagccagccccagcacgtggccgtgatcctgaaccaggagatcagagagctggagagacagcaggagcagctggtgaagatctgcaagaactgcaccggctgcttcgacagacacatcccctgcgtgagcctgaactgccccgtgctgttcaagctgagcagagtgaacagagagctgagcaaggccccctacctgagacagctgctggaccagttctag

SEQ ID NO: 96993 - DNA, 9393 bp, Artificial Sequence; identical to SEQ ID NO: 96992
  Description of Artificial Sequence: Synthetic coding sequence

SEQ ID NO: 96994 - DNA, 9393 bp, Artificial Sequence; identical to SEQ ID NO: 96992
  Description of Artificial Sequence: Synthetic coding sequence

SEQ ID NO: 96995 - DNA, 9159 bp, Artificial Sequence
  Description of Artificial Sequence: Synthetic coding sequence
atggccttcagcatcgacagagccctgaacgtggccctgggcaaccccagcagcaccgcccagcacgtgttcaaggtgagcctggtgagcggcatgcccttctacggctaccacgagaaggagagacacttcatgaagatctacctgtacaaccccaccatggtgaagagaatctgcgagctgctgcagagcggcgccatcatgaacaagttctaccagccccacgaggcccacatcccctacctgctgcagctgttcatcgactacaacctgtacggcatgaacctgatcaacctggccgccgtgaagttcagaaaggccagaagaaagagcaacaccctgcacgccaccggcagctgcaagaaccacctgagcggcaacagcctggccgacaccctgttcagatgggagcaggacgagatccccagcagcctgatcctggagggcgtggagccccagagcacctgcgagctggaggtggacgccgtggccgccgacatcctgaacagactggacatcgaggcccagatcggcggcaaccccggcctgcaggccatctgggaggacgagaagcagagaagaagaaacagaaacgagaccagccagatgagccagcccgagagccaggaccacagattcgtgcccgccaccgagagcgagaagaagttccagaagagactgcaggagatcctgaagcagaacgacttcagcgtgaccctgagcggcagcgtggactacagcgacggcagccaggagttcagcgccgagctgaccctgcacagcgaggtgctgagccccgagatgctgcagtgcacccccgccaacatggtggaggtgcacaaggacaaggagagcagcaagggccacaccagacacaaggtggaggaggccctgatcaacgaggaggccatcctgaacctgatggagaacagccagaccttccagcccctgacccagagactgagcgagagccccgtgttcatggacagcagccccgacgaggccctggtgcacctgctggccggcctggagagcgacggctacagaggcgagagaaacagaatgcccagcccctgcagaagcttcggcaacaacaagtacccccagaacagcgacgacgaggagaacgagccccagatcgagaaggaggagatggagctgagcctggtgatgagccagagatgggacagcaacatcgaggagcactgcgccaagaagagaagcctgtgcagaaacacccacagaagcagcaccgaggacgacgacagcagcagcggcgaggagatggagtggagcgacaacagcctgctgctggccagcctgagcatcccccagctggacggcaccgccgacgagaacagcgacaaccccctgaacaacgagaacagcagaacccacagcagcgtgatcgccaccagcaagctgagcgtgaagcccagcatcttccacaaggacgccgccaccctggagcccagcagcagcgccaagatcaccttccagtgcaagcacaccagcgccctgagcagccacgtgctgaacaaggaggacctgatcgaggacctgagccagaccaacaagaacaccgagaagggcctggacaacagcgtgaccagcttcaccaacgagagcacctacagcatgaagtaccccggcagcctgagcagcaccgtgcacagcgagaacagccacaaggagaacagcaagaaggagatcctgcccgtgagcagctgcgagagcagcatcttcgactacgaggaggacatccccagcgtgaccagacaggtgcccagcagaaagtacaccaacatcagaaagatcgagaaggacagccccttcatccacatgcacagacaccccaacgagaacaccctgggcaagaacagcttcaacttcagcgacctgaaccacagcaagaacaaggtgagcagcgagggcaacgagaagggcaacagcaccgccctgagcagcctgttccccagcagcttcaccgagaactgcgagctgctgagctgcagcggcgagaacagaaccatggtgcacagcctgaacagcaccgccgacgagagcggcctgaacaagctgaagatcagatacgaggagttccaggagcacaagaccgagaagcccagcctgagccagcaggccgcccactacatgttcttccccagcgtggtgctgagcaactgcctgaccagaccccagaagctgagccccgtgacctacaagctgcagcccggcaacaagcccagcagactgaagctgaacaagagaaagctggccggccaccaggagaccagcaccaagagcagcgagaccggcagcaccaaggacaacttcatccagaacaacccctgcaacagcaaccccgagaaggacaacgccctggccagcgacctgaccaagaccaccagaggcgccttcgagaacaagacccccaccgacggcttcatcgactgccacttcggcgacggcaccctggagaccgagcagagcttcggcctgtacggcaacaagtacaccctgagagccaagagaaaggtgaactacgagaccgaggacagcgagagcagcttcgtgacccacaacagcaagatcagcctgccccaccccatggagatcggcgagagcctggacggcaccctgaagagcagaaagagaagaaagatgagcaagaagctgccccccgtgatcatcaagtacatcatcatcaacagattcagaggcagaaagaacatgctggtgaagctgggcaagatcgacagcaaggagaagcaggtgatcctgaccgaggagaagatggagctgtacaagaagctggcccccctgaaggacttctggcccaaggtgcccgacagccccgccaccaagtaccccatctaccccctgacccccaagaagagccacagaagaaagagcaagcacaagagcgccaagaagaagaccggcaagcagcagagaaccaacaacgagaacatcaagagaaccctgagcttcagaaagaagagaagccacgccatcctgagcccccccagccccagctacaacgccgagaccgaggactgcgacctgaactacagcgacgtgatgagcaagctgggcttcctgagcgagagaagcaccagccccatcaacagcagcccccccagatgctggagccccaccgaccccagagccgaggagatcatggccgccgccgagaaggaggccatgctgttcaagggccccaacgtgtacaagaagaccgtgaacagcagaatcggcaagaccagcagagccagagcccagatcaagaagagcaaggccaagctggccaaccccagcatcgtgaccaagaagagaaacaagagaaaccagaccaacaagctggtggacgacggcaagaagaagcccagagccaagcagaagaccaacgagaagggcaccagcagaaagcacaccaccctgaaggacgagaagatcaagagccagagcggcgccgaggtgaagttcgtgctgaagcaccagaacgtgagcgagttcgccagcagcagcggcggcagccagctgctgttcaagcagaaggacatgcccctgatgggcagcgccgtggaccaccccctgagcgccagcctgcccaccggcatcaacgcccagcagaagctgagcggctgcttcagcagcttcctggagagcaagaagagcgtggacctgcagaccttccccagcagcagagacgacctgcaccccagcgtggtgtgcaacagcatcggccccggcgtgagcaagatcaacgtgcagagaccccacaaccagagcgccatgttcaccctgaaggagagcaccctgatccagaagaacatcttcgacctgagcaaccacctgagccaggtggcccagaacacccagatcagcagcggcatgagcagcaagatcgaggacaacgccaacaacatccagagaaactacctgagcagcatcggcaagctgagcgagtacagaaacagcctggagagcaagctggaccaggcctacacccccaacttcctgcactgcaaggacagccagcagcagatcgtgtgcatcgccgagcagagcaagcacagcgagacctgcagccccggcaacaccgccagcgaggagagccagatgcccaacaactgcttcgtgaccagcctgagaagccccatcaagcagatcgcctgggagcagaagcagagaggcttcatcctggacatgagcaacttcaagcccgagagagtgaagcccagaagcctgagcgaggccatcagccagaccaaggccctgagccagtgcaagaacagaaacgtgagcacccccagcgccttcggcgagggccagagcggcctggccgtgctgaaggagctgctgcagaagagacagcagaaggcccagaacgccaacaccacccaggaccccctgagcaacaagcaccagcccaacaagaacatcagcggcagcctggagcacaacaaggccaacaagagaaccagaagcgtgaccagccccagaaagcccagaacccccagaagcaccaagcagaaggagaagatccccaagctgctgaaggtggacagcctgaacctgcagaacagcagccagctggacaacagcgtgagcgacgacagccccatcttcttcagcgaccccggcttcgagagctgctacagcctggaggacagcctgagccccgagcacaactacaacttcgacatcaacaccatcggccagaccggcttctgcagcttctacagcggcagccagttcgtgcccgccgaccagaacctgccccagaagttcctgagcgacgccgtgcaggacctgttccccggccaggccatcgagaagaacgagttcctgagccacgacaaccagaagtgcgacgaggacaagcaccacaccaccgacagcgccagctggatcagaagcggcaccctgagccccgagatcttcgagaagagcaccatcgacagcaacgagaacagaagacacaaccagtggaagaacagcttccaccccctgaccaccagaagcaacagcatcatggacagcttctgcgtgcagcaggccgaggactgcctgagcgagaagagcagactgaacagaagcagcgtgagcaaggaggtgttcctgagcctgccccagcccaacaacagcgactggatccagggccacaccagaaaggagatgggccagagcctggacagcgccaacaccagcttcaccgccatcctgagcagccccgacggcgagctggtggacgtggcctgcgaggacctggagctgtacgtgagcagaaacaacgacatgctgacccccacccccgacagcagccccagaagcaccagcagccccagccagagcaagaacggcagcttcacccccagaaccgccaacatcctgaagcccctgatgagcccccccagcagagaggagatcatggccaccctgctggaccacgacctgagcgagaccatctaccaggagcccttctgcagcaaccccagcgacgtgcccgagaagcccagagagatcggcggcagactgctgatggtggagaccagactggccaacgacctggccgagttcgagggcgacttcagcctggagggcctgagactgtggaagaccgccttcagcgccatgacccagaaccccagacccggcagccccctgagaagcggccagggcgtggtgaacaagggcagcagcaacagccccaagatggtggaggacaagaagatcgtgatcatgccctgcaagtgcgcccccagcagacagctggtgcaggtgtggctgcaggccaaggaggagtacgagagaagcaagaagctgcccaagaccaagcccaccggcgtggtgaagagcgccgagaacttcagcagcagcgtgaaccccgacgacaagcccgtggtgccccccaagatggacgtgagcccctgcatcctgcccaccaccgcccacaccaaggaggacgtggacaacagccagatcgccctgcaggcccccaccaccggctgcagccagaccgccagcgagagccagatgctgccccccgtggccagcgccagcgaccccgagaaggacgaggacgacgacgacaactactacatcagctacagcagccccgacagccccgtgatccccccctggcagcagcccatcagccccgacagcaaggccctgaacggcgacgacagacccagcagccccgtggaggagctgcccagcctggccttcgagaacttcctgaagcccatcaaggacggcatccagaagagcccctgcagcgagccccaggagcccctggtgatcagccccatcaacaccagagccagaaccggcaagtgcgagagcctgtgcttccacagcacccccatcatccagagaaagctgctggagagactgcccgaggcccccggcctgagccccctgagcaccgagcccaagacccagaagctgagcaacaagaagggcagcaacaccgacaccctgagaagagtgctgctgacccaggccaagaaccagttcgccgccgtgaacaccccccagaaggagaccagccagatcgacggccccagcctgaacaacacctacggcttcaaggtgagcatccagaacctgcaggaggccaaggccctgcacgagatccagaacctgaccctgatcagcgtggagctgcacgccagaaccagaagagacctggagcccgaccccgagttcgaccccatctgcgccctgttctactgcatcagcagcgacacccccctgcccgacaccgagaagaccgagctgaccggcgtgatcgtgatcgacaaggacaagaccgtgttcagccaggacatcagataccagacccccctgctgatcagaagcggcatcaccggcctggaggtgacctacgccgccgacgagaaggccctgttccacgagatcgccaacatcatcaagagatacgaccccgacatcctgctgggctacgagatccagatgcacagctggggctacctgctgcagagagccgccgccctgagcatcgacctgtgcagaatgatcagcagagtgcccgacgacaagatcgagaacagattcgccgccgagagagacgagtacggcagctacaccatgagcgagatcaacatcgtgggcagaatcaccctgaacctgtggagaatcatgagaaacgaggtggccctgaccaactacaccttcgagaacgtgagcttccacgtgctgcaccagagattccccctgttcaccttcagagtgctgagcgactggttcgacaacaagaccgacctgtacagatggaagatggtggaccactacgtgagcagagtgagaggcaacctgcagatgctggagcagctggacctgatcggcaagaccagcgagatggccagactgttcggcatccagttcctgcacgtgctgaccagaggcagccagtacagagtggagagcatgatgctgagaatcgccaagcccatgaactacatccccgtgacccccagcgtgcagcagagaagccagatgagagccccccagtgcgtgcccctgatcatggagcccgagagcagattctacagcaacagcgtgctggtgctggacttccagagcctgtaccccagcatcgtgatcgcctacaactactgcttcagcacctgcctgggccacgtggagaacctgggcaagtacgacgagttcaagttcggctgcaccagcctgagagtgccccccgacctgctgtaccaggtgagacacgacatcaccgtgagccccaacggcgtggccttcgtgaagcccagcgtgagaaagggcgtgctgcccagaatgctggaggagatcctgaagaccagattcatggtgaagcagagcatgaaggcctacaagcaggacagagccctgagcagaatgctggacgccagacagctgggcctgaagctgatcgccaacgtgaccttcggctacaccagcgccaacttcagcggcagaatgccctgcatcgaggtgggcgacagcatcgtgcacaaggccagagagaccctggagagagccatcaagctggtgaacgacaccaagaagtggggcgccagagtggtgtacggcgacaccgacagcatgttcgtgctgctgaagggcgccaccaaggagcagagcttcaagatcggccaggagatcgccgaggccgtgaccgccaccaaccccaagcccgtgaagctgaagttcgagaaggtgtacctgccctgcgtgctgcagaccaagaagagatacgtgggctacatgtacgagaccctggaccagaaggaccccgtgttcgacgccaagggcatcgagaccgtgagaagagacagctgccccgccgtgagcaagatcctggagagaagcctgaagctgctgttcgagaccagagacatcagcctgatcaagcagtacgtgcagagacagtgcatgaagctgctggagggcaaggccagcatccaggacttcatcttcgccaaggagtacagaggcagcttcagctacaagcccggcgcctgcgtgcccgccctggagctgaccagaaagatgctgacctacgacagaagaagcgagccccaggtgggcgagagagtgccctacgtgatcatctacggcacccccggcgtgcccctgatccagctggtgagaagacccgtggaggtgctgcaggaccccaccctgagactgaacgccacctactacatcaccaagcagatcctgccccccctggccagaatcttcagcctgatcggcatcgacgtgttcagctggtaccacgagctgcccagaatccacaaggccaccagcagcagcagaagcgagcccgagggcagaaagggcaccatcagccagtacttcaccaccctgcactgccccgtgtgcgacgacctgacccagcacggcatctgcagcaagtgcagaagccagccccagcacgtggccgtgatcctgaaccaggagatcagagagctggagagacagcaggagcagctggtgaagatctgcaagaactgcaccggctgcttcgacagacacatcccctgcgtgagcctgaactgccccgtgctgttcaagctgagcagagtgaacagagagctgagcaaggccccctacctgagacagctgctggaccagttctag

SEQ ID NO: 96996 - DNA, 2289 bp, Artificial Sequence
  Description of Artificial Sequence: Synthetic coding sequence
atggtggagaccagactggccaacgacctggccgagttcgagggcgacttcagcctggagggcctgagactgtggaagaccgccttcagcgccatgacccagaaccccagacccggcagccccctgagaagcggccagggcgtggtgaacaagggcagcagcaacagccccaagatggtggaggacaagaagatcgtgatcatgccctgcaagtgcgcccccagcagacagctggtgcaggtgtggctgcaggccaaggaggagtacgagagaagcaagaagctgcccaagaccaagcccaccggcgtggtgaagagcgccgagaacttcagcagcagcgtgaaccccgacgacaagcccgtggtgccccccaagatggacgtgagcccctgcatcctgcccaccaccgcccacaccaaggaggacgtggacaacagccagatcgccctgcaggcccccaccaccggctgcagccagaccgccagcgagagccagatgctgccccccgtggccagcgccagcgaccccgagaaggacgaggacgacgacgacaactactacatcagctacagcagccccgacagccccgtgatccccccctggcagcagcccatcagccccgacagcaaggccctgaacggcgacgacagacccagcagccccgtggaggagctgcccagcctggccttcgagaacttcctgaagcccatcaaggacggcatccagaagagcccctgcagcgagccccaggagcccctggtgatcagccccatcaacaccagagccagaaccggcaagtgcgagagcctgtgcttccacagcacccccatcatccagagaaagctgctggagagactgcccgaggcccccggcctgagccccctgagcaccgagcccaagacccagaagctgagcaacaagaagggcagcaacaccgacaccctgagaagagtgctgctgacccaggccaagaaccagttcgccgccgtgaacaccccccagaaggagaccagccagatcgacggccccagcctgaacaacacctacggcttcaaggtgagcatccagaacctgcaggaggccaaggccctgcacgagatccagaacctgaccctgatcagcgtggagctgcacgccagaaccagaagagacctggagcccgaccccgagttcgaccccatctgcgccctgttctactgcatcagcagcgacacccccctgcccgacaccgagaagaccgagctgaccggcgtgatcgtgatcgacaaggacaagaccgtgttcagccaggacatcagataccagacccccctgctgatcagaagcggcatcaccggcctggaggtgacctacgccgccgacgagaaggccctgttccacgagatcgccaacatcatcaagagatacgaccccgacatcctgctgggctacgagatccagatgcacagctggggctacctgctgcagagagccgccgccctgagcatcgacctgtgcagaatgatcagcagagtgcccgacgacaagatcgagaacagattcgccgccgagagagacgagtacggcagctacaccatgagcgagatcaacatcgtgggcagaatcaccctgaacctgtggagaatcatgagaaacgaggtggccctgaccaactacaccttcgagaacgtgagcttccacgtgctgcaccagagattccccctgttcaccttcagagtgctgagcgactggttcgacaacaagaccgacctgtacagatggaagatggtggaccactacgtgagcagagtgagaggcaacctgcagatgctggagcagctggacctgatcggcaagaccagcgagatggccagactgttcggcatccagttcctgcacgtgctgaccagaggcagccagtacagagtggagagcatgatgctgagaatcgccaagcccatgaactacatccccgtgacccccagcgtgcagcagagaagccagatgagagccccccagtgcgtgcccctgatcatggagcccgagagcagattctacagcaacagcgtgctggtgctggacttccagagcctgtaccccagcatcgtgatcgcctacaactactgcttcagcacctgcctgggccacgtggagaacctgggcaagtacgacgagttcaagttcggctgcaccagcctgagagtgccccccgacctgctgtaccaggtgagacacgacatcaccgtgagccccaacggcgtggccttcgtgaagatcgccaacaagtgcagacccgagggcatggcctag

SEQ ID NO: 96997 - DNA, 3666 bp, Artificial Sequence
  Description of Artificial Sequence: Synthetic coding sequence
atgctgagaagcaccggcttcttcagagccatcgactgcccctactggagcggcgcccccggcggcccctgcagaagaccctactgccacttcagacacagaggcgccagaggcagcggcgcccccggcgacggcggcgaggccccccccgccgccggcctgggctacgacccctacaaccccgagctgcccaagccccccgcccagagagagaacggcaccctgggcctgggcgaggagcccagacccgacgtgctggagctggagctggtgaaccaggccatcgaggccgtgagaagcgaggtggagctggagcagagaagatacagagagctgctggagaccaccagagagcacagaagcgccgaggcccccgccctggcccccagaggccccaacgccagccccaccgtgggccccgacgaggacgccttccccctggccttcgactacagccccggcagccacggcctgctgagccccgacgccggctaccagcccacccccctggccgcccccgccgagcccggcagcaagtacagcctggccagcctggacagaggccagggcagaggcggcggcggcggcggcgccctggagtacgtgcccaaggccgtgagccagcccagaagacacagcagacccgtgcccagcggcaagtacgtggtggacaacagcagaccccccaccgacctggagtacgaccccctgagcaactacagcgccagacacctgagcagagccagcagcagagacgagagagccgccaagagacccagaggcagcagaggcagcgagccctacacccccgcccccaagaagctgtgcgaccccttcggcagctgcgacgccagattcagcgacagcgaggacgaggccgccaccgtgcccggcaacgagcccaccaccgccagcacccccaaggccagagccgaccccgagatcaaggccaccggccagccccccagcaaggagggcctggaggccgagggcggcggcctgagagagaccaaggagaccgccgtgcagtgcgacgtgggcgacctgcagcccccccccgccaagcccgccagccccgcccaggtgcagagcagccaggacggcggctgccccaaggagggcaagcccaagaagaagaagaccggcgccccccccgcccccagctgcaaggacggcgcccagggcaaggacaagaccaaggacaagggcagaggcagacccgtggagaagcccagagccgacaagaagggcccccaggccagcagccccagaagaaaggccgagagacccgagggcaccaagaagaagcccagcagcgccacccccgtggccaccagcggcaagggcagacccgacagacccgccagaagacccagccccaccagcggcgacagcagacccgccgccggcagaggcccccccagacccctgcagctgcccgacagaaagagcaccaaggcccccagcggcaagctggtggagagaaaggccagaagcctggacgagggcgccagccaggacgcccccaagctgaagaagagagccctgagccacgccgacctgttcggcgacgagagcgaggacgaggccgccggccccggcgtgcccagcgtgtggcccagcgccctgcccagcctgagcagcgacagcgacagcgacagcgacagcagcctgggcttccccgaggcccagggcccccccaagagactgaaggccagccccccccccagccccgcccccagcagcagcagcagcagcagcagcagcaccagcagcgccggcgccgacgtggactacagcgccctggagaaggaggtggacttcgacagcgaccccatggaggagtgcctgagaatcttcaacgagagcaccagcgtgaagaccgaggacagaggcagactggccagacagccccccaaggaggagaagagcgaggagaagggcctgagcggcctgaccaccctgttccccggccagaagagaagaatcagccacctgagcaagcagggccaggaggtggagccccccagaagaggccccgccgtgccccccgccagaccccccaccgcccaggaggtgtgctacctgagagcccagcaggcccagagagccagcgccagcctgctgcaggcccccgccagactggccgagaagagccccagcgtgcacatcagcgcccccggcgagaagagaagaatcgcccacatccccaaccccagactggccgccgcccccaccggcgccaagagaaccctggccgccagcggcagccagagcagcaacggccccgagcccggcggccagcagctgaagaccagaaccctgagcggcatggccagcaagaccaccaccaccatcatccccaagagaatcgcccacagccccagcctgcagagcctgaagaagcccatcatccccaaggagttcggcggcaaggtgcccaccgtgatcagacagagatacctgaacctgttcatcgaggagtgcctgaagttctgcaccagcaaccaggaggccatcgagaaggccctgaacgaggagaaggtggcctacgacagaagccccagcaagaacatctacctgaacgtggccgtgaacaccctgaagaagctgagaggcctggcccccagcgccgtgcccggcctgagcaagaccagcggcagaagagtggtgagccacgaggtggtgctgggcggcagactggccgccaagaccagcttcagcctgagcagacccagcagccccagagtggaggacctgaagggcgccgccctgtacagcagactgagagagtacctgctgacccaggaccagctgaaggagaacggctaccccttcccccaccccgagagacccggcggcgccatcatcttcaccgccgaggagaagagacccaaggacagcagctgcagaacctgctgcagatgcggcaccgagtacctggtgagcagcagcggcagatgcatcagagacgaggagtgctactaccactggggcagactgagaagaaacagagtggccggcggctgggagacccagtacatgtgctgcagcgccgccgccggcagcgtgggctgccaggtggccaagcagcacgtgcaggacggcagaaaggagagactggagggcttcgtgaagaccttcgagaaggagctgagcggcgacacccaccccggcatctacgccctggactgcgagatgagctacaccacctacggcctggagctgaccagagtgaccgtggtggacaccgacgtgcacgtggtgtacgacaccttcgtgaagcccgacaacgagatcgtggactacaacaccagattcagcggcgtgaccgaggccgacctggccgacaccagcgtgaccctgagagacgtgcaggccgtgctgctgagcatgttcagcgccgacaccatcctgatcggccacagcctggagagcgacctgctggccctgaaggtgatccacagcaccgtggtggacaccagcgtgctgttcccccacagactgggcctgccctacaagagaagcctgagaaacctgatggccgactacctgagacagatcatccaggacaacgtggacggccacagcagcagcgaggacgccggcgcctgcatgcacctggtgatctggaaggtgagagaggacgccaagaccaagagatag

SEQ ID NO: 96998 - DNA, 1014 bp, Artificial Sequence
  Description of Artificial Sequence: Synthetic coding sequence
atgctgcccagcagcaccagactgggctacgacccctacaaccccgagctgcccaagccccccgcccagagagagaacggcaccctgggcctgggcgaggagcccagacccgacgtgctggagctggagctggtgaaccaggccatcgaggccgtgagaagcgaggtggagctggagcagagaagatacagagagctgctggagaccaccagagagcacagaagcgccgaggcccccgccctggcccccagaggccccaacgccagccccaccgtgggccccgacgaggacgccttccccctggccttcgactacagccccggcagccacggcctgctgagccccgacgccggctaccagcccacccccctggccgcccccgccgagcccggcagcaagtacagcctggccagcctggacagaggccagggcagaggcggcggcggcggcggcgccctggagtacgtgcccaaggccgtgagccagcccagaagacacagcagacccgtgcccagcggcaagtacgtggtggacaacagcagaccccccaccgacctggagtacgaccccctgagcaactacagcgccagacacctgagcagagccagcagcagagacgagagagccgccaagagacccagaggcagcagaggcagcgagccctacacccccgcccccaagaagctgtgcgaccccttcggcagctgcgacgccagattcagcgacagcgaggacgaggccgccaccgtgcccggcaacgagcccaccaccgccagcacccccaaggccagagccgaccccgagatcaaggccaccggccagccccccagcaaggagggcctggaggccgagggcggcggcctgagagagaccaaggagaccgccgtgcagtgcgacgtgggcgacctgcagcccccccccgccaagcccgccagccccgcccaggtgcagagcagccaggacggcggctgccccaaggagggcaagcccaagaagaagaagaccggcgcctag

SEQ ID NO: 96999 - DNA, 1482 bp, Artificial Sequence
  Description of Artificial Sequence: Synthetic coding sequence
atgggcagccacagcccctgcgcccacaccccctgcgccccccccgcccccaccggcgccaagagaaccctggccgccagcggcagccagagcagcaacggccccgagcccggcggccagcagctgaagaccagaaccctgagcggcatggccagcaagaccaccaccaccatcatccccaagagaatcgcccacagccccagcctgcagagcctgaagaagcccatcatccccaaggagttcggcggcaaggtgcccaccgtgatcagacagagatacctgaacctgttcatcgaggagtgcctgaagttctgcaccagcaaccaggaggccatcgagaaggccctgaacgaggagaaggtggcctacgacagaagccccagcaagaacatctacctgaacgtggccgtgaacaccctgaagaagctgagaggcctggcccccagcgccgtgcccggcctgagcaagaccagcggcagaagagtggtgagccacgaggtggtgctgggcggcagactggccgccaagaccagcttcagcctgagcagacccagcagccccagagtggaggacctgaagggcgccgccctgtacagcagactgagagagtacctgctgacccaggaccagctgaaggagaacggctaccccttcccccaccccgagagacccggcggcgccatcatcttcaccgccgaggagaagagacccaaggacagcagctgcagaacctgctgcagatgcggcaccgagtacctggtgagcagcagcggcagatgcatcagagacgaggagtgctactaccactggggcagactgagaagaaacagagtggccggcggctgggagacccagtacatgtgctgcagcgccgccgccggcagcgtgggctgccaggtggccaagcagcacgtgcaggacggcagaaaggagagactggagggcttcgtgaagaccttcgagaaggagctgagcggcgacacccaccccggcatctacgccctggactgcgagatgagctacaccacctacggcctggagctgaccagagtgaccgtggtggacaccgacgtgcacgtggtgtacgacaccttcgtgaagcccgacaacgagatcgtggactacaacaccagattcagcggcgtgaccgaggccgacctggccgacaccagcgtgaccctgagagacgtgcaggccgtgctgctgagcatgttcagcgccgacaccatcctgatcggccacagcctggagagcgacctgctggccctgaaggtgatccacagcaccgtggtggacaccagcgtgctgttcccccacagactgggcctgccctacaagagaagcctgagaaacctgatggccgactacctgagacagatcatccaggacaacgtggacggccacagcagcagcgaggacgccggcgcctgcatgcacctggtgatctggaaggtgagagaggacgccaagaccaagagatag

SEQ ID NO: 97000 - DNA, 714 bp, Artificial Sequence
  Description of Artificial Sequence: Synthetic coding sequence
atgctgggcggcagcctgggcagcagactgctgagaggcgtgggcggcagccacggcagattcggcgccagaggcgtgagagagggcggcgccgccatggccgccggcgagagcatggcccagagaatggtgtgggtggacctggagatgaccggcctggacatcgagaaggaccagatcatcgagatggcctgcctgatcaccgacagcgacctgaacatcctggccgagggccccaacctgatcatcaagcagcccgacgagctgctggacagcatgagcgactggtgcaaggagcaccacggcaagagcggcctgaccaaggccgtgaaggagagcaccatcaccctgcagcaggccgagtacgagttcctgagcttcgtgagacagcagaccccccccggcctgtgccccctggccggcaacagcgtgcacgaggacaagaagttcctggacaagtacatgccccagttcatgaagcacctgcactacagaatcatcgacgtgagcaccgtgaaggagctgtgcagaagatggtaccccgaggagtacgagttcgcccccaagaaggccgccagccacagagccctggacgacatcagcgagagcatcaaggagctgcagttctacagaaacaacatcttcaagaagaagatcgacgagaagaagagaaagatcatcgagaacggcgagaacgagaagaccgtgagctag

SEQ ID NO: 97001 - DNA, 753 bp, Artificial Sequence
  Description of Artificial Sequence: Synthetic coding sequence
atgggcaaggccaaggtgcccgccagcaagagagcccccagcagccccgtggccaagcccggccccgtgaagaccctgaccagaaagaagaacaagaagaagaagagattctggaagagcaaggccagagaggtgagcaagaagcccgccagcggccccggcgccgtggtgagaccccccaaggcccccgaggacttcagccagaactggaaggccctgcaggaggtgcccagatggaccggcggcagacagtacctggcccccagacccgtggagcagagcaccatcagaaaggagcccagaaagggccagatggtgatcctgttccagaacgagggcaccagcagcatcagaagcggcaagctgagaagacagccccagccccacccccccagagaggagctggaggtggtgcagaaggaggtggccgagatgctgaagggcagaatcctggtgggccacgccctgcacaacgacctgaaggtgctgttcctggaccaccccaagaagaagatcagagacacccagaagtacaagcccttcaagagccaggtgaagagcggcagacccagcctgagactgctgagcgagaagatcctgggcctgcaggtgcagcaggccgagcactgcagcatccaggacgcccaggccgccatgagactgtacgtgatggtgaagaaggagtgggagagcatggccagagacagaagacccctgctgaccgcccccgaccactgcagcgacgacgcctag

SEQ ID NO: 97002 - DNA, 1269 bp, Artificial Sequence
  Description of Artificial Sequence: Synthetic coding sequence
atgggcaaggccaaggtgcccgccagcaagagagcccccagcagccccgtggccaagcccggccccgtgaagaccctgaccagaaagaagaacaagaagaagaagagattctggaagagcaaggccagagaggtgagcaagaagcccgccagcggccccggcgccgtggtgagaccccccaaggcccccgaggacttcagccagaactggaaggccctgcaggagtggctgctgaagcagaagagccaggcccccgagaagcccctggtgatcagccagatgggcagcaagaagaagcccaagatcatccagcagaacaagaaggagaccagcccccaggtgaagggcgaggagatgcccgccggcaaggaccaggaggccagcagaggcagcgtgcccagcggcagcaagatggacagaagagcccccgtgcccagaaccaaggccagcggcaccgagcacaacaagaagggcaccaaggagagaaccaacggcgacatcgtgcccgagagaggcgacatcgagcacaagaagagaaaggccaaggaggccgcccccgccccccccaccgaggaggacatctggttcgacgacgtggaccccgccgacatcgaggccgccatcggccccgaggccgccaagatcgccagaaagcagctgggccagagcgagggcagcgtgagcctgagcctggtgaaggagcaggccttcggcggcctgaccagagccctggccctggactgcgagatggtgggcgtgggccccaagggcgaggagagcatggccgccagagtgagcatcgtgaaccagtacggcaagtgcgtgtacgacaagtacgtgaagcccaccgagcccgtgaccgactacagaaccgccgtgagcggcatcagacccgagaacctgaagcagggcgaggagctggaggtggtgcagaaggaggtggccgagatgctgaagggcagaatcctggtgggccacgccctgcacaacgacctgaaggtgctgttcctggaccaccccaagaagaagatcagagacacccagaagtacaagcccttcaagagccaggtgaagagcggcagacccagcctgagactgctgagcgagaagatcctgggcctgcaggtgcagcaggccgagcactgcagcatccaggacgcccaggccgccatgagactgtacgtgatggtgaagaaggagtgggagagcatggccagagacagaagacccctgctgaccgcccccgaccactgcagcgacgacgcctag

SEQ ID NO: 97003 - DNA, 570 bp, Artificial Sequence
  Description of Artificial Sequence: Synthetic coding sequence
atgggcagcaagaagaagcccaagatcatccagcagaacaagaaggagaccagcccccaggtgaagggcgaggagatgcccgccggcaaggaccaggaggccagcagaggcagcgtgcccagcggcagcaagatggacagaagagcccccgtgcccagaaccaaggccagcggcaccgagcacaacaagaagggcaccaaggagagaaccaacggcgacatcgtgcccgagagaggcgacatcgagcacaagaagagaaaggccaaggaggccgcccccgccccccccaccgaggaggacatctggttcgacgacgtggaccccgccgacatcgaggccgccatcggccccgaggccgccaagatcgccagaaagcagctgggccagagcgagggcagcgtgagcctgagcctggtgaaggagcaggccttcggcggcctgaccagagccctggccctggactgcgagatggtgggcgtgggccccaagggcgaggagagcatggccgccagagtgagcatcgtgaaccagtacggcaagtgcgtgtacgacaagtacgtgaagccctag

SEQ ID NO: 97004 - DNA, 1125 bp, Artificial Sequence
  Description of Artificial Sequence: Synthetic coding sequence
cccgtggccaagcccggccccgtgaagaccctgaccagaaagaagaacaagaagaagaagagattctggaagagcaaggccagagaggtgagcaagaagcccgccagcggccccggcgccgtggtgagaccccccaaggcccccgaggacttcagccagaactggaaggccctgcaggagtggctgctgaagcagaagagccaggcccccgagaagcccctggtgatcagccagatgggcagcaagaagaagcccaagatcatccagcagaacaagaaggagaccagcccccaggtgaagggcgaggagatgcccgccggcaaggaccaggaggccagcagaggcagcgtgcccagcggcagcaagatggacagaagagcccccgtgcccagaaccaaggccagcggcaccgagcacaacaagaagggcaccaaggagagaaccaacggcgacatcgtgcccgagagaggcgacatcgagcacaagaagagaaaggccaaggaggccgcccccgccccccccaccgaggaggacatctggttcgacgacgtggaccccgccgacatcgaggccgccatcggccccgaggccgccaagatcgccagaaagcagctgggccagagcgagggcagcgtgagcctgagcctggtgaaggagcaggccttcggcggcctgaccagagccctggccctggactgcgagatggtgggcgtgggccccaagggcgaggagagcatggccgccagagtgagcatcgtgaaccagtacggcaagtgcgtgtacgacaagtacgtgaagcccaccgagcccgtgaccgactacagaaccgccgtgagcggcatcagacccgagaacctgaagcagggcgaggagctggaggtggtgcagaaggaggtggccgagatgctgaagggcagaatcctggtgggccacgccctgcacaacgacctgaagagcggcagacccagcctgagactgctgagcgagaagatcctgggcctgcaggtgcagcaggacagcggctgccccggcagcaacgaggccgtgagacacggcgaggagggcgtgggcgagcacggccccagacaggccccccccgccgactgcagcagacccctgcagtag

SEQ ID NO: 97005 - DNA, 702 bp, Artificial Sequence
  Description of Artificial Sequence: Synthetic coding sequence
atgggcaaggccaaggtgcccgccagcaagagagcccccagcagccccgtggccaagcccggccccgtgaagaccctgaccagaaagaagaacaagaagaagaagagattctggaagagcaaggccagagaggtgagcaagaagcccgccagcggccccggcgccgtggtgagaccccccaaggcccccgaggacttcagccagaactggaaggccctgcaggaggtgcccagatggaccggcggcagacagtacctggcccccagacccgtggagcagagcaccatcagaaaggagcccagaaagggccagatggtgatcctgttccagaacgagggcaccagcagcatcagaagcggcaagctgagaagacagccccagccccacccccccagagaggagctggaggtggtgcagaaggaggtggccgagatgctgaagggcagaatcctggtgggccacgccctgcacaacgacctgaaggtgctgttcctggaccaccccaagaagaagatcagagacacccagaagtacaagcccttcaagagccaggtgaagagcggcagacccagcctgagactgctgagcgagaagatcctgggcctgcaggtgcagcaggccgagcactgcagcatccaggacgcccaggccgccatgagactgtacgtgatggtgaagaaggagtgggagagcatggcctag

SEQ ID NO: 97006 - DNA, 996 bp, Artificial Sequence
  Description of Artificial Sequence: Synthetic coding sequence
atgagcagagccagaggcgccctgtgcagagcctgcctggccctggccgccgccctggccgccctgctgctgctgcccctgcccctgcccagagcccccgcccccgccagaacccccgcccccgcccccagagccccccccagcagacccgccgcccccagcctgagacccgacgacgtgttcatcgccgtgaagaccaccagaaagaaccacggccccagactgagactgctgctgagaacctggatcagcagagccagacagcagaccttcatcttcaccgacggcgacgaccccgagctggagctgcagggcggcgacagagtgatcaacaccaactgcagcgccgtgagaaccagacaggccctgtgctgcaagatgagcgtggagtacgacaagttcatcgagagcggcagaaagtggttctgccacgtggacgacgacaactacgtgaacgccagaagcctgctgcacctgctgagcagcttcagccccagccaggacgtgtacctgggcagacccagcctggaccaccccatcgaggccaccgagagagtgcagggcggcagaaccgtgaccaccgtgaagttctggttcgccaccggcggcgccggcttctgcctgagcagaggcctggccctgaagatgagcccctgggccagcctgggcagcttcatgagcaccgccgagcaggtgagactgcccgacgactgcaccgtgggctacatcgtggagggcctgctgggcgccagactgctgcacagccccctgttccacagccacctggagaacctgcagagactgccccccgacaccctgctgcagcaggtgaccctgagccacggcggccccgagaacccccacaacgtggtgaacgtggccggcggcttcagcctgcaccaggaccccaccagattcaagagcatccactgcctgctgtaccccgacaccgactggtgccccagacagaagcagggcgcccccaccagcagatag

SEQ ID NO: 97007 - DNA, 873 bp, Artificial Sequence
  Description of Artificial Sequence: Synthetic coding sequence
atgagcagagccccccccagcagacccgccgcccccagcctgagacccgacgacgtgttcatcgccgtgaagaccaccagaaagaaccacggccccagactgagactgctgctgagaacctggatcagcagagccagacagcagaccttcatcttcaccgacggcgacgaccccgagctggagctgcagggcggcgacagagtgatcaacaccaactgcagcgccgtgagaaccagacaggccctgtgctgcaagatgagcgtggagtacgacaagttcatcgagagcggcagaaagtggttctgccacgtggacgacgacaactacgtgaacgccagaagcctgctgcacctgctgagcagcttcagccccagccaggacgtgtacctgggcagacccagcctggaccaccccatcgaggccaccgagagagtgcagggcggcagaaccgtgaccaccgtgaagttctggttcgccaccggcggcgccggcttctgcctgagcagaggcctggccctgaagatgagcccctgggccagcctgggcagcttcatgagcaccgccgagcaggtgagactgcccgacgactgcaccgtgggctacatcgtggagggcctgctgggcgccagactgctgcacagccccctgttccacagccacctggagaacctgcagagactgccccccgacaccctgctgcagcaggtgaccctgagccacggcggccccgagaacccccacaacgtggtgaacgtggccggcggcttcagcctgcaccaggaccccaccagattcaagagcatccactgcctgctgtaccccgacaccgactggtgccccagacagaagcagggcgcccccaccagcagatag

SEQ ID NO: 97008 - DNA, 1626 bp, Artificial Sequence
  Description of Artificial Sequence: Synthetic coding sequence
atgggcagccaggaggtgctgggccacgccgccagactggccagcagcggcctgctgctgcaggtgctgttcagactgatcaccttcgtgctgaacgccttcatcctgagattcctgagcaaggagatcgtgggcgtggtgaacgtgagactgaccctgctgtacagcaccaccctgttcctggccagagaggccttcagaagagcctgcctgagcggcggcacccagagagactggagccagaccctgaacctgctgtggctgaccgtgcccctgggcgtgttctggagcctgttcctgggctggatctggctgcagctgctggaggtgcccgaccccaacgtggtgccccactacgccaccggcgtggtgctgttcggcctgagcgccgtggtggagctgctgggcgagcccttctgggtgctggcccaggcccacatgttcgtgaagctgaaggtgatcgccgagagcctgagcgtgatcctgaagagcgtgctgaccgccttcctggtgctgtggctgccccactggggcctgtacatcttcagcctggcccagctgttctacaccaccgtgctggtgctgtgctacgtgatctacttcaccaagctgctgggcagccccgagagcaccaagctgcagaccctgcccgtgagcagaatcaccgacctgctgcccaacatcaccagaaacggcgccttcatcaactggaaggaggccaagctgacctggagcttcttcaagcagagcttcctgaagcagatcctgaccgagggcgagagatacgtgatgaccttcctgaacgtgctgaacttcggcgaccagggcgtgtacgacatcgtgaacaacctgggcagcctggtggccagactgatcttccagcccatcgaggagagcttctacatcttcttcgccaaggtgctggagagaggcaaggacgccaccctgcagaagcaggaggacgtggccgtggccgccgccgtgctggagagcctgctgaagctggccctgctggccggcctgaccatcaccgtgttcggcttcgcctacagccagctggccctggacatctacggcggcaccatgctgagcagcggcagcggccccgtgctgctgagaagctactgcctgtacgtgctgctgctggccatcaacggcgtgaccgagtgcttcaccttcgccgccatgagcaaggaggaggtggacagatacaacttcgtgatgctggccctgagcagcagcttcctggtgctgagctacctgctgaccagatggtgcggcagcgtgggcttcatcctggccaactgcttcaacatgggcatcagaatcacccagagcctgtgcttcatccacagatactacagaagaagcccccacagacccctggccggcctgcacctgagccccgtgctgctgggcaccttcgccctgagcggcggcgtgaccgccgtgagcgaggtgttcctgtgctgcgagcagggctggcccgccagactggcccacatcgccgtgggcgccttctgcctgggcgccaccctgggcaccgccttcctgaccgagaccaagctgatccacttcctgagaacccagctgggcgtgcccagaagaaccgacaagatgacctag

SEQ ID NO: 97009 - DNA, 1509 bp, Artificial Sequence
  Description of Artificial Sequence: Synthetic coding sequence
atgggcagccaggaggtgctgggccacgccgccagactggccagcagcggcctgctgctgcaggtgctgttcagactgatcaccttcgtgctgaacgccttcatcctgagattcctgagcaaggagatcgtgggcgtggtgaacgtgagagtgcccctgggcgtgttctggagcctgttcctgggctggatctggctgcagctgctggaggtgcccgaccccaacgtggtgccccactacgccaccggcgtggtgctgttcggcctgagcgccgtggtggagctgctgggcgagcccttctgggtgctggcccaggcccacatgttcgtgaagctgaaggtgatcgccgagagcctgagcgtgatcctgaagagcgtgctgaccgccttcctggtgctgtggctgccccactggggcctgtacatcttcagcctggcccagctgttctacaccaccgtgctggtgctgtgctacgtgatctacttcaccaagctgctgggcagccccgagagcaccaagctgcagaccctgcccgtgagcagaatcaccgacctgctgcccaacatcaccagaaacggcgccttcatcaactggaaggaggccaagctgacctggagcttcttcaagcagagcttcctgaagcagatcctgaccgagggcgagagatacgtgatgaccttcctgaacgtgctgaacttcggcgaccagggcgtgtacgacatcgtgaacaacctgggcagcctggtggccagactgatcttccagcccatcgaggagagcttctacatcttcttcgccaaggtgctggagagaggcaaggacgccaccctgcagaagcaggaggacgtggccgtggccgccgccgtgctggagagcctgctgaagctggccctgctggccggcctgaccatcaccgtgttcggcttcgcctacagccagctggccctggacatctacggcggcaccatgctgagcagcggcagcggccccgtgctgctgagaagctactgcctgtacgtgctgctgctggccatcaacggcgtgaccgagtgcttcaccttcgccgccatgagcaaggaggaggtggacagatacaacttcgtgatgctggccctgagcagcagcttcctggtgctgagctacctgctgaccagatggtgcggcagcgtgggcttcatcctggccaactgcttcaacatgggcatcagaatcacccagagcctgtgcttcatccacagatactacagaagaagcccccacagacccctggccggcctgcacctgagccccgtgctgctgggcaccttcgccctgagcggcggcgtgaccgccgtgagcgaggtgttcctgtgctgcgagcagggctggcccgccagactggcccacatcgccgtgggcgccttctgcctgggcgccaccctgggcaccgccttcctgaccgagaccaagctgatccacttcctgagaacccagctgggcgtgcccagaagaaccgacaagatgacctag

SEQ ID NO: 97010 - DNA, 4308 bp, Artificial Sequence
  Description of Artificial Sequence: Synthetic coding sequence
atggcccagacccccgacggcatcagctgcgagctgagaggcgagatcaccagattcctgtggcccaaggaggtggagctgctgctgaagacctggctgcccggcgagggcgccgtgcagaaccacgtgctggccctgctgagatggagagcctacctgctgcacaccacctgcctgcccctgagagtggactgcaccttcagctacctggaggtgcaggccatggccctgcaggagacccccccccaggtgaccttcgagctggagagcctgagagagctggtgctggagttccccggcgtggccgccctggagcagctggcccagcacgtggccgccgccatcaagaaggtgttccccagaagcaccctgggcaagctgttcagaagacccacccccgccagcatgctggccagactggagagaagcagccccagcgagagcaccgacccctgcagcccctgcggcggcttcctggagacctacgaggccctgtgcgactacaacggcttccccttcagagaggagatccagtgggacgtggacaccatctaccacagacagggctgcagacacttcagcctgggcgacttcagccacctgggcagcagagacctggccctgagcgtggccgccctgagctacaacctgtggttcagatgcctgagctgcgtggacatgaagctgagcctggaggtgagcgagcagatcctgcacatgatgagccagagcagccacctggaggagctggtgctggagacctgcagcctgagaggcgacttcgtgagaagactggcccaggccctggccggccacagcagcagcggcctgagagagctgagcctggccggcaacctgctggacgacagaggcatgaccgccctgagcagacacctggagagatgccccggcgccctgagaagactgagcctggcccagaccggcctgacccccagaggcatgagagccctgggcagagccctggccaccaacgccgccttcgacagcaccctgacccacctggacctgagcggcaaccccggcgccctgggcgccagcgaggacagcggcggcctgtacagcttcctgagcagacccaacgtgctgagcttcctgaacctggccggcaccgacaccgccctggacaccgtgagaggctgcagcgtgggcggctggatgaccggcagagccgactggagagccggcagaggcggcctgggcccccccgccggcgtggccaacagcctgcccccccagctgttcgccgccgtgagcagaggctgctgcaccagcctgacccacctggacgccagcagaaacgtgttcagcagaaccaagagcagagccgcccccgccgccctgcagctgttcctgagcagagccagaaccctgagacacctgggcctggccggctgcaagctgccccccgacgccctgagagccctgctggacggcctggccctgaacacccacctgagagacctgcacctggacctgagcgcctgcgagctgagaagcgccggcgcccaggtgatccaggacctggtgtgcgacgccggcgccgtgagcagcctggacctggccgacaacggcttcggcagcgacatggtgaccctggtgctggccatcggcagaagcagaagcctgagacacgtggccctgggcagaaacttcaacgtgagatgcaaggagaccctggacgacgtgctgcacagaatcgtgcagctgatgcaggacgacgactgccccctgcagagcctgagcgtggccgagagcagactgaagctgggcgccagcgtgctgctgagagccctggccaccaaccccaacctgaccgccctggacatcagcggcaacgccatgggcgacgccggcgccaagctgctggccaaggccctgagagtgaacagcagactgagaagcgtggtgtgggacagaaaccacaccagcgccctgggcctgctggacgtggcccaggccctggagcagaaccacagcctgaaggccatgcccctgcccctgaacgacgtggcccaggcccagagaagcagacccgagctgaccgccagagccgtgcaccagatccaggcctgcctgctgagaaacaacagagccgaccccgccagcagcgaccacaccaccagactgcagcccctgggcctggtgagcgaccccagcgagcaggaggtgaacgagctgtgccagagcgtgcaggagcacgtggagctgctgggctgcggcgccggcccccagggcgaggccgccgtgagacaggccgaggacgccatccagaacgccaacttcagcctgagcatcctgcccatcctgtacgaggccggcagcagccccagccaccactggcagctgggccagaagctggagggcctgctgagacaggtgggcgaggtgtgcagacaggacatccaggacttcacccaggccaccctggacaccgccagaagcctgtgcccccagatgctgcagggcagcagctggagagagcagctggagggcgtgctggccggcagcagaggcctgcccgagctgctgcccgagcagctgctgcaggacgccttcaccagactgagagacatgagactgagcatcaccggcaccctggccgagagcatcgtggcccaggccctggccggcctgagcgccgccagagaccagctggtggagagcctggcccagcaggccaccgtgaccatgccccccgccctgcccgcccccgacggcggcgagcccagcctgctggagcccggcgagctggagggcctgttcttccccgaggagaaggaggaggagaaggagaaggacgacagccccccccagaagtggcccgagctgagccacggcctgcacctggtgcccttcatccacagcgccgccgaggaggccgagcccgagcccgagctggccgcccccggcgaggacgccgagccccaggccggccccagcgccagaggcagccccagccccgccgcccccggcccccccgccggccccctgcccagaatggacctgcccctggccggccagcccctgagacaccccaccagagccagacccagacccagaagacagcaccaccacagacccccccccggcggcccccaggtgccccccgccctgccccaggagggcaacggcctgagcgccagagtggacgagggcgtggaggagttcttcagcaagagactgatccagcaggacagactgtgggcccccgaggaggaccccgccaccgagggcggcgccacccccgtgcccagaaccctgagaaagaagctgggcaccctgttcgccttcaagaagcccagaagcaccagaggccccagaaccgacctggagaccagccccggcgccgcccccagaaccagaaagaccaccttcggcgacctgctgagaccccccaccagacccagcagaggcgaggagctgggcggcgccgagggcgacaccagcagccccgaccccgccggcagaagcagacccagatacaccagagacagcaaggcctacagcatgatcctgctgcccgccgaggaggaggccaccctgggcgccagacccgacaagagaagacccctggagagaggcgagaccgagctggcccccagcttcgagcagagagtgcaggtgatgctgcagagaatcggcgtgagcagaggcagcggcggcgccgagggcaagagaaagcagagcaaggacggcgagatcaagaaggccggcagcgacggcgacatcatggacagcagcaccgaggccccccccatcagcatcaagagcagaacccacagcgtgagcgccgaccccagctgcagacccggccccggcagccagggccccgagagcgccacctggaagaccctgggccagcagctgaacgccgagctgagaagcagaggctggggccagcaggacggccccggcccccccagccccggccagagccccagcccctgcagaaccagccccagccccgacagcctgggcctgcccgaggacccctgcctgggccccagaaacgaggacggccagctgagacccagacccctgagcgccggcagaagagccgtgagcgtgcacgaggaccagctgcaggcccccgccgagagacccctgagactgcagagaagccccgtgctgaagagaagacccaagctggaggccccccccagccccagcctgggcagcggcctgggcaccgagcccctgcccccccagcccaccgagcccagcagccccgagagaagcccccccagccccgccaccgaccagagaggcggcggccccaacccctag

SEQ ID NO: 97011 - DNA, 1335 bp, Artificial Sequence
  Description of Artificial Sequence: Synthetic coding sequence
atgccccccgccctgcccgcccccgacggcggcgagcccagcctgctggagcccggcgagctggagggcctgttcttccccgaggagaaggaggaggagaaggagaaggacgacagccccccccagaagtggcccgagctgagccacggcctgcacctggtgcccttcatccacagcgccgccgaggaggccgagcccgagcccgagctggccgcccccggcgaggacgccgagccccaggccggccccagcgccagaggcagccccagccccgccgcccccggcccccccgccggccccctgcccagaatggacctgcccctggccggccagcccctgagacaccccaccagagccagacccagacccagaagacagcaccaccacagacccccccccggcggcccccaggtgccccccgccctgccccaggagggcaacggcctgagcgccagagtggacgagggcgtggaggagttcttcagcaagagactgatccagcaggacagactgtgggcccccgaggaggaccccgccaccgagggcggcgccacccccgtgcccagaaccctgagaaagaagctgggcaccctgttcgccttcaagaagcccagaagcaccagaggccccagaaccgacctggagaccagccccggcgccgcccccagaaccagaaagaccaccttcggcgacctgctgagaccccccaccagacccagcagaggcgaggagctgggcggcgccgagggcgacaccagcagccccgaccccgccggcagaagcagacccagatacaccagagacagcaaggcctacagcatgatcctgctgcccgccgaggaggaggccaccctgggcgccagacccgacaagagaagacccctggagagaggcgagaccgagctggcccccagcttcgagcagagagtgcaggtgatgctgcagagaatcggcgtgagcagaggcagcggcggcgccgagggcaagagaaagcagagcaaggacggcgagatcaagaaggccggcagcgacggcgacatcatggacagcagcaccgaggccccccccatcagcatcaagagcagaacccacagcgtgagcgccgaccccagctgcagacccggccccggcagccagggccccgagagcgccacctggaagaccctgggccagcagctgaacgccgagctgagaagcagaggctggggccagcaggacggccccggcccccccagccccggccagagccccagcccctgcagaacccccccccagaccgcctgggccagccagagaaccctggcctgggcccccgagatgaagaacggcccctag

SEQ ID NO: 97012 - DNA, 4119 bp, Artificial Sequence
  Description of Artificial Sequence: Synthetic coding sequence
atggcccagacccccgacggcatcagctgcgagctgagaggcgagatcaccagattcctgtggcccaaggaggtggagctgctgctgaagacctggctgcccggcgagggcgccgtgcagaaccacgtgctggccctgctgagatggagagcctacctgctgcacaccacctgcctgcccctgagagtggactgcaccttcagctacctggaggtgcaggccatggccctgcaggagacccccccccaggtgaccttcgagctggagagcctgagagagctggtgctggagttccccggcgtggccgccctggagcagctggcccagcacgtggccgccgccatcaagaaggtgttccccagaagcaccctgggcaagctgttcagaagacccacccccgccagcatgctggccagactggagagaagcagccccagcgagagcaccgacccctgcagcccctgcggcggcttcctggagacctacgaggccctgtgcgactacaacggcttccccttcagagaggagatccagtgggacgtggacaccatctaccacagacagggctgcagacacttcagcctgggcgacttcagccacctgggcagcagagacctggccctgagcgtggccgccctgagctacaacctgtggttcagatgcctgagctgcgtggacatgaagctgagcctggaggtgagcgagcagatcctgcacatgatgagccagagcagccacctggaggagctggtgctggagacctgcagcctgagaggcgacttcgtgagaagactggcccaggccctggccggccacagcagcagcggcctgagagagctgagcctggccggcaacctgctggacgacagaggcatgaccgccctgagcagacacctggagagatgccccggcgccctgagaagactgagcctggcccagaccggcctgacccccagaggcatgagagccctgggcagagccctggccaccaacgccgccttcgacagcaccctgacccacctggacctgagcggcaaccccggcgccctgggcgccagcgaggacagcggcggcctgtacagcttcctgagcagacccaacgtgctgagcttcctgaacctggccggcaccgacaccgccctggacaccctgttcgccgccgtgagcagaggctgctgcaccagcctgacccacctggacgccagcagaaacgtgttcagcagaaccaagagcagagccgcccccgccgccctgcagctgttcctgagcagagccagaaccctgagacacctgggcctggccggctgcaagctgccccccgacgccctgagagccctgctggacggcctggccctgaacacccacctgagagacctgcacctggacctgagcgcctgcgagctgagaagcgccggcgcccaggtgatccaggacctggtgtgcgacgccggcgccgtgagcagcctggacctggccgacaacggcttcggcagcgacatggtgaccctggtgctggccatcggcagaagcagaagcctgagacacgtggccctgggcagaaacttcaacgtgagatgcaaggagaccctggacgacgtgctgcacagaatcgtgcagctgatgcaggacgacgactgccccctgcagagcctgagcgtggccgagagcagactgaagctgggcgccagcgtgctgctgagagccctggccaccaaccccaacctgaccgccctggacatcagcggcaacgccatgggcgacgccggcgccaagctgctggccaaggccctgagagtgaacagcagactgagaagcgtggtgtgggacagaaaccacaccagcgccctgggcctgctggacgtggcccaggccctggagcagaaccacagcctgaaggccatgcccctgcccctgaacgacgtggcccaggcccagagaagcagacccgagctgaccgccagagccgtgcaccagatccaggcctgcctgctgagaaacaacagagccgaccccgccagcagcgaccacaccaccagactgcagcccctgggcctggtgagcgaccccagcgagcaggaggtgaacgagctgtgccagagcgtgcaggagcacgtggagctgctgggctgcggcgccggcccccagggcgaggccgccgtgagacaggccgaggacgccatccagaacgccaacttcagcctgagcatcctgcccatcctgtacgaggccggcagcagccccagccaccactggcagctgggccagaagctggagggcctgctgagacaggtgggcgaggtgtgcagacaggacatccaggacttcacccaggccaccctggacaccgccagaagcctgtgcccccagatgctgcagggcagcagctggagagagcagctggagggcgtgctggccggcagcagaggcctgcccgagctgctgcccgagcagctgctgcaggacgccttcaccagactgagagacatgagactgagcatcaccggcaccctggccgagagcatcgtggcccaggccctggccggcctgagcgccgccagagaccagctggtggagagcctggcccagcaggccaccgtgaccatgccccccgccctgcccgcccccgacggcggcgagcccagcctgctggagcccggcgagctggagggcctgttcttccccgaggagaaggaggaggagaaggagaaggacgacagccccccccagaagtggcccgagctgagccacggcctgcacctggtgcccttcatccacagcgccgccgaggaggccgagcccgagcccgagctggccgcccccggcgaggacgccgagccccaggccggccccagcgccagaggcagccccagccccgccgcccccggcccccccgccggccccctgcccagaatggacctgcccctggccggccagcccctgagacaccccaccagagccagacccagacccagaagacagcaccaccacagacccccccccggcggcccccaggtgccccccgccctgccccaggagggcaacggcctgagcgccagagtggacgagggcgtggaggagttcttcagcaagagactgatccagcaggacagactgtgggcccccgaggaggaccccgccaccgagggcggcgccacccccgtgcccagaaccctgagaaagaagctgggcaccctgttcgccttcaagaagcccagaagcaccagaggccccagaaccgacctggagaccagccccggcgccgcccccagaaccagaaagaccaccttcggcgacctgctgagaccccccaccagacccagcagaggcgaggagctgggcggcgccgagggcgacaccagcagccccgaccccgccggcagaagcagacccagatacaccagagacagcaaggcctacagcatgatcctgctgcccgccgaggaggaggccaccctgggcgccagacccgacaagagaagacccctggagagaggcgagaccgagctggcccccagcttcgagcagagagtgcaggtgatgctgcagagaatcggcgtgagcagaggcagcggcggcgccgagggcaagagaaagcagagcaaggacggcgagatcaagaaggccggcagcgacggcgacatcatggacagcagcaccgaggccccccccatcagcatcaagagcagaacccacagcgtgagcgccgaccccagctgcagacccggccccggcagccagggccccgagagcgccacctggaagaccctgggccagcagctgaacgccgagctgagaagcagaggctggggccagcaggacggccccggcccccccagccccggccagagccccagcccctgcagaaccagccccagccccgacagcctgggcctgcccgaggacccctgcctgggccccagaaacgaggagagacccctgagactgcagagaagccccgtgctgaagagaagacccaagctggaggccccccccagccccagcctgggcagcggcctgggcaccgagcccctgcccccccagcccaccgagcccagcagccccgagagaagcccccccagccccgccaccgaccagagaggcggcggccccaacccctag

SEQ ID NO: 97013 - DNA, 1305 bp, Artificial Sequence
  Description of Artificial Sequence: Synthetic coding sequence
atgggcatgggcagaggcgccggcagaagcgccctgggcttctggcccaccctggccttcctgctgtgcagcttccccgccgccaccagcccctgcaagatcctgaagtgcaacagcgagttctggagcgccaccagcggcagccacgcccccgccagcgacgacacccccgagttctgcgccgccctgagaagctacgccctgtgcaccagaagaaccgccagaacctgcagaggcgacctggcctaccacagcgccgtgcacggcatcgaggacctgatgagccagcacaactgcagcaaggacggccccaccagccagcccagactgagaaccctgccccccgccggcgacagccaggagagaagcgacagccccgagatctgccactacgagaagagcttccacaagcacagcgccacccccaactacacccactgcggcctgttcggcgacccccacctgagaaccttcaccgacagattccagacctgcaaggtgcagggcgcctggcccctgatcgacaacaactacctgaacgtgcaggtgaccaacacccccgtgctgcccggcagcgccgccaccgccaccagcaagctgaccatcatcttcaagaacttccaggagtgcgtggaccagaaggtgtaccaggccgagatggacgagctgcccgccgccttcgtggacggcagcaagaacggcggcgacaagcacggcgccaacagcctgaagatcaccgagaaggtgagcggccagcacgtggagatccaggccaagtacatcggcaccaccatcgtggtgagacaggtgggcagatacctgaccttcgccgtgagaatgcccgaggaggtggtgaacgccgtggaggactgggacagccagggcctgtacctgtgcctgagaggctgccccctgaaccagcagatcgacttccaggccttccacaccaacgccgagggcaccggcgccagaagactggccgccgccagccccgcccccaccgcccccgagaccttcccctacgagaccgccgtggccaagtgcaaggagaagctgcccgtggaggacctgtactaccaggcctgcgtgttcgacctgctgaccaccggcgacgtgaacttcaccctggccgcctactacgccctggaggacgtgaagatgctgcacagcaacaaggacaagctgcacctgtacgacagaaccagagacctgcccggcagagccgccgccggcctgcccctggcccccagacccctgctgggcgccctggtgcccctgctggccctgctgcccgtgttctgctag

SEQ ID NO: 97014 - DNA, 1353 bp, Artificial Sequence
  Description of Artificial Sequence: Synthetic coding sequence
atgcagccccccagagagagactggtggtgaccggcagagccggctggatgggcatgggcagaggcgccggcagaagcgccctgggcttctggcccaccctggccttcctgctgtgcagcttccccgccgccaccagcccctgcaagatcctgaagtgcaacagcgagttctggagcgccaccagcggcagccacgcccccgccagcgacgacacccccgagttctgcgccgccctgagaagctacgccctgtgcaccagaagaaccgccagaacctgcagaggcgacctggcctaccacagcgccgtgcacggcatcgaggacctgatgagccagcacaactgcagcaaggacggccccaccagccagcccagactgagaaccctgccccccgccggcgacagccaggagagaagcgacagccccgagatctgccactacgagaagagcttccacaagcacagcgccacccccaactacacccactgcggcctgttcggcgacccccacctgagaaccttcaccgacagattccagacctgcaaggtgcagggcgcctggcccctgatcgacaacaactacctgaacgtgcaggtgaccaacacccccgtgctgcccggcagcgccgccaccgccaccagcaagctgaccatcatcttcaagaacttccaggagtgcgtggaccagaaggtgtaccaggccgagatggacgagctgcccgccgccttcgtggacggcagcaagaacggcggcgacaagcacggcgccaacagcctgaagatcaccgagaaggtgagcggccagcacgtggagatccaggccaagtacatcggcaccaccatcgtggtgagacaggtgggcagatacctgaccttcgccgtgagaatgcccgaggaggtggtgaacgccgtggaggactgggacagccagggcctgtacctgtgcctgagaggctgccccctgaaccagcagatcgacttccaggccttccacaccaacgccgagggcaccggcgccagaagactggccgccgccagccccgcccccaccgcccccgagaccttcccctacgagaccgccgtggccaagtgcaaggagaagctgcccgtggaggacctgtactaccaggcctgcgtgttcgacctgctgaccaccggcgacgtgaacttcaccctggccgcctactacgccctggaggacgtgaagatgctgcacagcaacaaggacaagctgcacctgtacgacagaaccagagacctgcccggcagagccgccgccggcctgcccctggcccccagacccctgctgggcgccctggtgcccctgctggccctgctgcccgtgttctgctag

SEQ ID NO: 97015 - DNA, 1305 bp, Artificial Sequence; identical to SEQ ID NO: 97013
  Description of Artificial Sequence: Synthetic coding sequence

SEQ ID NO: 97016 - DNA, 1026 bp, Artificial Sequence
  Description of Artificial Sequence: Synthetic coding sequence
atgagccagcacaactgcagcaaggacggccccaccagccagcccagactgagaaccctgccccccgccggcgacagccaggagagaagcgacagccccgagatctgccactacgagaagagcttccacaagcacagcgccacccccaactacacccactgcggcctgttcggcgacccccacctgagaaccttcaccgacagattccagacctgcaaggtgcagggcgcctggcccctgatcgacaacaactacctgaacgtgcaggtgaccaacacccccgtgctgcccggcagcgccgccaccgccaccagcaagctgaccatcatcttcaagaacttccaggagtgcgtggaccagaaggtgtaccaggccgagatggacgagctgcccgccgccttcgtggacggcagcaagaacggcggcgacaagcacggcgccaacagcctgaagatcaccgagaaggtgagcggccagcacgtggagatccaggccaagtacatcggcaccaccatcgtggtgagacaggtgggcagatacctgaccttcgccgtgagaatgcccgaggaggtggtgaacgccgtggaggactgggacagccagggcctgtacctgtgcctgagaggctgccccctgaaccagcagatcgacttccaggccttccacaccaacgccgagggcaccggcgccagaagactggccgccgccagccccgcccccaccgcccccgagaccttcccctacgagaccgccgtggccaagtgcaaggagaagctgcccgtggaggacctgtactaccaggcctgcgtgttcgacctgctgaccaccggcgacgtgaacttcaccctggccgcctactacgccctggaggacgtgaagatgctgcacagcaacaaggacaagctgcacctgtacgacagaaccagagacctgcccggcagagccgccgccggcctgcccctggcccccagacccctgctgggcgccctggtgcccctgctggccctgctgcccgtgttctgctag

SEQ ID NO: 97017 - DNA, 1305 bp, Artificial Sequence; identical to SEQ ID NO: 97013
  Description of Artificial Sequence: Synthetic coding sequence

SEQ ID NO: 97018 - DNA, 1377 bp, Artificial Sequence
  Description of Artificial Sequence: Synthetic coding sequence
atgggcggcctgggccccagaagagccggcaccagcagagagagactggtggtgaccggcagagccggctggatgggcatgggcagaggcgccggcagaagcgccctgggcttctggcccaccctggccttcctgctgtgcagcttccccgccgccaccagcccctgcaagatcctgaagtgcaacagcgagttctggagcgccaccagcggcagccacgcccccgccagcgacgacacccccgagttctgcgccgccctgagaagctacgccctgtgcaccagaagaaccgccagaacctgcagaggcgacctggcctaccacagcgccgtgcacggcatcgaggacctgatgagccagcacaactgcagcaaggacggccccaccagccagcccagactgagaaccctgccccccgccggcgacagccaggagagaagcgacagccccgagatctgccactacgagaagagcttccacaagcacagcgccacccccaactacacccactgcggcctgttcggcgacccccacctgagaaccttcaccgacagattccagacctgcaaggtgcagggcgcctggcccctgatcgacaacaactacctgaacgtgcaggtgaccaacacccccgtgctgcccggcagcgccgccaccgccaccagcaagctgaccatcatcttcaagaacttccaggagtgcgtggaccagaaggtgtaccaggccgagatggacgagctgcccgccgccttcgtggacggcagcaagaacggcggcgacaagcacggcgccaacagcctgaagatcaccgagaaggtgagcggccagcacgtggagatccaggccaagtacatcggcaccaccatcgtggtgagacaggtgggcagatacctgaccttcgccgtgagaatgcccgaggaggtggtgaacgccgtggaggactgggacagccagggcctgtacctgtgcctgagaggctgccccctgaaccagcagatcgacttccaggccttccacaccaacgccgagggcaccggcgccagaagactggccgccgccagccccgcccccaccgcccccgagaccttcccctacgagaccgccgtggccaagtgcaaggagaagctgcccgtggaggacctgtactaccaggcctgcgtgttcgacctgctgaccaccggcgacgtgaacttcaccctggccgcctactacgccctggaggacgtgaagatgctgcacagcaacaaggacaagctgcacctgtacgacagaaccagagacctgcccggcagagccgccgccggcctgcccctggcccccagacccctgctgggcgccctggtgcccctgctggccctgctgcccgtgttctgctag

SEQ ID NO: 97019 - DNA, 1437 bp, Artificial Sequence
  Description of Artificial Sequence: Synthetic coding sequence
atgatcagaaagaagagaaagagaagcgccccccccggcccctgcagaagccacggccccagacccgccaccgcccccgcccccccccccagccccgagcccaccagacccgcctggaccggcatgggcctgagagccgcccccagcagcgccgccgccgccgccgccgaggtggagcagagaagaagccccggcctgtgccccccccccctggagctgctgctgctgctgctgttcagcctgggcctgctgcacgccggcgactgccagcagcccgcccagtgcagaatccagaagtgcaccaccgacttcgtgagcctgaccagccacctgaacagcgccgtggacggcttcgacagcgagttctgcaaggccctgagagcctacgccggctgcacccagagaaccagcaaggcctgcagaggcaacctggtgtaccacagcgccgtgctgggcatcagcgacctgatgagccagagaaactgcagcaaggacggccccaccagcagcaccaaccccgaggtgacccacgacccctgcaactaccacagccacgccggcgccagagagcacagaagaggcgaccagaacccccccagctacctgttctgcggcctgttcggcgacccccacctgagaaccttcaaggacaacttccagacctgcaaggtggagggcgcctggcccctgatcgacaacaactacctgagcgtgcaggtgaccaacgtgcccgtggtgcccggcagcagcgccaccgccaccaacaagatcaccatcatcttcaaggcccaccacgagtgcaccgaccagaaggtgtaccaggccgtgaccgacgacctgcccgccgccttcgtggacggcaccaccagcggcggcgacagcgacgccaagagcctgagaatcgtggagagagagagcggccactacgtggagatgcacgccagatacatcggcaccaccgtgttcgtgagacaggtgggcagatacctgaccctggccatcagaatgcccgaggacctggccatgagctacgaggagagccaggacctgcagctgtgcgtgaacggctgccccctgagcgagagaatcgacgacggccagggccaggtgagcgccatcctgggccacagcctgcccagaaccagcctggtgcaggcctggcccggctacaccctggagaccgccaacacccagtgccacgagaagatgcccgtgaaggacatctacttccagagctgcgtgttcgacctgctgaccaccggcgacgccaacttcaccgccgccgcccacagcgccctggaggacgtggaggccctgcaccccagaaaggagagatggcacatcttccccagcagcggcaacggcacccccagaggcggcagcgacctgagcgtgagcctgggcctgacctgcctgatcctgatcgtgttcctgtag

SEQ ID NO: 97020 - DNA, 1314 bp, Artificial Sequence
  Description of Artificial Sequence: Synthetic coding sequence
atgggcctgagagccgcccccagcagcgccgccgccgccgccgccgaggtggagcagagaagaagccccggcctgtgccccccccccctggagctgctgctgctgctgctgttcagcctgggcctgctgcacgccggcgactgccagcagcccgcccagtgcagaatccagaagtgcaccaccgacttcgtgagcctgaccagccacctgaacagcgccgtggacggcttcgacagcgagttctgcaaggccctgagagcctacgccggctgcacccagagaaccagcaaggcctgcagaggcaacctggtgtaccacagcgccgtgctgggcatcagcgacctgatgagccagagaaactgcagcaaggacggccccaccagcagcaccaaccccgaggtgacccacgacccctgcaactaccacagccacgccggcgccagagagcacagaagaggcgaccagaacccccccagctacctgttctgcggcctgttcggcgacccccacctgagaaccttcaaggacaacttccagacctgcaaggtggagggcgcctggcccctgatcgacaacaactacctgagcgtgcaggtgaccaacgtgcccgtggtgcccggcagcagcgccaccgccaccaacaagatcaccatcatcttcaaggcccaccacgagtgcaccgaccagaaggtgtaccaggccgtgaccgacgacctgcccgccgccttcgtggacggcaccaccagcggcggcgacagcgacgccaagagcctgagaatcgtggagagagagagcggccactacgtggagatgcacgccagatacatcggcaccaccgtgttcgtgagacaggtgggcagatacctgaccctggccatcagaatgcccgaggacctggccatgagctacgaggagagccaggacctgcagctgtgcgtgaacggctgccccctgagcgagagaatcgacgacggccagggccaggtgagcgccatcctgggccacagcctgcccagaaccagcctggtgcaggcctggcccggctacaccctggagaccgccaacacccagtgccacgagaagatgcccgtgaaggacatctacttccagagctgcgtgttcgacctgctgaccaccggcgacgccaacttcaccgccgccgcccacagcgccctggaggacgtggaggccctgcaccccagaaaggagagatggcacatcttccccagcagcggcaacggcacccccagaggcggcagcgacctgagcgtgagcctgggcctgacctgcctgatcctgatcgtgttcctgtag

SEQ ID NO: 97021 - DNA, 1176 bp, Artificial Sequence
  Description of Artificial Sequence: Synthetic coding sequence
atgatcgaggtggtggccgagctgagcagaggccccgtgttcctggccggcgaggccctggagtgcgtggtgaccgtgaccaaccccctgccccccaccgccaccagcgccagcagcgaggccctggcctgggccagcgcccagatccactgccagttccacgccagcgagagcagagtggccctgcccccccccgacagcagccagcccgacgtgcagcccgacagccagaccgtgttcctgccccacagaggcgagagaggccagtgcatcctgagcaccccccccaagatcctgttctgcgacctgagactggaccccggcgagagcaagagctacagctacagcgaggtgctgcccatcgagggcccccccagcttcagaggccagagcgtgaagtacgtgtacaagctgaccatcggctgccagagagtgaacagccccatcaccctgctgagagtgcccctgagagtgctggtgctgaccggcctgcaggacgtgagattcccccaggacgaggccgtggcccccagcagccccttcctggaggaggacgagggcggcaagaaggacagctggctggccgagctggccggcgagagactgatggccgccaccagctgcagaagcctgcacctgtacaacatcagcgacggcagaggcaaggtgggcaccttcggcatcttcaagagcgtgtacagactgggcgaggacgtggtgggcaccctgaacctgggcgagggcaccgtggcctgcctgcagttcagcgtgagcctgcagaccgaggagagagtgcagcccgagtaccagagaagaagaggcgccggcggcgtgcccagcgtgagccacgtgacccacgccagacaccaggagagctgcctgcacaccaccagaaccagcttcagcctgcccatccccctgagcagcacccccggcttctgcaccgccatcgtgagcctgaagtggagactgcacttcgagttcgtgaccagcagagagcccggcctggtgctgctgccccccgtggagcagcccgagcccaccacctggaccggccccgagcaggtgcccgtggacaccttcagctgggacctgcccatcaaggtgctgcccaccagccccaccctggccagctacgccgcccccggccccagcaccagcaccatcaccatctag

SEQ ID NO: 97022 - DNA, 1296 bp, Artificial Sequence
  Description of Artificial Sequence: Synthetic coding sequence
atgaccagagccctgagcggcctggcctgcagagccctgcccgccggcagagacagcgccgagggcctgggcgtgcccatccccagcgtggactacgccagaagcgacagcggcgccgccatgatcgaggtggtggccgagctgagcagaggccccgtgttcctggccggcgaggccctggagtgcgtggtgaccgtgaccaaccccctgccccccaccgccaccagcgccagcagcgaggccctggcctgggccagcgcccagatccactgccagttccacgccagcgagagcagagtggccctgcccccccccgacagcagccagcccgacgtgcagcccgacagccagaccgtgttcctgccccacagaggcgagagaggccagtgcatcctgagcaccccccccaagatcctgttctgcgacctgagactggaccccggcgagagcaagagctacagctacagcgaggtgctgcccatcgagggcccccccagcttcagaggccagagcgtgaagtacgtgtacaagctgaccatcggctgccagagagtgaacagccccatcaccctgctgagagtgcccctgagagtgctggtgctgaccggcctgcaggacgtgagattcccccaggacgaggccgtggcccccagcagccccttcctggaggaggacgagggcggcaagaaggacagctggctggccgagctggccggcgagagactgatggccgccaccagctgcagaagcctgcacctgtacaacatcagcgacggcagaggcaaggtgggcaccttcggcatcttcaagagcgtgtacagactgggcgaggacgtggtgggcaccctgaacctgggcgagggcaccgtggcctgcctgcagttcagcgtgagcctgcagaccgaggagagagtgcagcccgagtaccagagaagaagaggcgccggcggcgtgcccagcgtgagccacgtgacccacgccagacaccaggagagctgcctgcacaccaccagaaccagcttcagcctgcccatccccctgagcagcacccccggcttctgcaccgccatcgtgagcctgaagtggagactgcacttcgagttcgtgaccagcagagagcccggcctggtgctgctgccccccgtggagcagcccgagcccaccacctggaccggccccgagcaggtgcccgtggacaccttcagctgggacctgcccatcaaggtgctgcccaccagccccaccctggccagctacgccgcccccggccccagcaccagcaccatcaccatctag

SEQ ID NO: 97023 - DNA, 1119 bp, Artificial Sequence
  Description of Artificial Sequence: Synthetic coding sequence
atgagcagcaagtaccccagaagcgtgagaagatgcctgcccctgtgcgccctgaccctggaggccgccctgatcctgctgttctacttcttcacccactacgacgccagcctggaggaccagaagggcctggtggccagctaccaggtgggccaggacctgaccgtgatggccgccctgggcctgggcttcctgaccagcaacttcagaagacacagctggagcagcgtggccttcaacctgttcatgctggccctgggcgtgcagtgggccatcctgctggacggcttcctgagccagttcccccccggcaaggtggtgatcaccctgttcagcatcagactggccaccatgagcgccatgagcgtgctgatcagcgccggcgccgtgctgggcaaggtgaacctggcccagctggtggtgatggtgctggtggaggtgaccgccctgggcaccctgagaatggtgatcagcaacatcttcaacaccgactaccacatgaacctgagacacttctacgtgttcgccgcctacttcggcctgaccgtggcctggtgcctgcccaagcccctgcccaagggcaccgaggacaacgaccagagagccaccatccccagcctgagcgccatgctgggcgccctgttcctgtggatgttctggcccagcgtgaacagcgccctgctgagaagccccatccagagaaagaacgccatgttcaacacctactacgccctggccgtgagcgtggtgaccgccatcagcggcagcagcctggcccacccccagagaaagatcagcatgacctacgtgcacagcgccgtgctggccggcggcgtggccgtgggcaccagctgccacctgatccccagcccctggctggccatggtgctgggcctggtggccggcctgatcagcatcggcggcgccaagtgcctgcccgtgtgctgcaacagagtgctgggcatccaccacatcagcgtgatgcacagcatcttcagcctgctgggcctgctgggcgagatcacctacatcgtgctgctggtgctgcacaccgtgtggaacggcaacggcatgttcgcccccaagagccagaacatggagagcaccagctgcggctag

SEQ ID NO: 97024 - DNA, 1254 bp, Artificial Sequence
  Description of Artificial Sequence: Synthetic coding sequence
atgagcagcaagtaccccagaagcgtgagaagatgcctgcccctgtgcgccctgaccctggaggccgccctgatcctgctgttctacttcttcacccactacgacgccagcctggaggaccagaagggcctggtggccagctaccaggtgggccaggacctgaccgtgatggccgccctgggcctgggcttcctgaccagcaacttcagaagacacagctggagcagcgtggccttcaacctgttcatgctggccctgggcgtgcagtgggccatcctgctggacggcttcctgagccagttcccccccggcaaggtggtgatcaccctgttcagcatcagactggccaccatgagcgccatgagcgtgctgatcagcgccggcgccgtgctgggcaaggtgaacctggcccagctggtggtgatggtgctggtggaggtgaccgccctgggcaccctgagaatggtgatcagcaacatcttcaacaccgactaccacatgaacctgagacacttctacgtgttcgccgcctacttcggcctgaccgtggcctggtgcctgcccaagcccctgcccaagggcaccgaggacaacgaccagagagccaccatccccagcctgagcgccatgctgggcgccctgttcctgtggatgttctggcccagcgtgaacagcgccctgctgagaagccccatccagagaaagaacgccatgttcaacacctactacgccctggccgtgagcgtggtgaccgccatcagcggcagcagcctggcccacccccagagaaagatcagcatgacctacgtgcacagcgccgtgctggccggcggcgtggccgtgggcaccagctgccacctgatccccagcccctggctggccatggtgctgggcctggtggccggcctgatcagcatcggcggcgccaagtgcctgcccgtgtgctgcaacagagtgctgggcatccaccacatcagcgtgatgcacagcatcttcagcctgctgggcctgctgggcgagatcacctacatcgtgctgctggtgctgcacaccgtgtggaacggcaacggcatgatcggcttccaggtgctgctgagcatcggcgagctgagcctggccatcgtgatcgccctgaccagcggcctgctgaccggcctgctgctgaacctgaagatctggaaggccccccacgtggccaagtacttcgacgaccaggtgttctggaagttcccccacctggccgtgggcttctag

SEQ ID NO: 97025 - DNA, 804 bp, Artificial Sequence
  Description of Artificial Sequence: Synthetic coding sequence
atgagcagcaagtaccccagaagcgtgagaagatgcctgcccctgtgcgccctgaccctggaggccgccctgatcctgctgttctacttcttcacccactacgacgccagcctggaggaccagaagggcctggtggccagctaccaggtgggccaggacctgaccgtgatggccgccctgggcctgggcttcctgaccagcaacttcagaagacacagctggagcagcgtggccttcaacctgttcatgctggccctgggcgtgcagtgggccatcctgctggacggcttcctgagccagttcccccccggcaaggtggtgatcaccctgttcagcatcagactggccaccatgagcgccatgagcgtgctgatcagcgccggcgccgtgctgggcaaggtgaacctggcccagctggtggtgatggtgctggtggaggtgaccgccctgggcaccctgagaatggtgatcagcaacatcttcaacacctacgtgcacagcgccgtgctggccggcggcgtggccgtgggcaccagctgccacctgatccccagcccctggctggccatggtgctgggcctggtggccggcctgatcagcatcggcggcgccaagtgcctgcccgtgtgctgcaacagagtgctgggcatccaccacatcagcgtgatgcacagcatcttcagcctgctgggcctgctgggcgagatcacctacatcgtgctgctggtgctgcacaccgtgtggaacggcaacggcatgttcgcccccaagagccagaacatggagagcaccagctgcggctag

SEQ ID NO: 97026 - DNA, 801 bp, Artificial Sequence
  Description of Artificial Sequence: Synthetic coding sequence
atgagcagcaagtaccccagaagcgtgagaagatgcctgcccctgtgcgccctgaccctggaggccgccctgatcctgctgttctacttcttcacccactacgacgccagcctggaggaccagaagggcctggtggccagctaccaggtgggccaggacctgaccgtgatggccgccctgggcctgggcttcctgaccagcaacttcagaagacacagctggagcagcgtggccttcaacctgttcatgctggccctgggcgtgcagtgggccatcctgctggacggcttcctgagccagttcccccccggcaaggtggtgatcaccctgttcagcatcagactggccaccatgagcgccatgagcgtgctgatcagcgccggcgccgtgctgggcaaggtgaacctggcccagctggtggtgatggtgctggtggaggtgaccgccctgggcaccctgagaatggtgatcagcaacatcttcaacgtgtgctgcaacagagtgctgggcatccaccacatcagcgtgatgcacagcatcttcagcctgctgggcctgctgggcgagatcacctacatcgtgctgctggtgctgcacaccgtgtggaacggcaacggcatgatcggcttccaggtgctgctgagcatcggcgagctgagcctggccatcgtgatcgccctgaccagcggcctgctgaccggcctgctgctgaacctgaagatctggaaggccccccacgtggccaagtacttcgacgaccaggtgttctggaagttcccccacctggccgtgggcttctag

SEQ ID NO: 97027 - DNA, 1206 bp, Artificial Sequence
  Description of Artificial Sequence: Synthetic coding sequence
atgtacttcatcaaccagagactgttcctgagactgtggagagtgcccgtgatgagagccagccactgctaccagagccagggctggagacccgtggccgtgggccaggacctgaccgtgatggccgccctgggcctgggcttcctgaccagcaacttcagaagacacagctggagcagcgtggccttcaacctgttcatgctggccctgggcgtgcagtgggccatcctgctggacggcttcctgagccagttcccccccggcaaggtggtgatcaccctgttcagcatcagactggccaccatgagcgccatgagcgtgctgatcagcgccggcgccgtgctgggcaaggtgaacctggcccagctggtggtgatggtgctggtggaggtgaccgccctgggcaccctgagaatggtgatcagcaacatcttcaacaccgactaccacatgaacctgagacacttctacgtgttcgccgcctacttcggcctgaccgtggcctggtgcctgcccaagcccctgcccaagggcaccgaggacaacgaccagagagccaccatccccagcctgagcgccatgctgggcgccctgttcctgtggatgttctggcccagcgtgaacagcgccctgctgagaagccccatccagagaaagaacgccatgttcaacacctactacgccctggccgtgagcgtggtgaccgccatcagcggcagcagcctggcccacccccagagaaagatcagcatgacctacgtgcacagcgccgtgctggccggcggcgtggccgtgggcaccagctgccacctgatccccagcccctggctggccatggtgctgggcctggtggccggcctgatcagcatcggcggcgccaagtgcctgcccgtgtgctgcaacagagtgctgggcatccaccacatcagcgtgatgcacagcatcttcagcctgctgggcctgctgggcgagatcacctacatcgtgctgctggtgctgcacaccgtgtggaacggcaacggcatgatcggcttccaggtgctgctgagcatcggcgagctgagcctggccatcgtgatcgccctgaccagcggcctgctgaccggcctgctgctgaacctgaagatctggaaggccccccacgtggccaagtacttcgacgaccaggtgttctggaagttcccccacctggccgtgggcttctag

SEQ ID NO: 97028 - DNA, 1065 bp, Artificial Sequence
  Description of Artificial Sequence: Synthetic coding sequence
atgagcagcaagtaccccagaagcgtgagaagatgcctgcccctgtgcgccctgaccctggaggccgccctgatcctgctgttctacttcttcacccactacgacgccagcctggaggaccagaagggcctggtggccagctaccaggtgggccaggacctgaccgtgatggccgccctgggcctgggcttcctgaccagcaacttcagaagacacagctggagcagcgtggccttcaacctgttcatgctggccctgggcgtgcagtgggccatcctgctggacggcttcctgagccagttcccccccggcaaggtggtgatcaccctgttcagcatcagactggccaccatgagcgccatgagcgtgctgatcagcgccggcgccgtgctgggcaaggtgaacctggcccagctggtggtgatggtgctggtggaggtgaccgccctgggcaccctgagaatggtgatcagcaacatcttcaacaccgactaccacatgaacctgagacacttctacgtgttcgccgcctacttcggcctgaccgtggcctggtgcctgcccaagcccctgcccaagggcaccgaggacaacgaccagagagccaccatccccagcctgagcgccatgctgggcgccctgttcctgtggatgttctggcccagcgtgaacagcgccctgctgagaagccccatccagagaaagaacgccatgttcaacacctactacgccctggccgtgagcgtggtgaccgccatcagcggcagcagcctggcccacccccagagaaagatcagcatgacctacgtgcacagcgccgtgctggccggcggcgtggccgtgggcaccagctgccacctgatccccagcccctggctggccatggtgctgggcctggtggccggcctgatcagcatcggcggcgccaagtgcctgcccgactggctgcccggccccccccagcactggggcacccagctgggccacagagacagcagccacgtgtggagccccgacagattcgcccccaagagccagaacatggagagcaccagctgcggctag

SEQ ID NO: 97029 - DNA, 1206 bp, Artificial Sequence; identical to SEQ ID NO: 97027
  Description of Artificial Sequence: Synthetic coding sequence

SEQ ID NO: 97030 - DNA, 1191 bp, Artificial Sequence
  Description of Artificial Sequence: Synthetic coding sequence
atgagcagcaagtaccccagaagcgtgagaagatgcctgcccctgtgcgccctgaccctggaggccgccctgatcctgctgttctacttcttcacccactacgacgccagcctggaggaccagaagggcctggtggccagctaccaggtgggccaggacctgaccgtgatggccgccctgggcctgggcttcctgaccagcaacttcagaagacacagctggagcagcgtggccttcaacctgttcatgctggccctgggcgtgcagtgggccatcctgctggacggcttcctgagccagttcccccccggcaaggtggtgatcaccctgttcagcatcagactggccaccatgagcgccatgagcgtgctgatcagcgccggcgccgtgctgggcaaggtgaacctggcccagctggtggtgatggtgctggtggaggtgaccgccctgggcaccctgagaatggtgatcagcaacatcttcaacaccgactaccacatgaacctgagacacttctacgtgttcgccgcctacttcggcctgaccgtggcctggtgcctgcccaagcccctgcccaagggcaccgaggacaacgaccagagagccaccatccccagcctgagcgccatgctgggcgccctgttcctgtggatgttctggcccagcgtgaacagcgccctgctgagaagccccatccagagaaagaacgccatgttcaacacctactacgccctggccgtgagcgtggtgaccgccatcagcggcagcagcctggcccacccccagagaaagatcagcatgacctacgtgcacagcgccgtgctggccggcggcgtggccgtgggcaccagctgccacctgatccccagcccctggctggccatggtgctgggcctggtggccggcctgatcagcatcggcggcgccaagtgcctgcccgtgtgctgcaacagagtgctgggcatccaccacatcagcgtgatgcacagcatcttcagcctgctgggcctgctgggcgagatcacctacatcgtgctgctggtgctgcacaccgtgtggaacggcaacggcatcttcctgatctggctgctggacttcaagcagaagcaccccagaaagaccagacccgtgcagaagcaggacaacttcctgagcctgctgcccgccttcgtgagagagaagagaagctag

SEQ ID NO: 97031 - DNA, 927 bp, Artificial Sequence
  Description of Artificial Sequence: Synthetic coding sequence
atgagcagcaagtaccccagaagcgtgagaagatgcctgcccctgtgcgccctgaccctggaggccgccctgatcctgctgttctacttcttcacccactacgacgccagcctggaggaccagaagggcctggtggccagctaccaggtgggccaggacctgaccgtgatggccgccctgggcctgggcttcctgaccagcaacttcagaagacacagctggagcagcgtggccttcaacctgttcatgctggccctgggcgtgcagtgggccatcctgctggacggcttcctgagccagttcccccccggcaaggtggtgatcaccctgttcagcatcagactggccaccatgagcgccatgagcgtgctgatcagcgccggcgccgtgctgggcaaggtgaacctggcccagctggtggtgatggtgctggtggaggtgaccgccctgggcaccctgagaatggtgatcagcaacatcttcaacaccgactaccacatgaacctgagacacttctacgtgttcgccgcctacttcggcctgaccgtggcctggtgcctgcccaagcccctgcccaagggcaccgaggacaacgaccagagagccaccatccccagcctgagcgccatgctgggcgccctgttcctgtggatgttctggcccagcgtgaacagcgccctgctgagaagccccatccagagaaagaacgccatgttcaacacctactacgccctggccgtgagcgtggtgaccgccatcagcggcagcagcctggcccacccccagagaaagatcagcatggactggctgcccggccccccccagcactggggcacccagctgggccacagagacagcagccacgtgtggagccccgacagattcgcccccaagagccagaacatggagagcaccagctgcggctag

SEQ ID NO: 97032 - DNA, 1197 bp, Artificial Sequence
  Description of Artificial Sequence: Synthetic coding sequence
atgagcagcaagtaccccagaagcgtgagaagatgcctgcccctgtgcgccctgaccctggaggccgccctgatcctgctgttctacttcttcacccactacgacgccagcctggaggaccagaagggcctggtggccagctaccaggtgggccaggacctgaccgtgatggccgccctgggcctgggcttcctgaccagcaacttcagaagacacagctggagcagcgtggccttcaacctgttcatgctggccctgggcgtgcagtgggccatcctgctggacggcttcctgagccagttcccccccggcaaggtggtgatcaccctgttcagcatcagactggccaccatgagcgccatgagcgtgctgatcagcgccggcgccgtgctgggcaaggtgaacctggcccagctggtggtgatggtgctggtggaggtgaccgccctgggcaccctgagaatggtgatcagcaacatcttcaacaccgactaccacatgaacctgagacacttctacgtgttcgccgcctacttcggcctgaccgtggcctggtgcctgcccaagcccctgcccaagggcaccgaggacaacgaccagagagccaccatccccagcctgagcgccatgctgggcgccctgttcctgtggatgttctggcccagcgtgaacagcgccctgctgagaagccccatccagagaaagaacgccatgttcaacacctactacgccctggccgtgagcgtggtgaccgccatcagcggcagcagcctggcccacccccagagaaagatcagcatgacctacgtgcacagcgccgtgctggccggcggcgtggccgtgggcaccagctgccacctgatccccagcccctggctggccatggtgctgggcctggtggccggcctgatcagcatcggcggcgccaagtgcctgcccgtgtgctgcaacagagtgctgggcatcccccacctgagacacgccctgcacctgcagctggccggcagcgcctggagagaccacctgcactgcgccgccggcgccagctactgcctggagagacagtggcacgactggctgcccggccccccccagcactggggcacccagctgggccacagagacagcagccacgtgtggagccccgacagattcgcccccaagagccagaacatggagagcaccagctgcggctag

SEQ ID NO: 97033 - DNA, 939 bp, Artificial Sequence
  Description of Artificial Sequence: Synthetic coding sequence
atgagcagcaagtaccccagaagcgtgagaagatgcctgcccctgtgcgccctgaccctggaggccgccctgatcctgctgttctacttcttcacccactacgacgccagcctggaggaccagaagggcctggtggccagctaccaggtgggccaggacctgaccgtgatggccgccctgggcctgggcttcctgaccagcaacttcagaagacacagctggagcagcgtggccttcaacctgttcatgctggccctgggcgtgcagtgggccatcctgctggacggcttcctgagccagttcccccccggcaaggtggtgatcaccctgttcagcatcagactggccaccatgagcgccatgagcgtgctgatcagcgccggcgccgtgctgggcaaggtgaacctggcccagctggtggtgatggtgctggtggaggtgaccgccctgggcaccctgagaatggtgatcagcaacatcttcaacacctacgtgcacagcgccgtgctggccggcggcgtggccgtgggcaccagctgccacctgatccccagcccctggctggccatggtgctgggcctggtggccggcctgatcagcatcggcggcgccaagtgcctgcccgtgtgctgcaacagagtgctgggcatccaccacatcagcgtgatgcacagcatcttcagcctgctgggcctgctgggcgagatcacctacatcgtgctgctggtgctgcacaccgtgtggaacggcaacggcatgatcggcttccaggtgctgctgagcatcggcgagctgagcctggccatcgtgatcgccctgaccagcggcctgctgaccggcctgctgctgaacctgaagatctggaaggccccccacgtggccaagtacttcgacgaccaggtgttctggaagttcccccacctggccgtgggcttctag

SEQ ID NO: 97034 - DNA, 1041 bp, Artificial Sequence
  Description of Artificial Sequence: Synthetic coding sequence
atgagcagcaagtaccccagaagcgtgagaagatgcctgcccctgtgcgccctgaccctggaggccgccctgatcctgctgttctacttcttcacccactacgacgccagcctggaggaccagaagggcctggtggccagctaccaggtgggccaggacctgaccgtgatggccgccctgggcctgggcttcctgaccagcaacttcagaagacacagctggagcagcgtggccttcaacctgttcatgctggccctgggcgtgcagtgggccatcctgctggacggcttcctgagccagttcccccccggcaaggtggtgatcaccctgttcagcatcagactggccaccatgagcgccatgagcgtgctgatcagcgccggcgccgtgctgggcaaggtgaacctggcccagctggtggtgatggtgctggtggaggtgaccgccctgggcaccctgagaatggtgatcagcaacatcttcaaccccagcgtgaacagcgccctgctgagaagccccatccagagaaagaacgccatgttcaacacctactacgccctggccgtgagcgtggtgaccgccatcagcggcagcagcctggcccacccccagagaaagatcagcatgacctacgtgcacagcgccgtgctggccggcggcgtggccgtgggcaccagctgccacctgatccccagcccctggctggccatggtgctgggcctggtggtgtgctgcaacagagtgctgggcatccaccacatcagcgtgatgcacagcatcttcagcctgctgggcctgctgggcgagatcacctacatcgtgctgctggtgctgcacaccgtgtggaacggcaacggcatgatcggcttccaggtgctgctgagcatcggcgagctgagcctggccatcgtgatcgccctgaccagcggcctgctgaccggcctgctgctgaacctgaagatctggaaggccccccacgtggccaagtacttcgacgaccaggtgttctggaagttcccccacctggccgtgggcttctag

SEQ ID NO: 97035 - DNA, 1254 bp, Artificial Sequence
  Description of Artificial Sequence: Synthetic coding sequence
atgagcagcaagtaccccagaagcgtgagaagatgcctgcccctgtgggccctgaccctggaggccgccctgatcctgctgttctacttcttcacccactacgacgccagcctggaggaccagaagggcctggtggccagctaccaggtgggccaggacctgaccgtgatggccgccatcggcctgggcttcctgaccagcagcttcagaagacacagctggagcagcgtggccttcaacctgttcatgctggccctgggcgtgcagtgggccatcctgctggacggcttcctgagccagttccccagcggcaaggtggtgatcaccctgttcagcatcagactggccaccatgagcgccctgagcgtgctgatcagcgtggacgccgtgctgggcaaggtgaacctggcccagctggtggtgatggtgctggtggaggtgaccgccctgggcaacctgagaatggtgatcagcaacatcttcaacaccgactaccacatgaacatgatgcacatctacgtgttcgccgcctacttcggcctgagcgtggcctggtgcctgcccaagcccctgcccgagggcaccgaggacaaggaccagaccgccaccatccccagcctgagcgccatgctgggcgccctgttcctgtggatgttctggcccagcttcaacagcgccctgctgagaagccccatcgagagaaagaacgccgtgttcaacacctactacgccgtggccgtgagcgtggtgaccgccatcagcggcagcagcctggcccacccccagggcaagatcagcaagacctacgtgcacagcgccgtgctggccggcggcgtggccgtgggcaccagctgccacctgatccccagcccctggctggccatggtgctgggcctggtggccggcctgatcagcgtgggcggcgccaagtacctgcccggctgctgcaacagagtgctgggcatcccccacagcagcatcatgggctacaacttcagcctgctgggcctgctgggcgagatcatctacatcgtgctgctggtgctggacaccgtgggcgccggcaacggcatgatcggcttccaggtgctgctgagcatcggcgagctgagcctggccatcgtgatcgccctgatgagcggcctgctgaccggcctgctgctgaacctgaagatctggaaggccccccacgaggccaagtacttcgacgaccaggtgttctggaagttcccccacctggccgtgggcttctag

SEQ ID NO: 97036 - DNA, 1482 bp, Artificial Sequence
  Description of Artificial Sequence: Synthetic coding sequence
atgagcagcaagtaccccagaagcgtgagaagatgcctgcccctgtgggccctgaccctggaggccgccctgatcctgctgttctacttcttcacccactacgacgccagcctggaggaccagaagggcctggtggccagctaccaggtgggccaggacctgaccgtgatggccgccatcggcctgggcttcctgaccagcagcttcagaagacacagctggagcagcgtggccttcaacctgttcatgctggccctgggcgtgcagtgggccatcctgctggacggcttcctgagccagttccccagcggcaaggtggtgatcaccctgttcagcatcagactggccaccatgagcgccctgagcgtgctgatcagcgtggacgccgtgctgggcaaggtgaacctggcccagctggtggtgatggtgctggtggaggtgaccgccctgggcaacctgagaatggtgatcagcaacatcttcaacaccgactaccacatgaacatgatgcacatctacgtgttcgccgcctacttcggcctgagcgtggcctggtgcctgcccaagcccctgcccgagggcaccgaggacaaggaccagaccgccaccatccccagcctgagcgccatgctgggcgccctgttcctgtggatgttctggcccagcttcaacagcgccctgctgagaagccccatcgagagaaagaacgccgtgttcaacacctactacgccgtggccgtgagcgtggtgaccgccatcagcggcagcagcctggcccacccccagggcaagatcagcaagacctacgtgcacagcgccgtgctggccggcggcgtggccgtgggcaccagctgccacctgatccccagcccctggctggccatggtgctgggcctggtggccggcctgatcagcgtgggcggcgccaagtacctgcccggctgctgcaacagagtgctgggcatcccccacagcagcatcatgggctacaacttcagcctgctgggcctgctgggcgagatcatctacatcgtgctgctggtgctggacaccgtgggcgccggcaacggcatgagcctgggctggaacctggccgtgaagatggccgaggccggcgacgaggagctgatgagactggacgtgagccagagaaaccacggcggcgccgccgtgcccaccggcagctggatgcccagcaccgagaccaccatcgcccccaactacagagaccacatcagcgtggtgagcagcttcggctgctggatcctgagcaagagcatccaggagaagcagggcctgttcaagaacaagaccaccagcagccactgctgcctgcacctgtacgtgagaaacgcccacgacagcaaggtgagcaacgtgagagccggcaccggcgtgagagagaacggcgtggagagcttcctgtgccacagcctgagaagaatcagccccttcatcatgcactgcagaatccagcagtag

SEQ ID NO: 97037 - DNA, 1191 bp, Artificial Sequence
  Description of Artificial Sequence: Synthetic coding sequence
atgagcagcaagtaccccagaagcgtgagaagatgcctgcccctgtgggccctgaccctggaggccgccctgatcctgctgttctacttcttcacccactacgacgccagcctggaggaccagaagggcctggtggccagctaccaggtgggccaggacctgaccgtgatggccgccatcggcctgggcttcctgaccagcagcttcagaagacacagctggagcagcgtggccttcaacctgttcatgctggccctgggcgtgcagtgggccatcctgctggacggcttcctgagccagttccccagcggcaaggtggtgatcaccctgttcagcatcagactggccaccatgagcgccctgagcgtgctgatcagcgtggacgccgtgctgggcaaggtgaacctggcccagctggtggtgatggtgctggtggaggtgaccgccctgggcaacctgagaatggtgatcagcaacatcttcaacaccgactaccacatgaacatgatgcacatctacgtgttcgccgcctacttcggcctgagcgtggcctggtgcctgcccaagcccctgcccgagggcaccgaggacaaggaccagaccgccaccatccccagcctgagcgccatgctgggcgccctgttcctgtggatgttctggcccagcttcaacagcgccctgctgagaagccccatcgagagaaagaacgccgtgttcaacacctactacgccgtggccgtgagcgtggtgaccgccatcagcggcagcagcctggcccacccccagggcaagatcagcaagacctacgtgcacagcgccgtgctggccggcggcgtggccgtgggcaccagctgccacctgatccccagcccctggctggccatggtgctgggcctggtggccggcctgatcagcgtgggcggcgccaagtacctgcccggctgctgcaacagagtgctgggcatcccccacagcagcatcatgggctacaacttcagcctgctgggcctgctgggcgagatcatctacatcgtgctgctggtgctggacaccgtgggcgccggcaacggcatcttcctgatctggctgctggacttcaagcagaagcaccccagaaagaccagacccgtgcagaagcaggacaacttcctgagcctgctgcccgccttcgtgagagagaagagaagctag

SEQ ID NO: 97038 - DNA, 1137 bp, Artificial Sequence
  Description of Artificial Sequence: Synthetic coding sequence
atgagcagcaagtaccccagaagcgtgagaagatgcctgcccctgtgggccctgaccctggaggccgccctgatcctgctgttctacttcttcacccactacgacgccagcctggaggaccagaagggcctggtggccagctaccaggtgggccaggacctgaccgtgatggccgccatcggcctgggcttcctgaccagcagcttcagaagacacagctggagcagcgtggccttcaacctgttcatgctggccctgggcgtgcagtgggccatcctgctggacggcttcctgagccagttccccagcggcaaggtggtgatcaccctgttcagcatcagactggccaccatgagcgccctgagcgtgctgatcagcgtggacgccgtgctgggcaaggtgaacctggcccagctggtggtgatggtgctggtggaggtgaccgccctgggcaacctgagaatggtgatcagcaacatcttcaacaccgactaccacatgaacatgatgcacatctacgtgttcgccgcctacttcggcctgagcgtggcctggtgcctgcccaagcccctgcccgagggcaccgaggacaaggaccagaccgccaccatccccagcctgagcgccatgctgggcgccctgttcctgtggatgttctggcccagcttcaacagcgccctgctgagaagccccatcgagagaaagaacgccgtgttcaacacctactacgccgtggccgtgagcgtggtgaccgccatcagcggcagcagcctggcccacccccagggcaagatcagcaagacctacgtgcacagcgccgtgctggccggcggcgtggccgtgggcaccagctgccacctgatccccagcccctggctggccatggtgctgggcctggtggccggcctgatcagcgtgggcggcgccaagtacctgcccgactggctgcccggccccccccagcactggggcacccagctgggccacagagacagcagccacgtgtggagccccgacagcttcctgatctggctgctggacttcaagcagaagcaccccagaaagaccagacccgtgcagaagcaggacaacttcctgagcctgctgcccgccttcgtgagagagaagagaagctag

SEQ ID NO: 97039 - DNA, 1464 bp, Artificial Sequence
  Description of Artificial Sequence: Synthetic coding sequence
atgagcagcaagtaccccagaagcgtgagaagatgcctgcccctgtgggccctgaccctggaggccgccctgatcctgctgttctacttcttcacccactacgacgccagcctggaggaccagaagggcctggtggccagctaccaggtgggccaggacctgaccgtgatggccgccatcggcctgggcttcctgaccagcagcttcagaagacacagctggagcagcgtggccttcaacctgttcatgctggccctgggcgtgcagtgggccatcctgctggacggcttcctgagccagttccccagcggcaaggtggtgatcaccctgttcagcatcagactggccaccatgagcgccctgagcgtgctgatcagcgtggacgccgtgctgggcaaggtgaacctggcccagctggtggtgatggtgctggtggaggtgaccgccctgggcaacctgagaatggtgatcagcaacatcttcaacaccgactaccacatgaacatgatgcacatctacgtgttcgccgcctacttcggcctgagcgtggcctggtgcctgcccaagcccctgcccgagggcaccgaggacaaggaccagaccgccaccatccccagcctgagcgccatgctgggcgccctgttcctgtggatgttctggcccagcttcaacagcgccctgctgagaagccccatcgagagaaagaacgccgtgttcaacacctactacgccgtggccgtgagcgtggtgaccgccatcagcggcagcagcctggcccacccccagggcaagatcagcaagacctacgtgcacagcgccgtgctggccggcggcgtggccgtgggcaccagctgccacctgatccccagcccctggctggccatggtgctgggcctggtggccggcctgatcagcgtgggcggcgccaagtacctgcccggctgctgcaacagagtgctgggcatcccccacagcagcatcatgggctacaacttcagcctgctgggcctgctgggcgagatcatctacatcgtgctgctggtgctggacaccgtgggcgccggcaacggcatgatcggcttccaggtgctgctgagcatcggcgagctgagcctggccatcgtgatcgccctgatgagcggcctgctgaccggcctgctgctgaacctgaagatctggaaggccccccacgaggccaagtacttcgacgaccaggtgttctggaagttcccccacctggccgtgggcttcagcaagagcatccaggagaagcagggcctgttcaagaacaagaccaccagcagccactgctgcctgcacctgtacgtgagaaacgcccacgacagcaaggtgagcaacgtgagagccggcaccggcgtgagagagaacggcgtggagagcttcctgtgccacagcctgagaagaatcagccccttcatcatgcactgcagaatccagcagtag

SEQ ID NO: 97040 - DNA, 1296 bp, Artificial Sequence
  Description of Artificial Sequence: Synthetic coding sequence
atgagcagcaagtaccccagaagcgtgagaagatgcctgcccctgtgggccctgaccctggaggccgccctgatcctgctgttctacttcttcacccactacgacgccagcctggaggaccagaagggcctggtggccagctaccaggtgggccaggacctgaccgtgatggccgccatcggcctgggcttcctgaccagcagcttcagaagacacagctggagcagcgtggccttcaacctgttcatgctggccctgggcgtgcagtgggccatcctgctggacggcttcctgagccagttccccagcggcaaggtggtgatcaccctgttcagcatcagactggccaccatgagcgccctgagcgtgctgatcagcgtggacgccgtgctgggcaaggtgaacctggcccagctggtggtgatggtgctggtggaggtgaccgccctgggcaacctgagaatggtgatcagcaacatcttcaacaccgactaccacatgaacatgatgcacatctacgtgttcgccgcctacttcggcctgagcgtggcctggtgcctgcccaagcccctgcccgagggcaccgaggacaaggaccagaccgccaccatccccagcctgagcgccatgctgggcgccctgttcctgtggatgttctggcccagcttcaacagcgccctgctgagaagccccatcgagagaaagaacgccgtgttcaacacctactacgccgtggccgtgagcgtggtgaccgccatcagcggcagcagcctggcccacccccagggcaagatcagcaagacctacgtgcacagcgccgtgctggccggcggcgtggccgtgggcaccagctgccacctgatccccagcccctggctggccatggtgctgggcctggtggccggcctgatcagcgtgggcggcgccaagtacctgcccggctgctgcaacagagtgctgggcatcccccacagcagcatcatgggctacaacttcagcctgctgggcctgctgggcgagatcatctacatcgtgctgctggtgctggacaccgtgggcgccggcaacggcatgagcctgggctggaacctggccgtgaagatggccgaggccggcgacgaggagctgatgagactggacgtgagccagagaaaccacggcggcgccgccgtgcccaccggcagctggatgcccagcaccgagaccaccatcgcccccaactacagagaccacatcagcgtgggcctggccagcagaagcagcagcgccctgggcaacagcgcctggcccagctag

SEQ ID NO: 97041 - DNA, 966 bp, Artificial Sequence
  Description of Artificial Sequence: Synthetic coding sequence
atgagcagcaagtaccccagaagcgtgagaagatgcctgcccctgtgggccctgaccctggaggccgccctgatcctgctgttctacttcttcacccactacgacgccagcctggaggaccagaagggcctggtggccagctaccaggtgggccaggacctgaccgtgatggccgccatcggcctgggcttcctgaccagcagcttcagaagacacagctggagcagcgtggccttcaacctgttcatgctggccctgggcgtgcagtgggccatcctgctggacggcttcctgagccagttccccagcggcaaggtggtgatcaccctgttcagcatcagactggccaccatgagcgccctgagcgtgctgatcagcgtggacgccgtgctgggcaaggtgaacctggcccagctggtggtgatggtgctggtggaggtgaccgccctgggcaacctgagaatggtgatcagcaacatcttcaacaccgactaccacatgaacatgatgcacatctacgtgttcgccgcctacttcggcctgagcgtggcctggtgcctgcccaagcccctgcccgagggcaccgaggacaaggaccagaccgccaccatccccagcctgagcgccatgctgggcgccctgttcctgtggatgttctggcccagcttcaacagcgccctgctgagaagccccatcgagagaaagaacgccgtgttcaacacctactacgccgtggccgtgagcgtggtgaccgccatcagcggcagcagcctggcccacccccagggcaagatcagcaagacctacgtgcacagcgccgtgctggccggcggcgtggccgtgggcaccagctgccacctgatccccagcccctggctggccatggtgctgggcctggtggccggcctgatcagcgtgggcggcgccaagtacctgcccttcccccacctggccgtgggcttctag

SEQ ID NO: 97042 - DNA, 294 bp, Artificial Sequence
  Description of Artificial Sequence: Synthetic coding sequence
atggccggcagccccagcagagccgccggcagaagactgcagctgcccctgctgtgcctgttcctgcagggcgccaccgccgtgctgttcgccgtgttcgtgagatacaaccacaagaccgacgccgccctgtggcacagaagcaaccacagcaacgccgacaacgagttctacttcagataccccaacggcgtgagcctgctgctgcccagactggagtgcaacggcaccatcagcgcccaccacaacctgtgcctgcccggcagcagcgacagccccgccagcgtgagctag

SEQ ID NO: 97043 - DNA, 462 bp, Artificial Sequence
  Description of Artificial Sequence: Synthetic coding sequence
atggccggcagccccagcagagccgccggcagaagactgcagctgcccctgctgtgcctgttcctgcagggcgccaccgccgtgctgttcgccgtgttcgtgagatacaaccacaagaccgacgccgccctgtggcacagaagcaaccacagcaacgccgacaacgagttctacttcagataccccaaggagagccacagcgtggcccaggccggcgtgcagagaagaaacctgggcagcctgcagcccagcccccccagactgcccggcagagcctgccacggcctgagaggcctgtggctgccccacggcctgcccgccgccctgagactgcagcagagaggcctgcacctgccccccggcagactgtgccccgccgtggtgcacaccggccccggcctgagccccctgctgcccagatggccccacccctgctggagaggcgagcacgaccagtgctag

SEQ ID NO: 97044 - DNA, 1119 bp, Artificial Sequence
  Description of Artificial Sequence: Synthetic coding sequence
atggtgttcgtgggcttcggcttcctgatggtgttcctgcagagatacggcttcagcagcgtgggcttcaccttcctgctggccgccttcgccctgcagtggagcaccctggtgcagggcttcctgcacagcttccacggcggccacatccacgtgggcgtggagagcatgatcaacgccgacttctgcgccggcgccgtgctgatcagcttcggcgccgtgctgggcaagaccggccccacccagctgctgctgatggccctgctggaggtggtgctgttcggcatcaacgagttcgtgctgctgcacctgctgggcgtgagagacgccggcggcagcatgaccatccacaccttcggcgcctacttcggcctggtgctgagcagagtgctgtacagaccccagctggagaagagcaagcacagacagggcagcgtgtaccacagcgacctgttcgccatgatcggcaccatcttcctgtggatcttctggcccagcttcaacgccgccctgaccgccctgggcgccggccagcacagaaccgccctgaacacctactacagcctggccgccagcaccctgggcaccttcgccctgagcgccctggtgggcgaggacggcagactggacatggtgcacatccagaacgccgccctggccggcggcgtggtggtgggcaccagcagcgagatgatgctgacccccttcggcgccctggccgccggcttcctggccggcaccgtgagcaccctgggctacaagttcttcacccccatcctggagagcaagttcaaggtgcaggacacctgcggcgtgcacaacctgcacggcatgcccggcgtgctgggcgccctgctgggcgtgctggtggccggcctggccacccacgaggcctacggcgacggcctggagagcgtgttccccctgatcgccgagggccagagaagcgccaccagccaggccatgcaccagctgttcggcctgttcgtgaccctgatgttcgccagcgtgggcggcggcctgggcggcctgctgctgaagctgcccttcctggacagcccccccagactgcccgccctgagaggccccagcagcctggccggcgcctggagagcctag

SEQ ID NO: 97045 - DNA, 1374 bp, Artificial Sequence
  Description of Artificial Sequence: Synthetic coding sequence
atggccggcagccccagcagagccgccggcagaagactgcagctgcccctgctgtgcctgttcctgcagggcgccaccgccgtgctgttcgccgtgttcgtgagatacaaccacaagaccgacgccgccctgtggcacagaagcaaccacagcaacgccgacaacgagttctacttcagataccccagcttccaggacgtgcacgccatggtgttcgtgggcttcggcttcctgatggtgttcctgcagagatacggcttcagcagcgtgggcttcaccttcctgctggccgccttcgccctgcagtggagcaccctggtgcagggcttcctgcacagcttccacggcggccacatccacgtgggcgtggagagcatgatcaacgccgacttctgcgccggcgccgtgctgatcagcttcggcgccgtgctgggcaagaccggccccacccagctgctgctgatggccctgctggaggtggtgctgttcggcatcaacgagttcgtgctgctgcacctgctgggcgtgagagacgccggcggcagcatgaccatccacaccttcggcgcctacttcggcctggtgctgagcagagtgctgtacagaccccagctggagaagagcaagcacagacagggcagcgtgtaccacagcgacctgttcgccatgatcggcaccatcttcctgtggatcttctggcccagcttcaacgccgccctgaccgccctgggcgccggccagcacagaaccgccctgaacacctactacagcctggccgccagcaccctgggcaccttcgccctgagcgccctggtgggcgaggacggcagactggacatggtgcacatccagaacgccgccctggccggcggcgtggtggtgggcaccagcagcgagatgatgctgacccccttcggcgccctggccgccggcttcctggccggcaccgtgagcaccctgggctacaagttcttcacccccatcctggagagcaagttcaaggtgcaggacacctgcggcgtgcacaacctgcacggcatgcccggcgtgctgggcgccctgctgggcgtgctggtggccggcctggccacccacgaggcctacggcgacggcctggagagcgtgttccccctgatcgccgagggccagagaagcgccaccagccaggccatgcaccagctgttcggcctgttcgtgaccctgatgttcgccagcgtgggcggcggcctgggcggcctgctgctgaagctgcccttcctggacccccccgacagccagcactacgaggaccaggtgcactggcaggtgcccggcgagcacgaggacaaggcccagagacccctgagagtggaggaggccgacacccaggcctag

SEQ ID NO: 97046 - DNA, 1326 bp, Artificial Sequence
  Description of Artificial Sequence: Synthetic coding sequence
atggccggcagccccagcagagccgccggcagaagactgcagctgcccctgctgtgcctgttcctgcagggcgccaccgccgtgctgttcgccgtgttcgtgagatacaaccacaagaccgacgccgccctgtggcacagaagcaaccacagcaacgccgacaacgagttctacttcagataccccagcttccaggacgtgcacgccatggtgttcgtgggcttcggcttcctgatggtgttcctgcagagatacggcttcagcagcgtgggcttcaccttcctgctggccgccttcgccctgcagtggagcaccctggtgcagggcttcctgcacagcttccacggcggccacatccacgtgggcgtggagagcatgatcaacgccgacttctgcgccggcgccgtgctgatcagcttcggcgccgtgctgggcaagaccggccccacccagctgctgctgatggccctgctggaggtggtgctgttcggcatcaacgagttcgtgctgctgcacctgctgggcgtgagagacgccggcggcagcatgaccatccacaccttcggcgcctacttcggcctggtgctgagcagagtgctgtacagaccccagctggagaagagcaagcacagacagggcagcgtgtaccacagcgacctgttcgccatgatcggcaccatcttcctgtggatcttctggcccagcttcaacgccgccctgaccgccctgggcgccggccagcacagaaccgccctgaacacctactacagcctggccgccagcaccctgggcaccttcgccctgagcgccctggtgggcgaggacggcagactggacatggtgcacatccagaacgccgccctggccggcggcgtggtggtgggcaccagcagcgagatgatgctgacccccttcggcgccctggccgccggcttcctggccggcaccgtgagcaccctgggctacaagttcttcacccccatcctggagagcaagttcaaggtgcaggacacctgcggcgtgcacaacctgcacggcatgcccggcgtgctgggcgccctgctgggcgtgctggtggccggcctggccacccacgaggcctacggcgacggcctggagagcgtgttccccctgatcgccgagggccagagaagcgccaccagccaggccatgcaccagctgttcggcctgttcgtgaccctgatgttcgccagcgtgggcggcggcctgggcggcctgctgctgaagctgcccttcctggacagcccccccagactgcccgccctgagaggccccagcagcctggccggcgcctggagagcctag

SEQ ID NO: 97047 - DNA, 1230 bp, Artificial Sequence
  Description of Artificial Sequence: Synthetic coding sequence
atggtgttcgtgggcttcggcttcctgatggtgttcctgcagagatacggcttcagcagcgtgggcttcaccttcctgctggccgccttcgccctgcagtggagcaccctggtgcagggcttcctgcacagcttccacggcggccacatccacgtgggcgtggagagcatgatcaacgccgacttctgcgccggcgccgtgctgatcagcttcggcgccgtgctgggcaagaccggccccacccagctgctgctgatggccctgctggaggtggtgctgttcggcatcaacgagttcgtgctgctgcacctgctgggcgtgagagtgtggggcggcatggagagcggcgtgggcggcggccagggccagcccctgagccaggagagaggcggcggcggcggcgtgctgcccctgaccccccccccccaggtgagagacgccggcggcagcatgaccatccacaccttcggcgcctacttcggcctggtgctgagcagagtgctgtacagaccccagctggagaagagcaagcacagacagggcagcgtgtaccacagcgacctgttcgccatgatcggcaccatcttcctgtggatcttctggcccagcttcaacgccgccctgaccgccctgggcgccggccagcacagaaccgccctgaacacctactacagcctggccgccagcaccctgggcaccttcgccctgagcgccctggtgggcgaggacggcagactggacatggtgcacatccagaacgccgccctggccggcggcgtggtggtgggcaccagcagcgagatgatgctgacccccttcggcgccctggccgccggcttcctggccggcaccgtgagcaccctgggctacaagttcttcacccccatcctggagagcaagttcaaggtgcaggacacctgcggcgtgcacaacctgcacggcatgcccggcgtgctgggcgccctgctgggcgtgctggtggccggcctggccacccacgaggcctacggcgacggcctggagagcgtgttccccctgatcgccgagggccagagaagcgccaccagccaggccatgcaccagctgttcggcctgttcgtgaccctgatgttcgccagcgtgggcggcggcctgggcggcctgctgctgaagctgcccttcctggacagcccccccagactgcccgccctgagaggccccagcagcctggccggcgcctggagagcctag

SEQ ID NO: 97048 - DNA, 1125 bp, Artificial Sequence
  Description of Artificial Sequence: Synthetic coding sequence
atggtgttcgtgggcttcggcttcctgatggtgttcctgcagagatacggcttcagcagcgtgggcttcaccttcctgctggccgccttcgccctgcagtggagcaccctggtgcagggcttcctgcacagcttccacggcggccacatccacgtgggcgtggagagcatgatcaacgccgacttctgcgccggcgccgtgctgatcagcttcggcgccgtgctgggcaagaccggccccacccagctgctgctgatggccctgctggaggtggtgctgttcggcatcaacgagttcgtgctgctgcacctgctgggcgtgagagtgtggggcggcatggagagcggcgtgggcggcggccagggccagcccctgagccaggagagaggcggcggcggcggcgtgctgcccctgaccccccccccccaggtgagagacgccggcggcagcatgaccatccacaccttcggcgcctacttcggcctggtgctgagcagagtgctgtacagaccccagctggagaagagcaagcacagacagggcagcgtgtaccacagcgacctgttcgccatgatcggcaccatcttcctgtggatcttctggcccagcttcaacgccgccctgaccgccctgggcgccggccagcacagaaccgccctgaacacctactacagcctggccgccagcaccctgggcaccttcgccctgagcgccctggtgggcgaggacggcagactggacatgcccatcctggagagcaagttcaaggtgcaggacacctgcggcgtgcacaacctgcacggcatgcccggcgtgctgggcgccctgctgggcgtgctggtggccggcctggccacccacgaggcctacggcgacggcctggagagcgtgttccccctgatcgccgagggccagagaagcgccaccagccaggccatgcaccagctgttcggcctgttcgtgaccctgatgttcgccagcgtgggcggcggcctgggcggcatcatcctggtgctgtgcctgctggacccctgcgccctgtggcactgggtggcccccagcagcatggtgggcggcagagaggccagccagatcctgccctaccaccaccagggcagctgctag

SEQ ID NO: 97049 - DNA, 687 bp, Artificial Sequence
  Description of Artificial Sequence: Synthetic coding sequence
atggccggcagccccagcagagccgccggcagaagactgcagctgcccctgctgtgcctgttcctgcagggcgccaccgccgtgctgttcgccgtgttcgtgagatacaaccacaagaccgacgccgccctgtggcacagaagcaaccacagcaacgccgacaacgagttctacttcagataccccagaaccatcttcctgtggatcttctggcccagcttcaacgccgccctgaccgccctgggcgccggccagcacagaaccgccctgaacacctactacagcctggccgccagcaccctgggcaccttcgccctgagcgccctggtgggcgaggacggcagactggacatggtgcacatccagaacgccgccctggccggcggcgtggtggtgggcaccagcagcgagatgatgctgacccccttcggcgccctggccgccggcttcctggccggcaccgtgagcaccctgggccccagcctgaaccagaacagcaagagcaagacccacgtggagagcaccaccagcatgggctgcagaggcagctggggccccagctggggcagcctgtggctggacctgccccccatgaagctgaccgagatgggcgagttcccccccaacccctactgcagcagacaccccagcggcatgaccagcgtgatcctgttccactgcgtgtag

SEQ ID NO: 97050 - DNA, 1440 bp, Artificial Sequence
  Description of Artificial Sequence: Synthetic coding sequence
atggcctggaacaccaacctgagatggagactgcccctgacctgcctgctgctgcaggtgatcatggtgatcctgttcggcgtgttcgtgagatacgacttcgaggccgacgcccactggtggagcgagagaacccacaagaacctgagcgacatggagaacgagttctactacagataccccagcttccaggacgtgcacgtgatggtgttcgtgggcttcggcttcctgatgaccttcctgcagagatacggcttcagcgccgtgggcttcaacttcctgctggccgccttcggcatccagtgggccctgctgatgcagggctggttccacttcctgcaggacagatacatcgtggtgggcgtggagaacctgatcaacgccgacttctgcgtggccagcgtgtgcgtggccttcggcgccgtgctgggcaaggtgagccccatccagctgctgatcatgaccttcttccaggtgaccctgttcgccgtgaacgagttcatcctgctgaacctgctgaaggtgaaggacgccggcggcagcatgaccatccacaccttcggcgcctacttcggcctgaccgtgaccagaatcctgtacagaagaaacctggagcagagcaaggagagacagaacagcgtgtaccagagcgacctgttcgccatgatcggcaccctgttcctgtggatgtactggcccagcttcaacagcgccatcagctaccacggcgacagccagcacagagccgccatcaacacctactgcagcctggccgcctgcgtgctgaccagcgtggccatcagcagcgccctgcacaagaagggcaagctggacatggtgcacatccagaacgccaccctggccggcggcgtggccgtgggcaccgccgccgagatgatgctgatgccctacggcgccctgatcatcggcttcgtgtgcggcatcatcagcaccctgggcttcgtgtacctgacccccttcctggagagcagactgcacatccaggacacctgcggcatcaacaacctgcacggcatccccggcatcatcggcggcatcgtgggcgccgtgaccgccgccagcgccagcctggaggtgtacggcaaggagggcctggtgcacagcttcgacttccagggcttcaacggcgactggaccgccagaacccagggcaagttccagatctacggcctgctggtgaccctggccatggccctgatgggcggcatcatcgtgggcctgatcctgagactgcccttctggggccagcccagcgacgagaactgcttcgaggacgccgtgtactgggagatgcccgagggcaacagcaccgtgtacatccccgaggaccccaccttcaagcccagcggccccagcgtgcccagcgtgcccatggtgagccccctgcccatggccagcagcgtgcccctggtgccctag

SEQ ID NO: 97051 - DNA, 1413 bp, Artificial Sequence
  Description of Artificial Sequence: Synthetic coding sequence
atggcctggaacacctgcctgctgctgcaggtgatcatggtgatcctgttcggcgtgttcgtgagatacgacttcgaggccgacgcccactggtggagcgagagaacccacaagaacctgagcgacatggagaacgagttctactacagataccccagcttccaggacgtgcacgtgatggtgttcgtgggcttcggcttcctgatgaccttcctgcagagatacggcttcagcgccgtgggcttcaacttcctgctggccgccttcggcatccagtgggccctgctgatgcagggctggttccacttcctgcaggacagatacatcgtggtgggcgtggagaacctgatcaacgccgacttctgcgtggccagcgtgtgcgtggccttcggcgccgtgctgggcaaggtgagccccatccagctgctgatcatgaccttcttccaggtgaccctgttcgccgtgaacgagttcatcctgctgaacctgctgaaggtgaaggacgccggcggcagcatgaccatccacaccttcggcgcctacttcggcctgaccgtgaccagaatcctgtacagaagaaacctggagcagagcaaggagagacagaacagcgtgtaccagagcgacctgttcgccatgatcggcaccctgttcctgtggatgtactggcccagcttcaacagcgccatcagctaccacggcgacagccagcacagagccgccatcaacacctactgcagcctggccgcctgcgtgctgaccagcgtggccatcagcagcgccctgcacaagaagggcaagctggacatggtgcacatccagaacgccaccctggccggcggcgtggccgtgggcaccgccgccgagatgatgctgatgccctacggcgccctgatcatcggcttcgtgtgcggcatcatcagcaccctgggcttcgtgtacctgacccccttcctggagagcagactgcacatccaggacacctgcggcatcaacaacctgcacggcatccccggcatcatcggcggcatcgtgggcgccgtgaccgccgccagcgccagcctggaggtgtacggcaaggagggcctggtgcacagcttcgacttccagggcttcaacggcgactggaccgccagaacccagggcaagttccagatctacggcctgctggtgaccctggccatggccctgatgggcggcatcatcgtgggcctgatcctgagactgcccttctggggccagcccagcgacgagaactgcttcgaggacgccgtgtactgggagatgcccgagggcaacagcaccgtgtacatccccgaggaccccaccttcaagcccagcggccccagcgtgcccagcgtgcccatggtgagccccctgcccatggccagcagcgtgcccctggtgccctag

SEQ ID NO: 97052 - DNA, 1338 bp, Artificial Sequence
  Description of Artificial Sequence: Synthetic coding sequence
atggcctggaacaccaacctgagatggagactgcccctgacctgcctgctgctgcaggtgatcatggtgatcctgttcggcgtgttcgtgagatacgacttcgaggccgacgcccactggtggagcgagagaacccacaagaacctgagcgacatggagaacgagttctactacagataccccagcttccaggacgtgcacgtgatggtgttcgtgggcttcggcttcctgatgaccttcctgcagagatacggcttcagcgccgtgggcttcaacttcctgctggccgccttcggcatccagtgggccctgctgatgcagggctggttccacttcctgcaggacagatacatcgtggtgggcgtggagaacctgatcaacgccgacttctgcgtggccagcgtgtgcgtggccttcggcgccgtgctgggcaaggtgagccccatccagctgctgatcatgaccttcttccaggtgaccctgttcgccgtgaacgagttcatcctgctgaacctgctgaaggtgaaggacgccggcggcagcatgaccatccacaccttcggcgcctacttcggcctgaccgtgaccagaatcctgtacagaagaaacctggagcagagcaaggagagacagaacagcgtgtaccagagcgacctgttcgccatgatcggcaccctgttcctgtggatgtactggcccagcttcaacagcgccatcagctaccacggcgacagccagcacagagccgccatcaacacctactgcagcctggccgcctgcgtgctgaccagcgtggccatcagcagcgccctgcacaagaagggcaagctggacatggtgcacatccagaacgccaccctggccggcggcgtggccgtgggcaccgccgccgagatgatgctgatgccctacggcgccctgatcatcggcttcgtgtgcggcatcatcagcaccctgggcttcgtgtacctgacccccttcctggagagcagactgcacatccaggacacctgcggcatcaacaacctgcacggcatccccggcatcatcggcggcatcgtgggcgccgtgaccgccgccagcgccagcctggaggtgtacggcaaggagggcctggtgcacagcttcgacttccagggcttcaacggcgactggaccgccagaacccagggcaagttccagatctacggcctgctggtgaccctggccatggccctgatgggcggcatcatcgtgggcctgatcctgagactgcccttctggggccagcccagcgacgagaactgcttcgaggacgccgtgtactgggaggacctggagctggcccccaaccagtag

SEQ ID NO: 97053 - DNA, 714 bp, Artificial Sequence
  Description of Artificial Sequence: Synthetic coding sequence
tgagacagccagcacagagccgccatcaacacctactgcagcctggccgcctgcgtgctgaccagcgtggccatcagcagcgccctgcacaagaagggcaagctggacatggtgcacatccagaacgccaccctggccggcggcgtggccgtgggcaccgccgccgagatgatgctgatgccctacggcgccctgatcatcggcttcgtgtgcggcatcatcagcaccctgggcttcgtgtacctgacccccttcctggagagcagactgcacatccaggacacctgcggcatcaacaacctgcacggcatccccggcatcatcggcggcatcgtgggcgccgtgaccgccgccagcgccagcctggaggtgtacggcaaggagggcctggtgcacagcttcgacttccagggcttcaacggcgactggaccgccagaacccagggcaagttccagatctacggcctgctggtgaccctggccatggccctgatgggcggcatcatcgtgggcctgatcctgagactgcccttctggggccagcccagcgacgagaactgcttcgaggacgccgtgtactgggagatgcccgagggcaacagcaccgtgtacatccccgaggaccccaccttcaagcccagcggccccagcgtgcccagcgtgcccatggtgagccccctgcccatggccagcagcgtgcccctggtgccctag

SEQ ID NO: 97054 - DNA, 429 bp, Artificial Sequence
  Description of Artificial Sequence: Synthetic coding sequence
atggccgccgccgtggccgccgccggcgccggcgagccccagagccccgacgagctgctgcccaagggcgacgccgagaagcccgaggaggagctggaggaggacgacgacgaggagctggacgagaccctgagcgagagactgtggggcctgaccgagatgttccccgagagagtgagaagcgccgccggcgccaccttcgacctgagcctgttcgtggcccagaagatgtacagattcagcagagccgccctgtggatcggcaccaccagcttcatgatcctggtgctgcccgtggtgttcgagaccgagaagctgcagatggagcagcagcagcagctgcagcagagacagatcctgctgggccccaacaccggcctgagcggcggcatgcccggcgccctgcccagcctgcccggcaagatctag

SEQ ID NO: 97055 - DNA, 1083 bp, Artificial Sequence
  Description of Artificial Sequence: Synthetic coding sequence
atgagccaggagagacccaccttctacagacaggagctgaacaagaccatctgggaggtgcccgagagataccagaacctgagccccgtgggcagcggcgcctacggcagcgtgtgcgccgccttcgacaccaagaccggcctgagagtggccgtgaagaagctgagcagacccttccagagcatcatccacgccaagagaacctacagagagctgagactgctgaagcacatgaagcacgagaacgtgatcggcctgctggacgtgttcacccccgccagaagcctggaggagttcaacgacgtgtacctggtgacccacctgatgggcgccgacctgaacaacatcgtgaagtgccagaagctgaccgacgaccacgtgcagttcctgatctaccagatcctgagaggcctgaagtacatccacagcgccgacatcatccacagagacctgaagcccagcaacctggccgtgaacgaggactgcgagctgaagatcctggacttcggcctggccagacacaccgacgacgagatgaccggctacgtggccaccagatggtacagagcccccgagatcatgctgaactggatgcactacaaccagaccgtggacatctggagcgtgggctgcatcatggccgagctgctgaccggcagaaccctgttccccggcaccgaccacatcaaccagctgcagcagatcatgagactgaccggcaccccccccgcctacctgatcaacagaatgcccagccacgaggccagaaactacatccagagcctgacccagatgcccaagatgaacttcgccaacgtgttcatcggcgccaaccccctggccgtggacctgctggagaagatgctggtgctggacagcgacaagagaatcaccgccgcccaggccctggcccacgcctacttcgcccagtaccacgaccccgacgacgagcccgtggccgacccctacgaccagagcttcgagagcagagacctgctgatcgacgagtggaagagcctgacctacgacgaggtgatcagcttcgtgcccccccccctggaccaggaggagatggagagctag

SEQ ID NO: 97056 - DNA, 1230 bp, Artificial Sequence
  Description of Artificial Sequence: Synthetic coding sequence
atgagattcaccttccccctgatggccatcgtgctggagatcgccatgatcgtgctgttcggcctgttcgtggagtacgagaccgaccagaccgtgctggagcagctgaacatcaccaagcccaccgacatgggcatcttcttcgagctgtaccccctgttccaggacgtgcacgtgatgatcttcgtgggcttcggcttcctgatgaccttcctgaagaagtacggcttcagcagcgtgggcatcaacctgctggtggccgccctgggcctgcagtggggcaccatcgtgcagggcatcctgcagagccagggccagaagttcaacatcggcatcaagaacatgatcaacgccgacttcagcgccgccaccgtgctgatcagcttcggcgccgtgctgggcaagaccagccccacccagatgctgatcatgaccatcctggagatcgtgttcttcgcccacaacgagtacctggtgagcgagatcttcaaggccagcgacatcggcgccagcatgaccatccacgccttcggcgcctacttcggcctggccgtggccggcatcctgtacagaagcggcctgagaaagggccacgagaacgaggagagcgcctactacagcgacctgttcgccatgatcggcaccctgttcctgtggatgttctggcccagcttcaacagcgccatcgccgagcccggcgacaagcagtgcagagccatcgtgaacacctacttcagcctggccgcctgcgtgctgaccgccttcgccttcagcagcctggtggagcacagaggcaagctgaacatggtgcacatccagaacgccaccctggccggcggcgtggccgtgggcacctgcgccgacatggccatccaccccttcggcagcatgatcatcggcagcatcgccggcatggtgagcgtgctgggctacaagttcctgacccccctgttcaccaccaagctgagaatccacgacacctgcggcgtgcacaacctgcacggcctgcccggcgtggtgggcggcctggccggcatcgtggccgtggccatgggcgccagcaacaccagcatggccatgcaggccgccgccctgggcagcagcatcggcaccgccgtggtgggcggcctgatgaccggcctgatcctgaagctgcccctgtggggccagcccagcgaccagaactgctacgacgacagcgtgtactggaaggtgcccaagaccagatag

SEQ ID NO: 97057 - DNA, 1233 bp, Artificial Sequence
  Description of Artificial Sequence: Synthetic coding sequence
atgagattcaccttccccctgatggccatcgtgctggagatcgccatgatcgtgctgttcggcctgttcgtggagtacgagaccgaccagaccgtgctggagcagctgaacatcaccaagcccaccgacatgggcatcttcttcgagctgtaccccctgttccaggacgtgcacgtgatgatcttcgtgggcttcggcttcctgatgaccttcctgaagaagtacggcttcagcagcgtgggcatcaacctgctggtggccgccctgggcctgcagtggggcaccatcgtgcagggcatcctgcagagccagggccagaagttcaacatcggcatcaagaacatgatcaacgccgacttcagcgccgccaccgtgctgatcagcttcggcgccgtgctgggcaagaccagccccacccagatgctgatcatgaccatcctggagatcgtgttcttcgcccacaacgagtacctggtgagcgagatcttcaaggccagcgacatcggcgccagcatgaccatccacgccttcggcgcctacttcggcctggccgtggccggcatcctgtacagaagcggcctgagaaagggccacgagaacgaggagagcgcctactacagcgacctgttcgccatgatcggcaccctgttcctgtggatgttctggcccagcttcaacagcgccatcgccgagcccggcgacaagcagtgcagagccatcgtgaacacctacttcagcctggccgcctgcgtgctgaccgccttcgccttcagcagcctggtggagcacagaggcaagctgaacatggtgcacatccagaacgccaccctggccggcggcgtggccgtgggcacctgcgccgacatggccatccaccccttcggcagcatgatcatcggcagcatcgccggcatggtgagcgtgctgggctacaagttcctgacccccctgttcaccaccaagctgagaatccacgacacctgcggcgtgcacaacctgcacggcctgcccggcgtggtgggcggcctggccggcatcgtggccgtggccatgggcgccagcaacaccagcatggccatgcaggccgccgccctgggcagcagcatcggcaccgccgtggtgggcggcctgatgaccggcctgatcctgaagctgcccctgtggggccagcccagcgaccagaactgctacgacgacagcgtgtactggaaggtgcccaagaccagagtgtag

SEQ ID NO: 97058 - DNA, 1146 bp, Artificial Sequence
  Description of Artificial Sequence: Synthetic coding sequence
atgagattcaccttccccctgatggccatcgtgctggagatcgccatgatcgtgctgttcggcctgttcgtggagtacgagaccgaccagaccgtgctggagcagctgaacatcaccaagcccaccgacatgggcatcttcttcgagctgtaccccctgttccaggacgtgcacgtgatgatcttcgtgggcttcggcttcctgatgaccttcctgaagaagtacggcttcagcagcgtgggcatcaacctgctggtggccgccctgggcctgcagtggggcaccatcgtgcagggcatcctgcagagccagggccagaagttcaacatcggcatcaagaacatgatcaacgccgacttcagcgccgccaccgtgctgatcagcttcggcgccgtgctgggcaagaccagccccacccagatgctgatcatgaccatcctggagatcgtgttcttcgcccacaacgagtacctggtgagcgagatcttcaaggccagcgacatcggcgccagcatgaccatccacgccttcggcgcctacttcggcctggccgtggccggcatcctgtacagaagcggcctgagaaagggccacgagaacgaggagagcgcctactacagcgacctgttcgccatgatcggcaccctgttcctgtggatgttctggcccagcttcaacagcgccatcgccgagcccggcgacaagcagtgcagagccatcgtgaacacctacttcagcctggccgcctgcgtgctgaccgccttcgccttcagcagcctggtggagcacagaggcaagctgaacatggtgcacatccagaacgccaccctggccggcggcgtggccgtgggcacctgcgccgacatggccatccaccccttcggcagcatgatcatcggcagcatcgccggcatggtgagcgtgctgggctacaagttcctgacccccctgttcaccaccaagctgagaatccacgacacctgcggcgtgcacaacctgcacggcctgcccggcgtggtgggcggcctggccggcatcgtggccgtggccatgggcgccagcaacaccagcatggccatgcaggccgccgccctgggcagcagcatcggcaccgccgtggtgggcggcctgatgaccggcacctag

SEQ ID NO: 97059 - DNA, 387 bp, Artificial Sequence
  Description of Artificial Sequence: Synthetic coding sequence
atgaagagcctgatcctgctggccatcctggccgccctggccgtggtgaccctgtgctacggcgagtggcagaaggaggagaacttcggcttcgacatcgtgagcgtgctgagcctgaactggcacagagcccaggagagccacgagagcatggagagctacgagctgaaccccttcatcaacagaagaaacgccaacaccttcatcagcccccagcagagatggagagccaaggtgcaggagagaatcagagagagaagcaagcccgtgcacgagctgaacagagaggcctgcgacgactacagactgtgcgagagatacgccatggtgtacggctacaacgccgcctacaacagatacttcagaaagagaagaggcaccaagtag

SEQ ID NO: 97060 - DNA, 339 bp, Artificial Sequence
  Description of Artificial Sequence: Synthetic coding sequence
atgaccgagaaggcccccgagccccacgtggaggaggacgacgacgacgagctggacagcaagctgaactacaagccccccccccagaagagcctgaaggagctgcaggagatggacaaggacgacgagagcctgatcaagtacaagaagaccctgctgggcgacggccccgtggtgaccgaccccaaggcccccaacgtggtggtgaccagactgaccctggtgtgcgagagcgcccccggccccatcaccatggacctgaccggcgacctggaggccctgaagaaggagaccatcgtgctgaaggagggcagcgagtacagagtgaagatccactag

SEQ ID NO: 97061 - DNA, 606 bp, Artificial Sequence
  Description of Artificial Sequence: Synthetic coding sequence
atgaccgagaaggcccccgagccccacgtggaggaggacgacgacgacgagctggacagcaagctgaactacaagccccccccccagaagagcctgaaggagctgcaggagatggacaaggacgacgagagcctgatcaagtacaagaagaccctgctgggcgacggccccgtggtgaccgaccccaaggcccccaacgtggtggtgaccagactgaccctggtgtgcgagagcgcccccggccccatcaccatggacctgaccggcgacctggaggccctgaagaaggagaccatcgtgctgaaggagggcagcgagtacagagtgaagatccacttcaaggtgaacagagacatcgtgagcggcctgaagtacgtgcagcacacctacagaaccggcgtgaaggtggacaaggccaccttcatggtgggcagctacggccccagacccgaggagtacgagttcctgacccccgtggaggaggcccccaagggcatgctggccagaggcacctaccacaacaagagcttcttcaccgacgacgacaagcaggaccacctgagctgggagtggaacctgagcatcaagaaggagtggaccgagtag

SEQ ID NO: 97062 - DNA, 606 bp, Artificial Sequence; identical to SEQ ID NO: 97061
  Description of Artificial Sequence: Synthetic coding sequence

SEQ ID NO: 97063 - DNA, 267 bp, Artificial Sequence
  Description of Artificial Sequence: Synthetic coding sequence
atgaccgagaaggcccccgagccccacgtggaggaggacgacgacgacgagctggacagcaagctgaactacaagccccccccccagaagagcctgaaggagctgcaggagatggacaaggacgacgagagcctgatcaagtacaagaagaccctgctgggcgacggccccgtggtgaccgaccccaaggcccccaacgtggtggtgaccagactgaccctggtgtgcgagagcgcccccggccccatcaccatggacctgacctag

SEQ ID NO: 97064 - DNA, 480 bp, Artificial Sequence
  Description of Artificial Sequence: Synthetic coding sequence
atgaccgagaaggcccccgagccccacgtggaggaggacgacgacgacgagctggacagcaagctgaactacaagccccccccccagaagagcctgaaggagctgcaggagatggacaaggacgacgagagcctgatcaagtacaagaagaccctgctgggcgacggccccgtggtgaccgaccccaaggcccccaacgtggtggtgaccagactgaccctggtgtgcgagagcgcccccggccccatcaccatggacctgaccggcgacctggaggccctgaagaaggagaccatcgtgctgaaggagggcagcgagtacagagtgaagatccacttcaaggtgaacagagacatcgtgagcggcctgaagtacgtgcagcacacctacagaaccggcgtgaaggtggacaaggccaccttcatggtgggcagctacggccccagacccgaggagtacgagttcctgacccccgtgtag

SEQ ID NO: 97065 - DNA, 1320 bp, Artificial Sequence
  Description of Artificial Sequence: Synthetic coding sequence
atggaccccctgagcgagctgcaggacgacctgaccctggacgacaccagcgaggccctgaaccagctgaagctggccagcatcgacgagaagaactggcccagcgacgagatgcccgacttccccaagagcgacgacagcaagagcagcagccccgagctggtgacccacctgaagtgggacgacccctactacgacatcgccagacaccagatcgtggaggtggccggcgacgacaagtacggcagaaagatcatcgtgttcagcgcctgcagaatgccccccagccaccagctggaccacagcaagctgctgggctacctgaagcacaccctggaccagtacgtggagagcgactacaccctgctgtacctgcaccacggcctgaccagcgacaacaagcccagcctgagctggctgagagacgcctacagagagttcgacagaaagtacaagaagaacatcaaggccctgtacatcgtgcaccccaccatgttcatcaagaccctgctgatcctgttcaagcccctgatcagcttcaagttcggccagaagatcttctacgtgaactacctgagcgagctgagcgagcacgtgaagctggagcagctgggcatccccagacaggtgctgaagtacgacgacttcctgaagagcacccagaagagccccgccaccgcccccaagcccatgccccccagaccccccctgcccaaccagcagttcggcgtgagcctgcagcacctgcaggagaagaaccccgagcaggagcccatccccatcgtgctgagagagaccgtggcctacctgcaggcccacgccctgaccaccgagggcatcttcagaagaagcgccaacacccaggtggtgagagaggtgcagcagaagtacaacatgggcctgcccgtggacttcgaccagtacaacgagctgcacctgcccgccgtgatcctgaagaccttcctgagagagctgcccgagcccctgctgaccttcgacctgtacccccacgtggtgggcttcctgaacatcgacgagagccagagagtgcccgccaccctgcaggtgctgcagaccctgcccgaggagaactaccaggtgctgagattcctgaccgccttcctggtgcagatcagcgcccacagcgaccagaacaagatgaccaacaccaacctggccgtggtgttcggccccaacctgctgtgggccaaggacgccgccatcaccctgaaggccatcaaccccatcaacaccttcaccaagttcctgctggaccaccagggcgagctgttccccagccccgaccccagcggcctgtag

SEQ ID NO: 97066 - DNA, 1377 bp, Artificial Sequence
  Description of Artificial Sequence: Synthetic coding sequence
atggaccccctgagcgagctgcaggacgacctgaccctggacgacaccagcgaggccctgaaccagctgaagctggccagcatcgacgagaagaactggcccagcgacgagatgcccgacttccccaagagcgacgacagcaagagcagcagccccgagctggtgacccacctgaagtgggacgacccctactacgacatcgccagacaccagatcgtggaggtggccggcgacgacaagtacggcagaaagatcatcgtgttcagcgcctgcagaatgccccccagccaccagctggaccacagcaagctgctgggctacctgaagcacaccctggaccagtacgtggagagcgactacaccctgctgtacctgcaccacggcctgaccagcgacaacaagcccagcctgagctggctgagagacgcctacagagagttcgacagaaagtacaagaagaacatcaaggccctgtacatcgtgcaccccaccatgttcatcaagaccctgctgatcctgttcaagcccctgatcagcttcaagttcggccagaagatcttctacgtgaactacctgagcgagctgagcgagcacgtgaagctggagcagctgggcatccccagacaggtgctgaagtacgacgacttcctgaagagcacccagaagagccccgccaccgcccccaagcccatgccccccagaccccccctgcccaaccagcagttcggcgtgagcctgcagcacctgcaggagaagaaccccgagcaggagcccatccccatcgtgctgagagagaccgtggcctacctgcaggcccacgccctgaccaccgagggcatcttcagaagaagcgccaacacccaggtggtgagagaggtgcagcagaagtacaacatgggcctgcccgtggacttcgaccagtacaacgagctgcacctgcccgccgtgatcctgaagaccttcctgagagagctgcccgagcccctgctgaccttcgacctgtacccccacgtggtgggcttcctgaacatcgacgagagccagagagtgcccgccaccctgcaggtgctgcagaccctgcccgaggagaactaccaggtgctgagattcctgaccgccttcctggtgcagatcagcgcccacagcgaccagaacaagatgaccaacaccaacctggccgtggtgttcggccccaacctgctgtgggccaaggacgccgccatcaccctgaaggccatcaaccccatggccaccttcttcttcttcttcctgagatggagcctggccctgagccccggctggagcgccgtggccagaagcagacacaccagcgccttctgggtgcaggccatcctgctgccccagccccccgagtag

SEQ ID NO: 97067 - DNA, 579 bp, Artificial Sequence
  Description of Artificial Sequence: Synthetic coding sequence
atggaccccctgagcgagctgcaggacgacctgaccctggacgacaccagcgaggccctgaaccagctgaagctggccagcatcgacgagaagaactggcccagcgacgagatgcccgacttccccaagagcgacgacagcaagagcagcagccccgagctggtgacccacctgaagtgggacgacccctactacgacatcgccagacaccagatcgtggaggtggccggcgacgacaagtacggcagaaagatcatcgtgttcagcgcctgcagaatgccccccagccaccagctggaccacagcaagctgctgggctacctgaagcacaccctggaccagtacgtggagagcgactacaccctgctgtacctgcaccacggcctgaccagcgacaacaagcccagcctgagctggctgagagacgcctacagagagttcgacagaaagtacaagaagaacatcaaggccctgtacatcgtgcaccccaccatgttcatcaagaccctgctgatcctgttcaagcccctgatcagcttcaagttcggccagaagatcttctacgtgaactacctgtag

SEQ ID NO: 97068 - DNA, 2361 bp, Artificial Sequence
  Description of Artificial Sequence: Synthetic coding sequence
atgggcctgcagcccctggagttcagcgactgctacctggacagcccctggttcagagagagaatcagagcccacgaggccgagctggagagaaccaacaagttcatcaaggagctgatcaaggacggcaagaacctgatcgccgccaccaagagcctgagcgtggcccagagaaagttcgcccacagcctgagagacttcaagttcgagttcatcggcgacgccgtgaccgacgacgagagatgcatcgacgccagcctgagagagttcagcaacttcctgaagaacctggaggagcagagagagatcatggccctgagcgtgaccgagaccctgatcaagcccctggagaagttcagaaaggagcagctgggcgccgtgaaggaggagaagaagaagttcgacaaggagaccgagaagaactacagcctgatcgacaagcacctgaacctgagcgccaagaagaaggacagccacctgcaggaggccgacatccaggtggagcagaacagacagcacttctacgagctgagcctggagtacgtgtgcaagctgcaggagatccaggagagaaagaagttcgagttcgtggagcccatgctgagcttcttccagggcatgttcaccttctaccaccagggccacgagctggccaaggacttcaaccactacaagatggagctgcagatcaacatccagaacaccagaaacagattcgagggcaccagaagcgaggtggaggagctgatgaacaagatcagacagaaccccaaggaccacaagagagccagccagttcaccgccgagggctacctgtacgtgcaggagaagagacccgcccccttcggcagcagctgggtgaagcactactgcatgtacagaaaggccgccaagaagttcaacatgatccccttcgagcacagaagcggcggcaagctgggcgacggcgaggtgttcttcctgaaggagtgcaccaagagacacaccgacagcatcgacagaagattctgcttcgacatcgaggccgccgacagacccggcgtgagcctgaccatgcaggccttcagcgaggaggagagaaagcagtggctggaggccctgggcggcaaggaggccctgagccacagcttcaacaccgccatcatccccagacccgagggcaacgcccagctggacaagatgggcttcaccatcatcagaaagtgcatcagcgccgtggagaccagaggcatcaacgaccagggcctgtacagagtggtgggcgtgagcagcaaggtgcagagactgctgagcatgctgatggacgtgaagacctgcaacgaggtggacctggagaacagcgccgactgggaggtgaagaccatcaccagcgccctgaagcagtacctgagaagcctgcccgagcccctgatgacctacgagctgcacggcgacttcatcgtgcccgccaagagcggcagccccgagagcagagtgaacgccatccacttcctggtgcacaagctgcccgagaagaacaaggagatgctggacatcctggtgaagcacctgaccaacgtgagcaaccacagcaagcagaacctgatgaccgtggccaacctgggcgtggtgttcggccccaccctgatgagaccccaggaggagaccgtggccgccctgatggacctgaagttccagaacatcgtggtggagatcctgatcgagaaccacgagaagatcttcagaaccccccccgacaccaccttccccgagcccacctgcctgagcgccagcccccccaacgccccccccagacagagcaagagacagggccagagaaccaagagacccgtggccgtgtacaacctgtgcctggagctggaggacggcgacaacccctaccccagcaaggaggacacccccaccagcagcctggacagcctgagcagccccagccccgtgaccaccgccgtgcccggcccccccggccccgacaagaaccacctgctggccgacggcggcagcttcggcgactgggccagcaccatccccggccagaccagaagcagcatggtgcagtggctgaacccccagagccccaccaccaccagcagcaacagcgccgtgacccccctgagccccggcagcagccccttccccttcagcccccccgccaccgtggccgacaagccccccgagagcatcagaagcagaaaggccagagccgtgtacccctgcgaggccgagcacagcagcgagctgagcttcgagatcggcgccatcttcgaggacgtgcagaccagcagagagcccggctggctggagggcaccctgaacggcaagagaggcctgatcccccagaactacgtgaagctgctgtag

SEQ ID NO: 97069 - DNA, 1155 bp, Artificial Sequence
  Description of Artificial Sequence: Synthetic coding sequence
atgcaggccttcagcgaggaggagagaaagcagtggctggaggccctgggcggcaaggaggccctgagccacagcttcaacaccgccatcatccccagacccgagggcaacgcccagctggacaagatgggcttcaccatcatcagaaagtgcatcagcgccgtggagaccagaggcatcaacgaccagggcctgtacagagtggtgggcgtgagcagcaaggtgcagagactgctgagcatgctgatggacgtgaagacctgcaacgaggtggacctggagaacagcgccgactgggaggtgaagaccatcaccagcgccctgaagcagtacctgagaagcctgcccgagcccctgatgacctacgagctgcacggcgacttcatcgtgcccgccaagagcggcagccccgagagcagagtgaacgccatccacttcctggtgcacaagctgcccgagaagaacaaggagatgctggacatcctggtgaagcacctgaccaacgtgagcaaccacagcaagcagaacctgatgaccgtggccaacctgggcgtggtgttcggccccaccctgatgagaccccaggaggagaccgtggccgccctgatggacctgaagttccagaacatcgtggtggagatcctgatcgagaaccacgagaagatcttcagaaccccccccgacaccaccttccccgagcccacctgcctgagcgccagcccccccaacgccccccccagacagagcaagagacagggccagagaaccaagagacccgtggccgtgtacaacctgtgcctggagctggaggacggcgacaacccctaccccagcaaggaggacacccccaccagcagcctggacagcctgagcagccccagccccgtgaccaccgccgtgcccggcccccccggccccgacaagaaccacctgctggccgacggcggcagcttcggcgactgggccagcaccatcatcagaagcagaaaggccagagccgtgtacccctgcgaggccgagcacagcagcgagctgagcttcgagatcggcgccatcttcgaggacgtgcagaccagcagagagcccggctggctggagggcaccctgaacggcaagagaggcctgatcccccagaactacgtgaagctgctgtag

SEQ ID NO: 97070 - DNA, 3072 bp, Artificial Sequence
  Description of Artificial Sequence: Synthetic coding sequence
atgtgggaccagagactggtgagactggccctgctgcagcacctgagagccttctacggcatcaaggtgaagggcgtgagaggccagtgcgacagaagaagacacgagaccgccgccaccgagatcggcggcaagatcttcggcgtgcccttcaacgccctgccccacagcgccgtgcccgagtacggccacatccccagcttcctggtggacgcctgcaccagcctggaggaccacatccacaccgagggcctgttcagaaagagcggcagcgtgatcagactgaaggccctgaagaacaaggtggaccacggcgagggctgcctgagcagcgcccccccctgcgacatcgccggcctgctgaagcagttcttcagagagctgcccgagcccatcctgcccgccgacctgcacgaggccctgctgaaggcccagcagctgggcaccgaggagaagaacaaggccaccctgctgctgagctgcctgctggccgaccacaccgtgcacgtgctgagatacttcttcaacttcctgagaaacgtgagcctgagaagcagcgagaacaagatggacagcagcaacctggccgtgatcttcgcccccaacctgctgcagaccagcgagggccacgagaagatgagcagcaacaccgagaagaagctgagactgcaggccgccgtggtgcagaccctgatcgactacgccagcgacatcggcagagtgcccgacttcatcctggagaagatccccgccatgctgggcatcgacggcctgtgcgccacccccagcctggagggcttcgaggagggcgagtacgagacccccggcgagtacaagagaaagagaagacagagcgtgggcgacttcgtgagcggcgccctgaacaagttcaagcccaacagaacccccagcatcaccccccaggaggagagaatcgcccagctgagcgagagccccgtgatcctgacccccaacgccaagagaaccctgcccgtggacagcagccacggcttcagcagcaagaagagaaagagcatcaagcacaacttcaacttcgagctgctgcccagcaacctgttcaacagcagcagcacccccgtgagcgtgcacatcgacaccagcagcgagggcagcagccagagcagcctgagccccgtgctgatcggcggcaaccacctgatcaccgccggcgtgcccagaagaagcaagagaatcgccggcaagaaggtgtgcagagtggagagcggcaaggccggctgcttcagccccaagatcagccacaaggagaaggtgagaagaagcctgagactgaagttcaacctgggcaagaacggcagagaggtgaacggctgcagcggcgtgaacagatacgagagcgtgggctggagactggccaaccagcagagcctgaagaacagaatcgagagcgtgaagaccggcctgctgttcagccccgacgtggacgagaagctgcccaagaagggcagcgagaagatcagcaagagcgaggagaccctgctgacccccgagagactggtgggcaccaactacagaatgagctggaccggccccaacaacagcagcttccaggaggtggacgccaacgaggccagcagcatggtggagaacctggaggtggagaacagcctggagcccgacatcatggtggagaagagccccgccaccagctgcgagctgacccccagcaacctgaacaacaagcacaacagcaacatcaccagcagccccctgagcggcgacgagaacaacatgaccaaggagaccctggtgaaggtgcagaaggccttcagcgagagcggcagcaacctgcacgccctgatgaaccagagacagagcagcgtgaccaacgtgggcaaggtgaagctgaccgagcccagctacctggaggacagccccgaggagaacctgttcgagaccaacgacctgaccatcgtggagagcaaggagaagtacgagcaccacaccggcaagggcgagaagtgcttcagcgagagagacttcagccccctgcagacccagaccttcaacagagagaccaccatcaagtgctacagcacccagatgaagatggagcacgagaaggacatccacagcaacatgcccaaggactacctgagcaagcaggagttcagcagcgacgaggagatcaagaagcagcagagccccaaggacaagctgaacaacaagctgaaggagaacgagaacatgatggagggcaacctgcccaagtgcgccgcccacagcaaggacgaggccagaagcagcttcagccagcagagcacctgcgtggtgaccaacctgagcaagcccagacccatgagaatcgccaagcagcagagcctggagacctgcgagaagaccgtgagcgagagcagccagatgaccgagcacagaaaggtgagcgaccacatccagtggttcaacaagctgagcctgaacgagcccaacagaatcaaggtgaagagccccctgaagttccagagaacccccgtgagacagagcgtgagaagaatcaacagcctgctggagtacagcagacagcccaccggccacaagctggccagcctgggcgacaccgccagccccctggtgaagagcgtgagctgcgacggcgccctgagcagctgcatcgagagcgccagcaaggacagcagcgtgagctgcatcaagagcggccccaaggagcagaagagcatgagctgcgaggagagcaacatcggcgccatcagcaagagcagcatggagctgcccagcaagagcttcctgaagatgagaaagcaccccgacagcgtgaacgccagcctgagaagcaccaccgtgtacaagcagaagatcctgagcgacggccaggtgaaggtgcccctggacgacctgaccaaccacgacatcgtgaagcccgtggtgaacaacaacatgggcatcagcagcggcatcaacaacagagtgctgagaagacccagcgagagaggcagagcctggtacaagggcagccccaagcaccccatcggcaagacccagctgctgcccaccagcaagcccgtggacctgtag

SEQ ID NO: 97071 - DNA, 2505 bp, Artificial Sequence
  Description of Artificial Sequence: Synthetic coding sequence
atggacagcagcaacctggccgtgatcttcgcccccaacctgctgcagaccagcgagggccacgagaagatgagcagcaacaccgagaagaagctgagactgcaggccgccgtggtgcagaccctgatcgactacgccagcgacatcggcagagtgcccgacttcatcctggagaagatccccgccatgctgggcatcgacggcctgtgcgccacccccagcctggagggcttcgaggagggcgagtacgagacccccggcgagtacaagagaaagagaagacagagcgtgggcgacttcgtgagcggcgccctgaacaagttcaagcccaacagaacccccagcatcaccccccaggaggagagaatcgcccagctgagcgagagccccgtgatcctgacccccaacgccaagagaaccctgcccgtggacagcagccacggcttcagcagcaagaagagaaagagcatcaagcacaacttcaacttcgagctgctgcccagcaacctgttcaacagcagcagcacccccgtgagcgtgcacatcgacaccagcagcgagggcagcagccagagcagcctgagccccgtgctgatcggcggcaaccacctgatcaccgccggcgtgcccagaagaagcaagagaatcgccggcaagaaggtgtgcagagtggagagcggcaaggccggctgcttcagccccaagatcagccacaaggagaaggtgagaagaagcctgagactgaagttcaacctgggcaagaacggcagagaggtgaacggctgcagcggcgtgaacagatacgagagcgtgggctggagactggccaaccagcagagcctgaagaacagaatcgagagcgtgaagaccggcctgctgttcagccccgacgtggacgagaagctgcccaagaagggcagcgagaagatcagcaagagcgaggagaccctgctgacccccgagagactggtgggcaccaactacagaatgagctggaccggccccaacaacagcagcttccaggaggtggacgccaacgaggccagcagcatggtggagaacctggaggtggagaacagcctggagcccgacatcatggtggagaagagccccgccaccagctgcgagctgacccccagcaacctgaacaacaagcacaacagcaacatcaccagcagccccctgagcggcgacgagaacaacatgaccaaggagaccctggtgaaggtgcagaaggccttcagcgagagcggcagcaacctgcacgccctgatgaaccagagacagagcagcgtgaccaacgtgggcaaggtgaagctgaccgagcccagctacctggaggacagccccgaggagaacctgttcgagaccaacgacctgaccatcgtggagagcaaggagaagtacgagcaccacaccggcaagggcgagaagtgcttcagcgagagagacttcagccccctgcagacccagaccttcaacagagagaccaccatcaagtgctacagcacccagatgaagatggagcacgagaaggacatccacagcaacatgcccaaggactacctgagcaagcaggagttcagcagcgacgaggagatcaagaagcagcagagccccaaggacaagctgaacaacaagctgaaggagaacgagaacatgatggagggcaacctgcccaagtgcgccgcccacagcaaggacgaggccagaagcagcttcagccagcagagcacctgcgtggtgaccaacctgagcaagcccagacccatgagaatcgccaagcagcagagcctggagacctgcgagaagaccgtgagcgagagcagccagatgaccgagcacagaaaggtgagcgaccacatccagtggttcaacaagctgagcctgaacgagcccaacagaatcaaggtgaagagccccctgaagttccagagaacccccgtgagacagagcgtgagaagaatcaacagcctgctggagtacagcagacagcccaccggccacaagctggccagcctgggcgacaccgccagccccctggtgaagagcgtgagctgcgacggcgccctgagcagctgcatcgagagcgccagcaaggacagcagcgtgagctgcatcaagagcggccccaaggagcagaagagcatgagctgcgaggagagcaacatcggcgccatcagcaagagcagcatggagctgcccagcaagagcttcctgaagatgagaaagcaccccgacagcgtgaacgccagcctgagaagcaccaccgtgtacaagcagaagatcctgagcgacggccaggtgaaggtgcccctggacgacctgaccaaccacgacatcgtgaagcccgtggtgaacaacaacatgggcatcagcagcggcatcaacaacagagtgctgagaagacccagcgagagaggcagagcctggtacaagggcagccccaagcaccccatcggcaagacccagctgctgcccaccagcaagcccgtggacctgtag

SEQ ID NO: 97072 - DNA, 1506 bp, Artificial Sequence
  Description of Artificial Sequence: Synthetic coding sequence
atgtgggaccagagactggtgagactggccctgctgcagcacctgagagccttctacggcatcaaggtgaagggcgtgagaggccagtgcgacagaagaagacacgagaccgccgccaccgagatcggcggcaagatcttcggcgtgcccttcaacgccctgccccacagcgccgtgcccgagtacggccacatccccagcttcctggtggacgcctgcaccagcctggaggaccacatccacaccgagggcctgttcagaaagagcggcagcgtgatcagactgaaggccctgaagaacaaggtggaccacggcgagggctgcctgagcagcgcccccccctgcgacatcgccggcctgctgaagcagttcttcagagagctgcccgagcccatcctgcccgccgacctgcacgaggccctgctgaaggcccagcagctgggcaccgaggagaagaacaaggccaccctgctgctgagctgcctgctggccgaccacaccgtgcacgtgctgagatacttcttcaacttcctgagaaacgtgagcctgagaagcagcgagaacaagatggacagcagcaacctggccgtgatcttcgcccccaacctgctgcagaccagcgagggccacgagaagatgagcagcaacaccgagaagaagctgagactgcaggccgccgtggtgcagaccctgatcgactacgccagcgacatcggcagagtgcccgacttcatcctggagaagatccccgccatgctgggcatcgacggcctgtgcgccacccccagcctggagggcttcgaggagggcgagtacgagacccccggcgagtacaagagaaagagaagacagagcgtgggcgacttcgtgagcggcgccctgaacaagttcaagcccaacagaacccccagcatcaccccccaggaggagagaatcgcccagctgagcgagagccccgtgatcctgacccccaacgccaagagaaccctgcccgtggacagcagccacggcttcagcagcaagaagagaaagagcatcaagcacaacttcaacttcgagctgctgcccagcaacctgttcaacagcagcagcacccccgtgagcgtgcacatcgacaccagcagcgagggcagcagccagagcagcctgagccccgtgctgatcggcggcaaccacctgatcaccgccggcgtgcccagaagaagcaagagaatcgccggcaagaaggtgtgcagagtggagagcggcaaggccggctgcttcagccccaagatcagccacaaggagaaggtgagaagaagcctgagactgaagttcaacctgggcaagaacggcagagaggtgaacggctgcagcggcgtgaacagatacgagagcgtgggctggagactggccaaccagcagagcctgaagaacagaatcgagagcgtgaagaccggcctgctgttcagccccgacgtggacgagaagctgcccaagaagggcaccttcacctactactgctag

SEQ ID NO: 97073 - DNA, 2385 bp, Artificial Sequence
  Description of Artificial Sequence: Synthetic coding sequence
atgaagatggccgacagaagcggcaagatcatccccggccaggtgtacatcgaggtggagtacgactacgagtacgaggccaaggacagaaagatcgtgatcaagcagggcgagagatacatcctggtgaagaagaccaacgacgactggtggcaggtgaagcccgacgagaacagcaaggccttctacgtgcccgcccagtacgtgaaggaggtgaccagaaaggccctgatgccccccgtgaagcaggtggccggcctgcccaacaacagcaccaagatcatgcagagcctgcacctgcagagaagcaccgagaacgtgaacaagctgcccgagctgagcagcttcggcaagcccagcagcagcgtgcagggcaccggcctgatcagagacgccaaccagaacttcggccccagctacaaccagggccagaccgtgaacctgagcctggacctgacccacaacaacggcaagttcaacaacgacagccacagccccaaggtgagcagccagaacagaaccagaagcttcggccacttccccggccccgagttcctggacgtggagaagaccagcttcagccaggagcagagctgcgacagcgccggcgagggcagcgagagaatccaccaggacagcgagagcggcgacgagctgagcagcagcagcaccgagcagatcagagccaccaccccccccaaccagggcagacccgacagccccgtgtacgccaacctgcaggagctgaagatcagccagagcgccctgccccccctgcccggcagccccgccatccagatcaacggcgagtgggagacccacaaggacagcagcggcagatgctactactacaacagaggcacccaggagagaacctggaagccccccagatggaccagagacgccagcatcagcaagggcgacttccagaaccccggcgaccaggagtggctgaagcacgtggacgaccagggcagacagtactactacagcgccgacggcagcagaagcgagtgggagctgcccaagtacaacgccagcagccagcagcagagagagatcatcaagagcagaagcctggacagaagactgcaggagcccatcgtgctgaccaagtggagacacagcaccatcgtgctggacaccaacgacaaggagagccccaccgccagcaagccctgcttccccgagaacgagagcagccccagcagccccaagcaccaggacaccgaccaggagaagtacggcctgctgaacgtgaccaagatcgccgagaacggcaagaaggtgagaaagaactggctgagcagctgggccgtgctgcagggcagcagcctgctgttcaccaagacccagggcagcagcaccagctggttcggcagcaaccagagcaagcccgagttcaccgtggacctgaagggcgccaccatcgagatggccagcaaggacaagagcagcaagaagaacgtgttcgagctgaagaccagacagggcaccgagctgctgatccagagcgacaacgacaccgtgatcaacgactggttcaaggtgctgagcagcaccatcaacaaccaggccgtggagaccgacgagggcatcgaggaggagatccccgacagccccggcatcgagaagcacgacaaggagaaggagcagaaggaccccaagaagctgagaagcttcaaggtgagcagcatcgacagcagcgagcagaagaagaccaagaagaacctgaagaagttcctgaccagaagacccaccctgcaggccgtgagagagaagggctacatcaaggaccaggtgttcggcagcaacctggccaacctgtgccagagagagaacggcaccgtgcccaagttcgtgaagctgtgcatcgagcacgtggaggagcacggcctggacatcgacggcatctacagagtgagcggcaacctggccgtgatccagaagctgagattcgccgtgaaccacgacgagaagctggacctgaacgacagcaagtgggaggacatccacgtgatcaccggcgccctgaagatgttcttcagagagctgcccgagcccctgttcaccttcaaccacttcaacgacttcgtgaacgccatcaagcaggagcccagacagagagtggccgccgtgaaggacctgatcagacagctgcccaagcccaaccaggacaccatgcagatcctgttcagacacctgagaagagtgatcgagaacggcgagaagaacagaatgacctaccagagcatcgccatcgtgttcggccccaccctgctgaagcccgagaaggagaccggcaacatcgccgtgcacaccgtgtaccagaaccagatcgtggagctgatcctgctggagctgagcagcatcttcggcagatag

SEQ ID NO: 97074 - DNA, 2541 bp, Artificial Sequence
  Description of Artificial Sequence: Synthetic coding sequence
atgaagatggccgacagaagcggcaagatcatccccggccaggtgtacatcgaggtggagtacgactacgagtacgaggccaaggacagaaagatcgtgatcaagcagggcgagagatacatcctggtgaagaagaccaacgacgactggtggcaggtgaagcccgacgagaacagcaaggccttctacgtgcccgcccagtacgtgaaggaggtgaccagaaaggccctgatgccccccgtgaagcaggtggccggcctgcccaacaacagcaccaagatcatgcagagcctgcacctgcagagaagcaccgagaacgtgaacaagctgcccgagctgagcagcttcggcaagcccagcagcagcgtgcagggcaccggcctgatcagagacgccaaccagaacttcggccccagctacaaccagggccagaccgtgaacctgagcctggacctgacccacaacaacggcaagttcaacaacgacagccacagccccaaggtgagcagccagaacagaaccagaagcttcggccacttccccggccccgagttcctggacgtggagaagaccagcttcagccaggagcagagctgcgacagcgccggcgagggcagcgagagaatccaccaggacagcgagagcggcgacgagctgagcagcagcagcaccgagcagatcagagccaccaccccccccaaccagggcagacccgacagccccgtgtacgccaacctgcaggagctgaagatcagccagagcgccctgccccccctgcccggcagccccgccatccagatcaacggcgagtgggagacccacaaggacagcagcggcagatgctactactacaacagaggcacccaggagagaacctggaagccccccagatggaccagagacgccagcatcagcaagggcgacttccagaaccccggcgaccaggagctgctgagcagcgaggagaactactacagcaccagctacagccagagcgacagccagtgcggcagcccccccagaggctggagcgaggagctggacgagagaggccacaccctgtacaccagcgactacaccaacgagaagtggctgaagcacgtggacgaccagggcagacagtactactacagcgccgacggcagcagaagcgagtgggagctgcccaagtacaacgccagcagccagcagcagagagagatcatcaagagcagaagcctggacagaagactgcaggagcccatcgtgctgaccaagtggagacacagcaccatcgtgctggacaccaacgacaaggagagccccaccgccagcaagccctgcttccccgagaacgagagcagccccagcagccccaagcaccaggacaccgccagcagccccaaggaccaggagaagtacggcctgctgaacgtgaccaagatcgccgagaacggcaagaaggtgagaaagaactggctgagcagctgggccgtgctgcagggcagcagcctgctgttcaccaagacccagggcagcagcaccagctggttcggcagcaaccagagcaagcccgagttcaccgtggacctgaagggcgccaccatcgagatggccagcaaggacaagagcagcaagaagaacgtgttcgagctgaagaccagacagggcaccgagctgctgatccagagcgacaacgacaccgtgatcaacgactggttcaaggtgctgagcagcaccatcaacaaccaggccgtggagaccgacgagggcatcgaggaggagatccccgacagccccggcatcgagaagcacgacaaggagaaggagcagaaggaccccaagaagctgagaagcttcaaggtgagcagcatcgacagcagcgagcagaagaagaccaagaagaacctgaagaagttcctgaccagaagacccaccctgcaggccgtgagagagaagggctacatcaaggaccaggtgttcggcagcaacctggccaacctgtgccagagagagaacggcaccgtgcccaagttcgtgaagctgtgcatcgagcacgtggaggagcacggcctggacatcgacggcatctacagagtgagcggcaacctggccgtgatccagaagctgagattcgccgtgaaccacgacgagaagctggacctgaacgacagcaagtgggaggacatccacgtgatcaccggcgccctgaagatgttcttcagagagctgcccgagcccctgttcaccttcaaccacttcaacgacttcgtgaacgccatcaagcaggagcccagacagagagtggccgccgtgaaggacctgatcagacagctgcccaagcccaaccaggacaccatgcagatcctgttcagacacctgagaagagtgatcgagaacggcgagaagaacagaatgacctaccagagcatcgccatcgtgttcggccccaccctgctgaagcccgagaaggagaccggcaacatcgccgtgcacaccgtgtaccagaaccagatcgtggagctgatcctgctggagctgagcagcatcttcggcagatag

SEQ ID NO: 97075 - DNA, 2385 bp, Artificial Sequence; identical to SEQ ID NO: 97073
  Description of Artificial Sequence: Synthetic coding sequence

SEQ ID NO: 97076 - DNA, 2451 bp, Artificial Sequence
  Description of Artificial Sequence: Synthetic coding sequence
atgaagatggccgacagaagcggcaagatcatccccggccaggtgtacatcgaggtggagtacgactacgagtacgaggccaaggacagaaagatcgtgatcaagcagggcgagagatacatcctggtgaagaagaccaacgacgactggtggcaggtgaagcccgacgagaacagcaaggccttctacgtgcccgcccagtacgtgaaggaggtgaccagaaaggccctgatgccccccgtgaagcaggtggccggcctgcccaacaacagcaccaagatcatgcagagcctgcacctgcagagaagcaccgagaacgtgaacaagctgcccgagctgagcagcttcggcaagcccagcagcagcgtgcagggcaccggcctgatcagagacgccaaccagaacttcggccccagctacaaccagggccagaccgtgaacctgagcctggacctgacccacaacaacggcaagttcaacaacgacagccacagccccaaggtgagcagccagaacagaaccagaagcttcggccacttccccggccccgagttcctggacgtggagaagaccagcttcagccaggagcagagctgcgacagcgccggcgagggcagcgagagaatccaccaggacagcgagagcggcgacgagctgagcagcagcagcaccgagcagatcagagccaccaccccccccaaccagggcagacccgacagccccgtgtacgccaacctgcaggagctgaagatcagccagagcgccctgccccccctgcccggcagccccgccatccagatcaacggcgagtgggagacccacaaggacagcagcggcagatgctactactacaacagaggcacccaggagagaacctggaagccccccagatggaccagagacgccagcatcagcaagggcgacttccagaaccccggcgaccaggagctgctgagcagcgaggagaactactacagcaccagctacagccagagcgacagccagtgcggcagcccccccagaggctggagcgaggagctggacgagagaggccacaccctgtacaccagcgactacaccaacgagaagtggctgaagcacgtggacgaccagggcagacagtactactacagcgccgacggcagcagaagcgagtgggagctgcccaagtacaacgccagcagccagcagcagagagagatcatcaagagcagaagcctggacagaagactgcaggagcccatcgtgctgaccaagtggagacacagcaccatcgtgctggacaccaacgacaaggaccaggagaagtacggcctgctgaacgtgaccaagatcgccgagaacggcaagaaggtgagaaagaactggctgagcagctgggccgtgctgcagggcagcagcctgctgttcaccaagacccagggcagcagcaccagctggttcggcagcaaccagagcaagcccgagttcaccgtggacctgaagggcgccaccatcgagatggccagcaaggacaagagcagcaagaagaacgtgttcgagctgaagaccagacagggcaccgagctgctgatccagagcgacaacgacaccgtgatcaacgactggttcaaggtgctgagcagcaccatcaacaaccaggccgtggagaccgacgagggcatcgaggaggagatccccgacagccccggcatcgagaagcacgacaaggagaaggagcagaaggaccccaagaagctgagaagcttcaaggtgagcagcatcgacagcagcgagcagaagaagaccaagaagaacctgaagaagttcctgaccagaagacccaccctgcaggccgtgagagagaagggctacatcaaggaccaggtgttcggcagcaacctggccaacctgtgccagagagagaacggcaccgtgcccaagttcgtgaagctgtgcatcgagcacgtggaggagcacggcctggacatcgacggcatctacagagtgagcggcaacctggccgtgatccagaagctgagattcgccgtgaaccacgacgagaagctggacctgaacgacagcaagtgggaggacatccacgtgatcaccggcgccctgaagatgttcttcagagagctgcccgagcccctgttcaccttcaaccacttcaacgacttcgtgaacgccatcaagcaggagcccagacagagagtggccgccgtgaaggacctgatcagacagctgcccaagcccaaccaggacaccatgcagatcctgttcagacacctgagaagagtgatcgagaacggcgagaagaacagaatgacctaccagagcatcgccatcgtgttcggccccaccctgctgaagcccgagaaggagaccggcaacatcgccgtgcacaccgtgtaccagaaccagatcgtggagctgatcctgctggagctgagcagcatcttcggcagatag

SEQ ID NO: 97077 - DNA, 2526 bp, Artificial Sequence
  Description of Artificial Sequence: Synthetic coding sequence
atgaagatggccgacagaagcggcaagatcatccccggccaggtgtacatcgaggtggagtacgactacgagtacgaggccaaggacagaaagatcgtgatcaagcagggcgagagatacatcctggtgaagaagaccaacgacgactggtggcaggtgaagcccgacgagaacagcaaggccttctacgtgcccgcccagtacgtgaaggaggtgaccagaaaggccctgatgccccccgtgaagcaggtggccggcctgcccaacaacagcaccaagatcatgcagagcctgcacctgcagagaagcaccgagaacgtgaacaagctgcccgagctgagcagcttcggcaagcccagcagcagcgtgcagggcaccggcctgatcagagacgccaaccagaacttcggccccagctacaaccagggccagaccgtgaacctgagcctggacctgacccacaacaacggcaagttcaacaacgacagccacagccccaaggtgagcagccagaacagaaccagaagcttcggccacttccccggccccgagttcctggacgtggagaagaccagcttcagccaggagcagagctgcgacagcgccggcgagggcagcgagagaatccaccaggacagcgagagcggcgacgagctgagcagcagcagcaccgagcagatcagagccaccaccccccccaaccagggcagacccgacagccccgtgtacgccaacctgcaggagctgaagatcagccagagcgccctgccccccctgcccggcagccccgccatccagatcaacggcgagtgggagacccacaaggacagcagcggcagatgctactactacaacagaggcacccaggagagaacctggaagccccccagatggaccagagacgccagcatcagcaagggcgacttccagaaccccggcgaccaggagctgctgagcagcgaggagaactactacagcaccagctacagccagagcgacagccagtgcggcagcccccccagaggctggagcgaggagctggacgagagaggccacaccctgtacaccagcgactacaccaacgagaagtggctgaagcacgtggacgaccagggcagacagtactactacagcgccgacggcagcagaagcgagtgggagctgcccaagtacaacgccagcagccagcagcagagagagatcatcaagagcagaagcctggacagaagactgcaggagcccatcgtgctgaccaagtggagacacagcaccatcgtgctggacaccaacgacaaggagagccccaccgccagcaagccctgcttccccgagaacgagagcagccccagcagccccaagcaccaggacaccgaccaggagaagtacggcctgctgaacgtgaccaagatcgccgagaacggcaagaaggtgagaaagaactggctgagcagctgggccgtgctgcagggcagcagcctgctgttcaccaagacccagggcagcagcaccagctggttcggcagcaaccagagcaagcccgagttcaccgtggacctgaagggcgccaccatcgagatggccagcaaggacaagagcagcaagaagaacgtgttcgagctgaagaccagacagggcaccgagctgctgatccagagcgacaacgacaccgtgatcaacgactggttcaaggtgctgagcagcaccatcaacaaccaggccgtggagaccgacgagggcatcgaggaggagatccccgacagccccggcatcgagaagcacgacaaggagaaggagcagaaggaccccaagaagctgagaagcttcaaggtgagcagcatcgacagcagcgagcagaagaagaccaagaagaacctgaagaagttcctgaccagaagacccaccctgcaggccgtgagagagaagggctacatcaaggaccaggtgttcggcagcaacctggccaacctgtgccagagagagaacggcaccgtgcccaagttcgtgaagctgtgcatcgagcacgtggaggagcacggcctggacatcgacggcatctacagagtgagcggcaacctggccgtgatccagaagctgagattcgccgtgaaccacgacgagaagctggacctgaacgacagcaagtgggaggacatccacgtgatcaccggcgccctgaagatgttcttcagagagctgcccgagcccctgttcaccttcaaccacttcaacgacttcgtgaacgccatcaagcaggagcccagacagagagtggccgccgtgaaggacctgatcagacagctgcccaagcccaaccaggacaccatgcagatcctgttcagacacctgagaagagtgatcgagaacggcgagaagaacagaatgacctaccagagcatcgccatcgtgttcggccccaccctgctgaagcccgagaaggagaccggcaacatcgccgtgcacaccgtgtaccagaaccagatcgtggagctgatcctgctggagctgagcagcatcttcggcagatag

SEQ ID NO: 97078 - DNA, 591 bp, Artificial Sequence
  Description of Artificial Sequence: Synthetic coding sequence
tgaagcaccagctacagccagagcgacagccagtgcggcagcccccccagaggctggagcgaggagctggacgagagaggccacaccctgtacaccagcgactacaccaacgagaagtggctgaagcacgtggacgaccagggcagacagtactactacagcgccgacggcagcagaagcgagtgggagctgcccaagtacaacgccagcagccagcagcagagagagatcatcaagagcagaagcctggacagaagactgcaggagcccatcgtgctgaccaagtggagacacagcaccatcgtgctggacaccaacgacaaggagagccccaccgccagcaagccctgcttccccgagaacgagagcagccccagcagccccaagcaccaggacaccgaccaggagaagtacggcctgctgaacgtgaccaagatcgccgagaacggcaagaaggtgagaaagaactggctgagcagctgggccgtgctgcagggcagcagcctgctgttcaccaagacccagggcagcagcaccagctggttcggcagcaaccagagcaagcccgagttcaccgtggacctgaagtag

SEQ ID NO: 97079 - DNA, 2646 bp, Artificial Sequence
  Description of Artificial Sequence: Synthetic coding sequence
atgaagaagcagttcaacagaatgaagcagctggccaaccagaccgtgggcagagccgagaagaccgaggtgctgagcgaggacctgctgcagatcgagagaagactggacaccgtgagaagcatctgccaccacagccacaagagactggtggcctgcttccagggccagcacggcaccgacgccgagagaagacacaagaagctgcccctgaccgccctggcccagaacatgcaggaggccagcacccagctggaggacagcctgctgggcaagatgctggagacctgcggcgacgccgagaaccagctggccctggagctgagccagcacgaggtgttcgtggagaaggagatcgtggaccccctgtacggcatcgccgaggtggagatccccaacatccagaagcagagaaagcagctggccagactggtgctggactgggacagcgtgagagccagatggaaccaggcccacaagagcagcggcaccaacttccagggcctgcccagcaagatcgacaccctgaaggaggagatggacgaggccggcaacaaggtggagcagtgcaaggaccagctggccgccgacatgtacaacttcatggccaaggagggcgagtacggcaagttcttcgtgaccctgctggaggcccaggccgactaccacagaaaggccctggccgtgctggagaagaccctgcccgagatgagagcccaccaggacaagtgggccgagaagcccgccttcggcacccccctggaggagcacctgaagagaagcggcagagagatcgccctgcccatcgaggcctgcgtgatgctgctgctggagaccggcatgaaggaggagggcctgttcagaatcggcgccggcgccagcaagctgaagaagctgaaggccgccctggactgcagcaccagccacctggacgagttctacagcgacccccacgccgtggccggcgccctgaagagctacctgagagagctgcccgagcccctgatgaccttcaacctgtacgaggagtggacccaggtggccagcgtgcaggaccaggacaagaagctgcaggacctgtggagaacctgccagaagctgcccccccagaacttcgtgaacttcagatacctgatcaagttcctggccaagctggcccagaccagcgacgtgaacaagatgacccccagcaacatcgccatcgtgctgggccccaacctgctgtgggccagaaacgagggcaccctggccgagatggccgccgccaccagcgtgcacgtggtggccgtgatcgagcccatcatccagcacgccgactggttcttccccgaggaggtggagttcaacgtgagcgaggccttcgtgcccctgaccacccccagcagcaaccacagcttccacaccggcaacgacagcgacagcggcaccctggagagaaagagacccgccagcatggccgtgatggagggcgacctggtgaagaaggagagcttcggcgtgaagctgatggacttccaggcccacagaagaggcggcaccctgaacagaaagcacatcagccccgccttccagccccccctgccccccaccgacggcagcaccgtggtgcccgccggccccgagccccccccccagagcagcagagccgagagcagcagcggcggcggcaccgtgcccagcagcgccggcatcctggagcagggccccagccccggcgacggcagcccccccaagcccaaggaccccgtgagcgccgccgtgcccgcccccggcagaaacaacagccagatcgccagcggccagaaccagccccaggccgccgccggcagccaccagctgagcatgggccagccccacaacgccgccggccccagcccccacaccctgagaagagccgtgaagaagcccgcccccgccccccccaagcccggcaaccccccccccggccaccccggcggccagagcagcagcggcaccagccagcacccccccagcctgagccccaagccccccaccagaagccccagcccccccacccagcacaccggccagccccccggccagcccagcgcccccagccagctgagcgcccccagaagatacagcagcagcctgagccccatccaggcccccaaccacccccccccccagccccccacccaggccacccccctgatgcacaccaagcccaacagccagggcccccccaaccccatggccctgcccagcgagcacggcctggagcagcccagccacacccccccccagacccccaccccccccagcaccccccccctgggcaagcagaaccccagcctgcccgccccccagaccctggccggcggcaaccccgagaccgcccagccccacgccggcaccctgcccagacccagacccgtgcccaagcccagaaacagacccagcgtgcccccccccccccagccccccggcgtgcacagcgccggcgacagcagcctgaccaacaccgcccccaccgccagcaagatcgtgaccgacagcaacagcagagtgagcgagccccacagaagcatcttccccgagatgcacagcgacagcgccagcaaggacgtgcccggcagaatcctgctggacatcgacaacgacaccgagagcaccgccctgtag

SEQ ID NO: 97080 - DNA, 2412 bp, Artificial Sequence
  Description of Artificial Sequence: Synthetic coding sequence
atgaagaagcagttcaacagaatgaagcagctggccaaccagaccgtgggcagagccgagaagaccgaggtgctgagcgaggacctgctgcagatcgagagaagactggacaccgtgagaagcatctgccaccacagccacaagagactggtggcctgcttccagggccagcacggcaccgacgccgagagaagacacaagaagctgcccctgaccgccctggcccagaacatgcaggaggccagcacccagctggaggacagcctgctgggcaagatgctggagacctgcggcgacgccgagaaccagctggccctggagctgagccagcacgaggtgttcgtggagaaggagatcgtggaccccctgtacggcatcgccgaggtggagatccccaacatccagaagcagagaaagcagctggccagactggtgctggactgggacagcgtgagagccagatggaaccaggcccacaagagcagcggcaccaacttccagggcctgcccagcaagatcgacaccctgaaggaggagatggacgaggccggcaacaaggtggagcagtgcaaggaccagctggccgccgacatgtacaacttcatggccaaggagggcgagtacggcaagttcttcgtgaccctgctggaggcccaggccgactaccacagaaaggccctggccgtgctggagaagaccctgcccgagatgagagcccaccaggacaagtgggccgagaagcccgccttcggcacccccctggaggagcacctgaagagaagcggcagagagatcgccctgcccatcgaggcctgcgtgatgctgctgctggagaccggcatgaaggaggagggcctgttcagaatcggcgccggcgccagcaagctgaagaagctgaaggccgccctggactgcagcaccagccacctggacgagttctacagcgacccccacgccgtggccggcgccctgaagagctacctgagagagctgcccgagcccctgatgaccttcaacctgtacgaggagtggacccaggtggccagcgtgcaggaccaggacaagaagctgcaggacctgtggagaacctgccagaagctgcccccccagaacttcgtgaacttcagatacctgatcaagttcctggccaagctggcccagaccagcgacgtgaacaagatgacccccagcaacatcgccatcgtgctgggccccaacctgctgtgggccagaaacgagggcaccctggccgagatggccgccgccaccagcgtgcacgtggtggccgtgatcgagcccatcatccagcacgccgactggttcttccccgaggaggtggagttcaacgtgagcgaggccttcgtgcccctgaccacccccagcagcaaccacagcttccacaccggcaacgacagcgacagcggcaccctggagagaaagagacccgccagcatggccgtgatggagggcgacctggtgaagaaggagagcccccccaagcccaaggaccccgtgagcgccgccgtgcccgcccccggcagaaacaacagccagatcgccagcggccagaaccagccccaggccgccgccggcagccaccagctgagcatgggccagccccacaacgccgccggccccagcccccacaccctgagaagagccgtgaagaagcccgcccccgccccccccaagcccggcaaccccccccccggccaccccggcggccagagcagcagcggcaccagccagcacccccccagcctgagccccaagccccccaccagaagccccagcccccccacccagcacaccggccagccccccggccagcccagcgcccccagccagctgagcgcccccagaagatacagcagcagcctgagccccatccaggcccccaaccacccccccccccagccccccacccaggccacccccctgatgcacaccaagcccaacagccagggcccccccaaccccatggccctgcccagcgagcacggcctggagcagcccagccacacccccccccagacccccaccccccccagcaccccccccctgggcaagcagaaccccagcctgcccgccccccagaccctggccggcggcaaccccgagaccgcccagccccacgccggcaccctgcccagacccagacccgtgcccaagcccagaaacagacccagcgtgcccccccccccccagccccccggcgtgcacagcgccggcgacagcagcctgaccaacaccgcccccaccgccagcaagatcgtgaccgacagcaacagcagagtgagcgagccccacagaagcatcttccccgagatgcacagcgacagcgccagcaaggacgtgcccggcagaatcctgctggacatcgacaacgacaccgagagcaccgccctgtag

SEQ ID NO: 97081 - DNA, 681 bp, Artificial Sequence
  Description of Artificial Sequence: Synthetic coding sequence
atgaagaagcagttcaacagaatgaagcagctggccaaccagaccgtgggcagagccgagaagaccgaggtgctgagcgaggacctgctgcagatcgagagaagactggacaccgtgagaagcatctgccaccacagccacaagagactggtggcctgcttccagggccagcacggcaccgacgccgagagaagacacaagaagctgcccctgaccgccctggcccagaacatgcaggaggccagcacccagctggaggacagcctgctgggcaagatgctggagacctgcggcgacgccgagaaccagctggccctggagctgagccagcacgaggtgttcgtggagaaggagatcgtggaccccctgtacggcatcgccgaggtggagatccccaacatccagaagcagagaaagcagctggccagactggtgctggactgggacagcgtgagagccagatggaaccaggcccacaagagcagcggcaccaacttccagggcctgcccagcaagatcgacaccctgaaggaggagatggacgaggccggcaacaaggtggagcagtgcaaggaccagctggccgccgacatgtacaacttcatggccaaggagggcgagtacggcaagttcttcgtgaccatcagcggcagaaagaaccagcccctgggcctgccctag

SEQ ID NO: 97082 - DNA, 2523 bp, Artificial Sequence
  Description of Artificial Sequence: Synthetic coding sequence
atgaagaagcagttcaacagaatgaagcagctggccaaccagaccgtgggcagagccgagaagaccgaggtgctgagcgaggacctgctgcagatcgagagaagactggacaccgtgagaagcatctgccaccacagccacaagagactggtggcctgcttccagggccagcacggcaccgacgccgagagaagacacaagaagctgcccctgaccgccctggcccagaacatgcaggaggccagcacccagctggaggacagcctgctgggcaagatgctggagacctgcggcgacgccgagaaccagctggccctggagctgagccagcacgaggtgttcgtggagaaggagatcgtggaccccctgtacggcatcgccgaggtggagatccccaacatccagaagcagagaaagcagctggccagactggtgctggactgggacagcgtgagagccagatggaaccaggcccacaagagcagcggcaccaacttccagggcctgcccagcaagatcgacaccctgaaggaggagatggacgaggccggcaacaaggtggagcagtgcaaggaccagctggccgccgacatgtacaacttcatggccaaggagggcgagtacggcaagttcttcgtgaccctgctggaggcccaggccgactaccacagaaaggccctggccgtgctggagaagaccctgcccgagatgagagcccaccaggacaagtgggccgagaagcccgccttcggcacccccctggaggagcacctgaagagaagcggcagagagatcgccctgcccatcgaggcctgcgtgatgctgctgctggagaccggcatgaaggaggagggcctgttcagaatcggcgccggcgccagcaagctgaagaagctgaaggccgccctggactgcagcaccagccacctggacgagttctacagcgacccccacgccgtggccggcgccctgaagagctacctgagagagctgcccgagcccctgatgaccttcaacctgtacgaggagtggacccaggtggccagcgtgcaggaccaggacaagaagctgcaggacctgtggagaacctgccagaagctgcccccccagaacttcgtgaacttcagatacctgatcaagttcctggccaagctggcccagaccagcgacgtgaacaagatgacccccagcaacatcgccatcgtgctgggccccaacctgctgtgggccagaaacgagggcaccctggccgagatggccgccgccaccagcgtgcacgtggtggccgtgatcgagcccatcatccagcacgccgactggttcttccccgaggaggtggagttcaacgtgagcgaggccttcgtgcccctgaccacccccagcagcaaccacagcttccacaccggcaacgacagcgacagcggcaccctggagagaaagagacccgccagcatggccgtgatggagggcgacctggtgaagaaggagagcttcggcgtgaagctgatggacttccaggcccacagaagaggcggcaccctgaacagaaagcacatcagccccgccttccagccccccctgccccccaccgacggcagcaccgtggtgcccgccggccccgagccccccccccagagcagcagagccgagagcagcagcggcggcggcaccgtgcccagcagcgccggcatcctggagcagggccccagccccggcgacggcagcccccccaagcccaaggaccccgtgagcgccgccgtgcccgcccccggcagaaacaacagccagatcgccagcggccagaaccagccccaggccgccgccggcagccaccagctgagcatgggccagccccacaacgccgccggccccagcccccacaccctgagaagagccgtgaagaagcccgcccccgccccccccaagcccggcaaccccccccccggccaccccggcggccagagcagcagcggcaccagccagcacccccccagcctgagccccaagccccccaccagaagccccagcccccccacccagcacaccggccagccccccggccagcccagcgcccccagccagctgagcgcccccagaagatacagcagcagcctgagccccatccaggcccccaaccacccccccccccagccccccacccaggccacccccctgatgcacaccaagcccaacagccagggcccccccaaccccatggccctgcccagcgagcacggcctggagcagcccagccacacccccccccagacccccaccccccccagcaccccccccctgggcaagcagaaccccagcctgcccgccccccagaccctggccggcggcaaccccgagaccgcccagccccacgccggcaccctgcccagacccagacccgtgcccaagcccagaaacagacccagcgtgcccccccccccccagccccccggcgtgcacagcgccggcgacagcagcctgaccaacaccgcccccaccgccagcaagatcgtgaccggcgtgtag

SEQ ID NO: 97083 - DNA, 1992 bp, Artificial Sequence
  Description of Artificial Sequence: Synthetic coding sequence
atgagctggctgagcagcagccagggcgtggtgctgaccgcctaccaccccagcggcaaggaccagaccgtgggcaacagccacgccaaggccggcgaggaggccaccagcagcagaagatacggccagtacaccatgaaccaggagagcaccaccatcaaggtgatggagaagccccccttcgacagaagcatcagccaggacagcctggacgagctgagcatggaggactactggatcgagctggagaacatcaagaagagcagcgagaacagccaggaggaccaggaggtggtggtggtgaaggagcccgacgagggcgagctggaggaggagtggctgaaggaggccggcctgagcaacctgttcggcgagagcgccggcgacccccaggagagcatcgtgttcctgagcaccctgaccagaacccaggccgccgccgtgcagaagagagtggagaccgtgagccagaccctgagaaagaagaacaagcagtaccagatccccgacgtgagagacatcttcgcccagcagagagagagcaaggagaccgcccccggcggcaccgagagccagagcctgagaaccaacgagaacaagtaccagggcagagacgacgaggccagcaacctggtgggcgaggagaagctgatcccccccgaggagacccccgcccccgagaccgacatcaacctggaggtgagcttcgccgagcaggccctgaaccagaaggagagcagcaaggagaagatccagaagagcaagggcgacgacgccaccctgcccagcttcagactgcccaaggacaagaccggcaccaccagaatcggcgacctggccccccaggacatgaagaaggtgtgccacctggccctgatcgagctgaccgccctgtacgacgtgctgggcatcgagctgaagcagcagaaggccgtgaagatcaagaccaaggacagcggcctgttctgcgtgcccctgaccgccctgctggagcaggaccagagaaaggtgcccggcatgagaatccccctgatcttccagaagctgatcagcagaatcgaggagagaggcctggagaccgagggcctgctgagaatccccggcgccgccatcagaatcaagaacctgtgccaggagctggaggccaagttctacgagggcaccttcaactgggagagcgtgaagcagcacgacgccgccagcctgctgaagctgttcatcagagagctgccccagcccctgctgagcgtggagtacctgaaggccttccaggccgtgcagaacctgcccaccaagaagcagcagctgcaggccctgaacctgctggtgatcctgctgcccgacgccaacagagacaccctgaaggccctgctggagttcctgcagagagtgatcgacaacaaggagaagaacaagatgaccgtgatgaacgtggccatggtgatggcccccaacctgttcatgtgccacgccctgggcctgaagagcagcgagcagagagagttcgtgatggccgccggcaccgccaacaccatgcacctgctgatcaagtaccagaagctgctgtggaccatccccaagttcatcgtgaaccaggtgagaaagcagaacaccgagaaccacaagaaggacaagagagccatgaagaagctgctgaagaagatggcctacgacagagagaagtacgagaagcaggacaagagcaccaacgacgccgacgtgccccagggcgtgatcagagtgcaggccccccacctgagcaaggtgagcatggccatccagctgaccgaggagctgaaggccagcgacgtgctggccagattcctgagccaggagagcggcgtggcccagaccctgaagaagggcgaggtgttcctgtacgagatcggcggcaacatcggcgagagatgcctggacgacgacacctacatgaaggacctgtaccagctgaaccccaacgccgagtgggtgatcaagagcaagcccctgtag

SEQ ID NO: 97084 - DNA, 1857 bp, Artificial Sequence
  Description of Artificial Sequence: Synthetic coding sequence
atgaaccaggagagcaccaccatcaaggtgatggagaagccccccttcgacagaagcatcagccaggacagcctggacgagctgagcatggaggactactggatcgagctggagaacatcaagaagagcagcgagaacagccaggaggaccaggaggtggtggtggtgaaggagcccgacgagggcgagctggaggaggagtggctgaaggaggccggcctgagcaacctgttcggcgagagcgccggcgacccccaggagagcatcgtgttcctgagcaccctgaccagaacccaggccgccgccgtgcagaagagagtggagaccgtgagccagaccctgagaaagaagaacaagcagtaccagatccccgacgtgagagacatcttcgcccagcagagagagagcaaggagaccgcccccggcggcaccgagagccagagcctgagaaccaacgagaacaagtaccagggcagagacgacgaggccagcaacctggtgggcgaggagaagctgatcccccccgaggagacccccgcccccgagaccgacatcaacctggaggtgagcttcgccgagcaggccctgaaccagaaggagagcagcaaggagaagatccagaagagcaagggcgacgacgccaccctgcccagcttcagactgcccaaggacaagaccggcaccaccagaatcggcgacctggccccccaggacatgaagaaggtgtgccacctggccctgatcgagctgaccgccctgtacgacgtgctgggcatcgagctgaagcagcagaaggccgtgaagatcaagaccaaggacagcggcctgttctgcgtgcccctgaccgccctgctggagcaggaccagagaaaggtgcccggcatgagaatccccctgatcttccagaagctgatcagcagaatcgaggagagaggcctggagaccgagggcctgctgagaatccccggcgccgccatcagaatcaagaacctgtgccaggagctggaggccaagttctacgagggcaccttcaactgggagagcgtgaagcagcacgacgccgccagcctgctgaagctgttcatcagagagctgccccagcccctgctgagcgtggagtacctgaaggccttccaggccgtgcagaacctgcccaccaagaagcagcagctgcaggccctgaacctgctggtgatcctgctgcccgacgccaacagagacaccctgaaggccctgctggagttcctgcagagagtgatcgacaacaaggagaagaacaagatgaccgtgatgaacgtggccatggtgatggcccccaacctgttcatgtgccacgccctgggcctgaagagcagcgagcagagagagttcgtgatggccgccggcaccgccaacaccatgcacctgctgatcaagtaccagaagctgctgtggaccatccccaagttcatcgtgaaccaggtgagaaagcagaacaccgagaaccacaagaaggacaagagagccatgaagaagctgctgaagaagatggcctacgacagagagaagtacgagaagcaggacaagagcaccaacgacgccgacgtgccccagggcgtgatcagagtgcaggccccccacctgagcaaggtgagcatggccatccagctgaccgaggagctgaaggccagcgacgtgctggccagattcctgagccaggagagcggcgtggcccagaccctgaagaagggcgaggtgttcctgtacgagatcggcggcaacatcggcgagagatgcctggacgacgacacctacatgaaggacctgtaccagctgaaccccaacgccgagtgggtgatcaagagcaagcccctgtag

SEQ ID NO: 97085 - DNA, 1485 bp, Artificial Sequence
  Description of Artificial Sequence: Synthetic coding sequence
atggccaccgaggcccagagcgagggcgaggtgcccgccagagagagcggcagaagcgacgccatctgcagcttcgtgatctgcaacgacagcagcctgagaggccagcccatcatcttcaaccccgacttcttcgtggagaagctgagacacgagaagcccgagatcttcaccgagctggtggtgagcaacatcaccagactgatcgacctgcccggcaccgagctggcccagctgatgggcgaggtggacctgaagctgcccggcggcgccggccccgccagcggcttcttcagaagcctgatgagcctgaagagaaaggagaagggcgtgatcttcggcagccccctgaccgaggagggcatcgcccagatctaccagctgatcgagtacctgcacaagaacctgagagtggagggcctgttcagagtgcccggcaacagcgtgagacagcagatcctgagagacgccctgaacaacggcaccgacatcgacctggagagcggcgagttccacagcaacgacgtggccaccctgctgaagatgttcctgggcgagctgcccgagcccctgctgacccacaagcacttcaacgcccacctgaagatcgccgacctgatgcagttcgacgacaagggcaacaagaccaacatccccgacaaggacagacagatcgaggccctgcagctgctgttcctgatcctgcccccccccaacagaaacctgctgaagctgctgctggacctgctgtaccagaccgccaagaagcaggacaagaacaagatgagcgcctacaacctggccctgatgttcgccccccacgtgctgtggcccaagaacgtgaccgccaacgacctgcaggagaacatcaccaagctgaacagcggcatggccttcatgatcaagcacagccagaagctgttcaaggcccccgcctacatcagagagtgcgccagactgcactacctgggcagcagaacccaggccagcaaggacgacctggacctgatcgccagctgccacaccaagagcttccagctggccaagagccagaagagaaacagagtggacagctgcccccaccaggaggagacccagcaccacaccgaggaggccctgagagagctgttccagcacgtgcacgacatgcccgagagcgccaagaagaagcagctgatcagacagttcaacaagcagagcctgacccagacccccggcagagagcccagcaccagccaggtgcagaagagagccagaagcagaagcttcagcggcctgatcaagagaaaggtgctgggcaaccagatgatgagcgagaagaagaagaagaaccccacccccgagagcgtggccatcggcgagctgaagggcaccagcaaggagaacagaaacctgctgttcagcggcagccccgccgtgaccatgacccccaccagactgaagtggagcgagggcaagaaggagggcaagaaggtgttcctgtag

SEQ ID NO: 97086 - DNA, 1458 bp, Artificial Sequence
  Description of Artificial Sequence: Synthetic coding sequence
atgccccaccagaagctgagcgccctgatcgacgccatctgcagcttcgtgatctgcaacgacagcagcctgagaggccagcccatcatcttcaaccccgacttcttcgtggagaagctgagacacgagaagcccgagatcttcaccgagctggtggtgagcaacatcaccagactgatcgacctgcccggcaccgagctggcccagctgatgggcgaggtggacctgaagctgcccggcggcgccggccccgccagcggcttcttcagaagcctgatgagcctgaagagaaaggagaagggcgtgatcttcggcagccccctgaccgaggagggcatcgcccagatctaccagctgatcgagtacctgcacaagaacctgagagtggagggcctgttcagagtgcccggcaacagcgtgagacagcagatcctgagagacgccctgaacaacggcaccgacatcgacctggagagcggcgagttccacagcaacgacgtggccaccctgctgaagatgttcctgggcgagctgcccgagcccctgctgacccacaagcacttcaacgcccacctgaagatcgccgacctgatgcagttcgacgacaagggcaacaagaccaacatccccgacaaggacagacagatcgaggccctgcagctgctgttcctgatcctgcccccccccaacagaaacctgctgaagctgctgctggacctgctgtaccagaccgccaagaagcaggacaagaacaagatgagcgcctacaacctggccctgatgttcgccccccacgtgctgtggcccaagaacgtgaccgccaacgacctgcaggagaacatcaccaagctgaacagcggcatggccttcatgatcaagcacagccagaagctgttcaaggcccccgcctacatcagagagtgcgccagactgcactacctgggcagcagaacccaggccagcaaggacgacctggacctgatcgccagctgccacaccaagagcttccagctggccaagagccagaagagaaacagagtggacagctgcccccaccaggaggagacccagcaccacaccgaggaggccctgagagagctgttccagcacgtgcacgacatgcccgagagcgccaagaagaagcagctgatcagacagttcaacaagcagagcctgacccagacccccggcagagagcccagcaccagccaggtgcagaagagagccagaagcagaagcttcagcggcctgatcaagagaaaggtgctgggcaaccagatgatgagcgagaagaagaagaagaaccccacccccgagagcgtggccatcggcgagctgaagggcaccagcaaggagaacagaaacctgctgttcagcggcagccccgccgtgaccatgacccccaccagactgaagtggagcgagggcaagaaggagggcaagaaggtgttcctgtag

SEQ ID NO: 97087 - DNA, 1398 bp, Artificial Sequence
  Description of Artificial Sequence: Synthetic coding sequence
atggccaccgaggcccagagcgagggcgaggtgcccgccagagagagcggcagaagcgacgccatctgcagcttcgtgatctgcaacgacagcagcctgagaggccagcccatcatcttcaaccccgacttcttcgtggagaagctgagacacgagaagcccgagatcttcaccgagctggtggtgagcaacatcaccagactgatcgacctgcccggcaccgagctggcccagctgatgggcgaggtggacctgaagctgcccggcggcgccggccccgccagcggcttcttcagaagcctgatgagcctgaagagaaaggagaagggcgtgatcttcggcagccccctgaccgaggagggcatcgcccagatctaccagctgatcgagtacctgcacaagaacctgagagtggagggcctgttcagagtgcccggcaacagcgtgagacagcagatcctgagagacgccctgaacaacggcaccgacatcgacctggagagcggcgagttccacagcaacgacgtggccaccctgctgaagatgttcctgggcgagctgcccgagcccctgctgacccacaagcacttcaacgcccacctgaagatcgccgacctgatgcagttcgacgacaagggcaacaagaccaacatccccgacaaggacagacagatcgaggccctgcagctgctgttcctgatcctgcccccccccaacagaaacctgctgaagctgctgctggacctgctgtaccagaccgccaagaagcaggacaagaacaagatgagcgcctacaacctggccctgatgttcgccccccacgtgctgtggcccaagaacgcccccgcctacatcagagagtgcgccagactgcactacctgggcagcagaacccaggccagcaaggacgacctggacctgatcgccagctgccacaccaagagcttccagctggccaagagccagaagagaaacagagtggacagctgcccccaccaggaggagacccagcaccacaccgaggaggccctgagagagctgttccagcacgtgcacgacatgcccgagagcgccaagaagaagcagctgatcagacagttcaacaagcagagcctgacccagacccccggcagagagcccagcaccagccaggtgcagaagagagccagaagcagaagcttcagcggcctgatcaagagaaaggtgctgggcaaccagatgatgagcgagaagaagaagaagaaccccacccccgagagcgtggccatcggcgagctgaagggcaccagcaaggagaacagaaacctgctgttcagcggcagccccgccgtgaccatgacccccaccagactgaagtggagcgagggcaagaaggagggcaagaaggccttcgtgtag

SEQ ID NO: 97088 - DNA, 1485 bp, Artificial Sequence
  Description of Artificial Sequence: Synthetic coding sequence
atggccaccgaggcccagagcgagggcgaggtgcccgccagagagagcggcagaagcgacgccatctgcagcttcgtgatctgcaacgacagcagcctgagaggccagcccatcatcttcaaccccgacttcttcgtggagaagctgagacacgagaagcccgagatcttcaccgagctggtggtgagcaacatcaccagactgatcgacctgcccggcaccgagctggcccagctgatgggcgaggtggacctgaagctgcccggcggcgccggccccgccagcggcttcttcagaagcctgatgagcctgaagagaaaggagaagggcgtgatcttcggcagccccctgaccgaggagggcatcgcccagatctaccagctgatcgagtacctgcacaagaacctgagagtggagggcctgttcagagtgcccggcaacagcgtgagacagcagatcctgagagacgccctgaacaacggcaccgacatcgacctggagagcggcgagttccacagcaacgacgtggccaccctgctgaagatgttcctgggcgagctgcccgagcccctgctgacccacaagcacttcaacgcccacctgaagatcgccgacctgatgcagttcgacgacaagggcaacaagaccaacatccccgacaaggacagacagatcgaggccctgcagctgctgttcctgatcctgcccccccccaacagaaacctgctgaagctgctgctggacctgctgtaccagaccgccaagaagcaggacaagaacaagatgagcgcctacaacctggccctgatgttcgccccccacgtgctgtggcccaagaacgtgaccgccaacgacctgcaggagaacatcaccaagctgaacagcggcatggccttcatgatcaagcacagccagaagctgttcaaggcccccgcctacatcagagagtgcgccagactgcactacctgggcagcagaacccaggccagcaaggacgacctggacctgatcgccagctgccacaccaagagcttccagctggccaagagccagaagagaaacagagtggacagctgcccccaccaggaggagacccagcaccacaccgaggaggccctgagagagctgttccagcacgtgcacgacatgcccgagagcgccaagaagaagcagctgatcagacagttcaacaagcagagcctgacccagacccccggcagagagcccagcaccagccaggtgcagaagagagccagaagcagaagcttcagcggcctgatcaagagaaaggtgctgggcaaccagatgatgagcgagaagaagaagaagaaccccacccccgagagcgtggccatcggcgagctgaagggcaccagcaaggagaacagaaacctgctgttcagcggcagccccgccgtgaccatgacccccaccagactgaagtggagcgagggcaagaaggagggcaagaagggcttcctgtag

SEQ ID NO: 97089 - DNA, 1458 bp, Artificial Sequence
  Description of Artificial Sequence: Synthetic coding sequence
atgccccaccagaagctgagcgccctgatcgacgccatctgcagcttcgtgatctgcaacgacagcagcctgagaggccagcccatcatcttcaaccccgacttcttcgtggagaagctgagacacgagaagcccgagatcttcaccgagctggtggtgagcaacatcaccagactgatcgacctgcccggcaccgagctggcccagctgatgggcgaggtggacctgaagctgcccggcggcgccggccccgccagcggcttcttcagaagcctgatgagcctgaagagaaaggagaagggcgtgatcttcggcagccccctgaccgaggagggcatcgcccagatctaccagctgatcgagtacctgcacaagaacctgagagtggagggcctgttcagagtgcccggcaacagcgtgagacagcagatcctgagagacgccctgaacaacggcaccgacatcgacctggagagcggcgagttccacagcaacgacgtggccaccctgctgaagatgttcctgggcgagctgcccgagcccctgctgacccacaagcacttcaacgcccacctgaagatcgccgacctgatgcagttcgacgacaagggcaacaagaccaacatccccgacaaggacagacagatcgaggccctgcagctgctgttcctgatcctgcccccccccaacagaaacctgctgaagctgctgctggacctgctgtaccagaccgccaagaagcaggacaagaacaagatgagcgcctacaacctggccctgatgttcgccccccacgtgctgtggcccaagaacgtgaccgccaacgacctgcaggagaacatcaccaagctgaacagcggcatggccttcatgatcaagcacagccagaagctgttcaaggcccccgcctacatcagagagtgcgccagactgcactacctgggcagcagaacccaggccagcaaggacgacctggacctgatcgccagctgccacaccaagagcttccagctggccaagagccagaagagaaacagagtggacagctgcccccaccaggaggagacccagcaccacaccgaggaggccctgagagagctgttccagcacgtgcacgacatgcccgagagcgccaagaagaagcagctgatcagacagttcaacaagcagagcctgacccagacccccggcagagagcccagcaccagccaggtgcagaagagagccagaagcagaagcttcagcggcctgatcaagagaaaggtgctgggcaaccagatgatgagcgagaagaagaagaagaaccccacccccgagagcgtggccatcggcgagctgaagggcaccagcaaggagaacagaaacctgctgttcagcggcagccccgccgtgaccatgacccccaccagactgaagtggagcgagggcaagaaggagggcaagaagggcttcctgtag

SEQ ID NO: 97090 - DNA, 942 bp, Artificial Sequence
  Description of Artificial Sequence: Synthetic coding sequence
atgttcctgggcgagctgcccgagcccctgctgacccacaagcacttcaacgcccacctgaagatcgccgacctgatgcagttcgacgacaagggcaacaagaccaacatccccgacaaggacagacagatcgaggccctgcagctgctgttcctgatcctgcccccccccaacagaaacctgctgaagctgctgctggacctgctgtaccagaccgccaagaagcaggacaagaacaagatgagcgcctacaacctggccctgatgttcgccccccacgtgctgtggcccaagaacgtgaccgccaacgacctgcaggagaacatcaccaagctgaacagcggcatggccttcatgatcaagcacagccagaagctgttcaaggcccccgcctacatcagagagtgcgccagactgcactacctgggcagcagaacccaggccagcaaggacgacctggacctgatcgccagctgccacaccaagagcttccagctggccaagagccagaagagaaacagagtggacagctgcccccaccaggaggagacccagcaccacaccgaggaggccctgagagagctgttccagcacgtgcacgacatgcccgagagcgccaagaagaagcagctgatcagacagttcaacaagcagagcctgacccagacccccggcagagagcccagcaccagccaggtgcagaagagagccagaagcagaagcttcagcggcctgatcaagagaaaggtgctgggcaaccagatgatgagcgagaagaagaagaagaaccccacccccgagagcgtggccatcggcgagctgaagggcaccagcaaggagaacagaaacctgctgttcagcggcagccccgccgtgaccatgacccccaccagactgaagtggagcgagggcaagaaggagggcaagaagggcttcctgtag

SEQ ID NO: 97091 - DNA, 1554 bp, Artificial Sequence
  Description of Artificial Sequence: Synthetic coding sequence
atggccaccgaggcccagagcgagggcgaggtgcccgccagagagagcggcagaagcgacgccatctgcagcttcgtgatctgcaacgacagcagcctgagaggccagcccatcatcttcaaccccgacttcttcgtggagaagctgagacacgagaagcccgagatcttcaccgagctggtggtgagcaacatcaccagactgatcgacctgcccggcaccgagctggcccagctgatgggcgaggtggacctgaagctgcccggcggcgccggccccgccagcggcttcttcagaagcctgatgagcctgaagagaaaggagaagggcgtgatcttcggcagccccctgaccgaggagggcatcgcccagatctaccagctgatcgagtacctgcacaagaacctgagagtggagggcctgttcagagtgcccggcaacagcgtgagacagcagatcctgagagacgccctgaacaacggcaccgacatcgacctggagagcggcgagttccacagcaacgacgtggccaccctgctgaagatgttcctgggcgagctgcccgagcccctgctgacccacaagcacttcaacgcccacctgaagatcgccgacctgatgcagttcgacgacaagggcaacaagaccaacatccccgacaaggacagacagatcgaggccctgcagctgctgttcctgatcctgcccccccccaacagaaacctgctgaagctgctgctggacctgctgtaccagaccgccaagaagcaggacaagaacaagatgagcgcctacaacctggccctgatgttcgccccccacgtgctgtggcccaagaacgtgaccgccaacgacctgcaggagaacatcaccaagctgaacagcggcatggccttcatgatcaagcacagccagaagctgttcaaggcccccgcctacatcagagagtgcgccagactgcactacctgggcagcagaacccaggccagcaaggacgacctggacctgatcgccagctgccacaccaagagcttccagctggccaagagccagaagagaaacagagtggacagctgcccccaccaggaggagacccagcaccacaccgaggaggccctgagagagctgttccagcacgtgcacgacatgcccgagagcgccaagaagaagcagctgatcagacagttcaacaagcagagcctgacccagacccccggcagagagcccagcaccagccaggtgcagaagagagccagaagcagaagcttcagcggcctgatcaagagaaaggtgctgggcaaccagatgatgagcgagaagaagaagaagaaccccacccccgagagcgtggccatcggcgagctgaagggcaccagcaaggagaacagaaacctgctgttcagcggcagccccgccgtgaccatgacccccaccagactgaagtggagcgagggcaagaaggagggcaagaagggcaacagcatggccaccaccagcctgggcagcatcagaatgaccctgagaggcagcagcagctgcggctgctgcagctag

SEQ ID NO: 97092 - DNA, 3654 bp, Artificial Sequence
  Description of Artificial Sequence: Synthetic coding sequence
atggcccagcccgtggagatcagcccccccgacagcagcctgagcaagcagcagaccagcacccccgtgctgacccagcccggcagagcctacagaatggagatccaggtgccccccagccccaccgacgtggccaagagcaacaccgccgtgtgcgtgtgcaacgagagcgtgagaaccgtgatcgtgcccagcgagaaggtggtggacctgctgagcaacagaaacaaccacaccggccccagccacagaaccgaggaggtgagatacggcgtgagcgagcagaccagcctgaagaccgtgagcagaaccaccagcccccccctgagcatccccaccacccacctgatccaccagcccgccggcagcagaagcctggagcccagcggcatcctgctgaagagcggcaactacagcggccacagcgacggcatcagcagcagcagaagccaggccgtggaggcccccagcgtgagcgtgaaccactacagccccaacagccaccagcacatcgactggaagaactacaagacctacaaggagtacatcgacaacagaagactgcacatcggctgcagaaccatccaggagagactggacagcctgagagccgccagccagagcaccaccgactacaaccaggtggtgcccaacagaaccaccctgcagggcagaagaagaagcaccagccacgacagagtgccccagagcgtgcagatcagacagagaagcgtgagccaggagagactggaggacagcgtgctgatgaagtactgccccagaagcgccagccagggcgccctgaccagccccagcgtgagcttcagcaaccacagaaccagaagctgggactacatcgagggccaggacgagaccctggagaacgtgaacagcggcacccccatccccgacagcaacggcgagaagaagcagacctacaagtggagcggcttcaccgagcaggacgacagaagaggcatctgcgagagacccagacagcaggagatccacaagagcttcagaggcagcaacttcaccgtggcccccagcgtggtgaacagcgacaacagaagaatgagcggcagaggcgtgggcagcgtgagccagttcaagaagatcccccccgacctgaagaccctgcagagcaacagaaacttccagaccacctgcggcatgagcctgcccagaggcatcagccaggacagaagccccctggtgaaggtgagaagcaacagcctgaaggcccccagcacccacgtgaccaagcccagcttcagccagaagagcttcgtgagcatcaaggaccagagacccgtgaaccacctgcaccagaacagcctgctgaaccagcagacctgggtgagaaccgacagcgcccccgaccagcaggtggagaccggcaagagccccagcctgagcggcgccagcgccaagcccgccccccagagcagcgagaacgccggcaccagcgacctggagctgcccgtgagccagagaaaccaggacctgagcctgcaggaggccgagaccgagcagagcgacaccctggacaacaaggaggccgtgatcctgagagagaagccccccagcggcagacagaccccccagcccctgagacaccagagctacatcctggccgtgaacgaccaggagaccggcagcgacaccacctgctggctgcccaacgacgccagaagagaggtgcacatcaagagaatggaggagagaaaggccagcagcaccagcccccccggcgacagcctggccagcatccccttcatcgacgagcccaccagccccagcatcgaccacgacatcgcccacatccccgccagcgccgtgatcagcgccagcaccagccaggtgcccagcatcgccaccgtgcccccctgcctgaccaccagcgcccccctgatcagaagacagctgagccacgaccacgagagcgtgggcccccccagcctggacgcccagcccaacagcaagaccgagagaagcaagagctacgacgagggcctggacgactacagagaggacgccaagctgagcttcaagcacgtgagcagcctgaagggcatcaagatcgccgacagccagaagagcagcgaggacagcggcagcagaaaggacagcagcagcgaggtgttcagcgacgccgccaaggagggctggctgcacttcagacccctggtgaccgacaagggcaagagagtgggcggcagcatcagaccctggaagcagatgtacgtggtgctgagaggccacagcctgtacctgtacaaggacaagagagagcagaccacccccagcgaggaggagcagcccatcagcgtgaacgcctgcctgatcgacatcagctacagcgagaccaagagaaagaacgtgttcagactgaccaccagcgactgcgagtgcctgttccaggccgaggacagagacgacatgctggcctggatcaagaccatccaggagagcagcaacctgaacgaggaggacaccggcgtgaccaacagagacctgatcagcagaagaatcaaggagtacaacaacctgatgagcaaggccgagcagctgcccaagacccccagacagagcctgagcatcagacagaccctgctgggcgccaagagcgagcccaagacccagagcccccacagccccaaggaggagagcgagagaaagctgctgagcaaggacgacaccagcccccccaaggacaagggcacctggagaaagggcatccccagcatcatgagaaagaccttcgagaagaagcccaccgccaccggcaccttcggcgtgagactggacgactgcccccccgcccacaccaacagatacatccccctgatcgtggacatctgctgcaagctggtggaggagagaggcctggagtacaccggcatctacagagtgcccggcaacaacgccgccatcagcagcatgcaggaggagctgaacaagggcatggccgacatcgacatccaggacgacaagtggagagacctgaacgtgatcagcagcctgctgaagagcttcttcagaaagctgcccgagcccctgttcaccaacgacaagtacgccgacttcatcgaggccaacagaaaggaggaccccctggacagactgaagaccctgaagagactgatccacgacctgcccgagcaccactacgagaccctgaagttcctgagcgcccacctgaagaccgtggccgagaacagcgagaagaacaagatggagcccagaaacctggccatcgtgttcggccccaccctggtgagaaccagcgaggacaacatgacccacatggtgacccacatgcccgaccagtacaagatcgtggagaccctgatccagcaccacgactggttcttcaccgaggagggcgccgaggagcccctgaccaccgtgcaggaggagagcaccgtggacagccagcccgtgcccaacatcgaccacctgctgaccaacatcggcagaaccggcgtgagccccggcgacgtgagcggcgaggtgggcggcgtgtaccacaccgtgatgagcctggtggacagcgtgatgagcctgatggacagctggaactgcagaaagaaggaggactgctgcccccactgcagctgcctggtgtgcagaaaccccagattcctgtag

SEQ ID NO: 97093 - DNA, 3498 bp, Artificial Sequence
  Description of Artificial Sequence: Synthetic coding sequence
atgatggccaccagaagaaccggcctgagcgagggcgacggcgacaagctgaaggcctgcgaggtgagcaagaacaaggacggcaaggagcagagcgagaccgtgagcctgagcgaggacgagaccttcagctggcccggccccaagaccgtgaccctgaagagaaccagccagggcttcggcttcaccctgagacacttcatcgtgtacccccccgagagcgccatccagttcagctacaaggacgaggagaacggcaacagaggcggcaagcagagaaacagactggagcccatggacaccatcttcgtgaagcaggtgaaggagggcggccccgccttcgaggccggcctgtgcaccggcgacagaatcatcaaggtgaacggcgagagcgtgatcggcaagacctacagccaggtgatcgccctgatccagaacagcgacaccaccctggagctgagcgtgatgcccaaggacgaggacatcctgcaggtggcctacagccaggacgcctacctgaagggcaacgaggcctacagcggcaacgccagaaacatccccgagcccccccccatctgctacccctggctgcccagcgcccccagcgccatggcccagcccgtggagatcagcccccccgacagcagcctgagcaagcagcagaccagcacccccgtgctgacccagcccggcagagcctacagaatggagatccaggtgccccccagccccaccgacgtggccaagagcaacaccgccgtgtgcgtgtgcaacgagagcgtgagaaccgtgatcgtgcccagcgagaaggtggtggacctgctgagcaacagaaacaaccacaccggccccagccacagaaccgaggaggtgagatacggcgtgagcgagcagaccagcctgaagaccgtgagcagaaccaccagcccccccctgagcatccccaccacccacctgatccaccagcccgccggcagcagaagcctggagcccagcggcatcctgctgaagagcggcaactacagcggccacagcgacggcatcagcagcagcagaagccaggccgtggaggcccccagcgtgagcgtgaaccactacagccccaacagccaccagcacatcgactggaagaactacaagacctacaaggagtacatcgacaacagaagactgcacatcggctgcagaaccatccaggagagactggacagcctgagagccgccagccagagcaccaccgactacaaccaggtggtgcccaacagaaccaccctgcagggcagaagaagaagcaccagccacgacagagtgccccagagcgtgcagatcagacagagaagcgtgagccaggagagactggaggacagcgtgctgatgaagtactgccccagaagcgccagccagggcgccctgaccagccccagcgtgagcttcagcaaccacagaaccagaagctgggactacatcgagggccaggacgagaccctggagaacgtgaacagcggcacccccatccccgacagcaacggcgagaagaagcagacctacaagtggagcggcttcaccgagcaggacgacagaagaggcatctgcgagagacccagacagcaggagatccacaagagcttcagaggcagcaacttcaccgtggcccccagcgtggtgaacagcgacaacagaagaatgagcggcagaggcgtgggcagcgtgagccagttcaagaagatcccccccgacctgaagaccctgcagagcaacagaaacttccagaccacctgcggcatgagcctgcccagaggcatcagccaggacagaagccccctggtgaaggtgagaagcaacagcctgaaggcccccagcacccacgtgaccaagcccagcttcagccagaagagcttcgtgagcatcaaggaccagagacccgtgaaccacctgcaccagaacagcctgctgaaccagcagacctgggtgagaaccgacagcgcccccgaccagcaggtggagaccggcaagagccccagcctgagcggcgccagcgccaagcccgccccccagagcagcgagaacgccggcaccagcgacctggagctgcccgtgagccagagaaaccaggacctgagcctgcaggaggccgagaccgagcagagcgacaccctggacaacaaggaggccgtgatcctgagagagaagccccccagcggcagacagaccccccagcccctgagacaccagagctacatcctggccgtgaacgaccaggagaccggcagcgacaccacctgctggctgcccaacgacgccagaagagaggtgcacatcaagagaatggaggagagaaaggccagcagcaccagcccccccggcgacagcctggccagcatccccttcatcgacgagcccaccagccccagcatcgaccacgacatcgcccacatccccgccagcgccgtgatcagcgccagcaccagccaggtgcccagcatcgccaccgtgcccccctgcctgaccaccagcgcccccctgatcagaagacagctgagccacgaccacgagagcgtgggcccccccagcctggacgcccagcccaacagcaagaccgagagaagcaagagctacgacgagggcctggacgactacagagaggacgccaagctgagcttcaagcacgtgagcagcctgaagggcatcaagatcgccgacagccagaagagcagcgaggacagcggcagcagaaaggacagcagcagcgaggtgttcagcgacgccgccaaggagggctggctgcacttcagacccctggtgaccgacaagggcaagagagtgggcggcagcatcagaccctggaagcagatgtacgtggtgctgagaggccacagcctgtacctgtacaaggacaagagagagcagaccacccccagcgaggaggagcagcccatcagcgtgaacgcctgcctgatcgacatcagctacagcgagaccaagagaaagaacgtgttcagactgaccaccagcgactgcgagtgcctgttccaggccgaggacagagacgacatgctggcctggatcaagaccatccaggagagcagcaacctgaacgaggaggacaccggcgtgaccaacagagacctgatcagcagaagaatcaaggagtacaacaacctgatgagcaaggccgagcagctgcccaagacccccagacagagcctgagcatcagacagaccctgctgggcgccaagagcgagcccaagacccagagcccccacagccccaaggaggagagcgagagaaagctgctgagcaaggacgacaccagcccccccaaggacaagggcacctggagaaagggcatccccagcatcatgagaaagaccttcgagaagaagcccaccgccaccggcaccttcggcgtgagactggacgactgcccccccgcccacaccaacagagtgggcgacaccagcccccccgacttcctgaagagcctgatccagttctag

SEQ ID NO: 97094 - DNA, 5877 bp, Artificial Sequence
  Description of Artificial Sequence: Synthetic coding sequence
atgatggccaccagaagaaccggcctgagcgagggcgacggcgacaagctgaaggcctgcgaggtgagcaagaacaaggacggcaaggagcagagcgagaccgtgagcctgagcgaggacgagaccttcagctggcccggccccaagaccgtgaccctgaagagaaccagccagggcttcggcttcaccctgagacacttcatcgtgtacccccccgagagcgccatccagttcagctacaaggacgaggagaacggcaacagaggcggcaagcagagaaacagactggagcccatggacaccatcttcgtgaagcaggtgaaggagggcggccccgccttcgaggccggcctgtgcaccggcgacagaatcatcaaggtgaacggcgagagcgtgatcggcaagacctacagccaggtgatcgccctgatccagaacagcgacaccaccctggagctgagcgtgatgcccaaggacgaggacatcctgcaggtgctgcagttcaccaaggacgtgaccgccctggcctacagccaggacgcctacctgaagggcaacgaggcctacagcggcaacgccagaaacatccccgagcccccccccatctgctacccctggctgcccagcgcccccagcgccatggcccagcccgtggagatcagcccccccgacagcagcctgagcaagcagcagaccagcacccccgtgctgacccagcccggcagagcctacagaatggagatccaggtgccccccagccccaccgacgtggccaagagcaacaccgccgtgtgcgtgtgcaacgagagcgtgagaaccgtgatcgtgcccagcgagaaggtggtggacctgctgagcaacagaaacaaccacaccggccccagccacagaaccgaggaggtgagatacggcgtgagcgagcagaccagcctgaagaccgtgagcagaaccaccagcccccccctgagcatccccaccacccacctgatccaccagcccgccggcagcagaagcctggagcccagcggcatcctgctgaagagcggcaactacagcggccacagcgacggcatcagcagcagcagaagccaggccgtggaggcccccagcgtgagcgtgaaccactacagccccaacagccaccagcacatcgactggaagaactacaagacctacaaggagtacatcgacaacagaagactgcacatcggctgcagaaccatccaggagagactggacagcctgagagccgccagccagagcaccaccgactacaaccaggtggtgcccaacagaaccaccctgcagggcagaagaagaagcaccagccacgacagagtgccccagagcgtgcagatcagacagagaagcgtgagccaggagagactggaggacagcgtgctgatgaagtactgccccagaagcgccagccagggcgccctgaccagccccagcgtgagcttcagcaaccacagaaccagaagctgggactacatcgagggccaggacgagaccctggagaacgtgaacagcggcacccccatccccgacagcaacggcgagaagaagcagacctacaagtggagcggcttcaccgagcaggacgacagaagaggcatctgcgagagacccagacagcaggagatccacaagagcttcagaggcagcaacttcaccgtggcccccagcgtggtgaacagcgacaacagaagaatgagcggcagaggcgtgggcagcgtgagccagttcaagaagatcccccccgacctgaagaccctgcagagcaacagaaacttccagaccacctgcggcatgagcctgcccagaggcatcagccaggacagaagccccctggtgaaggtgagaagcaacagcctgaaggcccccagcacccacgtgaccaagcccagcttcagccagaagagcttcgtgagcatcaaggaccagagacccgtgaaccacctgcaccagaacagcctgctgaaccagcagacctgggtgagaaccgacagcgcccccgaccagcaggtggagaccggcaagagccccagcctgagcggcgccagcgccaagcccgccccccagagcagcgagaacgccggcaccagcgacctggagctgcccgtgagccagagaaaccaggacctgagcctgcaggaggccgagaccgagcagagcgacaccctggacaacaaggaggccgtgatcctgagagagaagccccccagcggcagacagaccccccagcccctgagacaccagagctacatcctggccgtgaacgaccaggagaccggcagcgacaccacctgctggctgcccaacgacgccagaagagaggtgcacatcaagagaatggaggagagaaaggccagcagcaccagcccccccggcgacagcctggccagcatccccttcatcgacgagcccaccagccccagcatcgaccacgacatcgcccacatccccgccagcgccgtgatcagcgccagcaccagccaggtgcccagcatcgccaccgtgcccccctgcctgaccaccagcgcccccctgatcagaagacagctgagccacgaccacgagagcgtgggcccccccagcctggacgcccagcccaacagcaagaccgagagaagcaagagctacgacgagggcctggacgactacagagaggacgccaagctgagcttcaagcacgtgagcagcctgaagggcatcaagatcgccgacagccagaagagcagcgaggacagcggcagcagaaaggacagcagcagcgaggtgttcagcgacgccgccaaggagggctggctgcacttcagacccctggtgaccgacaagggcaagagagtgggcggcagcatcagaccctggaagcagatgtacgtggtgctgagaggccacagcctgtacctgtacaaggacaagagagagcagaccacccccagcgaggaggagcagcccatcagcgtgaacgcctgcctgatcgacatcagctacagcgagaccaagagaaagaacgtgttcagactgaccaccagcgactgcgagtgcctgttccaggccgaggacagagacgacatgctggcctggatcaagaccatccaggagagcagcaacctgaacgaggaggacaccggcgtgaccaacagagacctgatcagcagaagaatcaaggagtacaacaacctgatgagcaaggccgagcagctgcccaagacccccagacagagcctgagcatcagacagaccctgctgggcgccaagagcgagcccaagacccagagcccccacagccccaaggaggagagcgagagaaagctgctgagcaaggacgacaccagcccccccaaggacaagggcacctggagaaagggcatccccagcatcatgagaaagaccttcgagaagaagcccaccgccaccggcaccttcggcgtgagactggacgactgcccccccgcccacaccaacagatacatccccctgatcgtggacatctgctgcaagctggtggaggagagaggcctggagtacaccggcatctacagagtgcccggcaacaacgccgccatcagcagcatgcaggaggagctgaacaagggcatggccgacatcgacatccaggacgacaagtggagagacctgaacgtgatcagcagcctgctgaagagcttcttcagaaagctgcccgagcccctgttcaccaacgacaagtacgccgacttcatcgaggccaacagaaaggaggaccccctggacagactgaagaccctgaagagactgatccacgacctgcccgagcaccactacgagaccctgaagttcctgagcgcccacctgaagaccgtggccgagaacagcgagaagaacaagatggagcccagaaacctggccatcgtgttcggccccaccctggtgagaaccagcgaggacaacatgacccacatggtgacccacatgcccgaccagtacaagatcgtggagaccctgatccagcaccacgactggttcttcaccgaggagggcgccgaggagcccctgaccaccgtgcaggaggagagcaccgtggacagccagcccgtgcccaacatcgaccacctgctgaccaacatcggcagaaccggcgtgagccccggcgacgtgagcgacagcgccaccagcgacagcaccaagagcaagggcagctggggcagcggcaaggaccagtacagcagagagctgctggtgagcagcatcttcgccgccgccagcagaaagagaaagaagcccaaggagaaggcccagcccagcagcagcgaggacgagctggacaacgtgttcttcaagaaggagaacgtggagcagtgccacaacgacaccaaggaggagagcaagaaggagagcgagaccctgggcagaaagcagaagatcatcatcgccaaggagaacagcaccagaaaggaccccagcaccaccaaggacgagaagatcagcctgggcaaggagagcacccccagcgaggagcccagccccccccacaacagcaagcacaacaagagccccaccctgagctgcagattcgccatcctgaaggagagccccagaagcctgctggcccagaagagcagccacctggaggagaccggcagcgacagcggcaccctgctgagcaccagcagccaggccagcctggccagattcagcatgaagaagagcaccagccccgagaccaagcacagcgagttcctggccaacgtgagcaccatcaccagcgactacagcaccaccagcagcgccacctacctgaccagcctggacagcagcagactgagccccgaggtgcagagcgtggccgagagcaagggcgacgaggccgacgacgagagaagcgagctgatcagcgagggcagacccgtggagaccgacagcgagagcgagttccccgtgttccccaccgccctgaccagcgagagactgttcagaggcaagctgcaggaggtgaccaagagcagcagaagaaacagcgagggcagcgagctgagctgcaccgagggcagcctgaccagcagcctggacagcagaagacagctgttcagcagccacaagctgatcgagtgcgacaccctgagcagaaagaagagcgccagattcaagagcgacagcggcagcctgggcgacgccaagaacgagaaggaggcccccagcctgaccaaggtgttcgacgtgatgaagaagggcaagagcaccggcagcctgctgacccccaccagaggcgagagcgagaagcaggagcccacctggaagaccaagatcgccgacagactgaagctgagacccagagcccccgccgacgacatgttcggcgtgggcaaccacaaggtgaacgccgagaccgccaagagaaagagcatcagaagaagacacaccctgggcggccacagagacgccaccgagatcagcgtgctgaacttctggaaggtgcacgagcagagcggcgagagagagagcgagctgagcgccgtgaacagactgaagcccaagtgcagcgcccaggacctgagcatcagcgactggctggccagagagagactgagaaccagcaccagcgacctgagcagaggcgagatcggcgacccccagaccgagaaccccagcaccagagagatcgccaccaccgacacccccctgagcctgcactgcaacaccggcagcagcagcagcaccctggccagcaccaacagacccctgctgagcatccccccccagagccccgaccagatcaacggcgagagcttccagaacgtgagcaagaacgccagcagcgccgccaacgcccagccccacaagctgagcgagacccccggcagcaaggccgagttccacccctgcctgtag

SEQ ID NO: 97095 - DNA, 594 bp, Artificial Sequence
  Description of Artificial Sequence: Synthetic coding sequence
tgaaacaacgccgccatcagcagcatgcaggaggagctgaacaagggcatggccgacatcgacatccaggacgacaagtggagagacctgaacgtgatcagcagcctgctgaagagcttcttcagaaagctgcccgagcccctgttcaccaacgacaagtacgccgacttcatcgaggccaacagaaaggaggaccccctggacagactgaagaccctgaagagactgatccacgacctgcccgagcaccactacgagaccctgaagttcctgagcgcccacctgaagaccgtggccgagaacagcgagaagaacaagatggagcccagaaacctggccatcgtgttcggccccaccctggtgagaaccagcgaggacaacatgacccacatggtgacccacatgcccgaccagtacaagatcgtggagaccctgatccagcaccacgactggttcttcaccgaggagggcgccgaggagcccctgatccagctgctggtgacccagcagaacctgagagtgctgggcgacctggagagaatcagcatcgccggcaactgcctgtgcccccccagcctgcagctgctggtgtag

SEQ ID NO: 97096 - DNA, 342 bp, Artificial Sequence
  Description of Artificial Sequence: Synthetic coding sequence
tacatccccctgatcgtggacatctgctgcaagctggtggaggagagaggcctggagtacaccggcatctacagagtgcccggcaacaacgccgccatcagcagcatgcaggaggagctgaacaagggcatggccgacatcgacatccaggacgacaagtggagagacctgaacgtgatcagcagcctgctgaagagcttcttcagaaagctgcccgagcccctgttcaccaacgacaagtacgccgacttcatcgaggccaacagaaaggaggaccccctggacagactgaagaccctgaagagactgttcctgagcgcccacctgaagaccgtggcctag

SEQ ID NO: 97097 - DNA, 2724 bp, Artificial Sequence
  Description of Artificial Sequence: Synthetic coding sequence
atgcccaaggacgaggacatcctgcaggtggcctacagccaggacgcctacctgaagggcaacgaggcctacagcggcaacgccagaaacatccccgagcccccccccatctgctacccctggctgcccagcgcccccagcgccatggcccagcccgtggagatcagcccccccgacagcagcctgagcaagcagcagaccagcacccccgtgctgacccagcccggcagagcctacagaatggagatccaggtgccccccagccccaccgacgtggccaagagcaacaccgccgtgtgcgtgtgcaacgagagcgtgagaaccgtgatcgtgcccagcgagaaggtggtggacctgctgagcaacagaaacaaccacaccggccccagccacagaaccgaggaggtgagatacggcgtgagcgagcagaccagcctgaagaccgtgagcagaaccaccagcccccccctgagcatccccaccacccacctgatccaccagcccgccggcagcagaagcctggagcccagcggcatcctgctgaagagcggcaactacagcggccacagcgacggcatcagcagcagcagaagccaggccgtggaggcccccagcgtgagcgtgaaccactacagccccaacagccaccagcacatcgactggaagaactacaagacctacaaggagtacatcgacaacagaagactgcacatcggctgcagaaccatccaggagagactggacagcctgagagccgccagccagagcaccaccgactacaaccaggtggtgcccaacagaaccaccctgcagggcagaagaagaagcaccagccacgacagagtgccccagagcgtgcagatcagacagagaagcgtgagccaggagagactggaggacagcgtgctgatgaagtactgccccagaagcgccagccagggcgccctgaccagccccagcgtgagcttcagcaaccacagaaccagaagctgggactacatcgagggccaggacgagaccctggagaacgtgaacagcggcacccccatccccgacagcaacggcgagaagaagcagacctacaagtggagcggcttcaccgagcaggacgacagaagaggcatctgcgagagacccagacagcaggagatccacaagagcttcagaggcagcaacttcaccgtggcccccagcgtggtgaacagcgacaacagaagaatgagcggcagaggcgtgggcagcgtgagccagttcaagaagatcccccccgacctgaagaccctgcagagcaacagaaacttccagaccacctgcggcatgagcctgcccagaggcatcagccaggacagaagccccctggtgaaggtgagaagcaacagcctgaaggcccccagcacccacgtgaccaagcccagcttcagccagaagagcttcgtgagcatcaaggaccagagacccgtgaaccacctgcaccagaacagcctgctgaaccagcagacctgggtgagaaccgacagcgcccccgaccagcaggtggagaccggcaagagccccagcctgagcggcgccagcgccaagcccgccccccagagcagcgagaacgccggcaccagcgacctggagctgcccgtgagccagagaaaccaggacctgagcctgcaggaggccgagaccgagcagagcgacaccctggacaacaaggaggccgtgatcctgagagagaagccccccagcggcagacagaccccccagcccctgagacaccagagctacatcctggccgtgaacgaccaggagaccggcagcgacaccacctgctggctgcccaacgacgccagaagagaggtgcacatcaagagaatggaggagagaaaggccagcagcaccagcccccccggcgacagcctggccagcatccccttcatcgacgagcccaccagccccagcatcgaccacgacatcgcccacatccccgccagcgccgtgatcagcgccagcaccagccaggtgcccagcatcgccaccgtgcccccctgcctgaccaccagcgcccccctgatcagaagacagctgagccacgaccacgagagcgtgggcccccccagcctggacgcccagcccaacagcaagaccgagagaagcaagagctacgacgagggcctggacgactacagagaggacgccaagctgagcttcaagcacgtgagcagcctgaagggcatcaagatcgccgacagccagaagagcagcgaggacagcggcagcagaaaggacagcagcagcgaggtgttcagcgacgccgccaaggagggctggctgcacttcagacccctggtgaccgacaagggcaagagagtgggcggcagcatcagaccctggaagcagatgtacgtggtgctgagaggccacagcctgtacctgtacaaggacaagagagagcagaccacccccagcgaggaggagcagcccatcagcgtgaacgcctgcctgatcgacatcagctacagcgagaccaagagaaagaacgtgttcagactgaccaccagcgactgcgagtgcctgttccaggccgaggacagagacgacatgctggcctggatcaagaccatccaggagagcagcaacctgaacgaggaggacaccggcgtgaccaacagagacctgatcagcagaagaatcaaggagtacaacaacctgatgagcaaggccgagcagctgccctag

SEQ ID NO: 97098 - DNA, 3396 bp, Artificial Sequence
  Description of Artificial Sequence: Synthetic coding sequence
atgatggccaccagaagaaccggcctgagcgagggcgacggcgacaagctgaaggcctgcgaggtgagcaagaacaaggacggcaaggagcagagcgagaccgtgagcctgagcgaggacgagaccttcagctggcccggccccaagaccgtgaccctgaagagaaccagccagggcttcggcttcaccctgagacacttcatcgtgtacccccccgagagcgccatccagttcagctacaaggacgaggagaacggcaacagaggcggcaagcagagaaacagactggagcccatggacaccatcttcgtgaagcaggtgaaggagggcggccccgccttcgaggccggcctgtgcaccggcgacagaatcatcaaggtgaacggcgagagcgtgatcggcaagacctacagccaggtgatcgccctgatccagaacagcgacaccaccctggagctgagcgtgatgcccaaggacgaggacatcctgcaggtgctgcagttcaccaaggacgtgaccgccctggcctacagccaggacgcctacctgaagggcaacgaggcctacagcggcaacgccagaaacatccccgagcccccccccatctgctacccctggctgcccagcgcccccagcgccatggcccagcccgtggagatcagcccccccgacagcagcctgagcaagcagcagaccagcacccccgtgctgacccagcccggcagagcctacagaatggagatccaggtgccccccagccccaccgacgtggccaagagcaacaccgccgtgtgcgtgtgcaacgagagcgtgagaaccgtgatcgtgcccagcgagaaggtggtggacctgctgagcaacagaaacaaccacaccggccccagccacagaaccgaggaggtgagatacggcgtgagcgagcagaccagcctgaagaccgtgagcagaaccaccagcccccccctgagcatccccaccacccacctgatccaccagcccgccggcagcagaagcctggagcccagcggcatcctgctgaagagcggcaactacagcggccacagcgacggcatcagcagcagcagaagccaggccgtggaggcccccagcgtgagcgtgaaccactacagccccaacagccaccagcacatcgactggaagaactacaagacctacaaggagtacatcgacaacagaagactgcacatcggctgcagaaccatccaggagagactggacagcctgagagccgccagccagagcaccaccgactacaaccaggtggtgcccaacagaaccaccctgcagggcagaagaagaagcaccagccacgacagagtgccccagagcgtgcagatcagacagagaagcgtgagccaggagagactggaggacagcgtgctgatgaagtactgccccagaagcgccagccagggcgccctgaccagccccagcgtgagcttcagcaaccacagaaccagaagctgggactacatcgagggccaggacgagaccctggagaacgtgaacagcggcacccccatccccgacagcaacggcgagaagaagcagacctacaagtggagcggcttcaccgagcaggacgacagaagaggcatctgcgagagacccagacagcaggagatccacaagagcttcagaggcagcaacttcaccgtggcccccagcgtggtgaacagcgacaacagaagaatgagcggcagaggcgtgggcagcgtgagccagttcaagaagatcccccccgacctgaagaccctgcagagcaacagaaacttccagaccacctgcggcatgagcctgcccagaggcatcagccaggacagaagccccctggtgaaggtgagaagcaacagcctgaaggcccccagcacccacgtgaccaagcccagcttcagccagaagagcttcgtgagcatcaaggaccagagacccgtgaaccacctgcaccagaacagcctgctgaaccagcagacctgggtgagaaccgacagcgcccccgaccagcaggtggagaccggcaagagccccagcctgagcggcgccagcgccaagcccgccccccagagcagcgagaacgccggcaccagcgacctggagctgcccgtgagccagagaaaccaggacctgagcctgcaggaggccgagaccgagcagagcgacaccctggacaacaaggaggccgtgatcctgagagagaagccccccagcggcagacagaccccccagcccctgagacaccagagctacatcctggccgtgaacgaccaggagaccggcagcgacaccacctgctggctgcccaacgacgccagaagagaggtgcacatcaagagaatggaggagagaaaggccagcagcaccagcccccccggcgacagcctggccagcatccccttcatcgacgagcccaccagccccagcatcgaccacgacatcgcccacatccccgccagcgccgtgatcagcgccagcaccagccaggtgcccagcatcgccaccgtgcccccctgcctgaccaccagcgcccccctgatcagaagacagctgagccacgaccacgagagcgtgggcccccccagcctggacgcccagcccaacagcaagaccgagagaagcaagagctacgacgagggcctggacgactacagagaggacgccaagctgagcttcaagcacgtgagcagcctgaagggcatcaagatcgccgacagccagaagagcagcgaggacagcggcagcagaaaggacagcagcagcgaggtgttcagcgacgccgccaaggagggctggctgcacttcagacccctggtgaccgacaagggcaagagagtgggcggcagcatcagaccctggaagcagatgtacgtggtgctgagaggccacagcctgtacctgtacaaggacaagagagagcagaccacccccagcgaggaggagcagcccatcagcgtgaacgcctgcctgatcgacatcagctacagcgagaccaagagaaagaacgtgttcagactgaccaccagcgactgcgagtgcctgttccaggccgaggacagagacgacatgctggcctggatcaagaccatccaggagagcagcaacctgaacgaggaggacaccggcgtgaccaacagagacctgatcagcagaagaatcaaggagtacaacaacctgatgagcaaggccgagcagctgcccaagacccccagacagagcctgagcatcagacagaccctgctgggcgccaagagcgagcccaagacccagagcccccacagccccaaggaggagagcgagagaaagctgctgagcaaggacgacaccagcccccccaaggacaagggcacctggagaaagggcatccccagcatcatgtag

SEQ ID NO: 97099 - DNA, 4224 bp, Artificial Sequence
  Description of Artificial Sequence: Synthetic coding sequence
atggccaccagaagaaccggcctgagcgagggcgacggcgacaagctgaaggcctgcgaggtgagcaagaacaaggacggcaaggagcagagcgagaccgtgagcctgagcgaggacgagaccttcagctggcccggccccaagaccgtgaccctgaagagaaccagccagggcttcggcttcaccctgagacacttcatcgtgtacccccccgagagcgccatccagttcagctacaaggacgaggagaacggcaacagaggcggcaagcagagaaacagactggagcccatggacaccatcttcgtgaagcaggtgaaggagggcggccccgccttcgaggccggcctgtgcaccggcgacagaatcatcaaggtgaacggcgagagcgtgatcggcaagacctacagccaggtgatcgccctgatccagaacagcgacaccaccctggagctgagcgtgatgcccaaggacgaggacatcctgcaggtggcctacagccaggacgcctacctgaagggcaacgaggcctacagcggcaacgccagaaacatccccgagcccccccccatctgctacccctggctgcccagcgcccccagcgccatggcccagcccgtggagatcagcccccccgacagcagcctgagcaagcagcagaccagcacccccgtgctgacccagcccggcagagcctacagaatggagatccaggtgccccccagccccaccgacgtggccaagagcaacaccgccgtgtgcgtgtgcaacgagagcgtgagaaccgtgatcgtgcccagcgagaaggtggtggacctgctgagcaacagaaacaaccacaccggccccagccacagaaccgaggaggtgagatacggcgtgagcgagcagaccagcctgaagaccgtgagcagaaccaccagcccccccctgagcatccccaccacccacctgatccaccagcccgccggcagcagaagcctggagcccagcggcatcctgctgaagagcggcaactacagcggccacagcgacggcatcagcagcagcagaagccaggccgtggaggcccccagcgtgagcgtgaaccactacagccccaacagccaccagcacatcgactggaagaactacaagacctacaaggagtacatcgacaacagaagactgcacatcggctgcagaaccatccaggagagactggacagcctgagagccgccagccagagcaccaccgactacaaccaggtggtgcccaacagaaccaccctgcagggcagaagaagaagcaccagccacgacagagtgccccagagcgtgcagatcagacagagaagcgtgagccaggagagactggaggacagcgtgctgatgaagtactgccccagaagcgccagccagggcgccctgaccagccccagcgtgagcttcagcaaccacagaaccagaagctgggactacatcgagggccaggacgagaccctggagaacgtgaacagcggcacccccatccccgacagcaacggcgagaagaagcagacctacaagtggagcggcttcaccgagcaggacgacagaagaggcatctgcgagagacccagacagcaggagatccacaagagcttcagaggcagcaacttcaccgtggcccccagcgtggtgaacagcgacaacagaagaatgagcggcagaggcgtgggcagcgtgagccactggagaaagggcatccccagcatcatgagaaagaccttcgagaagaagcccaccgccaccggcaccttcggcgtgagactggacgactgcccccccgcccacaccaacagatacatccccctgatcgtggacatctgctgcaagctggtggaggagagaggcctggagtacaccggcatctacagagtgcccggcaacaacgccgccatcagcagcatgcaggaggagctgaacaagggcatggccgacatcgacatccaggacgacaagtggagagacctgaacgtgatcagcagcctgctgaagagcttcttcagaaagctgcccgagcccctgttcaccaacgacaagtacgccgacttcatcgaggccaacagaaaggaggaccccctggacagactgaagaccctgaagagactgatccacgacctgcccgagcaccactacgagaccctgaagttcctgagcgcccacctgaagaccgtggccgagaacagcgagaagaacaagatggagcccagaaacctggccatcgtgttcggccccaccctggtgagaaccagcgaggacaacatgacccacatggtgacccacatgcccgaccagtacaagatcgtggagaccctgatccagcaccacgactggttcttcaccgaggagggcgccgaggagcccctgaccaccgtgcaggaggagagcaccgtggacagccagcccgtgcccaacatcgaccacctgctgaccaacatcggcagaaccggcgtgagccccggcgacgtgagcgacagcgccaccagcgacagcaccaagagcaagggcagctggggcagcggcaaggaccagtacagcagagagctgctggtgagcagcatcttcgccgccgccagcagaaagagaaagaagcccaaggagaaggcccagcccagcagcagcgaggacgagctggacaacgtgttcttcaagaaggagaacgtggagcagtgccacaacgacaccaaggaggagagcaagaaggagagcgagaccctgggcagaaagcagaagatcatcatcgccaaggagaacagcaccagaaaggaccccagcaccaccaaggacgagaagatcagcctgggcaaggagagcacccccagcgaggagcccagccccccccacaacagcaagcacaacaagagccccaccctgagctgcagattcgccatcctgaaggagagccccagaagcctgctggcccagaagagcagccacctggaggagaccggcagcgacagcggcaccctgctgagcaccagcagccaggccagcctggccagattcagcatgaagaagagcaccagccccgagaccaagcacagcgagttcctggccaacgtgagcaccatcaccagcgactacagcaccaccagcagcgccacctacctgaccagcctggacagcagcagactgagccccgaggtgcagagcgtggccgagagcaagggcgacgaggccgacgacgagagaagcgagctgatcagcgagggcagacccgtggagaccgacagcgagagcgagttccccgtgttccccaccgccctgaccagcgagagactgttcagaggcaagctgcaggaggtgaccaagagcagcagaagaaacagcgagggcagcgagctgagctgcaccgagggcagcctgaccagcagcctggacagcagaagacagctgttcagcagccacaagctgatcgagtgcgacaccctgagcagaaagaagagcgccagattcaagagcgacagcggcagcctgggcgacgccaagaacgagaaggaggcccccagcctgaccaaggtgttcgacgtgatgaagaagggcaagagcaccggcagcctgctgacccccaccagaggcgagagcgagaagcaggagcccacctggaagaccaagatcgccgacagactgaagctgagacccagagcccccgccgacgacatgttcggcgtgggcaaccacaaggtgaacgccgagaccgccaagagaaagagcatcagaagaagacacaccctgggcggccacagagacgccaccgagatcagcgtgctgaacttctggaaggtgcacgagcagagcggcgagagagagagcgagctgagcgccgtgaacagactgaagcccaagtgcagcgcccaggacctgagcatcagcgactggctggccagagagagactgagaaccagcaccagcgacctgagcagaggcgagatcggcgacccccagaccgagaaccccagcaccagagagatcgccaccaccgacacccccctgagcctgcactgcaacaccggcagcagcagcagcaccctggccagcaccaacagacccctgctgagcatccccccccagagccccgaccagatcaacggcgagagcttccagaacgtgagcaagaacgccagcagcgccgccaacgcccagccccacaagctgagcgagacccccggcagcaaggccgagttccacccctgcctgtag

SEQ ID NO: 97100 - DNA, 279 bp, Artificial Sequence
  Description of Artificial Sequence: Synthetic coding sequence
atggacaccatcttcgtgaagcaggtgaaggagggcggccccgccttcgaggccggcctgtgcaccggcgacagaatcatcaaggtgaacggcgagagcgtgatcggcaagacctacagccaggtgatcgccctgatccagaacagcgacaccaccctggagctgagcgtgatgcccaaggacgaggacatcctgcaggtgaacctggagttcagcaccttctacaagaacaccatcgccaagttcctgcagctgagcgacatggagatgctgtgctag

SEQ ID NO: 97101 - DNA, 4476 bp, Artificial Sequence
  Description of Artificial Sequence: Synthetic coding sequence
atgaacggcgtggccttctgcctggtgggcatcccccccagacccgagcccagacccccccagctgcccctgggccccagagacggctgcagccccagaagacccttcccctggcagggccccagaaccctgctgctgtacaagagcccccaggacggcttcggcttcaccctgagacacttcatcgtgtacccccccgagagcgccgtgcactgcagcctgaaggaggaggagaacggcggcagaggcggcggccccagccccagatacagactggagcccatggacaccatcttcgtgaagaacgtgaaggaggacggccccgcccacagagccggcctgagaaccggcgacagactggtgaaggtgaacggcgagagcgtgatcggcaagacctacagccaggtgatcgccctgatccagaacagcgacgacaccctggagctgagcatcatgcccaaggacgaggacatcctgcagctggcctacagccaggacgcctacctgaagggcaacgagccctacagcggcgaggccagaagcatccccgagcccccccccatctgctaccccagaaagacctacgccccccccgccagagccagcaccagagccaccatggtgcccgagcccaccagcgccctgcccagcgaccccagaagccccgccgcctggagcgaccccggcctgagagtgccccccgccgccagagcccacctggacaacagcagcctgggcatgagccagcccagacccagccccggcgccttcccccacctgagcagcgagcccagaacccccagagccttccccgagcccggcagcagagtgccccccagcagactggagtgccagcaggccctgagccactggctgagcaaccaggtgcccagaagagccggcgagagaagatgccccgccatggcccccagagccagaagcgccagccaggacagactggaggaggtggccgcccccagaccctggccctgcagcaccagccaggacgccctgagccagctgggccaggagggctggcacagagccagaagcgacgactacctgagcagagccaccagaagcgccgaggccctgggccccggcgccctggtgagccccagattcgagagatgcggctgggccagccagagaagcagcgccagaacccccgcctgccccaccagagacctgcccggcccccaggcccccccccccagcggcctgcagggcctggacgacctgggctacatcggctacagaagctacagccccagcttccagagaagaaccggcctgctgcacgccctgagcttcagagacagccccttcggcggcctgcccaccttcaacctggcccagagccccgccagcttcccccccgaggccagcgagccccccagagtggtgagacccgagcccagcaccagagccctggagccccccgccgaggacagaggcgacgaggtggtgctgagacagaagccccccaccggcagaaaggtgcagctgacccccgccagacagatgaacctgggcttcggcgacgagagccccgagcccgaggccagcggcagaggcgagagactgggcagaaaggtggcccccctggccaccaccgaggacagcctggccagcatccccttcatcgacgagcccaccagccccagcatcgacctgcaggccaagcacgtgcccgccagcgccgtggtgagcagcgccatgaacagcgcccccgtgctgggcaccagccccagcagccccaccttcaccttcaccctgggcagacactacagccaggactgcagcagcatcaaggccggcagaagaagcagctacctgctggccatcaccaccgagagaagcaagagctgcgacgacggcctgaacaccttcagagacgagggcagagtgctgagaagactgcccaacagaatccccagcctgagaatgctgagaagcttcttcaccgacggcagcctggacagctggggcaccagcgaggacgccgacgcccccagcaagagacacagcaccagcgacctgagcgacgccaccttcagcgacatcagaagagagggctggctgtactacaagcagatcctgaccaagaagggcaagaaggccggcagcggcctgagacagtggaagagagtgtacgccgccctgagagccagaagcctgagcctgagcaaggagagaagagagcccggccccgccgccgccggcgccgccgccgccggcgccggcgaggacgaggccgcccccgtgtgcatcggcagctgcctggtggacatcagctacagcgagaccaagagaagacacgtgttcagactgaccaccgccgacttctgcgagtacctgttccaggccgaggacagagacgacatgctgggctggatcagagccatcagagagaacagcagagccgagggcgaggaccccggctgcgccaaccaggccctgatcagcaagaagctgaacgactacagaaaggtgagccacagcagcggccccaaggccgacagcagccccaagggcagcagaggcctgggcggcctgaagagcgagttcctgaagcagagcgccgccagaggcctgagaacccaggacctgcccgccggcagcaaggacgacagcgccgccgcccccaagaccccctggggcatcaacatcatcaagaagaacaagaaggccgcccccagagccttcggcgtgagactggaggagtgccagcccgccaccgagaaccagagagtgcccctgatcgtggccgcctgctgcagaatcgtggaggccagaggcctggagagcaccggcatctacagagtgcccggcaacaacgccgtggtgagcagcctgcaggagcagctgaacagaggccccggcgacatcaacctgcaggacgagagatggcaggacctgaacgtgatcagcagcctgctgaagagcttcttcagaaagctgcccgagcccctgttcaccgacgacaagtacaacgacttcatcgaggccaacagaatcgaggacgccagagagagaatgagaaccctgagaaagctgatcagagacctgcccggccactactacgagaccctgaagttcctggtgggccacctgaagaccatcgccgaccacagcgagaagaacaagatggagcccagaaacctggccctggtgttcggccccaccctggtgagaaccagcgaggacaacatgaccgacatggtgacccacatgcccgacagatacaagatcgtggagaccctgatccagcacagcgactggttcttcagcgacgaggaggacaagggcgagagaacccccgtgggcgacaaggagccccaggccgtgcccaacatcgagtacctgctgcccaacatcggcagaaccgtgccccccggcgaccccggcagcgacagcaccacctgcagcagcgccaagagcaagggcagctgggcccccaagaaggagccctacgccagagagatgctggccatcagcttcatcagcgccgtgaacagaaagagaaagaagagaagagaggccagaggcctgggcagcagcaccgacgacgacagcgagcaggaggcccacaagcccggcgccggcgccaccgcccccggcacccaggagagaccccagggccccctgcccggcgccgtggcccccgaggcccccggcagactgagcccccccgccgcccccgaggagagacccgccgccgacaccagaagcatcgtgagcggctacagcaccctgagcaccatggacagaagcgtgtgcagcggcgccagcggcagaagagccggcgccggcgacgaggccgacgacgagagaagcgagctgagccacgtggagaccgacaccgagggcgccgccggcgccggccccggcggcagactgaccagaagacccagcttcagcagccaccacctgatgccctgcgacaccctggccagaagaagactggccagaggcagacccgacggcgagggcgccggcagaggcggccccagagcccccgagccccccggcagcgccagcagcagcagccaggagagcctgagaccccccgccgccgccctggccagcagacccagcagaatggaggccctgagactgagactgagaggcaccgccgacgacatgctggccgtgagactgagaagacccctgagccccgagaccagaagaagaagaagcagctggagaagacacaccgtggtggtgcagagccccctgaccgacctgaacttcaacgagtggaaggagctgggcggcggcggcccccccgagcccgccggcgccagagcccacagcgacaacaaggacagcggcctgagcagcctggagagcaccaaggccagagcccccagcagcgccgccagccagccccccgcccccggcgacaccggcagcctgcagagccagccccccagaagaagcgccgccagcagactgcaccagtgcctgtag

SEQ ID NO: 97102 - DNA, 3435 bp, Artificial Sequence
  Description of Artificial Sequence: Synthetic coding sequence
atgaacggcgtggccttctgcctggtgggcatcccccccagacccgagcccagacccccccagctgcccctgggccccagagacggctgcagccccagaagacccttcccctggcagggccccagaaccctgctgctgtacaagagcccccaggacggcttcggcttcaccctgagacacttcatcgtgtacccccccgagagcgccgtgcactgcagcctgaaggaggaggagaacggcggcagaggcggcggccccagccccagatacagactggagcccatggacaccatcttcgtgaagaacgtgaaggaggacggccccgcccacagagccggcctgagaaccggcgacagactggtgaaggtgaacggcgagagcgtgatcggcaagacctacagccaggtgatcgccctgatccagaacagcgacgacaccctggagctgagcatcatgcccaaggacgaggacatcctgcagctggcctacagccaggacgcctacctgaagggcaacgagccctacagcggcgaggccagaagcatccccgagcccccccccatctgctaccccagaaagacctacgccccccccgccagagccagcaccagagccaccatggtgcccgagcccaccagcgccctgcccagcgaccccagaagccccgccgcctggagcgaccccggcctgagagtgccccccgccgccagagcccacctggacaacagcagcctgggcatgagccagcccagacccagccccggcgccttcccccacctgagcagcgagcccagaacccccagagccttccccgagcccggcagcagagtgccccccagcagactggagtgccagcaggccctgagccactggctgagcaaccaggtgcccagaagagccggcgagagaagatgccccgccatggcccccagagccagaagcgccagccaggacagactggaggaggtggccgcccccagaccctggccctgcagcaccagccaggacgccctgagccagctgggccaggagggctggcacagagccagaagcgacgactacctgagcagagccaccagaagcgccgaggccctgggccccggcgccctggtgagccccagattcgagagatgcggctgggccagccagagaagcagcgccagaacccccgcctgccccaccagagacctgcccggcccccaggcccccccccccagcggcctgcagggcctggacgacctgggctacatcggctacagaagctacagccccagcttccagagaagaaccggcctgctgcacgccctgagcttcagagacagccccttcggcggcctgcccaccttcaacctggcccagagccccgccagcttcccccccgaggccagcgagccccccagagtggtgagacccgagcccagcaccagagccctggagccccccgccgaggacagaggcgacgaggtggtgctgagacagaagccccccaccggcagaaaggtgcagctgacccccgccagacagatgaacctgggcttcggcgacgagagccccgagcccgaggccagcggcagaggcgagagactgggcagaaaggtggcccccctggccaccaccgaggacagcctggccagcatccccttcatcgacgagcccaccagccccagcatcgacctgcaggccaagcacgtgcccgccagcgccgtggtgagcagcgccatgaacagcgcccccgtgctgggcaccagccccagcagccccaccttcaccttcaccctgggcagacactacagccaggactgcagcagcatcaaggccggcagaagaagcagctacctgctggccatcaccaccgagagaagcaagagctgcgacgacggcctgaacaccttcagagacgagggcagagtgctgagaagactgcccaacagaatccccagcctgagaatgctgagaagcttcttcaccgacggcagcctggacagctggggcaccagcgaggacgccgacgcccccagcaagagacacagcaccagcgacctgagcgacgccaccttcagcgacatcagaagagagggctggctgtactacaagcagatcctgaccaagaagggcaagaaggccggcagcggcctgagacagtggaagagagtgtacgccgccctgagagccagaagcctgagcctgagcaaggagagaagagagcccggccccgccgccgccggcgccgccgccgccggcgccggcgaggacgaggccgcccccgtgtgcatcggcagctgcctggtggacatcagctacagcgagaccaagagaagacacgtgttcagactgaccaccgccgacttctgcgagtacctgttccaggccgaggacagagacgacatgctgggctggatcagagccatcagagagaacagcagagccgagggcgaggaccccggctgcgccaaccaggccctgatcagcaagaagctgaacgactacagaaaggtgagccacagcagcggccccaaggccgacagcagccccaagggcagcagaggcctgggcggcctgaagagcgagttcctgaagcagagcgccgccagaggcctgagaacccaggacctgcccgccggcagcaaggacgacagcgccgccgcccccaagaccccctggggcatcaacatcatcaagaagaacaagaaggccgcccccagagccttcggcgtgagactggaggagtgccagcccgccaccgagaaccagagagtgcccctgatcgtggccgcctgctgcagaatcgtggaggccagaggcctggagagcaccggcatctacagagtgcccggcaacaacgccgtggtgagcagcctgcaggagcagctgaacagaggccccggcgacatcaacctgcaggacgagagatggcaggacctgaacgtgatcagcagcctgctgaagagcttcttcagaaagctgcccgagcccctgttcaccgacgacaagtacaacgacttcatcgaggccaacagaatcgaggacgccagagagagaatgagaaccctgagaaagctgatcagagacctgcccggccactactacgagaccctgaagttcctggtgggccacctgaagaccatcgccgaccacagcgagaagaacaagatggagcccagaaacctggccctggtgttcggccccaccctggtgagaaccagcgaggacaacatgaccgacatggtgacccacatgcccgacagatacaagatcgtggagaccctgatccagcacagcgactggttcttcagcgacgaggaggacaagggcgagagaacccccgtgggcgacaaggagccccaggccgtgcccaacatcgagtacctgctgcccaacatcggcagaaccgtgccccccggcgaccccggcagcgccgacctgctggagatctag

SEQ ID NO: 97103 - DNA, 4194 bp, Artificial Sequence
  Description of Artificial Sequence: Synthetic coding sequence
atggacaccatcttcgtgaagaacgtgaaggaggacggccccgcccacagagccggcctgagaaccggcgacagactggtgaaggtgaacggcgagagcgtgatcggcaagacctacagccaggtgatcgccctgatccagaacagcgacgacaccctggagctgagcatcatgcccaaggacgaggacatcctgcagctggcctacagccaggacgcctacctgaagggcaacgagccctacagcggcgaggccagaagcatccccgagcccccccccatctgctaccccagaaagacctacgccccccccgccagagccagcaccagagccaccatggtgcccgagcccaccagcgccctgcccagcgaccccagaagccccgccgcctggagcgaccccggcctgagagtgccccccgccgccagagcccacctggacaacagcagcctgggcatgagccagcccagacccagccccggcgccttcccccacctgagcagcgagcccagaacccccagagccttccccgagcccggcagcagagtgccccccagcagactggagtgccagcaggccctgagccactggctgagcaaccaggtgcccagaagagccggcgagagaagatgccccgccatggcccccagagccagaagcgccagccaggacagactggaggaggtggccgcccccagaccctggccctgcagcaccagccaggacgccctgagccagctgggccaggagggctggcacagagccagaagcgacgactacctgagcagagccaccagaagcgccgaggccctgggccccggcgccctggtgagccccagattcgagagatgcggctgggccagccagagaagcagcgccagaacccccgcctgccccaccagagacctgcccggcccccaggcccccccccccagcggcctgcagggcctggacgacctgggctacatcggctacagaagctacagccccagcttccagagaagaaccggcctgctgcacgccctgagcttcagagacagccccttcggcggcctgcccaccttcaacctggcccagagccccgccagcttcccccccgaggccagcgagccccccagagtggtgagacccgagcccagcaccagagccctggagccccccgccgaggacagaggcgacgaggtggtgctgagacagaagccccccaccggcagaaaggtgcagctgacccccgccagacagatgaacctgggcttcggcgacgagagccccgagcccgaggccagcggcagaggcgagagactgggcagaaaggtggcccccctggccaccaccgaggacagcctggccagcatccccttcatcgacgagcccaccagccccagcatcgacctgcaggccaagcacgtgcccgccagcgccgtggtgagcagcgccatgaacagcgcccccgtgctgggcaccagccccagcagccccaccttcaccttcaccctgggcagacactacagccaggactgcagcagcatcaaggccggcagaagaagcagctacctgctggccatcaccaccgagagaagcaagagctgcgacgacggcctgaacaccttcagagacgagggcagagtgctgagaagactgcccaacagaatccccagcctgagaatgctgagaagcttcttcaccgacggcagcctggacagctggggcaccagcgaggacgccgacgcccccagcaagagacacagcaccagcgacctgagcgacgccaccttcagcgacatcagaagagagggctggctgtactacaagcagatcctgaccaagaagggcaagaaggccggcagcggcctgagacagtggaagagagtgtacgccgccctgagagccagaagcctgagcctgagcaaggagagaagagagcccggccccgccgccgccggcgccgccgccgccggcgccggcgaggacgaggccgcccccgtgtgcatcggcagctgcctggtggacatcagctacagcgagaccaagagaagacacgtgttcagactgaccaccgccgacttctgcgagtacctgttccaggccgaggacagagacgacatgctgggctggatcagagccatcagagagaacagcagagccgagggcgaggaccccggctgcgccaaccaggccctgatcagcaagaagctgaacgactacagaaaggtgagccacagcagcggccccaaggccgacagcagccccaagggcagcagaggcctgggcggcctgaagagcgagttcctgaagcagagcgccgccagaggcctgagaacccaggacctgcccgccggcagcaaggacgacagcgccgccgcccccaagaccccctggggcatcaacatcatcaagaagaacaagaaggccgcccccagagccttcggcgtgagactggaggagtgccagcccgccaccgagaaccagagagtgcccctgatcgtggccgcctgctgcagaatcgtggaggccagaggcctggagagcaccggcatctacagagtgcccggcaacaacgccgtggtgagcagcctgcaggagcagctgaacagaggccccggcgacatcaacctgcaggacgagagatggcaggacctgaacgtgatcagcagcctgctgaagagcttcttcagaaagctgcccgagcccctgttcaccgacgacaagtacaacgacttcatcgaggccaacagaatcgaggacgccagagagagaatgagaaccctgagaaagctgatcagagacctgcccggccactactacgagaccctgaagttcctggtgggccacctgaagaccatcgccgaccacagcgagaagaacaagatggagcccagaaacctggccctggtgttcggccccaccctggtgagaaccagcgaggacaacatgaccgacatggtgacccacatgcccgacagatacaagatcgtggagaccctgatccagcacagcgactggttcttcagcgacgaggaggacaagggcgagagaacccccgtgggcgacaaggagccccaggccgtgcccaacatcgagtacctgctgcccaacatcggcagaaccgtgccccccggcgaccccggcagcgacagcaccacctgcagcagcgccaagagcaagggcagctgggcccccaagaaggagccctacgccagagagatgctggccatcagcttcatcagcgccgtgaacagaaagagaaagaagagaagagaggccagaggcctgggcagcagcaccgacgacgacagcgagcaggaggcccacaagcccggcgccggcgccaccgcccccggcacccaggagagaccccagggccccctgcccggcgccgtggcccccgaggcccccggcagactgagcccccccgccgcccccgaggagagacccgccgccgacaccagaagcatcgtgagcggctacagcaccctgagcaccatggacagaagcgtgtgcagcggcgccagcggcagaagagccggcgccggcgacgaggccgacgacgagagaagcgagctgagccacgtggagaccgacaccgagggcgccgccggcgccggccccggcggcagactgaccagaagacccagcttcagcagccaccacctgatgccctgcgacaccctggccagaagaagactggccagaggcagacccgacggcgagggcgccggcagaggcggccccagagcccccgagccccccggcagcgccagcagcagcagccaggagagcctgagaccccccgccgccgccctggccagcagacccagcagaatggaggccctgagactgagactgagaggcaccgccgacgacatgctggccgtgagactgagaagacccctgagccccgagaccagaagaagaagaagcagctggagaagacacaccgtggtggtgcagagccccctgaccgacctgaacttcaacgagtggaaggagctgggcggcggcggcccccccgagcccgccggcgccagagcccacagcgacaacaaggacagcggcctgagcagcctggagagcaccaaggccagagcccccagcagcgccgccagccagccccccgcccccggcgacaccggcagcctgcagagccagccccccagaagaagcgccgccagcagactgcaccagtgcctgtag

SEQ ID NO: 97104 - DNA, 1968 bp, Artificial Sequence
  Description of Artificial Sequence: Synthetic coding sequence
atgcccgaggacagaaacagcggcggctgccccgccggcgccctggccagcacccccttcatccccaagaccacctacagaagaatcaagagatgcttcagcttcagaaagggcatcttcggccagaagctggaggacaccgtgagatacgagaagagatacggcaacagactggcccccatgctggtggagcagtgcgtggacttcatcagacagagaggcctgaaggaggagggcctgttcagactgcccggccaggccaacctggtgaaggagctgcaggacgccttcgactgcggcgagaagcccagcttcgacagcaacaccgacgtgcacaccgtggccagcctgctgaagctgtacctgagagagctgcccgagcccgtgatcccctacgccaagtacgaggacttcctgagctgcgccaagctgctgagcaaggaggaggaggccggcgtgaaggagctggccaagcaggtgaagagcctgcccgtggtgaactacaacctgctgaagtacatctgcagattcctggacgaggtgcagagctacagcggcgtgaacaagatgagcgtgcagaacctggccaccgtgttcggccccaacatcctgagacccaaggtggaggaccccctgaccatcatggagggcaccgtggtggtgcagcagctgatgagcgtgatgatcagcaagcacgactgcctgttccccaaggacgccgagctgcagagcaagccccaggacggcgtgagcaacaacaacgagatccagaagaaggccaccatgggccagctgcagaacaaggagaacaacaacaccaaggacagccccagcagacagtgcagctgggacaagagcgagagcccccagagaagcagcatgaacaacggcagccccaccgccctgagcggcagcaagaccaacagccccaagaacagcgtgcacaagctggacgtgagcagaagcccccccctgatggtgaagaagaaccccgccttcaacaagggcagcggcatcgtgaccaacggcagcttcagcagcagcaacgccgagggcctggagaagacccagaccacccccaacggcagcctgcaggccagaagaagcagcagcctgaaggtgagcggcaccaagatgggcacccacagcgtgcagaacggcaccgtgagaatgggcatcctgaacagcgacaccctgggcaaccccaccaacgtgagaaacatgagctggctgcccaacggctacgtgaccctgagagacaacaagcagaaggagcaggccggcgagctgggccagcacaacagactgagcacctacgacaacgtgcaccagcagttcagcatgatgaacctggacgacaagcagagcatcgacagcgccacctggagcaccagcagctgcgagatcagcctgcccgagaacagcaacagctgcagaagcagcaccaccacctgccccgagcaggacttcttcggcggcaacttcgaggaccccgtgctggacggccccccccaggacgacctgagccaccccagagactacgagagcaagagcgaccacagaagcgtgggcggcagaagcagcagagccaccagcagcagcgacaacagcgagaccttcgtgggcaacagcagcagcaaccacagcgccctgcacagcctggtgagcagcctgaagcaggagatgaccaagcagaagatcgagtacgagagcagaatcaagagcctggagcagagaaacctgaccctggagaccgagatgatgagcctgcacgacgagctggaccaggagagaaagaagttcaccatgatcgagatcaagatgagaaacgccgagagagccaaggaggacgccgagaagagaaacgacatgctgcagaaggagatggagcagttcttcagcaccttcggcgagctgaccgtggagcccagaagaaccgagagaggcaacaccatctggatccagtag

SEQ ID NO: 97105 - DNA, 1962 bp, Artificial Sequence
  Description of Artificial Sequence: Synthetic coding sequence
atgaccgccaaccacgagagctacctgctgatggccagcacccagaacgacatggaggactgggtgaagagcatcagaagagtgatctggggccccttcggcggcggcatcttcggccagaagctggaggacaccgtgagatacgagaagagatacggcaacagactggcccccatgctggtggagcagtgcgtggacttcatcagacagagaggcctgaaggaggagggcctgttcagactgcccggccaggccaacctggtgaaggagctgcaggacgccttcgactgcggcgagaagcccagcttcgacagcaacaccgacgtgcacaccgtggccagcctgctgaagctgtacctgagagagctgcccgagcccgtgatcccctacgccaagtacgaggacttcctgagctgcgccaagctgctgagcaaggaggaggaggccggcgtgaaggagctggccaagcaggtgaagagcctgcccgtggtgaactacaacctgctgaagtacatctgcagattcctggacgaggtgcagagctacagcggcgtgaacaagatgagcgtgcagaacctggccaccgtgttcggccccaacatcctgagacccaaggtggaggaccccctgaccatcatggagggcaccgtggtggtgcagcagctgatgagcgtgatgatcagcaagcacgactgcctgttccccaaggacgccgagctgcagagcaagccccaggacggcgtgagcaacaacaacgagatccagaagaaggccaccatgggccagctgcagaacaaggagaacaacaacaccaaggacagccccagcagacagtgcagctgggacaagagcgagagcccccagagaagcagcatgaacaacggcagccccaccgccctgagcggcagcaagaccaacagccccaagaacagcgtgcacaagctggacgtgagcagaagcccccccctgatggtgaagaagaaccccgccttcaacaagggcagcggcatcgtgaccaacggcagcttcagcagcagcaacgccgagggcctggagaagacccagaccacccccaacggcagcctgcaggccagaagaagcagcagcctgaaggtgagcggcaccaagatgggcacccacagcgtgcagaacggcaccgtgagaatgggcatcctgaacagcgacaccctgggcaaccccaccaacgtgagaaacatgagctggctgcccaacggctacgtgaccctgagagacaacaagcagaaggagcaggccggcgagctgggccagcacaacagactgagcacctacgacaacgtgcaccagcagttcagcatgatgaacctggacgacaagcagagcatcgacagcgccacctggagcaccagcagctgcgagatcagcctgcccgagaacagcaacagctgcagaagcagcaccaccacctgccccgagcaggacttcttcggcggcaacttcgaggaccccgtgctggacggccccccccaggacgacctgagccaccccagagactacgagagcaagagcgaccacagaagcgtgggcggcagaagcagcagagccaccagcagcagcgacaacagcgagaccttcgtgggcaacagcagcagcaaccacagcgccctgcacagcctggtgagcagcctgaagcaggagatgaccaagcagaagatcgagtacgagagcagaatcaagagcctggagcagagaaacctgaccctggagaccgagatgatgagcctgcacgacgagctggaccaggagagaaagaagttcaccatgatcgagatcaagatgagaaacgccgagagagccaaggaggacgccgagaagagaaacgacatgctgcagaaggagatggagcagttcttcagcaccttcggcgagctgaccgtggagcccagaagaaccgagagaggcaacaccatctggatccagtag

SEQ ID NO: 97106 - DNA, 2247 bp, Artificial Sequence
  Description of Artificial Sequence: Synthetic coding sequence
atggaggagaacaacgacagcaccgagaacccccagcagggccagggcagacagaacgccatcaagtgcggctggctgagaaagcagggcggcttcgtgaagacctggcacaccagatggttcgtgctgaagggcgaccagctgtactacttcaaggacgaggacgagaccaagcccctgggcaccatcttcctgcccggcaacaaggtgagcgagcacccctgcaacgaggagaaccccggcaagttcctgttcgaggtggtgcccggcggcgacagagacagaatgaccgccaaccacgagagctacctgctgatggccagcacccagaacgacatggaggactgggtgaagagcatcagaagagtgatctggggccccttcggcggcggcatcttcggccagaagctggaggacaccgtgagatacgagaagagatacggcaacagactggcccccatgctggtggagcagtgcgtggacttcatcagacagagaggcctgaaggaggagggcctgttcagactgcccggccaggccaacctggtgaaggagctgcaggacgccttcgactgcggcgagaagcccagcttcgacagcaacaccgacgtgcacaccgtggccagcctgctgaagctgtacctgagagagctgcccgagcccgtgatcccctacgccaagtacgaggacttcctgagctgcgccaagctgctgagcaaggaggaggaggccggcgtgaaggagctggccaagcaggtgaagagcctgcccgtggtgaactacaacctgctgaagtacatctgcagattcctggacgaggtgcagagctacagcggcgtgaacaagatgagcgtgcagaacctggccaccgtgttcggccccaacatcctgagacccaaggtggaggaccccctgaccatcatggagggcaccgtggtggtgcagcagctgatgagcgtgatgatcagcaagcacgactgcctgttccccaaggacgccgagctgcagagcaagccccaggacggcgtgagcaacaacaacgagatccagaagaaggccaccatgggccagctgcagaacaaggagaacaacaacaccaaggacagccccagcagacagtgcagctgggacaagagcgagagcccccagagaagcagcatgaacaacggcagccccaccgccctgagcggcagcaagaccaacagccccaagaacagcgtgcacaagctggacgtgagcagaagcccccccctgatggtgaagaagaaccccgccttcaacaagggcagcggcatcgtgaccaacggcagcttcagcagcagcaacgccgagggcctggagaagacccagaccacccccaacggcagcctgcaggccagaagaagcagcagcctgaaggtgagcggcaccaagatgggcacccacagcgtgcagaacggcaccgtgagaatgggcatcctgaacagcgacaccctgggcaaccccaccaacgtgagaaacatgagctggctgcccaacggctacgtgaccctgagagacaacaagcagaaggagcaggccggcgagctgggccagcacaacagactgagcacctacgacaacgtgcaccagcagttcagcatgatgaacctggacgacaagcagagcatcgacagcgccacctggagcaccagcagctgcgagatcagcctgcccgagaacagcaacagctgcagaagcagcaccaccacctgccccgagcaggacttcttcggcggcaacttcgaggaccccgtgctggacggccccccccaggacgacctgagccaccccagagactacgagagcaagagcgaccacagaagcgtgggcggcagaagcagcagagccaccagcagcagcgacaacagcgagaccttcgtgggcaacagcagcagcaaccacagcgccctgcacagcctggtgagcagcctgaagcaggagatgaccaagcagaagatcgagtacgagagcagaatcaagagcctggagcagagaaacctgaccctggagaccgagatgatgagcctgcacgacgagctggaccaggagagaaagaagttcaccatgatcgagatcaagatgagaaacgccgagagagccaaggaggacgccgagaagagaaacgacatgctgcagaaggagatggagcagttcttcagcaccttcggcgagctgaccgtggagcccagaagaaccgagagaggcaacaccatctggatccagtag

SEQ ID NO: 97107 - DNA, 741 bp, Artificial Sequence
  Description of Artificial Sequence: Synthetic coding sequence
atggaggagaacaacgacagcaccgagaacccccagcagggccagggcagacagaacgccatcaagtgcggctggctgagaaagcagggcggcttcgtgaagacctggcacaccagatggttcgtgctgaagggcgaccagctgtactacttcaaggacgaggacgagaccaagcccctgggcaccatcttcctgcccggcaacaaggtgagcgagcacccctgcaacgaggagaaccccggcaagttcctgttcgaggtggtgcccggcggcgacagagacagaatgaccgccaaccacgagagctacctgctgatggccagcacccagaacgacatggaggactgggtgaagagcatcagaagagtgatctggggccccttcggcggcggcatcttcggccagaagctggaggacaccgtgagatacgagaagagatacggcaacagactggcccccatgctggtggagcagtgcgtggacttcatcagacagagaggcctgaaggaggagggcctgttcagactgcccggccaggccaacctggtgaaggagctgcaggacgccttcgactgcggcgagaagcccagcttcgacagcaacaccgacgtgcacaccgtggccagcctgctgaagctgtacctgagagagctgcccgagcccgtgatcccctacgccaagtacgaggacttcctgagctgcgccaagctgctgagcaaggaggaggaggccgtgagctag

SEQ ID NO: 97108 - DNA, 249 bp, Artificial Sequence
  Description of Artificial Sequence: Synthetic coding sequence
atgaccgccaaccacgagagctacctgctgatggccagcacccagaacgacatggaggactgggtgaagagcatcagaagagtgatctggggccccttcggcggcggcatcttcggccagaagctggaggacaccgtgagatacgagaagagatacggcaacagactggcccccatgctggtggagcagtgcgtggacttcatcagacagagaggcctgaaggaggagggcctgttcagactgccctag

SEQ ID NO: 97109 - DNA, 1938 bp, Artificial Sequence
  Description of Artificial Sequence: Synthetic coding sequence
atgagcctgaagctgcccagaaactgggacttcaacctgaaggtggaggccgccaagatcgccagaagcagaagcgtgatgaccggcgagcagatggccgccttccaccccagcagcacccccaaccccctggagagacccatcaagatgggctggctgaagaagcagagaagcatcgtgaagaactggcagcagagatacttcgtgctgagagcccagcagctgtactactacaaggacgaggaggacaccaagccccagggctgcatgtacctgcccggctgcaccatcaaggagatcgccaccaaccccgaggaggccggcaagttcgtgttcgagatcatccccgccagctgggaccagaacagaatgggccaggacagctacgtgctgatggccagcagccaggccgagatggaggagtgggtgaagttcctgagaagagtggccggcaccccctgcggcgtgttcggccagagactggacgagaccgtggcctacgagcagaagttcggcccccacctggtgcccatcctggtggagaagtgcgccgagttcatcctggagcacggcagaaacgaggagggcatcttcagactgcccggccaggacaacctggtgaagcagctgagagacgccttcgacgccggcgagagacccagcttcgacagagacaccgacgtgcacaccgtggccagcctgctgaagctgtacctgagagacctgcccgagcccgtggtgccctggagccagtacgagggcttcctgctgtgcggccagctgaccaacgccgacgaggccaaggcccagcaggagctgatgaagcagctgagcatcctgcccagagacaactacagcctgctgagctacatctgcagattcctgcacgagatccagctgaactgcgccgtgaacaagatgagcgtggacaacctggccaccgtgatcggcgtgaacctgatcagaagcaaggtggaggaccccgccgtgatcatgagaggcaccccccagatccagagagtgatgaccatgatgatcagagaccacgaggtgctgttccccaagagcaaggacatccccctgagcccccccgcccagaagaacgaccccaagaaggcccccgtggccagaagcagcgtgggctgggacgccaccgaggacctgagaatcagcagaaccgacagcttcagcagcatgaccagcgacagcgacaccaccagccccaccggccagcagcccagcgacgccttccccgaggacagcagcaaggtgcccagagagaagcccggcgactggaagatgcagagcagaaagagaacccagaccctgcccaacagaaagtgcttcctgaccagcgccttccagggcgccaacagcagcaagatggagatcttcaagaacgagttctggagccccagcagcgaggccaaggccggcgagggccacagaagaaccatgagccaggacctgagacagctgagcgacagccagagaaccagcacctacgacaacgtgcccagcctgcccggcagccccggcgaggaggccagcgccctgagcagccaggcctgcgacagcaagggcgacaccctggccagccccaacagcgagaccggccccggcaagaagaacagcggcgaggaggagatcgacagcctgcagagaatggtgcaggagctgagaaaggagatcgagacccagaagcagatgtacgaggagcagatcaagaacctggagaaggagaactacgacgtgtgggccaaggtggtgagactgaacgaggagctggagaaggagaagaagaagagcgccgccctggagatcagcctgagaaacatggagagaagcagagaggacgtggagaagagaaacaaggccctggaggaggaggtgaaggagttcgtgaagagcatgaaggagcccaagaccgaggcctag

SEQ ID NO: 97110 - DNA, 1917 bp, Artificial Sequence
  Description of Artificial Sequence: Synthetic coding sequence
atgagcctgggccagagcgcctgcctgttcctgagcatcgccagaagcagaagcgtgatgaccggcgagcagatggccgccttccaccccagcagcacccccaaccccctggagagacccatcaagatgggctggctgaagaagcagagaagcatcgtgaagaactggcagcagagatacttcgtgctgagagcccagcagctgtactactacaaggacgaggaggacaccaagccccagggctgcatgtacctgcccggctgcaccatcaaggagatcgccaccaaccccgaggaggccggcaagttcgtgttcgagatcatccccgccagctgggaccagaacagaatgggccaggacagctacgtgctgatggccagcagccaggccgagatggaggagtgggtgaagttcctgagaagagtggccggcaccccctgcggcgtgttcggccagagactggacgagaccgtggcctacgagcagaagttcggcccccacctggtgcccatcctggtggagaagtgcgccgagttcatcctggagcacggcagaaacgaggagggcatcttcagactgcccggccaggacaacctggtgaagcagctgagagacgccttcgacgccggcgagagacccagcttcgacagagacaccgacgtgcacaccgtggccagcctgctgaagctgtacctgagagacctgcccgagcccgtggtgccctggagccagtacgagggcttcctgctgtgcggccagctgaccaacgccgacgaggccaaggcccagcaggagctgatgaagcagctgagcatcctgcccagagacaactacagcctgctgagctacatctgcagattcctgcacgagatccagctgaactgcgccgtgaacaagatgagcgtggacaacctggccaccgtgatcggcgtgaacctgatcagaagcaaggtggaggaccccgccgtgatcatgagaggcaccccccagatccagagagtgatgaccatgatgatcagagaccacgaggtgctgttccccaagagcaaggacatccccctgagcccccccgcccagaagaacgaccccaagaaggcccccgtggccagaagcagcgtgggctgggacgccaccgaggacctgagaatcagcagaaccgacagcttcagcagcatgaccagcgacagcgacaccaccagccccaccggccagcagcccagcgacgccttccccgaggacagcagcaaggtgcccagagagaagcccggcgactggaagatgcagagcagaaagagaacccagaccctgcccaacagaaagtgcttcctgaccagcgccttccagggcgccaacagcagcaagatggagatcttcaagaacgagttctggagccccagcagcgaggccaaggccggcgagggccacagaagaaccatgagccaggacctgagacagctgagcgacagccagagaaccagcacctacgacaacgtgcccagcctgcccggcagccccggcgaggaggccagcgccctgagcagccaggcctgcgacagcaagggcgacaccctggccagccccaacagcgagaccggccccggcaagaagaacagcggcgaggaggagatcgacagcctgcagagaatggtgcaggagctgagaaaggagatcgagacccagaagcagatgtacgaggagcagatcaagaacctggagaaggagaactacgacgtgtgggccaaggtggtgagactgaacgaggagctggagaaggagaagaagaagagcgccgccctggagatcagcctgagaaacatggagagaagcagagaggacgtggagaagagaaacaaggccctggaggaggaggtgaaggagttcgtgaagagcatgaaggagcccaagaccgaggcctag

SEQ ID NO: 97111 - DNA, 1941 bp, Artificial Sequence
  Description of Artificial Sequence: Synthetic coding sequence
atgagcctgaagctgcccagaaactgggacttcaacctgaaggtggaggccgccaagatcgccagaagcagaagcgtgatgaccggcgagcagatggccgccttccaccccagcagcacccccaaccccctggagagacccatcaagatgggctggctgaagaagcagagaagcatcgtgaagaactggcagcagagatacttcgtgctgagagcccagcagctgtactactacaaggacgaggaggacaccaagccccagggctgcatgtacctgcccggctgcaccatcaaggagatcgccaccaaccccgaggaggccggcaagttcgtgttcgagatcatccccgccagctgggaccagaacagaatgggccaggacagctacgtgctgatggccagcagccaggccgagatggaggagtgggtgaagttcctgagaagagtggccggcaccccctgcggcgccgtgttcggccagagactggacgagaccgtggcctacgagcagaagttcggcccccacctggtgcccatcctggtggagaagtgcgccgagttcatcctggagcacggcagaaacgaggagggcatcttcagactgcccggccaggacaacctggtgaagcagctgagagacgccttcgacgccggcgagagacccagcttcgacagagacaccgacgtgcacaccgtggccagcctgctgaagctgtacctgagagacctgcccgagcccgtggtgccctggagccagtacgagggcttcctgctgtgcggccagctgaccaacgccgacgaggccaaggcccagcaggagctgatgaagcagctgagcatcctgcccagagacaactacagcctgctgagctacatctgcagattcctgcacgagatccagctgaactgcgccgtgaacaagatgagcgtggacaacctggccaccgtgatcggcgtgaacctgatcagaagcaaggtggaggaccccgccgtgatcatgagaggcaccccccagatccagagagtgatgaccatgatgatcagagaccacgaggtgctgttccccaagagcaaggacatccccctgagcccccccgcccagaagaacgaccccaagaaggcccccgtggccagaagcagcgtgggctgggacgccaccgaggacctgagaatcagcagaaccgacagcttcagcagcatgaccagcgacagcgacaccaccagccccaccggccagcagcccagcgacgccttccccgaggacagcagcaaggtgcccagagagaagcccggcgactggaagatgcagagcagaaagagaacccagaccctgcccaacagaaagtgcttcctgaccagcgccttccagggcgccaacagcagcaagatggagatcttcaagaacgagttctggagccccagcagcgaggccaaggccggcgagggccacagaagaaccatgagccaggacctgagacagctgagcgacagccagagaaccagcacctacgacaacgtgcccagcctgcccggcagccccggcgaggaggccagcgccctgagcagccaggcctgcgacagcaagggcgacaccctggccagccccaacagcgagaccggccccggcaagaagaacagcggcgaggaggagatcgacagcctgcagagaatggtgcaggagctgagaaaggagatcgagacccagaagcagatgtacgaggagcagatcaagaacctggagaaggagaactacgacgtgtgggccaaggtggtgagactgaacgaggagctggagaaggagaagaagaagagcgccgccctggagatcagcctgagaaacatggagagaagcagagaggacgtggagaagagaaacaaggccctggaggaggaggtgaaggagttcgtgaagagcatgaaggagcccaagaccgaggcctag

SEQ ID NO: 97112 - DNA, 1920 bp, Artificial Sequence
  Description of Artificial Sequence: Synthetic coding sequence
atgagcctgggccagagcgcctgcctgttcctgagcatcgccagaagcagaagcgtgatgaccggcgagcagatggccgccttccaccccagcagcacccccaaccccctggagagacccatcaagatgggctggctgaagaagcagagaagcatcgtgaagaactggcagcagagatacttcgtgctgagagcccagcagctgtactactacaaggacgaggaggacaccaagccccagggctgcatgtacctgcccggctgcaccatcaaggagatcgccaccaaccccgaggaggccggcaagttcgtgttcgagatcatccccgccagctgggaccagaacagaatgggccaggacagctacgtgctgatggccagcagccaggccgagatggaggagtgggtgaagttcctgagaagagtggccggcaccccctgcggcgccgtgttcggccagagactggacgagaccgtggcctacgagcagaagttcggcccccacctggtgcccatcctggtggagaagtgcgccgagttcatcctggagcacggcagaaacgaggagggcatcttcagactgcccggccaggacaacctggtgaagcagctgagagacgccttcgacgccggcgagagacccagcttcgacagagacaccgacgtgcacaccgtggccagcctgctgaagctgtacctgagagacctgcccgagcccgtggtgccctggagccagtacgagggcttcctgctgtgcggccagctgaccaacgccgacgaggccaaggcccagcaggagctgatgaagcagctgagcatcctgcccagagacaactacagcctgctgagctacatctgcagattcctgcacgagatccagctgaactgcgccgtgaacaagatgagcgtggacaacctggccaccgtgatcggcgtgaacctgatcagaagcaaggtggaggaccccgccgtgatcatgagaggcaccccccagatccagagagtgatgaccatgatgatcagagaccacgaggtgctgttccccaagagcaaggacatccccctgagcccccccgcccagaagaacgaccccaagaaggcccccgtggccagaagcagcgtgggctgggacgccaccgaggacctgagaatcagcagaaccgacagcttcagcagcatgaccagcgacagcgacaccaccagccccaccggccagcagcccagcgacgccttccccgaggacagcagcaaggtgcccagagagaagcccggcgactggaagatgcagagcagaaagagaacccagaccctgcccaacagaaagtgcttcctgaccagcgccttccagggcgccaacagcagcaagatggagatcttcaagaacgagttctggagccccagcagcgaggccaaggccggcgagggccacagaagaaccatgagccaggacctgagacagctgagcgacagccagagaaccagcacctacgacaacgtgcccagcctgcccggcagccccggcgaggaggccagcgccctgagcagccaggcctgcgacagcaagggcgacaccctggccagccccaacagcgagaccggccccggcaagaagaacagcggcgaggaggagatcgacagcctgcagagaatggtgcaggagctgagaaaggagatcgagacccagaagcagatgtacgaggagcagatcaagaacctggagaaggagaactacgacgtgtgggccaaggtggtgagactgaacgaggagctggagaaggagaagaagaagagcgccgccctggagatcagcctgagaaacatggagagaagcagagaggacgtggagaagagaaacaaggccctggaggaggaggtgaaggagttcgtgaagagcatgaaggagcccaagaccgaggcctag

SEQ ID NO: 97113 - DNA, 852 bp, Artificial Sequence
  Description of Artificial Sequence: Synthetic coding sequence
atgaccggcgagcagatggccgccttccaccccagcagcacccccaaccccctggagagacccatcaagatgggctggctgaagaagcagagaagcatcgtgaagaactggcagcagagatacttcgtgctgagagcccagcagctgtactactacaaggacgaggaggacaccaagccccagggctgcatgtacctgcccggctgcaccatcaaggagatcgccaccaaccccgaggaggccggcaagttcgtgttcgagatcatccccgccagctgggaccagaacagaatgggccaggacagctacgtgctgatggccagcagccaggccgagatggaggagtgggtgaagttcctgagaagagtggccggcaccccctgcggcgccgtgttcggccagagactggacgagaccgtggcctacgagcagaagttcggcccccacctggtgcccatcctggtggagaagtgcgccgagttcatcctggagcacggcagaaacgaggagggcatcttcagactgcccggccaggacaacctggtgaagcagctgagagacgccttcgacgccggcgagagacccagcttcgacagagacaccgacgtgcacaccgtggccagcctgctgaagctgtacctgagagacctgcccgagcccgtggtgccctggagccagtacgagggcttcctgctgtgcggccagctgaccaacgccgacgaggccaagaactacagaaacagaaacgactgccagagcgtggtgagcgcccagatccaccagttctgccccagagtgagcctgctggcccacggccaggcccacctgctggtgaacgacctgctggtgtag

SEQ ID NO: 97114 - DNA, 1776 bp, Artificial Sequence
  Description of Artificial Sequence: Synthetic coding sequence
atgagcctgggccagagcgcctgcctgttcctgagcatcgccagaagcagaagcgtgatgaccggcgagcagatggccgccttccaccccagcagcacccccaaccccctggagagacccatcaagatgggctggctgaagaagcagagaagcatcgtgaagaactggcagcagagatacttcgtgctgagagcccagcagctgtactactacaaggacgaggaggacaccaagccccagggctgcatgtacctgcccggctgcaccatcaaggagatcgccaccaaccccgaggaggccggcaagttcgtgttcgagatcatccccgccagctgggaccagaacagaatgggccaggacagctacgtgctgatggccagcagccaggccgagatggaggagtgggtgaagttcctgagaagagtggccggcaccccctgcggcgccgtgttcggccagagactggacgagaccgtggcctacgagcagaagttcggcccccacctggtgcccatcctggtggagaagtgcgccgagttcatcctggagcacggcagaaacgaggagggcatcttcagactgcccggccaggacaacctggtgaagcagctgagagacgccttcgacgccggcgagagacccagcttcgacagagacaccgacgtgcacaccgtggccagcctgctgaagctgtacctgagagacctgcccgagcccgtggtgccctggagccagtacgagggcttcctgctgtgcggccagctgaccaacgccgacgaggccaaggcccagcaggagctgatgaagcagctgagcatcctgcccagagacaactacagcctgctgagctacatctgcagattcctgcacgagatccagctgaactgcgccgtgaacaagatgagcgtggacaacctggccaccgtgatcggcgtgaacctgatcagaagcaaggtggaggaccccgccgtgatcatgagaggcaccccccagatccagagagtgatgaccatgatgatcagagaccacgaggtgctgttccccaagagcaaggacatccccctgagcccccccgcccagaagaacgaccccaagaaggcccccgtggccagaagcagcgtgggctgggacgccaccgaggacctgagaatcagcagaaccgacagcttcagcagcatgaccagcgacagcgacaccaccagccccaccggccagcagcccagcgacgccttccccgaggacagcagcaaggtgcccagagagaagcccggcgactggaagatgcagagcagaaagagaacccagaccctgcccaacagaaagtgcttcctgaccagcgccttccagggcgccaacagcagcaagatggagatcttcaagaacgagttctggagccccagcagcgaggccaaggccggcgagggccacagaagaaccatgagccaggacctgagacagctgagcgacagccagagaaccagcacctacgacaacgtgcccagcctgcccggcagccccggcgaggaggccagcgccctgagcagccaggcctgcgacagcaagggcgacaccctggccagccccaacagcgagaccggccccggcaagaagaacagcggcgaggaggagatcgacagcctgcagagaatggtgcaggagctgagaaaggagatcgagacccagaagcagatgtacgaggagcagatcaagaacctggagaaggagaactacgacgtgtgggccaaggtggtgagacccttcctgagcgccatctag

SEQ ID NO: 97115 - DNA, 1377 bp, Artificial Sequence
  Description of Artificial Sequence: Synthetic coding sequence
atgagcctgggccagagcgcctgcctgttcctgagcatcgccagaagcagaagcgtgatgaccggcgagcagatggccgccttccaccccagcagcacccccaaccccctggagagacccatcaagatgggctggctgaagaagcagagaagcatcgtgaagaactggcagcagagatacttcgtgctgagagcccagcagctgtactactacaaggacgaggaggacaccaagccccagggctgcatgtacctgcccggctgcaccatcaaggagatcgccaccaaccccgaggaggccggcaagttcgtgttcgagatcatccccgccagctgggaccagaacagaatgggccaggacagctacgtgctgatggccagcagccaggccgagatggaggagtgggtgaagttcctgagaagagtggccggcaccccctgcggcgccgtgttcggccagagactggacgagaccgtggcctacgagcagaagttcggcccccacctggtgcccatcctggtggagaagtgcgccgagttcatcctggagcacggcagaaacgaggagggcatcttcagactgcccggccaggacaacctggtgaagcagctgagagacgccttcgacgccggcgagagacccagcttcgacagagacaccgacgtgcacaccgtggccagcctgctgaagctgtacctgagagacctgcccgagcccgtggtgccctggagccagtacgagggcttcctgctgtgcggccagctgaccaacgccgacgaggccaaggcccagcaggagctgatgaagcagctgagcatcctgcccagagacaactacagcctgctgagctacatctgcagattcctgcacgagatccagctgaactgcgccgtgaacaagatgagcgtggacaacctggccaccgtgatcggcgtgaacctgatcagaagcaaggtggaggaccccgccgtgatcatgagaggcaccccccagatccagagagtgatgaccatgatgatcagagaccacgaggtgctgttccccaagagcaaggacatccccctgagcccccccgcccagaagaacgaccccaagaaggcccccgtggccagaagcagcgtgggctgggacgccaccgaggacctgagaatcagcagaaccgacagcttcagcagcatggtgagatgcagagagcccagctgcttccactgggtgctgcccctggtgcaggccatcccctgcaaggcctgcagcagagtggccatctggggcgtgctgggcgacgccgtggccgtgggcgccgccgccaccgacagcagcgagcacaccctgaaggcctggcccctgagcaagagcagcttctactggcacctgtag

SEQ ID NO: 97116 - DNA, 1893 bp, Artificial Sequence
  Description of Artificial Sequence: Synthetic coding sequence
atgagcctgggccagagcgcctgcctgttcctgagcatcgccagaagcagaagcgtgatgaccggcgagcagatggccgccttccaccccagcagcacccccaaccccctggagagacccatcaagatgggctggctgaagaagcagagaagcatcgtgaagaactggcagcagagctactactacaaggacgaggaggacaccaagccccagggctgcatgtacctgcccggctgcaccatcaaggagatcgccaccaaccccgaggaggccggcaagttcgtgttcgagatcatccccgccagctgggaccagaacagaatgggccaggacagctacgtgctgatggccagcagccaggccgagatggaggagtgggtgaagttcctgagaagagtggccggcaccccctgcggcgccgtgttcggccagagactggacgagaccgtggcctacgagcagaagttcggcccccacctggtgcccatcctggtggagaagtgcgccgagttcatcctggagcacggcagaaacgaggagggcatcttcagactgcccggccaggacaacctggtgaagcagctgagagacgccttcgacgccggcgagagacccagcttcgacagagacaccgacgtgcacaccgtggccagcctgctgaagctgtacctgagagacctgcccgagcccgtggtgccctggagccagtacgagggcttcctgctgtgcggccagctgaccaacgccgacgaggccaaggcccagcaggagctgatgaagcagctgagcatcctgcccagagacaactacagcctgctgagctacatctgcagattcctgcacgagatccagctgaactgcgccgtgaacaagatgagcgtggacaacctggccaccgtgatcggcgtgaacctgatcagaagcaaggtggaggaccccgccgtgatcatgagaggcaccccccagatccagagagtgatgaccatgatgatcagagaccacgaggtgctgttccccaagagcaaggacatccccctgagcccccccgcccagaagaacgaccccaagaaggcccccgtggccagaagcagcgtgggctgggacgccaccgaggacctgagaatcagcagaaccgacagcttcagcagcatgaccagcgacagcgacaccaccagccccaccggccagcagcccagcgacgccttccccgaggacagcagcaaggtgcccagagagaagcccggcgactggaagatgcagagcagaaagagaacccagaccctgcccaacagaaagtgcttcctgaccagcgccttccagggcgccaacagcagcaagatggagatcttcaagaacgagttctggagccccagcagcgaggccaaggccggcgagggccacagaagaaccatgagccaggacctgagacagctgagcgacagccagagaaccagcacctacgacaacgtgcccagcctgcccggcagccccggcgaggaggccagcgccctgagcagccaggcctgcgacagcaagggcgacaccctggccagccccaacagcgagaccggccccggcaagaagaacagcggcgaggaggagatcgacagcctgcagagaatggtgcaggagctgagaaaggagatcgagacccagaagcagatgtacgaggagcagatcaagaacctggagaaggagaactacgacgtgtgggccaaggtggtgagactgaacgaggagctggagaaggagaagaagaagagcgccgccctggagatcagcctgagaaacatggagagaagcagagaggacgtggagaagagaaacaaggccctggaggaggaggtgaaggagttcgtgaagagcatgaaggagcccaagaccgaggcctag

SEQ ID NO: 97117 - DNA, 852 bp, Artificial Sequence; identical to SEQ ID NO: 97113
  Description of Artificial Sequence: Synthetic coding sequence

SEQ ID NO: 97118 - DNA, 1821 bp, Artificial Sequence
  Description of Artificial Sequence: Synthetic coding sequence
atgagcctgaagctgcccagaaactgggacttcaacctgaaggtggaggccgccaagatcgccagaagcagaagcgtgatgaccggcgagcagatggccgccttccaccccagcagcacccccaaccccctggagagacccatcaagatgggctggctgaagaagcagagaagcatcgtgaagaactggcagcagagatacttcgtgctgagagcccagcagctgtactactacaaggacgaggaggacaccaagccccagggctgcatgtacctgcccggctgcaccatcaaggagatcgccaccaaccccgaggaggccggcaagttcgtgttcgagatcatccccgtgttcggccagagactggacgagaccgtggcctacgagcagaagttcggcccccacctggtgcccatcctggtggagaagtgcgccgagttcatcctggagcacggcagaaacgaggagggcatcttcagactgcccggccaggacaacctggtgaagcagctgagagacgccttcgacgccggcgagagacccagcttcgacagagacaccgacgtgcacaccgtggccagcctgctgaagctgtacctgagagacctgcccgagcccgtggtgccctggagccagtacgagggcttcctgctgtgcggccagctgaccaacgccgacgaggccaaggcccagcaggagctgatgaagcagctgagcatcctgcccagagacaactacagcctgctgagctacatctgcagattcctgcacgagatccagctgaactgcgccgtgaacaagatgagcgtggacaacctggccaccgtgatcggcgtgaacctgatcagaagcaaggtggaggaccccgccgtgatcatgagaggcaccccccagatccagagagtgatgaccatgatgatcagagaccacgaggtgctgttccccaagagcaaggacatccccctgagcccccccgcccagaagaacgaccccaagaaggcccccgtggccagaagcagcgtgggctgggacgccaccgaggacctgagaatcagcagaaccgacagcttcagcagcatgaccagcgacagcgacaccaccagccccaccggccagcagcccagcgacgccttccccgaggacagcagcaaggtgcccagagagaagcccggcgactggaagatgcagagcagaaagagaacccagaccctgcccaacagaaagtgcttcctgaccagcgccttccagggcgccaacagcagcaagatggagatcttcaagaacgagttctggagccccagcagcgaggccaaggccggcgagggccacagaagaaccatgagccaggacctgagacagctgagcgacagccagagaaccagcacctacgacaacgtgcccagcctgcccggcagccccggcgaggaggccagcgccctgagcagccaggcctgcgacagcaagggcgacaccctggccagccccaacagcgagaccggccccggcaagaagaacagcggcgaggaggagatcgacagcctgcagagaatggtgcaggagctgagaaaggagatcgagacccagaagcagatgtacgaggagcagatcaagaacctggagaaggagaactacgacgtgtgggccaaggtggtgagactgaacgaggagctggagaaggagaagaagaagagcgccgccctggagatcagcctgagaaacatggagagaagcagagaggacgtggagaagagaaacaaggccctggaggaggaggtgaaggagttcgtgaagagcatgaaggagcccaagaccgaggcctag

SEQ ID NO: 97119 - DNA, 2445 bp, Artificial Sequence
  Description of Artificial Sequence: Synthetic coding sequence
atgggcctgcccgccctggagttcagcgactgctgcctggacagcccccacttcagagagaccctgaagagccacgaggccgagctggacaagaccaacaagttcatcaaggagctgatcaaggacggcaagagcctgatcagcgccctgaagaacctgagcagcgccaagagaaagttcgccgacagcctgaacgagttcaagttccagtgcatcggcgacgccgagaccgacgacgagatgtgcatcgccagaagcctgcaggagttcgccaccgtgctgagaaacctggaggacgagagaatcagaatgatcgagaacgccagcgaggtgctgatcacccccctggagaagttcagaaaggagcagatcggcgccgccaaggaggccaagaagaagtacgacaaggagaccgagaagtactgcggcatcctggagaagcacctgaacctgagcagcaagaagaaggagagccagctgcaggaggccgacagccaggtggacctggtgagacagcacttctacgaggtgagcctggagtacgtgttcaaggtgcaggaggtgcaggagagaaagatgttcgagttcgtggagcccctgctggccttcctgcagggcctgttcaccttctaccaccacggctacgagctggccaaggacttcggcgacttcaagacccagctgaccatcagcatccagaacaccagaaacagattcgagggcaccagaagcgaggtggagagcctgatgaagaagatgaaggagaaccccctggagcacaagaccatcagcccctacaccatggagggctacctgtacgtgcaggagaagagacacttcggcaccagctgggtgaagcactactgcacctaccagagagacagcaagcagatcaccatggtgcccttcgaccagaagagcggcggcaagggcggcgaggacgagagcgtgatcctgaagagctgcaccagaagaaagaccgacagcatcgagaagagattctgcttcgacgtggaggccgtggacagacccggcgtgatcaccatgcaggccctgagcgaggaggacagaagactgtggatggaggccatggacggcagagagcccgtgtacaacagcaacaaggacagccagagcgagggcaccgcccagctggacagcatcggcttcagcatcatcagaaagtgcatccacgccgtggagaccagaggcatcaacgagcagggcctgtacagaatcgtgggcgtgaacagcagagtgcagaagctgctgagcgtgctgatggaccccaagaccgccagcgagaccgagaccgacatctgcgccgagtgggagatcaagaccatcaccagcgccctgaagacctacctgagaatgctgcccggccccctgatgatgtaccagttccagagaagcttcatcaaggccgccaagctggagaaccaggagagcagagtgagcgagatccacagcctggtgcacagactgcccgagaagaacagacagatgctgcagctgctgatgaaccacctggccaacgtggccaacaaccacaagcagaacctgatgaccgtggccaacctgggcgtggtgttcggccccaccctgctgagaccccaggaggagaccgtggccgccatcatggacatcaagttccagaacatcgtgatcgagatcctgatcgagaaccacgagaagatcttcaacaccgtgcccgacatgcccctgaccaacgcccagctgcacctgagcagaaagaagagcagcgacagcaagccccccagctgcagcgagagacccctgaccctgttccacaccgtgcagagcaccgagaagcaggagcagagaaacagcatcatcaacagcagcctggagagcgtgagcagcaaccccaacagcatcctgaacagcagcagcagcctgcagcccaacatgaacagcagcgaccccgacctggccgtggtgaagcccaccagacccaacagcctgccccccaaccccagccccaccagccccctgagccccagctggcccatgttcagcgcccccagcagccccatgcccaccagcagcaccagcagcgacagcagccccgtgagaagcgtggccggcttcgtgtggttcagcgtggccgccgtggtgctgagcctggccagaagcagcctgcacgccgtgttcagcctgctggtgaacttcgtgccctgccaccccaacctgcacctgctgttcgacagacccgaggaggccgtgcacgaggacagcagcacccccttcagaaaggccaaggccctgtacgcctgcaaggccgagcacgacagcgagctgagcttcaccgccggcaccgtgttcgacaacgtgcaccccagccaggagcccggctggctggagggcaccctgaacggcaagaccggcctgatccccgagaactacgtggagttcctgtag

SEQ ID NO: 97120 - DNA, 2280 bp, Artificial Sequence
  Description of Artificial Sequence: Synthetic coding sequence
atgggcctgcccgccctggagttcagcgactgctgcctggacagcccccacttcagagagaccctgaagagccacgaggccgagctggacaagaccaacaagttcatcaaggagctgatcaaggacggcaagagcctgatcagcgccctgaagaacctgagcagcgccaagagaaagttcgccgacagcctgaacgagttcaagttccagtgcatcggcgacgccgagaccgacgacgagatgtgcatcgccagaagcctgcaggagttcgccaccgtgctgagaaacctggaggacgagagaatcagaatgatcgagaacgccagcgaggtgctgatcacccccctggagaagttcagaaaggagcagatcggcgccgccaaggaggccaagaagaagtacgacaaggagaccgagaagtactgcggcatcctggagaagcacctgaacctgagcagcaagaagaaggagagccagctgcaggaggccgacagccaggtggacctggtgagacagcacttctacgaggtgagcctggagtacgtgttcaaggtgcaggaggtgcaggagagaaagatgttcgagttcgtggagcccctgctggccttcctgcagggcctgttcaccttctaccaccacggctacgagctggccaaggacttcggcgacttcaagacccagctgaccatcagcatccagaacaccagaaacagattcgagggcaccagaagcgaggtggagagcctgatgaagaagatgaaggagaaccccctggagcacaagaccatcagcccctacaccatggagggctacctgtacgtgcaggagaagagacacttcggcaccagctgggtgaagcactactgcacctaccagagagacagcaagcagatcaccatggtgcccttcgaccagaagagcggcggcaagggcggcgaggacgagagcgtgatcctgaagagctgcaccagaagaaagaccgacagcatcgagaagagattctgcttcgacgtggaggccgtggacagacccggcgtgatcaccatgcaggccctgagcgaggaggacagaagactgtggatggaggccatggacggcagagagcccgtgtacaacagcaacaaggacagccagagcgagggcaccgcccagctggacagcatcggcttcagcatcatcagaaagtgcatccacgccgtggagaccagaggcatcaacgagcagggcctgtacagaatcgtgggcgtgaacagcagagtgcagaagctgctgagcgtgctgatggaccccaagaccgccagcgagaccgagaccgacatctgcgccgagtgggagatcaagaccatcaccagcgccctgaagacctacctgagaatgctgcccggccccctgatgatgtaccagttccagagaagcttcatcaaggccgccaagctggagaaccaggagagcagagtgagcgagatccacagcctggtgcacagactgcccgagaagaacagacagatgctgcagctgctgatgaaccacctggccaacgtggccaacaaccacaagcagaacctgatgaccgtggccaacctgggcgtggtgttcggccccaccctgctgagaccccaggaggagaccgtggccgccatcatggacatcaagttccagaacatcgtgatcgagatcctgatcgagaaccacgagaagatcttcaacaccgtgcccgacatgcccctgaccaacgcccagctgcacctgagcagaaagaagagcagcgacagcaagccccccagctgcagcgagagacccctgaccctgttccacaccgtgcagagcaccgagaagcaggagcagagaaacagcatcatcaacagcagcctggagagcgtgagcagcaaccccaacagcatcctgaacagcagcagcagcctgcagcccaacatgaacagcagcgaccccgacctggccgtggtgaagcccaccagacccaacagcctgccccccaaccccagccccaccagccccctgagccccagctggcccatgttcagcgcccccagcagccccatgcccaccagcagcaccagcagcgacagcagccccgtgagcacccccttcagaaaggccaaggccctgtacgcctgcaaggccgagcacgacagcgagctgagcttcaccgccggcaccgtgttcgacaacgtgcaccccagccaggagcccggctggctggagggcaccctgaacggcaagaccggcctgatccccgagaactacgtggagttcctgtag

SEQ ID NO: 97121 - DNA, 885 bp, Artificial Sequence
  Description of Artificial Sequence: Synthetic coding sequence
tgacccaagaccgccagcgagaccgagaccgacatctgcgccgagtgggagatcaagaccatcaccagcgccctgaagacctacctgagaatgctgcccggccccctgatgatgtaccagttccagagaagcttcatcaaggccgccaagctggagaaccaggagagcagagtgagcgagatccacagcctggtgcacagactgcccgagaagaacagacagatgctgcagctgctgatgaaccacctggccaacgtggccaacaaccacaagcagaacctgatgaccgtggccaacctgggcgtggtgttcggccccaccctgctgagaccccaggaggagaccgtggccgccatcatggacatcaagttccagaacatcgtgatcgagatcctgatcgagaaccacgagaagatcttcaacaccgtgcccgacatgcccctgaccaacgcccagctgcacctgagcagaaagaagagcagcgacagcaagccccccagctgcagcgagagacccctgaccctgttccacaccgtgcagagcaccgagaagcaggagcagagaaacagcatcatcaacagcagcctggagagcgtgagcagcaaccccaacagcatcctgaacagcagcagcagcctgcagcccaacatgaacagcagcgaccccgacctggccgtggtgaagcccaccagacccaacagcctgacccccttcagaaaggccaaggccctgtacgcctgcaaggccgagcacgacagcgagctgagcttcaccgccggcaccgtgttcgacaacgtgcaccccagccaggagcccggctggctggagggcaccctgaacggcaagaccggcctgatccccgagaactacgtggagttcctgtag

SEQ ID NO: 97122 - DNA, 861 bp, Artificial Sequence
  Description of Artificial Sequence: Synthetic coding sequence
atggaccccaagaccgccagcgagaccgagaccgacatctgcgccgagtgggagatcaagaccatcaccagcgccctgaagacctacctgagaatgctgcccggccccctgatgatgtaccagttccagagaagcttcatcaaggccgccaagctggagaaccaggagagcagagtgagcgagatccacagcctggtgcacagactgcccgagaagaacagacagatgctgcagctgctgatgaaccacctggccaacgtggccaacaaccacaagcagaacctgatgaccgtggccaacctgggcgtggtgttcggccccaccctgctgagaccccaggaggagaccgtggccgccatcatggacatcaagttccagaacatcgtgatcgagatcctgatcgagaaccacgagaagatcttcaacaccgtgcccgacatgcccctgaccaacgcccagctgcacctgagcagaaagaagagcagcgacagcaagccccccagctgcagcgagagacccctgaccctgttccacaccgtgcagagcaccgagaagcaggagcagagaaacagcatcatcaacagcagcctggagagcgtgagcagcaaccccaacagcatcctgaacagcagcagcagcctgcagcccaacatgaacagcagcgaccccgacctggccgtggtgaagcccaccagacccaacagcctgccccccaaccccagccccaccagccccctgagccccagctggcccatgttcagcgcccccagcagccccatgcccaccagcagcaccagcagcgacagcagccccagaatcacctggagcagcagcaacagaggcccccagcagaactgctag

SEQ ID NO: 97123 - DNA, 1167 bp, Artificial Sequence
  Description of Artificial Sequence: Synthetic coding sequence
tgagcccagctggacagcatcggcttcagcatcatcagaaagtgcatccacgccgtggagaccagaggcatcaacgagcagggcctgtacagaatcgtgggcgtgaacagcagagtgcagaagctgctgagcgtgctgatggaccccaagaccgccagcgagaccgagaccgacatctgcgccgagtgggagatcaagaccatcaccagcgccctgaagacctacctgagaatgctgcccggccccctgatgatgtaccagttccagagaagcttcatcaaggccgccaagctggagaaccaggagagcagagtgagcgagatccacagcctggtgcacagactgcccgagaagaacagacagatgctgcagctgctgatgaaccacctggccaacgtggccaacaaccacaagcagaacctgatgaccgtggccaacctgggcgtggtgttcggccccaccctgctgagaccccaggaggagaccgtggccgccatcatggacatcaagttccagaacatcgtgatcgagatcctgatcgagaaccacgagaagatcttcaacaccgtgcccgacatgcccctgaccaacgcccagctgcacctgagcagaaagaagagcagcgacagcaagccccccagctgcagcgagagacccctgaccctgttccacaccgtgcagagcaccgagaagcaggagcagagaaacagcatcatcaacagcagcctggagagcgtgagcagcaaccccaacagcatcctgaacagcagcagcagcctgcagcccaacatgaacagcagcgaccccgacctggccgtggtgaagcccaccagacccaacagcctgccccccaaccccagccccaccagccccctgagccccagctggcccatgttcagcgcccccagcagccccatgcccaccagcagcaccagcagcgacagcagccccgtgagacccgaggaggccgtgcacgaggacagcagcacccccttcagaaaggccaaggccctgtacgcctgcaaggccgagcacgacagcgagctgagcttcaccgccggcaccgtgttcgacaacgtgcaccccagccaggagcccggctggctggagggcaccctgaacggcaagaccggcctgatccccgagaactacgtggagttcctgtag

SEQ ID NO: 97124 - DNA, 792 bp, Artificial Sequence
  Description of Artificial Sequence: Synthetic coding sequence
atggccgccgacgtggtgggcgacgtgtacgtgctggtggagcaccccttcgagtacaccggcaaggacggcagaagagtggccatcagacccaacgagagatacagactgctgagaagaagcaccgagcactggtggcacgtgagaagagagcccggcggcagacccttctacctgcccgcccagtacgtgagagagctgcccgccctgggcaaccccgccgccgccgccccccccggcccccaccccagccccgccgcccccgagcccctggcctacgactacagattcgtgagcgccgccgccaccgccggccccgacggcgcccccgaggagagcggcggcagagccagcagcctgtgcggccccgcccagagaggcgccgccacccagagaagcagcctggcccccggcctgcccgcctgcctgtacctgagacccgccgcccccgtgagacccgcccagagcctgaacgacctggcctgcgccgccgtgagcccccccgccggcctgctgggcagcagcggcagcttcaaggcctgcagcgtggccggcagctgggtgtgccccagacccctggccagaagcgacagcgagaacgtgtacgaggtgatccaggacctgcacgtgcccccccccgaggagagcgccgagcaggtgccccccagagccctgggcagaggcggcggctggagagccagagacagagccagaaccgagcccggcagaaaggagaccagaagcgcccagagaagagccagaagaccccccctgagcgaggacttcggctag

SEQ ID NO: 97125 - DNA, 1647 bp, Artificial Sequence
  Description of Artificial Sequence: Synthetic coding sequence
atgcagcccggcctgagccccggcagccccggcgaccccagaccccccacccccgagaccgactaccccgagagcctgaccagctaccccgaggaggactacagccccgtgggcagcttcggcgagcccggccccaccagccccctgaccaccccccccggctggagctgccacgtgagccaggacaagcagatgctgtacaccaaccacttcacccaggagcagtgggtgagactggaggacccccacggcaagccctacttctacaaccccgaggacagcagcgtgagatgggagctgccccaggtgcccgtgcccgcccccagaagcatccacaagagcagccaggacggcgacacccccgcccaggccagcccccccgaggagaaggtgcccgccgagctggacgaggtgggcagctgggaggaggtgagccccgccaccgccgccgtgagaaccaagaccctggacaaggccggcgtgctgcacagaaccaagaccgccgacaagggcaagagactgagaaagaagcactggagcgccagctggaccgtgctggagggcggcgtgctgaccttcttcaaggacagcaagaccagcgccgccggcggcctgagacagcccagcaagttcagcacccccgagtacaccgtggagctgagaggcgccaccctgagctgggcccccaaggacaagagcagcagaaagaacgtgctggagctgagaagcagagacggcagcgagtacctgatccagcacgacagcgaggccatcatcagcacctggcacaaggccatcgcccagggcatccaggagctgagcgccgagctgccccccgaggagagcgagagcagcagagtggacttcggcagcagcgagagactgggcagctggcaggagaaggaggaggacgccagacccaacgccgccgcccccgccctgggccccgtgggcctggagagcgacctgagcaaggtgagacacaagctgagaaagttcctgcagagaagacccaccctgcagagcctgagagagaagggctacatcaaggaccaggtgttcggctgcgccctggccgccctgtgcgagagagagagaagcagagtgcccagattcgtgcagcagtgcatcagagccgtggaggccagaggcctggacatcgacggcctgtacagaatcagcggcaacctggccaccatccagaagctgagatacaaggtggaccacgacgagagactggacctggacgacggcagatgggaggacgtgcacgtgatcaccggcgccctgaagctgttcttcagagagctgcccgagcccctgttccccttcagccacttcagacagttcatcgccgccatcaagctgcaggaccaggccagaagaagcagatgcgtgagagacctggtgagaagcctgcccgcccccaaccacgacaccctgagaatgctgttccagcacctgtgcagagtgatcgagcacggcgagcagaacagaatgagcgtgcagagcgtggccatcgtgttcggccccaccctgctgagacccgaggtggaggagaccagcatgcccatgaccatggtgttccagaaccaggtggtggagctgatcctgcagcagtgcgccgacatcttccccccccactag

SEQ ID NO: 97126 - DNA, 2670 bp, Artificial Sequence
  Description of Artificial Sequence: Synthetic coding sequence
atggccgccgacgtggtgggcgacgtgtacgtgctggtggagcaccccttcgagtacaccggcaaggacggcagaagagtggccatcagacccaacgagagatacagactgctgagaagaagcaccgagcactggtggcacgtgagaagagagcccggcggcagacccttctacctgcccgcccagtacgtgagagagctgcccgccctgggcaaccccgccgccgccgccccccccggcccccaccccagccccgccgcccccgagcccctggcctacgactacagattcgtgagcgccgccgccaccgccggccccgacggcgcccccgaggagagcggcggcagagccagcagcctgtgcggccccgcccagagaggcgccgccacccagagaagcagcctggcccccggcctgcccgcctgcctgtacctgagacccgccgcccccgtgagacccgcccagagcctgaacgacctggcctgcgccgccgtgagcccccccgccggcctgctgggcagcagcggcagcttcaaggcctgcagcgtggccggcagctgggtgtgccccagacccctggccagaagcgacagcgagaacgtgtacgaggtgatccaggacctgcacgtgcccccccccgaggagagcgccgagcaggtggacgacccccccgagcccgtgtacgccaacatcgagagacagcccagagccaccagccccggcgccgccgccgcccccctgcccagccccgtgtgggagacccacaccgacgccggcaccggcagaccctactactacaaccccgacaccggcgtgaccacctgggagagccccttcgaggccgccgagggcgccgccagccccgccaccagccccgccagcgtggacagccacgtgagcctggagaccgagtggggccagtactgggacgaggagagcagaagagtgttcttctacaaccccctgaccggcgagaccgcctgggaggacgaggccgagaacgagcccgaggaggagctggagatgcagcccggcctgagccccggcagccccggcgaccccagaccccccacccccgagaccgactaccccgagagcctgaccagctaccccgaggaggactacagccccgtgggcagcttcggcgagcccggccccaccagccccctgaccaccccccccggctggagctgccacgtgagccaggacaagcagatgctgtacaccaaccacttcacccaggagcagtgggtgagactggaggacccccacggcaagccctacttctacaaccccgaggacagcagcgtgagatgggagctgccccaggtgcccgtgcccgcccccagaagcatccacaagagcagccaggacggcgacacccccgcccaggccagcccccccgaggagaaggtgcccgccgagctggacgaggtgggcagctgggaggaggtgagccccgccaccgccgccgtgagaaccaagaccctggacaaggccggcgtgctgcacagaaccaagaccgccgacaagggcaagagactgagaaagaagcactggagcgccagctggaccgtgctggagggcggcgtgctgaccttcttcaaggacagcaagaccagcgccgccggcggcctgagacagcccagcaagttcagcacccccgagtacaccgtggagctgagaggcgccaccctgagctgggcccccaaggacaagagcagcagaaagaacgtgctggagctgagaagcagagacggcagcgagtacctgatccagcacgacagcgaggccatcatcagcacctggcacaaggccatcgcccagggcatccaggagctgagcgccgagctgccccccgaggagagcgagagcagcagagtggacttcggcagcagcgagagactgggcagctggcaggagaaggaggaggacgccagacccaacgccgccgcccccgccctgggccccgtgggcctggagagcgacctgagcaaggtgagacacaagctgagaaagttcctgcagagaagacccaccctgcagagcctgagagagaagggctacatcaaggaccaggtgttcggctgcgccctggccgccctgtgcgagagagagagaagcagagtgcccagattcgtgcagcagtgcatcagagccgtggaggccagaggcctggacatcgacggcctgtacagaatcagcggcaacctggccaccatccagaagctgagatacaaggtggaccacgacgagagactggacctggacgacggcagatgggaggacgtgcacgtgatcaccggcgccctgaagctgttcttcagagagctgcccgagcccctgttccccttcagccacttcagacagttcatcgccgccatcaagctgcaggaccaggccagaagaagcagatgcgtgagagacctggtgagaagcctgcccgcccccaaccacgacaccctgagaatgctgttccagcacctgtgcagagtgatcgagcacggcgagcagaacagaatgagcgtgcagagcgtggccatcgtgttcggccccaccctgctgagacccgaggtggaggagaccagcatgcccatgaccatggtgttccagaaccaggtggtggagctgatcctgcagcagtgcgccgacatcttccccccccactag

SEQ ID NO: 97127 - DNA, 2589 bp, Artificial Sequence
  Description of Artificial Sequence: Synthetic coding sequence
atggccgccgacgtggtgggcgacgtgtacgtgctggtggagcaccccttcgagtacaccggcaaggacggcagaagagtggccatcagacccaacgagagatacagactgctgagaagaagcaccgagcactggtggcacgtgagaagagagcccggcggcagacccttctacctgcccgcccagtacgtgagagagctgcccgccctgggcaaccccgccgccgccgccccccccggcccccaccccagccccgccgcccccgagcccctggcctacgactacagattcgtgagcgccgccgccaccgccggccccgacggcgcccccgaggagagcggcggcagagccagcagcctgtgcggccccgcccagagaggcgccgccacccagagaagcagcctggcccccggcctgcccgcctgcctgtacctgagacccgccgcccccgtgagacccgcccagagcctgaacgacctggcctgcgccgccgtgagcccccccgccggcctgctgggcagcagcggcagcttcaaggcctgcagcgtggccggcagctgggtgtgccccagacccctggccagaagcgacagcgagaacgtgtacgaggtgatccaggacctgcacgtgcccccccccgaggagagcgccgagcaggtggacgacccccccgagcccgtgtacgccaacatcgagagacagcccagagccaccagccccggcgccgccgccgcccccctgcccagccccgtgtgggagacccacaccgacgccggcaccggcagaccctactactacaaccccgacaccggcgtgaccacctgggagagccccttcgaggccgccgagggcgccgccagccccgccaccagccccgccagcgtggacagccacgtgagcctggagaccgagtggggccagtactgggacgaggagagcagaagagtgttcttctacaaccccctgaccggcgagaccgcctgggaggacgaggccgagaacgagcccgaggaggagctggagatgcagcccggcctgagccccggcagccccggcgaccccagaccccccacccccgagaccgactaccccgagagcctgaccagctaccccgaggaggactacagccccgtgggcagcttcggcgagcccggccccaccagccccctgaccaccccccccggctggagctgccacgtgagccaggacaagcagatgctgtacaccaaccacttcacccaggagcaggtgcccgtgcccgcccccagaagcatccacaagagcagccaggacggcgacacccccgcccaggccagcccccccgaggagaaggtgcccgccgagctggacgaggtgggcagctgggaggaggtgagccccgccaccgccgccgtgagaaccaagaccctggacaaggccggcgtgctgcacagaaccaagaccgccgacaagggcaagagactgagaaagaagcactggagcgccagctggaccgtgctggagggcggcgtgctgaccttcttcaaggacagcaagaccagcgccgccggcggcctgagacagcccagcaagttcagcacccccgagtacaccgtggagctgagaggcgccaccctgagctgggcccccaaggacaagagcagcagaaagaacgtgctggagctgagaagcagagacggcagcgagtacctgatccagcacgacagcgaggccatcatcagcacctggcacaaggccatcgcccagggcatccaggagctgagcgccgagctgccccccgaggagagcgagagcagcagagtggacttcggcagcagcgagagactgggcagctggcaggagaaggaggaggacgccagacccaacgccgccgcccccgccctgggccccgtgggcctggagagcgacctgagcaaggtgagacacaagctgagaaagttcctgcagagaagacccaccctgcagagcctgagagagaagggctacatcaaggaccaggtgttcggctgcgccctggccgccctgtgcgagagagagagaagcagagtgcccagattcgtgcagcagtgcatcagagccgtggaggccagaggcctggacatcgacggcctgtacagaatcagcggcaacctggccaccatccagaagctgagatacaaggtggaccacgacgagagactggacctggacgacggcagatgggaggacgtgcacgtgatcaccggcgccctgaagctgttcttcagagagctgcccgagcccctgttccccttcagccacttcagacagttcatcgccgccatcaagctgcaggaccaggccagaagaagcagatgcgtgagagacctggtgagaagcctgcccgcccccaaccacgacaccctgagaatgctgttccagcacctgtgcagagtgatcgagcacggcgagcagaacagaatgagcgtgcagagcgtggccatcgtgttcggccccaccctgctgagacccgaggtggaggagaccagcatgcccatgaccatggtgttccagaaccaggtggtggagctgatcctgcagcagtgcgccgacatcttccccccccactag

SEQ ID NO: 97128 - DNA, 1647 bp, Artificial Sequence; identical to SEQ ID NO: 97125
  Description of Artificial Sequence: Synthetic coding sequence

SEQ ID NO: 97129 - DNA, 792 bp, Artificial Sequence; identical to SEQ ID NO: 97124
  Description of Artificial Sequence: Synthetic coding sequence

SEQ ID NO: 97130 - DNA, 1566 bp, Artificial Sequence
  Description of Artificial Sequence: Synthetic coding sequence
atgcagcccggcctgagccccggcagccccggcgaccccagaccccccacccccgagaccgactaccccgagagcctgaccagctaccccgaggaggactacagccccgtgggcagcttcggcgagcccggccccaccagccccctgaccaccccccccggctggagctgccacgtgagccaggacaagcagatgctgtacaccaaccacttcacccaggagcaggtgcccgtgcccgcccccagaagcatccacaagagcagccaggacggcgacacccccgcccaggccagcccccccgaggagaaggtgcccgccgagctggacgaggtgggcagctgggaggaggtgagccccgccaccgccgccgtgagaaccaagaccctggacaaggccggcgtgctgcacagaaccaagaccgccgacaagggcaagagactgagaaagaagcactggagcgccagctggaccgtgctggagggcggcgtgctgaccttcttcaaggacagcaagaccagcgccgccggcggcctgagacagcccagcaagttcagcacccccgagtacaccgtggagctgagaggcgccaccctgagctgggcccccaaggacaagagcagcagaaagaacgtgctggagctgagaagcagagacggcagcgagtacctgatccagcacgacagcgaggccatcatcagcacctggcacaaggccatcgcccagggcatccaggagctgagcgccgagctgccccccgaggagagcgagagcagcagagtggacttcggcagcagcgagagactgggcagctggcaggagaaggaggaggacgccagacccaacgccgccgcccccgccctgggccccgtgggcctggagagcgacctgagcaaggtgagacacaagctgagaaagttcctgcagagaagacccaccctgcagagcctgagagagaagggctacatcaaggaccaggtgttcggctgcgccctggccgccctgtgcgagagagagagaagcagagtgcccagattcgtgcagcagtgcatcagagccgtggaggccagaggcctggacatcgacggcctgtacagaatcagcggcaacctggccaccatccagaagctgagatacaaggtggaccacgacgagagactggacctggacgacggcagatgggaggacgtgcacgtgatcaccggcgccctgaagctgttcttcagagagctgcccgagcccctgttccccttcagccacttcagacagttcatcgccgccatcaagctgcaggaccaggccagaagaagcagatgcgtgagagacctggtgagaagcctgcccgcccccaaccacgacaccctgagaatgctgttccagcacctgtgcagagtgatcgagcacggcgagcagaacagaatgagcgtgcagagcgtggccatcgtgttcggccccaccctgctgagacccgaggtggaggagaccagcatgcccatgaccatggtgttccagaaccaggtggtggagctgatcctgcagcagtgcgccgacatcttccccccccactag

SEQ ID NO: 97131 - DNA, 2013 bp, Artificial Sequence
  Description of Artificial Sequence: Synthetic coding sequence
atgctgagcaacgagagcctgcacccccccgccttcagcagaagcaacagcgaggccagcgtggacagcgccagcatggaggacttctggagagagatcgagagcatcaaggacagcagcatgggcggccaggaggagcccccccccgccgaggtgacccccgtggacgagggcgagctggaggccgagtggctgcaggacgtgggcctgagcaccctgatcagcggcgacgaggaggaggacggcaaggccctgctgagcaccctgaccagaacccaggccgccgccgtgcagaagagataccacacctacacccagaccatgagaaagaaggacaagcagagcatcagagacgtgagagacatcttcggcgtgagcgagagcccccccagagacacctgcggcaaccacaccaaccagctggacggcaccaaggaggagagagagctgcccagagtgatcaagaccagcggcagcatgcccgacgacgccagcctgaacagcaccaccctgagcgacgccagccaggacaaggagggcagcttcgccgtgcccagaagcgacagcgtggccatcctggagaccatccccgtgctgcccgtgcacagcaacggcagccccgagcccggccagcccgtgcagaacgccatcagcgacgacgacttcctggagaagaacatcccccccgaggccgaggagctgagcttcgaggtgagctacagcgagatggtgaccgaggccctgaagagaaacaagctgaagaagagcgagatcaagaaggaggactacgtgctgaccaagttcaacgtgcagaagaccagattcggcctgaccgaggccggcgacctgagcgccgaggacatgaagaagatcagacacctgagcctgatcgagctgaccgccttcttcgacgccttcggcatccagctgaagagaaacaagaccgagaaggtgaagggcagagacaacggcatcttcggcgtgcccctgaccgtgctgctggacggcgacagaaagaaggaccccggcgtgaaggtgcccctggtgctgcagaagttcttcgagaaggtggaggagagcggcctggagagcgagggcatcttcagactgagcggctgcaccgccaaggtgaagcagtacagagaggagctggacgccaagttcaacgccgacaagttcaagtgggacaagatgtgccacagagaggccgccgtgatgctgaaggccttcttcagagagctgcccaccagcctgttccccgtggagtacatccccgccttcatcagcctgatggagagaggcccccacgtgaaggtgcagttccaggccctgcacctgatggtgatggccctgcccgacgccaacagagacgccgcccaggccctgatgaccttcttcaacaaggtgatcgccaacgagagcaagaacagaatgagcctgtggaacatcagcaccgtgatggcccccaacctgttcttcagcagaagcaagcacagcgactacgaggagctgctgctggccaacaccgccgcccacatcatcagactgatgctgaagtaccagaagatcctgtggaaggtgcccagcttcctgatcacccaggtgagaagaatgaacgaggccaccatgctgctgaagaagcagctgcccagcgtgagaaagctgctgagaagaaagaccctggagagagagaccgccagccccaagaccagcaaggtgctgcagaagagccccagcgccagaagaatgagcgacgtgcccgagggcgtgatcagagtgcacgcccccctgctgagcaaggtgagcatggccatccagctgaacaaccagaccaaggccaaggacatcctggccaagttccagtacgagaacagaatcctgcactggcagagagccgccctgagcttcctgaacggcaagtgggtgaagaaggagagagaggagagcaccgagaccaacagaagccccaagcacgtgttcctgttcaccatcggcctggacatcagcacctag

SEQ ID NO: 97132 - DNA, 1713 bp, Artificial Sequence
  Description of Artificial Sequence: Synthetic coding sequence
atgagaaagaaggacaagcagagcatcagagacgtgagagacatcttcggcgtgagcgagagcccccccagagacacctgcggcaaccacaccaaccagctggacggcaccaaggaggagagagagctgcccagagtgatcaagaccagcggcagcatgcccgacgacgccagcctgaacagcaccaccctgagcgacgccagccaggacaaggagggcagcttcgccgtgcccagaagcgacagcgtggccatcctggagaccatccccgtgctgcccgtgcacagcaacggcagccccgagcccggccagcccgtgcagaacgccatcagcgacgacgacttcctggagaagaacatcccccccgaggccgaggagctgagcttcgaggtgagctacagcgagatggtgaccgaggccctgaagagaaacaagctgaagaagagcgagatcaagaaggaggactacgtgctgaccaagttcaacgtgcagaagaccagattcggcctgaccgaggccggcgacctgagcgccgaggacatgaagaagatcagacacctgagcctgatcgagctgaccgccttcttcgacgccttcggcatccagctgaagagaaacaagaccgagaaggtgaagggcagagacaacggcatcttcggcgtgcccctgaccgtgctgctggacggcgacagaaagaaggaccccggcgtgaaggtgcccctggtgctgcagaagttcttcgagaaggtggaggagagcggcctggagagcgagggcatcttcagactgagcggctgcaccgccaaggtgaagcagtacagagaggagctggacgccaagttcaacgccgacaagttcaagtgggacaagatgtgccacagagaggccgccgtgatgctgaaggccttcttcagagagctgcccaccagcctgttccccgtggagtacatccccgccttcatcagcctgatggagagaggcccccacgtgaaggtgcagttccaggccctgcacctgatggtgatggccctgcccgacgccaacagagacgccgcccaggccctgatgaccttcttcaacaaggtgatcgccaacgagagcaagaacagaatgagcctgtggaacatcagcaccgtgatggcccccaacctgttcttcagcagaagcaagcacagcgactacgaggagctgctgctggccaacaccgccgcccacatcatcagactgatgctgaagtaccagaagatcctgtggaaggtgcccagcttcctgatcacccaggtgagaagaatgaacgaggccaccatgctgctgaagaagcagctgcccagcgtgagaaagctgctgagaagaaagaccctggagagagagaccgccagccccaagaccagcaaggtgctgcagaagagccccagcgccagaagaatgagcgacgtgcccgagggcgtgatcagagtgcacgcccccctgctgagcaaggtgagcatggccatccagctgaacaaccagaccaaggccaaggacatcctggccaagttccagtacgagaacagccacggcagcagcgagtgcatcaagatccagaaccagagactgtacgagatcggcggcaacatcggcgagcactgcctggaccccgacgcctacatcctggacgtgtacagaatcaacccccaggccgagtgggtgatcaagccccagcagagcagctag

SEQ ID NO: 97133 - DNA, 1638 bp, Artificial Sequence
  Description of Artificial Sequence: Synthetic coding sequence
atgaacgagctgcccagagacacctgcggcaaccacaccaaccagctggacggcaccaaggaggagagagagctgcccagagtgatcaagaccagcggcagcatgcccgacgacgccagcctgaacagcaccaccctgagcgacgccagccaggacaaggagggcagcttcgccgtgcccagaagcgacagcgtggccatcctggagaccatccccgtgctgcccgtgcacagcaacggcagccccgagcccggccagcccgtgcagaacgccatcagcgacgacgacttcctggagaagaacatcccccccgaggccgaggagctgagcttcgaggtgagctacagcgagatggtgaccgaggccctgaagagaaacaagctgaagaagagcgagatcaagaaggaggactacgtgctgaccaagttcaacgtgcagaagaccagattcggcctgaccgaggccggcgacctgagcgccgaggacatgaagaagatcagacacctgagcctgatcgagctgaccgccttcttcgacgccttcggcatccagctgaagagaaacaagaccgagaaggtgaagggcagagacaacggcatcttcggcgtgcccctgaccgtgctgctggacggcgacagaaagaaggaccccggcgtgaaggtgcccctggtgctgcagaagttcttcgagaaggtggaggagagcggcctggagagcgagggcatcttcagactgagcggctgcaccgccaaggtgaagcagtacagagaggagctggacgccaagttcaacgccgacaagttcaagtgggacaagatgtgccacagagaggccgccgtgatgctgaaggccttcttcagagagctgcccaccagcctgttccccgtggagtacatccccgccttcatcagcctgatggagagaggcccccacgtgaaggtgcagttccaggccctgcacctgatggtgatggccctgcccgacgccaacagagacgccgcccaggccctgatgaccttcttcaacaaggtgatcgccaacgagagcaagaacagaatgagcctgtggaacatcagcaccgtgatggcccccaacctgttcttcagcagaagcaagcacagcgactacgaggagctgctgctggccaacaccgccgcccacatcatcagactgatgctgaagtaccagaagatcctgtggaaggtgcccagcttcctgatcacccaggtgagaagaatgaacgaggccaccatgctgctgaagaagcagctgcccagcgtgagaaagctgctgagaagaaagaccctggagagagagaccgccagccccaagaccagcaaggtgctgcagaagagccccagcgccagaagaatgagcgacgtgcccgagggcgtgatcagagtgcacgcccccctgctgagcaaggtgagcatggccatccagctgaacaaccagaccaaggccaaggacatcctggccaagttccagtacgagaacagaatcctgcactggcagagagccgccctgagcttcctgaacggcaagtgggtgaagaaggagagagaggagagcaccgagaccaacagaagccccaagcacgtgttcctgttcaccatcggcctggacatcagcacctag

SEQ ID NO: 97134 - DNA, 2169 bp, Artificial Sequence
  Description of Artificial Sequence: Synthetic coding sequence
atggaggtggaggacagcggcggcgtggtgctgaccgcctaccacagctacgccagagcccagccccccaacgccgagagcagatgcgcccccagagccgccgccagccaccccctgagcagaaagagcatccccagatgcagaagaatcaacagaatgctgagcaacgagagcctgcacccccccgccttcagcagaagcaacagcgaggccagcgtggacagcgccagcatggaggacttctggagagagatcgagagcatcaaggacagcagcatgggcggccaggaggagcccccccccgccgaggtgacccccgtggacgagggcgagctggaggccgagtggctgcaggacgtgggcctgagcaccctgatcagcggcgacgaggaggaggacggcaaggccctgctgagcaccctgaccagaacccaggccgccgccgtgcagaagagataccacacctacacccagaccatgagaaagaaggacaagcagagcatcagagacgtgagagacatcttcggcgtgagcgagagcccccccagagacacctgcggcaaccacaccaaccagctggacggcaccaaggaggagagagagctgcccagagtgatcaagaccagcggcagcatgcccgacgacgccagcctgaacagcaccaccctgagcgacgccagccaggacaaggagggcagcttcgccgtgcccagaagcgacagcgtggccatcctggagaccatccccgtgctgcccgtgcacagcaacggcagccccgagcccggccagcccgtgcagaacgccatcagcgacgacgacttcctggagaagaacatcccccccgaggccgaggagctgagcttcgaggtgagctacagcgagatggtgaccgaggccctgaagagaaacaagctgaagaagagcgagatcaagaaggaggactacgtgctgaccaagttcaacgtgcagaagaccagattcggcctgaccgaggccggcgacctgagcgccgaggacatgaagaagatcagacacctgagcctgatcgagctgaccgccttcttcgacgccttcggcatccagctgaagagaaacaagaccgagaaggtgaagggcagagacaacggcatcttcggcgtgcccctgaccgtgctgctggacggcgacagaaagaaggaccccggcgtgaaggtgcccctggtgctgcagaagttcttcgagaaggtggaggagagcggcctggagagcgagggcatcttcagactgagcggctgcaccgccaaggtgaagcagtacagagaggagctggacgccaagttcaacgccgacaagttcaagtgggacaagatgtgccacagagaggccgccgtgatgctgaaggccttcttcagagagctgcccaccagcctgttccccgtggagtacatccccgccttcatcagcctgatggagagaggcccccacgtgaaggtgcagttccaggccctgcacctgatggtgatggccctgcccgacgccaacagagacgccgcccaggccctgatgaccttcttcaacaaggtgatcgccaacgagagcaagaacagaatgagcctgtggaacatcagcaccgtgatggcccccaacctgttcttcagcagaagcaagcacagcgactacgaggagctgctgctggccaacaccgccgcccacatcatcagactgatgctgaagtaccagaagatcctgtggaaggtgcccagcttcctgatcacccaggtgagaagaatgaacgaggccaccatgctgctgaagaagcagctgcccagcgtgagaaagctgctgagaagaaagaccctggagagagagaccgccagccccaagaccagcaaggtgctgcagaagagccccagcgccagaagaatgagcgacgtgcccgagggcgtgatcagagtgcacgcccccctgctgagcaaggtgagcatggccatccagctgaacaaccagaccaaggccaaggacatcctggccaagttccagtacgagaacagaatcctgcactggcagagagccgccctgagcttcctgaacggcaagtgggtgaagaaggagagagaggagagcaccgagaccaacagaagccccaagcacgtgttcctgttcaccatcggcctggacatcagcacctag

SEQ ID NO: 97135 - DNA, 1692 bp, Artificial Sequence
  Description of Artificial Sequence: Synthetic coding sequence
atgagaaagaaggacaagcagagcatcagagacgtgagagacatcttcggcgtgagcgagagcccccccagagacacctgcggcaaccacaccaaccagctggacggcaccaaggaggagagagagctgcccagagtgatcaagaccagcggcagcatgcccgacgacgccagcctgaacagcaccaccctgagcgacgccagccaggacaaggagggcagcttcgccgtgcccagaagcgacagcgtggccatcctggagaccatccccgtgctgcccgtgcacagcaacggcagccccgagcccggccagcccgtgcagaacgccatcagcgacgacgacttcctggagaagaacatcccccccgaggccgaggagctgagcttcgaggtgagctacagcgagatggtgaccgaggccctgaagagaaacaagctgaagaagagcgagatcaagaaggaggactacgtgctgaccaagttcaacgtgcagaagaccagattcggcctgaccgaggccggcgacctgagcgccgaggacatgaagaagatcagacacctgagcctgatcgagctgaccgccttcttcgacgccttcggcatccagctgaagagaaacaagaccgagaaggtgaagggcagagacaacggcatcttcggcgtgcccctgaccgtgctgctggacggcgacagaaagaaggaccccggcgtgaaggtgcccctggtgctgcagaagttcttcgagaaggtggaggagagcggcctggagagcgagggcatcttcagactgagcggctgcaccgccaaggtgaagcagtacagagaggagctggacgccaagttcaacgccgacaagttcaagtgggacaagatgtgccacagagaggccgccgtgatgctgaaggccttcttcagagagctgcccaccagcctgttccccgtggagtacatccccgccttcatcagcctgatggagagaggcccccacgtgaaggtgcagttccaggccctgcacctgatggtgatggccctgcccgacgccaacagagacgccgcccaggccctgatgaccttcttcaacaaggtgatcgccaacgagagcaagaacagaatgagcctgtggaacatcagcaccgtgatggcccccaacctgttcttcagcagaagcaagcacagcgactacgaggagctgctgctggccaacaccgccgcccacatcatcagactgatgctgaagtaccagaagatcctgtggaaggtgcccagcttcctgatcacccaggtgagaagaatgaacgaggccaccatgctgctgaagaagcagctgcccagcgtgagaaagctgctgagaagaaagaccctggagagagagaccgccagccccaagaccagcaaggtgctgcagaagagccccagcgccagaagaatgagcgacgtgcccgagggcgtgatcagagtgcacgcccccctgctgagcaaggtgagcatggccatccagctgaacaaccagaccaaggccaaggacatcctggccaagttccagtacgagaacagaatcctgcactggcagagagccgccctgagcttcctgaacggcaagtgggtgaagaaggagagagaggagagcaccgagaccaacagaagccccaagcacgtgttcctgttcaccatcggcctggacatcagcacctag

SEQ ID NO: 97136 - DNA, 1713 bp, Artificial Sequence; identical to SEQ ID NO: 97132
  Description of Artificial Sequence: Synthetic coding sequence

SEQ ID NO: 97137 - DNA, 354 bp, Artificial Sequence
  Description of Artificial Sequence: Synthetic coding sequence
atgctgagcaacgagagcctgcacccccccgccttcagcagaagcaacagcgaggccagcgtggacagcgccagcatggaggacttctggagagagatcgagagcatcaaggacagcagcatgggcggccaggaggagcccccccccgccgaggtgacccccgtggacgagggcgagctggaggccgagtggctgcaggacgtgggcctgagcaccctgatcagcggcgacgaggaggaggacggcaaggccctgctgagcaccctgaccagaacccaggccgccgccgtgcagaagagataccacacctacacccagaccatgagaaagaaggacaagcagagcatcagatag

SEQ ID NO: 97138 - DNA, 1665 bp, Artificial Sequence
  Description of Artificial Sequence: Synthetic coding sequence
atggccttcatgagaatcaacgtgatcatgaacgagctgcccagagacacctgcggcaaccacaccaaccagctggacggcaccaaggaggagagagagctgcccagagtgatcaagaccagcggcagcatgcccgacgacgccagcctgaacagcaccaccctgagcgacgccagccaggacaaggagggcagcttcgccgtgcccagaagcgacagcgtggccatcctggagaccatccccgtgctgcccgtgcacagcaacggcagccccgagcccggccagcccgtgcagaacgccatcagcgacgacgacttcctggagaagaacatcccccccgaggccgaggagctgagcttcgaggtgagctacagcgagatggtgaccgaggccctgaagagaaacaagctgaagaagagcgagatcaagaaggaggactacgtgctgaccaagttcaacgtgcagaagaccagattcggcctgaccgaggccggcgacctgagcgccgaggacatgaagaagatcagacacctgagcctgatcgagctgaccgccttcttcgacgccttcggcatccagctgaagagaaacaagaccgagaaggtgaagggcagagacaacggcatcttcggcgtgcccctgaccgtgctgctggacggcgacagaaagaaggaccccggcgtgaaggtgcccctggtgctgcagaagttcttcgagaaggtggaggagagcggcctggagagcgagggcatcttcagactgagcggctgcaccgccaaggtgaagcagtacagagaggagctggacgccaagttcaacgccgacaagttcaagtgggacaagatgtgccacagagaggccgccgtgatgctgaaggccttcttcagagagctgcccaccagcctgttccccgtggagtacatccccgccttcatcagcctgatggagagaggcccccacgtgaaggtgcagttccaggccctgcacctgatggtgatggccctgcccgacgccaacagagacgccgcccaggccctgatgaccttcttcaacaaggtgatcgccaacgagagcaagaacagaatgagcctgtggaacatcagcaccgtgatggcccccaacctgttcttcagcagaagcaagcacagcgactacgaggagctgctgctggccaacaccgccgcccacatcatcagactgatgctgaagtaccagaagatcctgtggaaggtgcccagcttcctgatcacccaggtgagaagaatgaacgaggccaccatgctgctgaagaagcagctgcccagcgtgagaaagctgctgagaagaaagaccctggagagagagaccgccagccccaagaccagcaaggtgctgcagaagagccccagcgccagaagaatgagcgacgtgcccgagggcgtgatcagagtgcacgcccccctgctgagcaaggtgagcatggccatccagctgaacaaccagaccaaggccaaggacatcctggccaagttccagtacgagaacagaatcctgcactggcagagagccgccctgagcttcctgaacggcaagtgggtgaagaaggagagagaggagagcaccgagaccaacagaagccccaagcacgtgttcctgttcaccatcggcctggacatcagcacctag

SEQ ID NO: 97139 - DNA, 3786 bp, Artificial Sequence
  Description of Artificial Sequence: Synthetic coding sequence
atgatcgcccacaagcagaagaagaccaagaagaagagagcctgggccagcggccagctgagcaccgacatcaccaccagcgagatgggcctgaagagcctgagcagcaacagcatcttcgaccccgactacatcaaggagctggtgaacgacatcagaaagttcagccacatgctgctgtacctgaaggaggccatcttcagcgactgcttcaaggaggtgatccacatcagactggaggagctgctgagagtgctgaagagcatcatgaacaagcaccagaacctgaacagcgtggacctgcagaacgccgccgagatgctgaccgccaaggtgaaggccgtgaacttcaccgaggtgaacgaggagaacaagaacgacctgttccaggaggtgttcagcagcatcgagaccctggccttcaccttcggcaacatcctgaccaacttcctgatgggcgacgtgggcaacgacagcctgctgagactgcccgtgagcagagagaccaagagcttcgagaacgtgagcgtggagagcgtggacagcagcagcgagaagggcaacttcagccccctggagctggacaacgtgctgctgaagaacaccgacagcatcgagctggccctgagctacgccaagacctggagcaagtacaccaagaacatcgtgagctgggtggagaagaagctgaacctggagctggagagcaccagaaacatggtgaagctggccgaggccaccagaaccaacatcggcatccaggagttcatgcccctgcagagcctgttcaccaacgccctgctgaacgacatcgagagcagccacctgctgcagcagaccatcgccgccctgcaggccaacaagttcgtgcagcccctgctgggcagaaagaacgagatggagaagcagagaaaggagatcaaggagctgtggaagcaggagcagaacaagatgctggaggccgagaacgccctgaagaaggccaagctgctgtgcatgcagagacaggacgagtacgagaaggccaagagcagcatgttcagagccgaggaggagcacctgagcagcagcggcggcctggccaagaacctgaacaagcagctggagaagaagagaagactggaggaggaggccctgcagaaggtggaggaggccaacgagctgtacaaggtgtgcgtgaccaacgtggaggagagaagaaacgacctggagaacaccaagagagagatcctggcccagctgagaaccctggtgttccagtgcgacctgaccctgaaggccgtgaccgtgaacctgttccacatgcagcacctgcaggccgccagcctggccgacagcctgcagagcctgtgcgacagcgccaagctgtacgaccccggccaggagtacagcgagttcgtgaaggccaccaacagcaccgaggaggagaaggtggacggcaacgtgaacaagcacctgaacagcagccagcccagcggcttcggccccgccaacagcctggaggacgtggtgagactgcccgacagcagcaacaagatcgaggaggacagatgcagcaacagcgccgacatcaccggccccagcttcatcagaagctggaccttcggcatgttcagcgacagcgagagcaccggcggcagcagcgagagcagaagcctggacagcgagagcatcagccccggcgacttccacagaaagctgcccagaacccccagcagcggcaccatgagcagcgccgacgacctggacgagagagagccccccagccccagcgagaccggccccaacagcctgggcaccttcaagaagaccctgatgagcaaggccgccctgacccacaagttcagaaagctgagaagccccaccaagtgcagagactgcgagggcatcgtggtgttccagggcgtggagtgcgaggagtgcctgctggtgtgccacagaaagtgcctggagaacctggtgatcatctgcggccaccagaagctgcccggcaagatccacctgttcggcgccgagttcacccaggtggccaagaaggagcccgacggcatccccttcatcctgaagatctgcgccagcgagatcgagaacagagccctgtgcctgcagggcatctacagagtgtgcggcaacaagatcaagaccgagaagctgtgccaggccctggagaacggcatgcacctggtggacatcagcgagttcagcagccacgacatctgcgacgtgctgaagctgtacctgagacagctgcccgagcccttcatcctgttcagactgtacaaggagttcatcgacctggccaaggagatccagcacgtgaacgaggagcaggagaccaagaagaacagcctggaggacaagaagtggcccaacatgtgcatcgagatcaacagaatcctgctgaagagcaaggacctgctgagacagctgcccgccagcaacttcaacagcctgcacttcctgatcgtgcacctgaagagagtggtggaccacgccgaggagaacaagatgaacagcaagaacctgggcgtgatcttcggccccagcctgatcagacccagacccaccaccgcccccatcaccatcagcagcctggccgagtacagcaaccaggccagactggtggagttcctgatcacctacagccagaagatcttcgacggcagcctgcagccccaggacgtgatgtgcagcatcggcgtggtggaccagggctgcttccccaagcccctgctgagccccgaggagagagacatcgagagaagcatgaagagcctgttcttcagcagcaaggaggacatccacaccagcgagagcgagagcaagatcttcgagagagccaccagcttcgaggagagcgagagaaagcagaacgccctgggcaagtgcgacgcctgcctgagcgacaaggcccagctgctgctggaccaggaggccgagagcgccagccagaagatcgaggacggcaagacccccaagcccctgagcctgaagagcgacagaagcaccaacaacgtggagagacacacccccagaaccaagatcagacccgtgagcctgcccgtggacagactgctgctggccagcccccccaacgagagaaacggcagaaacatgggcaacgtgaacctggacaagttctgcaagaaccccgccttcgagggcgtgaacagaaaggacgccgccaccaccgtgtgcagcaagttcaacggcttcgaccagcagaccctgcagaagatccaggacaagcagtacgagcagaacagcctgaccgccaagaccaccatgatcatgcccagcgccctgcaggagaagggcgtgaccaccagcctgcagatcagcggcgaccacagcatcaacgccacccagcccagcaagccctacgccgagcccgtgagaagcgtgagagaggccagcgagagaagaagcagcgacagctaccccctggcccccgtgagagcccccagaaccctgcagccccagcactggaccaccttctacaagccccacgcccccatcatcagcatcagaggcaacgaggagaagcccgccagccccagcgccgccgtgccccccggcaccgaccacgacccccacggcctggtggtgaagagcatgcccgaccccgacaaggccagcgcctgccccggccaggccaccggccagcccaaggaggacagcgaggagctgggcctgcccgacgtgaaccccatgtgccagagacccagactgaagagaatgcagcagttcgaggacctggagggcgagatcccccagttcgtgtag

SEQ ID NO: 97140 - DNA, 1182 bp, Artificial Sequence
  Description of Artificial Sequence: Synthetic coding sequence
atgatcgcccacaagcagaagaagaccaagaagaagagagcctgggccagcggccagctgagcaccgacatcaccaccagcgagatgggcctgaagagcctgagcagcaacagcatcttcgaccccgactacatcaaggagctggtgaacgacatcagaaagttcagccacatgctgctgtacctgaaggaggccatcttcagcgactgcttcaaggaggtgatccacatcagactggaggagctgctgagagtgctgaagagcatcatgaacaagcaccagaacctgaacagcgtggacctgcagaacgccgccgagatgctgaccgccaaggtgaaggccgtgaacttcaccgaggtgaacgaggagaacaagaacgacctgttccaggaggtgttcagcagcatcgagaccctggccttcaccttcggcaacatcctgaccaacttcctgatgggcgacgtgggcaacgacagcctgctgagactgcccgtgagcagagagaccaagagcttcgagaacgtgagcgtggagagcgtggacagcagcagcgagaagggcaacttcagccccctggagctggacaacgtgctgctgaagaacaccgacagcatcgagctggccctgagctacgccaagacctggagcaagtacaccaagaacatcgtgagctgggtggagaagaagctgaacctggagctggagagcaccagaaacatggtgaagctggccgaggccaccagaaccaacatcggcatccaggagttcatgcccctgcagagcctgttcaccaacgccctgctgaacgacatcgagagcagccacctgctgcagcagaccatcgccgccctgcaggccaacaagttcgtgcagcccctgctgggcagaaagaacgagatggagaagcagagaaaggagatcaaggagctgtggaagcaggagcagaacaagatgctggaggccgagaacgccctgaagaaggccaagctgctgtgcatgcagagacaggacgagtacgagaaggccaagagcagcatgttcagagccgaggaggagcacctgagcagcagcggcggcctggccaagaacctgaacaagcagctggagaagaagagaagactggaggaggaggccctgcagaaggtgaccatcttcttcttcttcatctgcaagctgaactag

SEQ ID NO: 97141 - DNA, 3306 bp, Artificial Sequence
  Description of Artificial Sequence: Synthetic coding sequence
atgaagagcagacagaagggcaagaagaagggcagcgccaaggagagagtgttcggctgcgacctgcaggagcacctgcagcacagcggccaggaggtgccccaggtgctgaagagctgcgccgagttcgtggaggagtacggcgtggtggacggcatctacagactgagcggcgtgagcagcaacatccagaagctgagacaggagttcgagagcgagagaaagcccgacctgagaagagacgtgtacctgcaggacatccactgcgtgagcagcctgtgcaaggcctacttcagagagctgcccgaccccctgctgacctacagactgtacgacaagttcgccgaggccgtgggcgtgcagctggagcccgagagactggtgaagatcctggaggtgctgagagagctgcccgtgcccaactacagaaccctggagttcctgatgagacacctggtgcacatggccagcttcagcgcccagaccaacatgcacgccagaaacctggccatcgtgtgggcccccaacctgctgagaagcaaggacatcgaggccagcggcttcaacggcaccgccgccttcatggaggtgagagtgcagagcatcgtggtggagttcatcctgacccacgtggaccagctgttcggcggcgccgccctgagcggcggcgaggtggagagcggctggagaagcctgcccggcaccagagccagcggcagccccgaggacctgatgcccagacccctgccctaccacctgcccagcatcctgcaggccggcgacggccccccccagatgagaccctaccacaccatcatcgagatcgccgagcacaagagaaagggcagcctgaaggtgagaaagtggagaagcatcttcaacctgggcagaagcggccacgagaccaagagaaagctgcccagaggcgccgaggacagagaggacaagagcaacaagggcaccctgagacccgccaagagcatggacagcctgagcgccgccgccggcgccagcgacgagcccgagggcctggtgggccccagcagccccagacccagccccctgctgcccgagagcctggagaacgacagcatcgaggccgccgagggcgagcaggagcccgaggccgaggccctgggcggcaccaacagcgagcccggcacccccagagccggcagaagcgccatcagagccggcggcagcagcagagccgagagatgcgccggcgtgcacatcagcgacccctacaacgtgaacctgcccctgcacatcaccagcatcctgagcgtgccccccaacatcatcagcaacgtgagcctggccagactgaccagaggcctggagtgccccgccctgcagcacagacccagccccgccagcggccccggccccggccccggcctgggccccggcccccccgacgagaagctggaggccagccccgccagcagccccctggccgacagcggccccgacgacctggcccccgccctggaggacagcctgagccaggaggtgcaggacagcttcagcttcctggaggacagcagcagcagcgagcccgagtgggtgggcgccgaggacggcgaggtggcccaggccgaggccgccggcgccgccttcagccccggcgaggacgaccccggcatgggctacctggaggagctgctgggcgtgggcccccaggtggaggagttcagcgtggagccccccctggacgacctgagcctggacgaggcccagttcgtgctggcccccagctgctgcagcctggacagcgccggccccagacccgaggtggaggaggagaacggcgaggaggtgttcctgagcgcctacgacgacctgagccccctgctgggccccaagccccccatctggaagggcagcggcagcctggagggcgaggccgccggctgcggcagacaggccctgggccagggcggcgaggagcaggcctgctgggaggtgggcgaggacaagcaggccgagcccggcggcagactggacatcagagaggaggccgagggcagccccgagaccaaggtggaggccggcaaggccagcgaggacagaggcgaggccggcggcagccaggagaccaaggtgagactgagagagggcagcagagaggagaccgaggccaaggaggagaagagcaagggccagaagaaggccgacagcatggaggccaagggcgtggaggagcccggcggcgacgagtacaccgacgagaaggagaaggagatcgagagagaggaggacgagcagagagaggaggcccaggtggaggccggcagagacctggagcagggcgcccaggaggaccaggtggccgaggagaagtgggaggtggtgcagaagcaggaggccgagggcgtgagagaggacgaggacaagggccagagagagaagggctaccacgaggccagaaaggaccagggcgacggcgaggacagcagaagccccgaggccgccaccgagggcggcgccggcgaggtgagcaaggagagagagagcggcgacggcgaggccgagggcgaccagagagccggcggctactacctggaggaggacaccctgagcgagggcagcggcgtggccagcctggaggtggactgcgccaaggagggcaacccccacagcagcgagatggaggaggtggccccccagcccccccagcccgaggagatggagcccgagggccagcccagccccgacggctgcctgtgcccctgcagcctgggcctgggcggcgtgggcatgagactggccagcaccctggtgcaggtgcagcaggtgagaagcgtgcccgtggtgccccccaagccccagttcgccaagatgcccagcgccatgtgcagcaagatccacgtggcccccgccaacccctgccccagacccggcagactggacggcacccccggcgagagagcctggggcagcagagccagcagaagcagctggagaaacggcggcagcctgagcttcgacgccgccgtggccctggccagagacagacagagaaccgaggcccagggcgtgagaagaacccagacctgcaccgagggcggcgactactgcctgatccccagaaccagcccctgcagcatgatcagcgcccacagccccagacccctgagctgcctggagctgcccagcgagggcgccgagggcagcggcagcagaagcagactgagcctgccccccagagagccccaggtgcccgaccccctgctgagcagccagagaagaagctacgccttcgagacccaggccaaccccggcaagggcgagggcctgtag

SEQ ID NO: 97142 - DNA, 2673 bp, Artificial Sequence
  Description of Artificial Sequence: Synthetic coding sequence
atgaagagcagacagaagggcaagaagaagggcagcgccaaggagagagtgttcggctgcgacctgcaggagcacctgcagcacagcggccaggaggtgccccaggtgctgaagagctgcgccgagttcgtggaggagtacggcgtggtggacggcatctacagactgagcggcgtgagcagcaacatccagaagctgagacaggagttcgagagcgagagaaagcccgacctgagaagagacgtgtacctgcaggacatccactgcgtgagcagcctgtgcaaggcctacttcagagagctgcccgaccccctgctgacctacagactgtacgacaagttcgccgaggccgtgggcgtgcagctggagcccgagagactggtgaagatcctggaggtgctgagagagctgcccgtgcccaactacagaaccctggagttcctgatgagacacctggtgcacatggccagcttcagcgcccagaccaacatgcacgccagaaacctggccatcgtgtgggcccccaacctgctgagaagcaaggacatcgaggccagcggcttcaacggcaccgccgccttcatggaggtgagagtgcagagcatcgtggtggagttcatcctgacccacgtggaccagctgttcggcggcgccgccctgagcggcggcgaggtggagagcggctggagaagcctgcccggcaccagagccagcggcagccccgaggacctgatgcccagacccctgccctaccacctgcccagcatcctgcaggccggcgacggccccccccagatgagaccctaccacaccatcatcgagatcgccgagcacaagagaaagggcagcctgaaggtgagaaagtggagaagcatcttcaacctgggcagaagcggccacgagaccaagagaaagctgcccagaggcgccgaggacagagaggacaagagcaacaagggcaccctgagacccgccaagagcatggacagcctgagcgccgccgccggcgccagcgacgagcccgagggcctggtgggccccagcagccccagacccagccccctgctgcccgagagcctggagaacgacagcatcgaggccgccgagggcgagcaggagcccgaggccgaggccctgggcggcaccaacagcgagcccggcacccccagagccggcagaagcgccatcagagccggcggcagcagcagagccgagagatgcgccggcgtgcacatcagcgacccctacaacgtgaacctgcccctgcacatcaccagcatcctgagcgtgccccccaacatcatcagcaacgtgagcctggccagactgaccagaggcctggagtgccccgccctgcagcacagacccagccccgccagcggccccggccccggccccggcctgggccccggcccccccgacgagaagctggaggccagccccgccagcagccccctggccgacagcggccccgacgacctggcccccgccctggaggacagcctgagccaggaggtgcaggacagcttcagcttcctggaggacagcagcagcagcgagcccgagtgggtgggcgccgaggacggcgaggtggcccaggccgaggccgccggcgccgccttcagccccggcgaggacgaccccggcatgggctacctggaggagctgctgggcgtgggcccccaggtggaggagttcagcgtggagccccccctggacgacctgagcctggacgaggcccagttcgtgctggcccccagctgctgcagcctggacagcgccggccccagacccgaggtggaggaggagaacggcgaggaggtgttcctgagcgcctacgacgacctgagccccctgctgggccccaagccccccatctggaagggcagcggcagcctggagggcgaggccgccggctgcggcagacaggccctgggccagggcggcgaggagcaggcctgctgggaggtgggcgaggacaagcaggccgagcccggcggcagactggacatcagagaggaggccgagggcaccccccagcccccccagcccgaggagatggagcccgagggccagcccagccccgacggctgcctgtgcccctgcagcctgggcctgggcggcgtgggcatgagactggccagcaccctggtgcaggtgcagcaggtgagaagcgtgcccgtggtgccccccaagccccagttcgccaagatgcccagcgccatgtgcagcaagatccacgtggcccccgccaacccctgccccagacccggcagactggacggcacccccggcgagagagcctggggcagcagagccagcagaagcagctggagaaacggcggcagcctgagcttcgacgccgccgtggccctggccagagacagacagagaaccgaggcccagggcgtgagaagaacccagacctgcaccgagggcggcgactactgcctgatccccagaaccagcccctgcagcatgatcagcgcccacagccccagacccctgagctgcctggagctgcccagcgagggcgccgagggcagcggcagcagaagcagactgagcctgccccccagagagccccaggtgcccgaccccctgctgagcagccagagaagaagctacgccttcgagacccaggccaaccccggcaagggcgagggcctgtag

SEQ ID NO: 97143 - DNA, 1500 bp, Artificial Sequence
  Description of Artificial Sequence: Synthetic coding sequence
atgagacacctggtgcacatggccagcttcagcgcccagaccaacatgcacgccagaaacctggccatcgtgtgggcccccaacctgctgagaagcaaggacatcgaggccagcggcttcaacggcaccgccgccttcatggaggtgagagtgcagagcatcgtggtggagttcatcctgacccacgtggaccagctgttcggcggcgccgccctgagcggcggcgaggtggagagcggctggagaagcctgcccggcaccagagccagcggcagccccgaggacctgatgcccagacccctgccctaccacctgcccagcatcctgcaggccggcgacggccccccccagatgagaccctaccacaccatcatcgagatcgccgagcacaagagaaagggcagcctgaaggtgagaaagtggagaagcatcttcaacctgggcagaagcggccacgagaccaagagaaagctgcccagaggcgccgaggacagagaggacaagagcaacaagggcaccctgagacccgccaagagcatggacagcctgagcgccgccgccggcgccagcgacgagcccgagggcctggtgggccccagcagccccagacccagccccctgctgcccgagagcctggagaacgacagcatcgaggccgccgagggcgagcaggagcccgaggccgaggccctgggcggcaccaacagcgagcccggcacccccagagccggcagaagcgccatcagagccggcggcagcagcagagccgagagatgcgccggcgtgcacatcagcgacccctacaacgtgaacctgcccctgcacatcaccagcatcctgagcgtgccccccaacatcatcagcaacgtgagcctggccagactgaccagaggcctggagtgccccgccctgcagcacagacccagccccgccagcggccccggccccggccccggcctgggccccggcccccccgacgagaagctggaggccagccccgccagcagccccctggccgacagcggccccgacgacctggcccccgccctggaggacagcctgagccaggaggtgcaggacagcttcagcttcctggaggacagcagcagcagcgagcccgagtgggtgggcgccgaggacggcgaggtggcccaggccgaggccgccggcgccgccttcagccccggcgaggacgaccccggcatgggctacctggaggagctgctgggcgtgggcccccaggtggaggagttcagcgtggagccccccctggacgacctgagcctggacgaggcccagttcgtgctggcccccagctgctgcagcctggacagcgccggccccagacccgaggtggaggaggagaacggcgaggaggtgttcctgagcgcctacgacgacctgagccccgccctgggcctgctgctgcagcccggctggggccacagaagccacagcagcgagggccagtgcctgagaatcaaggccgtgttcctgtag

SEQ ID NO: 97144 - DNA, 4335 bp, Artificial Sequence
  Description of Artificial Sequence: Synthetic coding sequence
atgaagaacaagggcgccaagcagaagctgaagagaaagggcgccgccagcgccttcggctgcgacctgaccgagtacctggagagcagcggccaggacgtgccctacgtgctgaagagctgcgccgagttcatcgagacccacggcatcgtggacggcatctacagactgagcggcgtgaccagcaacatccagagactgagacaggagttcggcagcgaccagtgccccgacctgaccagagaggtgtacctgcaggacatccactgcgtgggcagcctgtgcaagctgtacttcagagagctgcccaaccccctgctgacctacgagctgtacgagaagttcaccgaggccgtgagccactgccccgaggagggccagctggccagaatccagaacgtgatccaggagctgccccccagccactacagaaccctggagtacctgatcagacacctggcccacatcgccagcttcagcagcaagaccaacatgcacgccagaaacctggccctggtgtgggcccccaacctgctgagaagcaaggagatcgaggccaccggctgcaacggcgacgccgccttcctggccgtgagagtgcagcaggtggtgatcgagttcatcctgaaccacgtggaccagatcttcaacaacggcgcccccggcagcctggagaacgacgagaacagacccatcatgaagagcctgaccctgcccgccctgagcctgcccatgaagctggtgagcctggaggaggcccaggccagaagcctggccaccaaccaccccgccagaaaggagagaagagagaacagcctgcccgagatcgtgccccccatgggcaccctgttccacaccgtgctggagctgcccgacaacaagagaaagctgagcagcaagagcaagaagtggaagagcatcttcaacctgggcagaagcggcagcgacagcaagagcaagctgagcagaaacggcagcgtgttcgtgagaggccagagactgagcgtggagaaggccaccatcagacccgccaagagcatggacagcctgtgcagcgtgcccgtggagggcaaggagaccaagggcaacttcaacagaaccgtgaccaccggcggcttcttcatccccgccaccaagatgcacagcaccggcaccggcagcagctgcgacctgaccaagcaggagggcgagtggggccaggagggcatgccccccggcgccgagggcggcttcgacgtgagcagcgacagaagccacctgcagggcgcccaggccagacccccccccgagcagctgaaggtgttcagacccgtggaggaccccgagagcgagcagaccgcccccaagatgctgggcatgttctacaccagcaacgacagccccagcaagagcgtgttcaccagcagcctgttccagatggagcccagccccagaaaccagagaaaggccctgaacatcagcgagcccttcgccgtgagcgtgcccctgagagtgagcgccgtgatcagcaccaacagcaccccctgcagaaccccccccaaggagctgcagagcctgagcagcctggaggagttcagcttccacggcagcgagagcggcggctggcccgaggaggagaagcccctgggcgccgagaccagcgccgccagcgtgcccaagaaggccggcctggaggacgccaaggccgtgcccgaggcccccggcaccgtggagtgcagcaagggcctgagccaggagcccggcgcccacctggaggagaagaagacccccgagagcagcctgagcagccagcacctgaacgagctggagaagagacccaaccccgagaaggtggtggaggagggcagagaggccggcgagatggagagcagcaccctgcaggagagccccagagccagagccgaggccgtgctgctgcacgagatggacgaggacgacctggccaacgccctgatctggcccgagatccagcaggagctgaagatcatcgagagcgaggaggagctgagcagcctgcccccccccgccctgaagaccagccccatccagcccatcctggagagcagcctgggccccttcatccccagcgagccccccggcagcctgccctgcggcagcttccccgcccccgtgagcacccccctggaggtgtggaccagagaccccgccaaccagagcacccagggcgccagcaccgccgccagcagagagaagcccgagcccgagcagggcctgcaccccgacctggccagcctggcccccctggagatcgtgcccttcgagaaggccagcccccaggccaccgtggaggtgggcggccccggcaacctgagcccccccctgccccccgccccccccccccccacccccctggaggagagcacccccgtgctgctgagcaagggcggccccgagagagaggacagcagcagaaagctgagaaccgacctgtacatcgaccagctgaagagccaggacagccccgagatcagcagcctgtgccagggcgaggaggccacccccagacacagcgacaagcagaacagcaagaacgccgccagcgagggcaagggctgcggcttccccagccccaccagagaggtggagatcgtgagccaggaggaggaggacgtgacccacagcgtgcaggagcccagcgactgcgacgaggacgacaccgtgaccgacatcgcccagcacggcctggagatggtggagccctgggaggagccccagtgggtgaccagccccctgcacagccccaccctgaaggacgcccacaaggcccaggtgcagggcctgcagggccaccagctggagaagagactgagccacagacccagcctgagacagagccacagcctggacagcaagcccaccgtgaagagccagtggaccctggaggtgcccagcagcagcagctgcgccaacctggagaccgagagaaacagcgaccccctgcagccccaggcccccagaagagagatcaccggctgggacgagaaggccctgagaagcttcagagagttcagcggcctgaagggcgccgaggccccccccaaccagaagggccccagcggcgtgcagcccaaccccgccgagaccagccccatcagcctggccgagggcaaggagctgggcacccacctgggccacagcagcccccagatcagacagggcggcgtgcccggccccgagagcagcaaggagagcagccccagcgtgcaggacagcaccagccccggcgagcaccccgccaagctgcagctgaagagcaccgagtgcggcccccccaagggcaagaacagacccagcagcctgaacctggaccccgccatccccatcgccgacctgttctggttcgagaacgtggccagcttcagcagccccggcatgcaggtgagcgagcccggcgaccccaaggtgacctggatgaccagcagctactgcaaggccgacccctggagagtgtacagccaggacccccaggacctggacatcgtggcccacgccctgaccggcagaagaaacagcgcccccgtgagcgtgagcgccgtgagaaccagcttcatggtgaagatgtgccaggccagagccgtgcccgtgatcccccccaagatccagtacacccagatcccccagcccctgcccagccagagcagcggcgagaacggcgtgcagcccctggagagaagccaggagggccccagcagcaccagcggcaccacccagaagcccgccaaggacgacagccccagcagcctggagagcagcaaggaggagaagcccaagcaggaccccggcgccatcaagagcagccccgtggacgccaccgccccctgcatgtgcgagggccccaccctgagccccgagcccggcagcagcaacctgctgagcacccaggacgccgtggtgcagtgcagaaagagaatgagcgagaccgagcccagcggcgacaacctgctgagcagcaagctggagagacccagcggcggcagcaagcccttccacagaagcagacccggcagaccccagagcctgatcctgttcagcccccccttccccatcatggaccacctgccccccagcagcaccgtgaccgacagcaaggtgctgctgagccccatcagaagccccacccagaccgtgagccccggcctgctgtgcggcgagctggccgagaacacctgggtgacccccgagggcgtgaccctgagaaacaagatgaccatccccaagaacggccagagactggagaccagcaccagctgcttctaccagccccagagaagaagcgtgatcctggacggcagaagcggcagacagatcgagtag

SEQ ID NO: 97145 - DNA, 3300 bp, Artificial Sequence
  Description of Artificial Sequence: Synthetic coding sequence
atgaagaacaagggcgccaagcagaagctgaagagaaagggcgccgccagcgccttcggctgcgacctgaccgagtacctggagagcagcggccaggacgtgccctacgtgctgaagagctgcgccgagttcatcgagacccacggcatcgtggacggcatctacagactgagcggcgtgaccagcaacatccagagactgagacaggagttcggcagcgaccagtgccccgacctgaccagagaggtgtacctgcaggacatccactgcgtgggcagcctgtgcaagctgtacttcagagagctgcccaaccccctgctgacctacgagctgtacgagaagttcaccgaggccgtgagccactgccccgaggagggccagctggccagaatccagaacgtgatccaggagctgccccccagccactacagaaccctggagtacctgatcagacacctggcccacatcgccagcttcagcagcaagaccaacatgcacgccagaaacctggccctggtgtgggcccccaacctgctgagaagcaaggagatcgaggccaccggctgcaacggcgacgccgccttcctggccgtgagagtgcagcaggtggtgatcgagttcatcctgaaccacgtggaccagatcttcaacaacggcgcccccggcagcctggagaacgacgagaacagacccatcatgaagagcctgaccctgcccgccctgagcctgcccatgaagctggtgagcctggaggaggcccaggccagaagcctggccaccaaccaccccgccagaaaggagagaagagagaacagcctgcccgagatcgtgccccccatgggcaccctgttccacaccgtgctggagctgcccgacaacaagagaaagctgagcagcaagagcaagaagtggaagagcatcttcaacctgggcagaagcggcagcgacagcaagagcaagctgagcagaaacggcagcgtgttcgtgagaggccagagactgagcgtggagaaggccaccatcagacccgccaagagcatggacagcctgtgcagcgtgcccgtggagggcaaggagaccaagggcaacttcaacagaaccgtgaccaccggcggcttcttcatccccgccaccaagatgcacagcaccggcaccggcagcagctgcgacctgaccaagcaggagggcgagtggggccaggagggcatgccccccggcgccgagggcggcttcgacgtgagcagcgacagaagccacctgcagggcgcccaggccagacccccccccgagcagctgaaggtgttcagacccgtggaggaccccgagagcgagcagaccgcccccaagatgctgggcatgttctacaccagcaacgacagccccagcaagagcgtgttcaccagcagcctgttccagatggagcccagccccagaaaccagagaaaggccctgaacatcagcgagcccttcgccgtgagcgtgcccctgagagtgagcgccgtgatcagcaccaacagcaccccctgcagaaccccccccaaggagctgcagagcctgagcagcctggaggagttcagcttccacggcagcgagagcggcggctggcccgaggaggagaagcccctgggcgccgagaccagcgccgccagcgtgcccaagaaggccggcctggaggacgccaaggccgtgcccgaggcccccggcaccgtggagtgcagcaagggcctgagccaggagcccggcgcccacctggaggagaagaagacccccgagagcagcctgagcagccagcacctgaacgagctggagaagagacccaaccccgagaaggtggtggaggagggcagagaggccggcgagatggagagcagcaccctgcaggagagccccagagccagagccgaggccgtgctgctgcacgagatggacgaggacgacctggccaacgccctgatctggcccgagatccagcaggagctgaagatcatcgagagcgaggaggagctgagcagcctgcccccccccgccctgaagaccagccccatccagcccatcctggagagcagcctgggccccttcatccccagcgagccccccggcagcctgccctgcggcagcttccccgcccccgtgagcacccccctggaggtgtggaccagagaccccgccaaccagagcacccagggcgccagcaccgccgccagcagagagaagcccgagcccgagcagggcctgcaccccgacctggccagcctggcccccctggagatcgtgcccttcgagaaggccagcccccaggccaccgtggaggtgggcggccccggcaacctgagcccccccctgccccccgccccccccccccccacccccctggaggagagcacccccgtgctgctgagcaagggcggccccgagagagaggacagcagcagaaagctgagaaccgacctgtacatcgaccagctgaagagccaggacagccccgagatcagcagcctgtgccagggcgaggaggccacccccagacacagcgacaagcagaacagcaagaacgccgccagcgagggcaagggctgcggcttccccagccccaccagagaggtggagatcgtgagccaggaggaggaggacgtgacccacagcgtgcaggagcccagcgactgcgacgaggacgacaccgtgaccgacatcgcccagcacggcctggagatggtggagccctgggaggagccccagtgggtgaccagccccctgcacagccccaccctgaaggacgcccacaaggcccaggtgcagggcctgcagggccaccagctggagaagagactgagccacagacccagcctgagacagagccacagcctggacagcaagcccaccgtgaagagccagtggaccctggaggtgcccagcagcagcagctgcgccaacctggagaccgagagaaacagcgaccccctgcagccccaggcccccagaagagagatcaccggctgggacgagaaggccctgagaagcttcagagagttcagcggcctgaagggcgccgaggccccccccaaccagaagggccccagcggcgtgcagcccaaccccgcccagcccgtgggccccctgagaaacctgcccaagatgatcctgccccccccctggaaggcccagagaaagaagaaccagagcaagatccccgagcccctgagcccccaccagtggatgcccctgcaccccgcctgcgccagagacctgcccttcctgcagaaccaggccagactgacctgcagcccccccagaatgcagtag

SEQ ID NO: 97146 - DNA, 4509 bp, Artificial Sequence
  Description of Artificial Sequence: Synthetic coding sequence
atgatggccaagaacaaggagcccagaccccccagctacaccatcagcatcgtgggcctgagcggcaccgagaaggacaagggcaactgcggcgtgggcaagagctgcctgtgcaacagattcgtgagaagcaaggccgacgagtactaccccgagcacaccagcgtgctgagcaccatcgacttcggcggcagagtggtgaacaacgaccacttcctgtactggggcgacatcatccagaacagcgaggacggcgtggagtgcaagatccacgtgatcgagcagaccgagttcatcgacgaccagaccttcctgccccacagaagcaccaacctgcagccctacatcaagagagccgccgccagcaagctgcagagcgccgagaagctgatgtacatctgcaccgaccagctgggcctggagcaggacttcgagcagaagcagatgcccgagggcaagctgaacgtggacggcttcctgctgtgcatcgacgtgagccagggctgcaacagaaagttcgacgaccagctgaagttcgtgaacaacctgttcgtgcagctgagcaagagcaagaagcccgtgatcatcgccgccaccaagtgcgacgagtgcgtggaccactacctgagagaggtgcaggccttcgccagcaacaagaagaacctgctggtggtggagaccagcgccagattcaacgtgaacatcgagacctgcttcaccgccctggtgcagatgctggacaagaccagaagcaagcccaagatcatcccctacctggacgcctacaagacccagagacagctggtggtgaccgccaccgacaagttcgagaagctggtgcagaccgtgagagactaccacgccacctggaagaccgtgagcaacaagctgaagaaccaccccgactacgaggagtacatcaacctggagggcaccagaaaggccagaaacaccttcagcaagcacatcgagcagctgaagcaggagcacatcagaaagagaagagaggagtacatcaacaccctgcccagagccttcaacaccctgctgcccaacctggaggagatcgagcacctgaactggagcgaggccctgaagctgatggagaagagagccgacttccagctgtgcttcgtggtgctggagaagaccccctgggacgagaccgaccacatcgacaagatcaacgacagaagaatccccttcgacctgctgagcaccctggaggccgagaaggtgtaccagaaccacgtgcagcacctgatcagcgagaagagaagagtggagatgaaggagaagttcaagaagaccctggagaagatccagttcatcagccccggccagccctgggaggaggtgatgtgcttcgtgatggaggacgaggcctacaagtacatcaccgaggccgacagcaaggaggtgtacggcagacaccagagagagatcgtggagaaggccaaggaggagttccaggagatgctgttcgagcacagcgagctgttctacgacctggacctgaacgccacccccagcagcgacaagatgagcgagatccacaccgtgctgagcgaggagcccagatacaaggccctgcagaagctggcccccgacagagagagcctgctgctgaagcacatcggcttcgtgtaccaccccaccaaggagacctgcctgagcggccagaactgcaccgacatcaaggtggagcagctgctggccagcagcctgctgcagctggaccacggcagactgagactgtaccacgacagcaccaacatcgacaaggtgaacctgttcatcctgggcaaggacggcctggcccaggagctggccaacgagatcagaacccagagcaccgacgacgagtacgccctggacggcaagatctacgagctggacctgagacccgtggacgccaagagcccctacttcctgagccagctgtggaccgccgccttcaagccccacggctgcttctgcgtgttcaacagcatcgagagcctgagcttcatcggcgagttcatcggcaagatcagaaccgaggccagccagatcagaaaggacaagtacatggccaacctgcccttcaccctgatcctggccaaccagagagacagcatcagcaagaacctgcccatcctgagacaccagggccagcagctggccaacaagctgcagtgccccttcgtggacgtgcccgccggcacctaccccagaaagttcaacgagacccagatcaagcaggccctgagaggcgtgctggagagcgtgaagcacaacctggacgtggtgagccccatccccgccaacaaggacctgagcgaggccgacctgagaatcgtgatgtgcgccatgtgcggcgaccccttcagcgtggacctgatcctgagccccttcctggacagccacagctgcagcgccgcccaggccggccagaacaacagcctgatgctggacaagatcatcggcgagaagagaagaagaatccagatcaccatcctgagctaccacagcagcatcggcgtgagaaaggacgagctggtgcacggctacatcctggtgtacagcgccaagagaaaggccagcatgggcatgctgagagccttcctgagcgaggtgcaggacaccatccccgtgcagctggtggccgtgaccgacagccaggccgacttcttcgagaacgaggccatcaaggagctgatgaccgagggcgagcacatcgccaccgagatcaccgccaagttcaccgccctgtacagcctgagccagtaccacagacagaccgaggtgttcaccctgttcttcagcgacgtgctggagaagaagaacatgatcgagaacagctacctgagcgacaacaccagagagagcacccaccagagcgaggacgtgttcctgcccagccccagagactgcttcccctacaacaactaccccgacagcgacgacgacaccgaggccccccccccctacagccccatcggcgacgacgtgcagctgctgcccacccccagcgacagaagcagatacagactggacctggagggcaacgagtaccccatccacagcacccccaactgccacgaccacgagagaaaccacaaggtgcccccccccatcaagcccaagcccgtggtgcccaagaccaacgtgaagaagctggaccccaacctgctgaagaccatcgaggccggcatcggcaagaaccccagaaagcagaccagcagagtgcccctggcccaccccgaggacatggaccccagcgacaactacgccgagcccatcgacaccatcttcaagcagaagggctacagcgacgagatctacgtggtgcccgacgacagccagaacagaatcaagatcagaaacagcttcgtgaacaacacccagggcgacgaggagaacggcttcagcgacagaaccagcaagagccacggcgagagaagacccagcaagtacaagtacaagagcaagaccctgttcagcaaggccaagagctactacagaagaacccacagcgacgccagcgacgacgaggccttcaccaccagcaagaccaagagaaagggcagacacagaggcagcgaggaggaccccctgctgagccccgtggagacctggaagggcggcatcgacaaccccgccatcaccagcgaccaggagctggacgacaagaagatgaagaagaagacccacaaggtgaaggaggacaagaagcagaagaagaagaccaagaacttcaacccccccaccagaagaaactgggagagcaactacttcggcatgcccctgcaggacctggtgaccgccgagaagcccatccccctgttcgtggagaagtgcgtggagttcatcgaggacaccggcctgtgcaccgagggcctgtacagagtgagcggcaacaagaccgaccaggacaacatccagaagcagttcgaccaggaccacaacatcaacctggtgagcatggaggtgaccgtgaacgccgtggccggcgccctgaaggccttcttcgccgacctgcccgaccccctgatcccctacagcctgcaccccgagctgctggaggccgccaagatccccgacaagaccgagagactgcacgccctgaaggagatcgtgaagaagttccaccccgtgaactacgacgtgttcagatacgtgatcacccacctgaacagagtgagccagcagcacaagatcaacctgatgaccgccgacaacctgagcatctgcttctggcccaccctgatgagacccgacttcgagaacagagagttcctgagcaccaccaagatccaccagagcgtggtggagaccttcatccagcagtgccagttcttcttctacaacggcgagatcgtggagaccaccaacatcgtggccccccccccccccagcaaccccggccagctggtggagcccatggtgcccctgcagctgcccccccccctgcagccccagctgatccagccccagctgcagaccgaccccctgggcatcatctag

SEQ ID NO: 97147 - DNA, 714 bp, Artificial Sequence
  Description of Artificial Sequence: Synthetic coding sequence
atgagcctgcccccccccccccccggccccctgcccctgagaagaagaagaagaagacccaccctgctgggcctgtgcaccgagggcctgtacagagtgagcggcaacaagaccgaccaggacaacatccagaagcagttcgaccaggaccacaacatcaacctggtgagcatggaggtgaccgtgaacgccgtggccggcgccctgaaggccttcttcgccgacctgcccgaccccctgatcccctacagcctgcaccccgagctgctggaggccgccaagatccccgacaagaccgagagactgcacgccctgaaggagatcgtgaagaagttccaccccgtgaactacgacgtgttcagatacgtgatcacccacctgaacagagtgagccagcagcacaagatcaacctgatgaccgccgacaacctgagcatctgcttctggcccaccctgatgagacccgacttcgagaacagagagttcctgagcaccaccaagatccaccagagcgtggtggagaccttcatccagcagtgccagttcttcttctacaacggcgagatcgtggagaccaccaacatcgtggccccccccccccccagcaaccccggccagctggtggagcccatggtgcccctgcagctgcccccccccctgcagccccagctgatccagccccagctgcagaccgaccccctgggcatcatctag

SEQ ID NO: 97148 - DNA, 4506 bp, Artificial Sequence
  Description of Artificial Sequence: Synthetic coding sequence
atgatggccaagaacaaggagcccagaccccccagctacaccatcagcatcgtgggcctgagcggcaccgagaaggacaagggcaactgcggcgtgggcaagagctgcctgtgcaacagattcgtgagaagcaaggccgacgagtactaccccgagcacaccagcgtgctgagcaccatcgacttcggcggcagagtggtgaacaacgaccacttcctgtactggggcgacatcatccagaacagcgaggacggcgtggagtgcaagatccacgtgatcgagcagaccgagttcatcgacgaccagaccttcctgccccacagaagcaccaacctgcagccctacatcaagagagccgccgccagcaagctgcagagcgccgagaagctgatgtacatctgcaccgaccagctgggcctggagcaggacttcgagcagaagcagatgcccgagggcaagctgaacgtggacggcttcctgctgtgcatcgacgtgagccagggctgcaacagaaagttcgacgaccagctgaagttcgtgaacaacctgttcgtgcagctgagcaagagcaagaagcccgtgatcatcgccgccaccaagtgcgacgagtgcgtggaccactacctgagagaggtgcaggccttcgccagcaacaagaagaacctgctggtggtggagaccagcgccagattcaacgtgaacatcgagacctgcttcaccgccctggtgcagatgctggacaagaccagaagcaagcccaagatcatcccctacctggacgcctacaagacccagagacagctggtggtgaccgccaccgacaagttcgagaagctggtgcagaccgtgagagactaccacgccacctggaagaccgtgagcaacaagctgaagaaccaccccgactacgaggagtacatcaacctggagggcaccagaaaggccagaaacaccttcagcaagcacatcgagcagctgaagcaggagcacatcagaaagagaagagaggagtacatcaacaccctgcccagagccttcaacaccctgctgcccaacctggaggagatcgagcacctgaactggagcgaggccctgaagctgatggagaagagagccgacttccagctgtgcttcgtggtgctggagaagaccccctgggacgagaccgaccacatcgacaagatcaacgacagaagaatccccttcgacctgctgagcaccctggaggccgagaaggtgtaccagaaccacgtgcagcacctgatcagcgagaagagaagagtggagatgaaggagaagttcaagaagaccctggagaagatccagttcatcagccccggccagccctgggaggaggtgatgtgcttcgtgatggaggacgaggcctacaagtacatcaccgaggccgacagcaaggaggtgtacggcagacaccagagagagatcgtggagaaggccaaggaggagttccaggagatgctgttcgagcacagcgagctgttctacgacctggacctgaacgccacccccagcagcgacaagatgagcgagatccacaccgtgctgagcgaggagcccagatacaaggccctgcagaagctggcccccgacagagagagcctgctgctgaagcacatcggcttcgtgtaccaccccaccaaggagacctgcctgagcggccagaactgcaccgacatcaaggtggagcagctgctggccagcagcctgctgcagctggaccacggcagactgagactgtaccacgacagcaccaacatcgacaaggtgaacctgttcatcctgggcaaggacggcctggcccaggagctggccaacgagatcagaacccagagcaccgacgacgagtacgccctggacggcaagatctacgagctggacctgagacccgtggacgccaagagcccctacttcctgagccagctgtggaccgccgccttcaagccccacggctgcttctgcgtgttcaacagcatcgagagcctgagcttcatcggcgagttcatcggcaagatcagaaccgaggccagccagatcagaaaggacaagtacatggccaacctgcccttcaccctgatcctggccaaccagagagacagcatcagcaagaacctgcccatcctgagacaccagggccagcagctggccaacaagctgcagtgccccttcgtggacgtgcccgccggcacctaccccagaaagttcaacgagacccagatcaagcaggccctgagaggcgtgctggagagcgtgaagcacaacctggacgtggtgagccccatccccgccaacaaggacctgagcgaggccgacctgagaatcgtgatgtgcgccatgtgcggcgaccccttcagcgtggacctgatcctgagccccttcctggacagccacagctgcagcgccgcccaggccggccagaacaacagcctgatgctggacaagatcatcggcgagaagagaagaagaatccagatcaccatcctgagctaccacagcagcatcggcgtgagaaaggacgagctggtgcacggctacatcctggtgtacagcgccaagagaaaggccagcatgggcatgctgagagccttcctgagcgaggtgcaggacaccatccccgtgcagctggtggccgtgaccgacagccaggccgacttcttcgagaacgaggccatcaaggagctgatgaccgagggcgagcacatcgccaccgagatcaccgccaagttcaccgccctgtacagcctgagccagtaccacagacagaccgaggtgttcaccctgttcttcagcgacgtgctggagaagaagaacatgatcgagaacagctacctgagcgacaacaccagagagagcacccaccagagcgaggacgtgttcctgcccagccccagagactgcttcccctacaacaactaccccgacagcgacgacgacaccgaggccccccccccctacagccccatcggcgacgacgtgcagctgctgcccacccccagcgacagaagcagatacagactggacctggagggcaacgagtaccccatccacagcacccccaactgccacgaccacgagagaaaccacaaggtgcccccccccatcaagcccaagcccgtggtgcccaagaccaacgtgaagaagctggaccccaacctgctgaagaccatcgaggccggcatcggcaagaaccccagaaagcagaccagcagagtgcccctggcccaccccgaggacatggaccccagcgacaactacgccgagcccatcgacaccatcttcaagcagaagggctacagcgacgagatctacgtggtgcccgacgacagccagaacagaatcaagatcagaaacagcttcgtgaacaacacccagggcgacgaggagaacggcttcagcgacagaaccagcaagagccacggcgagagaagacccagcaagtacaagtacaagagcaagaccctgttcagcaaggccaagagctactacagaagaacccacagcgacgccagcgacgacgaggccttcaccaccagcaagaccaagagaaagggcagacacagaggcagcgaggaggaccccctgctgagccccgtggagacctggaagggcggcatcgacaaccccgccatcaccagcgaccaggagctggacgacaagaagatgaagaagaagacccacaaggtgaaggaggacaagaagaagaagaagaccaagaacttcaacccccccaccagaagaaactgggagagcaactacttcggcatgcccctgcaggacctggtgaccgccgagaagcccatccccctgttcgtggagaagtgcgtggagttcatcgaggacaccggcctgtgcaccgagggcctgtacagagtgagcggcaacaagaccgaccaggacaacatccagaagcagttcgaccaggaccacaacatcaacctggtgagcatggaggtgaccgtgaacgccgtggccggcgccctgaaggccttcttcgccgacctgcccgaccccctgatcccctacagcctgcaccccgagctgctggaggccgccaagatccccgacaagaccgagagactgcacgccctgaaggagatcgtgaagaagttccaccccgtgaactacgacgtgttcagatacgtgatcacccacctgaacagagtgagccagcagcacaagatcaacctgatgaccgccgacaacctgagcatctgcttctggcccaccctgatgagacccgacttcgagaacagagagttcctgagcaccaccaagatccaccagagcgtggtggagaccttcatccagcagtgccagttcttcttctacaacggcgagatcgtggagaccaccaacatcgtggccccccccccccccagcaaccccggccagctggtggagcccatggtgcccctgcagctgcccccccccctgcagccccagctgatccagccccagctgcagaccgaccccctgggcatcatctag

SEQ ID NO: 97149 - DNA, 726 bp, Artificial Sequence
  Description of Artificial Sequence: Synthetic coding sequence
atgcccctgcaggacctggtgaccgccgagaagcccatccccctgttcgtggagaagtgcgtggagttcatcgaggacaccggcctgtgcaccgagggcctgtacagagtgagcggcaacaagaccgaccaggacaacatccagaagcagttcgaccaggaccacaacatcaacctggtgagcatggaggtgaccgtgaacgccgtggccggcgccctgaaggccttcttcgccgacctgcccgaccccctgatcccctacagcctgcaccccgagctgctggaggccgccaagatccccgacaagaccgagagactgcacgccctgaaggagatcgtgaagaagttccaccccgtgaactacgacgtgttcagatacgtgatcacccacctgaacagagtgagccagcagcacaagatcaacctgatgaccgccgacaacctgagcatctgcttctggcccaccctgatgagacccgacttcgagaacagagagttcctgagcaccaccaagatccaccagagcgtggtggagaccttcatccagcagtgccagttcttcttctacaacggcgagatcgtggagaccaccaacatcgtggccccccccccccccagcaaccccggccagctggtggagcccatggtgcccctgcagctgcccccccccctgcagccccagctgatccagccccagctgcagaccgaccccctgggcatcatctag

SEQ ID NO: 97150 - DNA, 4509 bp, Artificial Sequence; identical to SEQ ID NO: 97146
  Description of Artificial Sequence: Synthetic coding sequence

SEQ ID NO: 97151 - DNA, 414 bp, Artificial Sequence
  Description of Artificial Sequence: Synthetic coding sequence
atgcccctgcaggacctggtgaccgccgagaagcccatccccctgttcgtggagaagtgcgtggagttcatcgaggacaccggcctgtgcaccgagggcctgtacagagtgagcggcaacaagaccgaccaggacaacatccagaagcagttcgaccaggaccacaacatcaacctggtgagcatggaggtgaccgtgaacgccgtggccggcgccctgaaggccttcttcgccgacctgcccgaccccctgatcccctacagcctgcaccccgagctgctggaggccgccaagatccccgacaagaccgagagactgcacgccctgaaggagatcgtgaagaagttccaccccgtgaactacgacgtgttcagatacgtgatcacccacctgaacagagtgagccagcagtag

SEQ ID NO: 97152 - DNA, 114 bp, Artificial Sequence
  Description of Artificial Sequence: Synthetic coding sequence
atgatggccaagaacaaggagcccagaccccccagctacaccatcagcatcgtgggcctgagcggcaccgagaaggacaagggcaactgcggcgtgggcaagagctgcctgtag

SEQ ID NO: 97153 - DNA, 423 bp, Artificial Sequence
  Description of Artificial Sequence: Synthetic coding sequence
atgatggccaagaacaaggagcccagaccccccagctacaccatcagcatcgtgggcctgagcggcaccgagaaggacaagggcaactgcggcgtgggcaagagctgcctgtgcaacagattcgtgagaagcaaggccgacgagtactaccccgagcacaccagcgtgctgagcaccatcgacttcggcggcagagtggtgaacaacgaccacttcctgtactggggcgacatcatccagaacagcgaggacggcgtggagtgcaagatccacgtgatcgagcagaccgagttcatcgacgaccagaccttcctgccccacagaagcaccaacctgcagccctacatcaagagagccgccgccagcaagctgcagagcgccgagaagctgatgtacatctgcaccgaccagctgggcctgtag

SEQ ID NO: 97154 - DNA, 4506 bp, Artificial Sequence; identical to SEQ ID NO: 97148
  Description of Artificial Sequence: Synthetic coding sequence

SEQ ID NO: 97155 - DNA, 2316 bp, Artificial Sequence
  Description of Artificial Sequence: Synthetic coding sequence
atgagcggcagaagcgtgagactgagaagcgtgcccatccagagcctgagcgagctggagagagccagactgcaggaggtggccttctaccagctgcagcaggactgcgacctgagctgccagatcaccatccccaaggacggccagaagagaaagaagagcctgagaaagaagctggacagcctgggcaaggagaagaacaaggacaaggagttcatcccccaggccttcggcatgcccctgagccaggtgatcgccaacgacagagcctacaagctgaagcaggacctgcagagagacgagcagaaggacgccagcgacttcgtggccagcctgctgcccttcggcaacaagagacagaacaaggagctgagcagcagcaacagcagcctgagcagcaccagcgagacccccaacgagagcaccagccccaacacccccgagcccgcccccagagccagaagaagaggcgccatgagcgtggacagcatcaccgacctggacgacaaccagagcagactgctggaggccctgcagctgagcctgcccgccgaggcccagagcaagaaggagaaggccagagacaagaagctgagcctgaaccccatctacagacaggtgcccagactggtggacagctgctgccagcacctggagaagcacggcctgcagaccgtgggcatcttcagagtgggcagcagcaagaagagagtgagacagctgagagaggagttcgacagaggcatcgacgtgagcctggaggaggagcacagcgtgcacgacgtggccgccctgctgaaggagttcctgagagacatgcccgaccccctgctgaccagagagctgtacaccgccttcatcaacaccctgctgctggagcccgaggagcagctgggcaccctgcagctgctgatctacctgctgcccccctgcaactgcgacaccctgcacagactgctgcagttcctgagcatcgtggccagacacgccgacgacaacatcagcaaggacggccaggaggtgaccggcaacaagatgaccagcctgaacctggccaccatcttcggccccaacctgctgcacaagcagaagagcagcgacaaggagttcagcgtgcagagcagcgccagagccgaggagagcaccgccatcatcgccgtggtgcagaagatgatcgagaactacgaggccctgttcatggtgccccccgacctgcagaacgaggtgctgatcagcctgctggagaccgaccccgacgtggtggactacctgctgagaagaaaggccagccagagcagcagccccgacatgctgcagagcgaggtgagcttcagcgtgggcggcagacacagcagcaccgacagcaacaaggccagcagcggcgacatcagcccctacgacaacaacagccccgtgctgagcgagagaagcctgctggccatgcaggaggacgccgcccccggcggcagcgagaagctgtacagagtgcccggccagttcatgctggtgggccacctgagcagcagcaagagcagagagagcagccccggccccagactgggcaaggacctgagcgaggagcccttcgacatctggggcacctggcacagcaccctgaagagcggcagcaaggaccccggcatgaccggcagcagcggcgacatcttcgagagcagcagcctgagagccggcccctgcagcctgagccagggcaacctgagccccaactggcccagatggcagggcagccccgccgagctggacagcgacacccagggcgccagaagaacccaggccgccgcccccgccaccgagggcagagcccaccccgccgtgagcagagcctgcagcaccccccacgtgcaggtggccggcaaggccgagagacccaccgccagaagcgagcagtacctgaccctgagcggcgcccacgacctgagcgagagcgagctggacgtggccggcctgcagagcagagccaccccccagtgccagagaccccacggcagcggcagagacgacaagagacccccccccccctaccccggccccggcaagcccgccgccgccgccgcctggatccagggcccccccgagggcgtggagacccccaccgaccagggcggccaggccgccgagagagagcagcaggtgacccagaagaagctgagcagcgccaacagcctgcccgccggcgagcaggacagccccagactgggcgacgccggctggctggactggcagagagagagatggcagatctgggagctgctgagcaccgacaaccccgacgccctgcccgagaccctggtgtag

SEQ ID NO: 97156 - DNA, 2925 bp, Artificial Sequence
  Description of Artificial Sequence: Synthetic coding sequence
atgagcgcccagagcctgctgcacagcgtgttcagctgcagcagccccgccagcagcagcgccgccagcgccaagggcttcagcaagagaaagctgagacagaccagaagcctggaccccgccctgatcggcggctgcggcagcgacgaggccggcgccgagggcagcgccagaggcgccaccgccggcagactgtacagccccagcctgcccgccgagagcctgggccccagactggccagcagcagcagaggccccccccccagagccaccagactgcccccccccggccccctgtgcagcagcttcagcacccccagcaccccccaggagaagagccccagcggcagcttccacttcgactacgaggtgcccctgggcagaggcggcctgaagaagagcatggcctgggacctgcccagcgtgctggccggccccgccagcagcagaagcgccagcagcatcctgtgcagcagcggcggcggccccaacggcatcttcgccagccccagaagatggctgcagcagagaaagttccagagcccccccgacagcagaggccacccctacgtggtgtggaagagcgagggcgacttcacctggaacagcatgagcggcagaagcgtgagactgagaagcgtgcccatccagagcctgagcgagctggagagagccagactgcaggaggtggccttctaccagctgcagcaggactgcgacctgagctgccagatcaccatccccaaggacggccagaagagaaagaagagcctgagaaagaagctggacagcctgggcaaggagaagaacaaggacaaggagttcatcccccaggccttcggcatgcccctgagccaggtgatcgccaacgacagagcctacaagctgaagcaggacctgcagagagacgagcagaaggacgccagcgacttcgtggccagcctgctgcccttcggcaacaagagacagaacaaggagctgagcagcagcaacagcagcctgagcagcaccagcgagacccccaacgagagcaccagccccaacacccccgagcccgcccccagagccagaagaagaggcgccatgagcgtggacagcatcaccgacctggacgacaaccagagcagactgctggaggccctgcagctgagcctgcccgccgaggcccagagcaagaaggagaaggccagagacaagaagctgagcctgaaccccatctacagacaggtgcccagactggtggacagctgctgccagcacctggagaagcacggcctgcagaccgtgggcatcttcagagtgggcagcagcaagaagagagtgagacagctgagagaggagttcgacagaggcatcgacgtgagcctggaggaggagcacagcgtgcacgacgtggccgccctgctgaaggagttcctgagagacatgcccgaccccctgctgaccagagagctgtacaccgccttcatcaacaccctgctgctggagcccgaggagcagctgggcaccctgcagctgctgatctacctgctgcccccctgcaactgcgacaccctgcacagactgctgcagttcctgagcatcgtggccagacacgccgacgacaacatcagcaaggacggccaggaggtgaccggcaacaagatgaccagcctgaacctggccaccatcttcggccccaacctgctgcacaagcagaagagcagcgacaaggagttcagcgtgcagagcagcgccagagccgaggagagcaccgccatcatcgccgtggtgcagaagatgatcgagaactacgaggccctgttcatggtgccccccgacctgcagaacgaggtgctgatcagcctgctggagaccgaccccgacgtggtggactacctgctgagaagaaaggccagccagagcagcagccccgacatgctgcagagcgaggtgagcttcagcgtgggcggcagacacagcagcaccgacagcaacaaggccagcagcggcgacatcagcccctacgacaacaacagccccgtgctgagcgagagaagcctgctggccatgcaggaggacgccgcccccggcggcagcgagaagctgtacagagtgcccggccagttcatgctggtgggccacctgagcagcagcaagagcagagagagcagccccggccccagactgggcaaggacctgagcgaggagcccttcgacatctggggcacctggcacagcaccctgaagagcggcagcaaggaccccggcatgaccggcagcagcggcgacatcttcgagagcagcagcctgagagccggcccctgcagcctgagccagggcaacctgagccccaactggcccagatggcagggcagccccgccgagctggacagcgacacccagggcgccagaagaacccaggccgccgcccccgccaccgagggcagagcccaccccgccgtgagcagagcctgcagcaccccccacgtgcaggtggccggcaaggccgagagacccaccgccagaagcgagcagtacctgaccctgagcggcgcccacgacctgagcgagagcgagctggacgtggccggcctgcagagcagagccaccccccagtgccagagaccccacggcagcggcagagacgacaagagacccccccccccctaccccggccccggcaagcccgccgccgccgccgcctggatccagggcccccccgagggcgtggagacccccaccgaccagggcggccaggccgccgagagagagcagcaggtgacccagaagaagctgagcagcgccaacagcctgcccgccggcgagcaggacagccccagactgggcgacgccggctggctggactggcagagagagagatggcagatctgggagctgctgagcaccgacaaccccgacgccctgcccgagaccctggtgtag

SEQ ID NO: 97157 - DNA, 1806 bp, Artificial Sequence
  Description of Artificial Sequence: Synthetic coding sequence
ctggagctgtacgacctgcagatcctgggcaccaagccccccatgaacagcgacacccacagaaacttcgaccccaccgccaccctgagaaaccagggcgacttcacctggaacagcatgagcggcagaagcgtgagactgagaagcgtgcccatccagagcctgagcgagctggagagagccagactgcaggaggtggccttctaccagctgcagcaggactgcgacctgagctgccagatcaccatccccaaggacggccagaagagaaagaagagcctgagaaagaagctggacagcctgggcaaggagaagaacaaggacaaggagttcatcccccaggccttcggcatgcccctgagccaggtgatcgccaacgacagagcctacaagctgaagcaggacctgcagagagacgagcagaaggacgccagcgacttcgtggccagcctgctgcccttcggcaacaagagacagaacaaggagctgagcagcagcaacagcagcctgagcagcaccagcgagacccccaacgagagcaccagccccaacacccccgagcccgcccccagagccagaagaagaggcgccatgagcgtggacagcatcaccgacctggacgacaaccagagcagactgctggaggccctgcagctgagcctgcccgccgaggcccagagcaagaaggagaaggccagagacaagaagctgagcctgaaccccatctacagacaggtgcccagactggtggacagctgctgccagcacctggagaagcacggcctgcagaccgtgggcatcttcagagtgggcagcagcaagaagagagtgagacagctgagagaggagttcgacagaggcatcgacgtgagcctggaggaggagcacagcgtgcacgacgtggccgccctgctgaaggagttcctgagagacatgcccgaccccctgctgaccagagagctgtacaccgccttcatcaacaccctgctgctggagcccgaggagcagctgggcaccctgcagctgctgatctacctgctgcccccctgcaactgcgacaccctgcacagactgctgcagttcctgagcatcgtggccagacacgccgacgacaacatcagcaaggacggccaggaggtgaccggcaacaagatgaccagcctgaacctggccaccatcttcggccccaacctgctgcacaagcagaagagcagcgacaaggagttcagcgtgcagagcagcgccagagccgaggagagcaccgccatcatcgccgtggtgcagaagatgatcgagaactacgaggccctgttcatggtgccccccgacctgcagaacgaggtgctgatcagcctgctggagaccgaccccgacgtggtggactacctgctgagaagaaaggccagccagagcagcagccccgacatgctgcagagcgaggtgagcttcagcgtgggcggcagacacagcagcaccgacagcaacaaggccagcagcggcgacatcagcccctacgacaacaacagccccgtgctgagcgagagaagcctgctggccatgcaggaggacgccgcccccggcggcagcgagaagctgtacagagtgcccggccagttcatgctggtgggccacctgagcagcagcaagagcagagagagcagccccggccccagactgggcaagggcaactggagcctggccagcagaagatggcccaagcaggccaccctgctgctgctgcacgtggcctggtgcggcgccctgagaaccttcagcagcagcctgccctacctgatgttcctgtag

SEQ ID NO: 97158 - DNA, 2298 bp, Artificial Sequence
  Description of Artificial Sequence: Synthetic coding sequence
atgagcgcccagagcctgctgcacagcgtgttcagctgcagcagccccgccagcagcagcgccgccagcgccaagggcttcagcaagagaaagctgagacagaccagaagcctggaccccgccctgatcggcggctgcggcagcgacgaggccggcgccgagggcagcgccagaggcgccaccgccggcagactgtacagccccagcctgcccgccgagagcctgggccccagactggccagcagcagcagaggccccccccccagagccaccagactgcccccccccggccccctgtgcagcagcttcagcacccccagcaccccccaggagaagagccccagcggcagcttccacttcgactacgaggtgcccctgggcagaggcggcctgaagaagagcatggcctgggacctgcccagcgtgctggccggccccgccagcagcagaagcgccagcagcatcctgtgcagcagcggcggcggccccaacggcatcttcgccagccccagaagatggctgcagcagagaaagttccagagcccccccgacagcagaggccacccctacgtggtgtggaagagcgagggcgacttcacctggaacagcatgagcggcagaagcgtgagactgagaagcgtgcccatccagagcctgagcgagctggagagagccagactgcaggaggtggccttctaccagctgcagcaggactgcgacctgagctgccagatcaccatccccaaggacggccagaagagaaagaagagcctgagaaagaagctggacagcctgggcaaggagaagaacaaggacaaggagttcatcccccaggccttcggcatgcccctgagccaggtgatcgccaacgacagagcctacaagctgaagcaggacctgcagagagacgagcagaaggacgccagcgacttcgtggccagcctgctgcccttcggcaacaagagacagaacaaggagctgagcagcagcaacagcagcctgagcagcaccagcgagacccccaacgagagcaccagccccaacacccccgagcccgcccccagagccagaagaagaggcgccatgagcgtggacagcatcaccgacctggacgacaaccagagcagactgctggaggccctgcagctgagcctgcccgccgaggcccagagcaagaaggagaaggccagagacaagaagctgagcctgaaccccatctacagacaggtgcccagactggtggacagctgctgccagcacctggagaagcacggcctgcagaccgtgggcatcttcagagtgggcagcagcaagaagagagtgagacagctgagagaggagttcgacagaggcatcgacgtgagcctggaggaggagcacagcgtgcacgacgtggccgccctgctgaaggagttcctgagagacatgcccgaccccctgctgaccagagagctgtacaccgccttcatcaacaccctgctgctggagcccgaggagcagctgggcaccctgcagctgctgatctacctgctgcccccctgcaactgcgacaccctgcacagactgctgcagttcctgagcatcgtggccagacacgccgacgacaacatcagcaaggacggccaggaggtgaccggcaacaagatgaccagcctgaacctggccaccatcttcggccccaacctgctgcacaagcagaagagcagcgacaaggagttcagcgtgcagagcagcgccagagccgaggagagcaccgccatcatcgccgtggtgcagaagatgatcgagaactacgaggccctgttcatggtgccccccgacctgcagaacgaggtgctgatcagcctgctggagaccgaccccgacgtggtggactacctgctgagaagaaaggccagccagagcagcagccccgacatgctgcagagcgaggtgagcttcagcgtgggcggcagacacagcagcaccgacagcaacaaggccagcagcggcgacatcagcccctacgacaacaacagccccgtgctgagcgagagaagcctgctggccatgcaggaggacgccgcccccggcggcagcgagaagctgtacagagtgcccggccagttcatgctggtgggccacctgagcagcagcaagagcagagagagcagccccggccccagactgggcaagggcaactggagcctggccagcagaagatggcccaagcaggccaccctgctgctgctgcacgtggcctggtgcggcgccctgagaaccttcagcagcagcctgccctacctgatgttcctgtag

SEQ ID NO: 97159 - DNA, 2073 bp, Artificial Sequence
  Description of Artificial Sequence: Synthetic coding sequence
atgagcgcccagagcctgctgcacagcgtgttcagctgcagcagccccgccagcagcagcgccgccagcgccaagggcttcagcaagagaaagctgagacagaccagaagcctggaccccgccctgatcggcggctgcggcagcgacgaggccggcgccgagggcagcgccagaggcgccaccgccggcagactgtacagccccagcctgcccgccgagagcctgggccccagactggccagcagcagcagaggccccccccccagagccaccagactgcccccccccggccccctgtgcagcagcttcagcacccccagcaccccccaggagaagagccccagcggcagcttccacttcgactacgaggtgcccctgggcagaggcggcctgaagaagagcatggcctgggacctgcccagcgtgctggccggccccgccagcagcagaagcgccagcagcatcctgtgcagcagcggcggcggccccaacggcatcttcgccagccccagaagatggctgcagcagagaaagttccagagcccccccgacagcagaggccacccctacgtggtgtggaagagcgagctggagctgtacgacctgcagatcctgggcaccaagccccccatgaacagcgacacccacagaaacttcgaccccaccgccaccctgagaaaccagggcgacttcacctggaacagcatgagcggcagaagcgtgagactgagaagcgtgcccatccagagcctgagcgagctggagagagccagactgcaggaggtggccttctaccagctgcagcaggactgcgacctgagctgccagatcaccatccccaaggacggccagaagagaaagaagagcctgagaaagaagctggacagcctgggcaaggagaagaacaaggacaaggagttcatcccccaggccttcggcatgcccctgagccaggtgatcgccaacgacagagcctacaagctgaagcaggacctgcagagagacgagcagaaggacgccagcgacttcgtggccagcctgctgcccttcggcaacaagagacagaacaaggagctgagcagcagcaacagcagcctgagcagcaccagcgagacccccaacgagagcaccagccccaacacccccgagcccgcccccagagccagaagaagaggcgccatgagcgtggacagcatcaccgacctggacgacaaccagagcagactgctggaggccctgcagctgagcctgcccgccgaggcccagagcaagaaggagaaggccagagacaagaagctgagcctgaaccccatctacagacaggtgcccagactggtggacagctgctgccagcacctggagaagcacggcctgcagaccgtgggcatcttcagagtgggcagcagcaagaagagagtgagacagctgagagaggagttcgacagaggcatcgacgtgagcctggaggaggagcacagcgtgcacgacgtggccgccctgctgaaggagttcctgagagacatgcccgaccccctgctgaccagagagctgtacaccgccttcatcaacaccctgctgctggagcccgaggagcagctgggcaccctgcagctgctgatctacctgctgcccccctgcaactgcgacaccctgcacagactgctgcagttcctgagcatcgtggccagacacgccgacgacaacatcagcaaggacggccaggaggtgaccggcaacaagatgaccagcctgaacctggccaccatcttcggccccaacctgctgcacaagcagaagagcagcgacaaggagttcagcgtgcagagcagcgccagagccgaggagagcaccgccatcatcgccgtggtgcagaagatgatcgagaactacgaggccctgttcatggtgccccccgacctgcagaacgaggtgctgatcagcctgctggagaccgaccccgacgtggtggactacctgctgagaagaaaggccagccagagcagcaccagcagcgtgctgcccgccgccgtgcaggcctgcccccagtaccccgccagcatgttcaccccctag

SEQ ID NO: 97160 - DNA, 2316 bp, Artificial Sequence; identical to SEQ ID NO: 97155
  Description of Artificial Sequence: Synthetic coding sequence

SEQ ID NO: 97161 - DNA, 1404 bp, Artificial Sequence
  Description of Artificial Sequence: Synthetic coding sequence
atgtacagaatcttcggcgacttcacctggaacagcatgagcggcagaagcgtgagactgagaagcgtgcccatccagagcctgagcgagctggagagagccagactgcaggaggtggccttctaccagctgcagcaggactgcgacctgagctgccagatcaccatccccaaggacggccagaagagaaagaagagcctgagaaagaagctggacagcctgggcaaggagaagaacaaggacaaggagttcatcccccaggccttcggcatgcccctgagccaggtgatcgccaacgacagagcctacaagctgaagcaggacctgcagagagacgagcagaaggacgccagcgacttcgtggccagcctgctgcccttcggcaacaagagacagaacaaggagctgagcagcagcaacagcagcctgagcagcaccagcgagacccccaacgagagcaccagccccaacacccccgagcccgcccccagagccagaagaagaggcgccatgagcgtggacagcatcaccgacctggacgacaaccagagcagactgctggaggccctgcagctgagcctgcccgccgaggcccagagcaagaaggagaaggccagagacaagaagctgagcctgaaccccatctacagacaggtgcccagactggtggacagctgctgccagcacctggagaagcacggcctgcagaccgtgggcatcttcagagtgggcagcagcaagaagagagtgagacagctgagagaggagttcgacagaggcatcgacgtgagcctggaggaggagcacagcgtgcacgacgtggccgccctgctgaaggagttcctgagagacatgcccgaccccctgctgaccagagagctgtacaccgccttcatcaacaccctgctgctggagcccgaggagcagctgggcaccctgcagctgctgatctacctgctgcccccctgcaactgcgacaccctgcacagactgctgcagttcctgagcatcgtggccagacacgccgacgacaacatcagcaaggacggccaggaggtgaccggcaacaagatgaccagcctgaacctggccaccatcttcggccccaacctgctgcacaagcagaagagcagcgacaaggagttcagcgtgcagagcagcgccagagccgaggagagcaccgccatcatcgccgtggtgcagaagatgatcgagaactacgaggccctgttcatggtgccccccgacctgcagaacgaggtgctgatcagcctgctggagaccgaccccgacgtggtggactacctgctgagaagaaaggccagccagagcagcaccagcagcgtgctgcccgccgccgtgcaggcctgcccccagtaccccgccagcatgttcaccccctag

SEQ ID NO: 97162 - DNA, 1815 bp, Artificial Sequence
  Description of Artificial Sequence: Synthetic coding sequence
atgaagagactgcacatcttcggccccaagatccacagcagcggcggcctgtggcagcagaagggcgacttcacctggaacagcatgagcggcagaagcgtgagactgagaagcgtgcccatccagagcctgagcgagctggagagagccagactgcaggaggtggccttctaccagctgcagcaggactgcgacctgagctgccagatcaccatccccaaggacggccagaagagaaagaagagcctgagaaagaagctggacagcctgggcaaggagaagaacaaggacaaggagttcatcccccaggccttcggcatgcccctgagccaggtgatcgccaacgacagagcctacaagctgaagcaggacctgcagagagacgagcagaaggacgccagcgacttcgtggccagcctgctgcccttcggcaacaagagacagaacaaggagctgagcagcagcaacagcagcctgagcagcaccagcgagacccccaacgagagcaccagccccaacacccccgagcccgcccccagagccagaagaagaggcgccatgagcgtggacagcatcaccgacctggacgacaaccagagcagactgctggaggccctgcagctgagcctgcccgccgaggcccagagcaagaaggagaaggccagagacaagaagctgagcctgaaccccatctacagacaggtgcccagactggtggacagctgctgccagcacctggagaagcacggcctgcagaccgtgggcatcttcagagtgggcagcagcaagaagagagtgagacagctgagagaggagttcgacagaggcatcgacgtgagcctggaggaggagcacagcgtgcacgacgtggccgccctgctgaaggagttcctgagagacatgcccgaccccctgctgaccagagagctgtacaccgccttcatcaacaccctgctgctggagcccgaggagcagctgggcaccctgcagctgctgatctacctgctgcccccctgcaactgcgacaccctgcacagactgctgcagttcctgagcatcgtggccagacacgccgacgacaacatcagcaaggacggccaggaggtgaccggcaacaagatgaccagcctgaacctggccaccatcttcggccccaacctgctgcacaagcagaagagcagcgacaaggagttcagcgtgcagagcagcgccagagccgaggagagcaccgccatcatcgccgtggtgcagaagatgatcgagaactacgaggccctgttcatggtgccccccgacctgcagaacgaggtgctgatcagcctgctggagaccgaccccgacgtggtggactacctgctgagaagaaaggccagccagagcagcagccccgacatgctgcagagcgaggtgagcttcagcgtgggcggcagacacagcagcaccgacagcaacaaggccagcagcggcgacatcagcccctacgacaacaacagccccgtgctgagcgagagaagcctgctggccatgcaggaggacgccgcccccggcggcagcgagaagctgtacagagtgcccggccagttcatgctggtgggccacctgagcagcagcaagagcagagagagcagccccggccccagactgggcaaggacctgagcgaggagcccttcgacatctggggcacctggcacagcaccctgaagagcggcagcaaggaccccggcatgaccggcaccacccccctgctgaacatcagcagccaggaggaccacagacagaaggacctgagactgatcttcaagatctacccctag

SEQ ID NO: 97163 - DNA, 918 bp, Artificial Sequence
  Description of Artificial Sequence: Synthetic coding sequence
atggccggccaggaccccgccctgagcaccagccaccccttctacgacgtggccagacacggcatcctgcaggtggccggcgacgacagattcggcagaagagtggtgaccttcagctgctgcagaatgccccccagccacgagctggaccaccagagactgctggagtacctgaagtacaccctggaccagtacgtggagaacgactacaccatcgtgtacttccactacggcctgaacagcagaaacaagcccagcctgggctggctgcagagcgcctacaaggagttcgacagaaagtacaagaagaacctgaaggccctgtacgtggtgcaccccaccagcttcatcaaggtgctgtggaacatcctgaagcccctgatcagccacaagttcggcaagaaggtgatctacttcaactacctgagcgagctgcacgagcacctgaagtacgaccagctggtgatcccccccgaggtgctgagatacgacgagaagctgcagagcctgcacgagggcagaacccccccccccaccaagacccccccccccagaccccccctgcccacccagcagttcggcgtgagcctgcagtacctgaaggacaagaaccagggcgagctgatcccccccgtgctgagattcaccgtgacctacctgagagagaagggcctgagaaccgagggcctgttcagaagaagcgccagcgtgcagaccgtgagagagatccagagactgtacaaccagggcaagcccgtgaacttcgacgactacggcgacatccacatccccgccgtgatcctgaagaccttcctgagagagctgccccagcccctgctgaccttccaggcctacgagcagatcctgggcatcacctgcgtgcccggcgagcacctgcagcagaacgagcagctgtag

SEQ ID NO: 97164 - DNA, 1302 bp, Artificial Sequence
  Description of Artificial Sequence: Synthetic coding sequence
atggccggccaggaccccgccctgagcaccagccaccccttctacgacgtggccagacacggcatcctgcaggtggccggcgacgacagattcggcagaagagtggtgaccttcagctgctgcagaatgccccccagccacgagctggaccaccagagactgctggagtacctgaagtacaccctggaccagtacgtggagaacgactacaccatcgtgtacttccactacggcctgaacagcagaaacaagcccagcctgggctggctgcagagcgcctacaaggagttcgacagaaagtacaagaagaacctgaaggccctgtacgtggtgcaccccaccagcttcatcaaggtgctgtggaacatcctgaagcccctgatcagccacaagttcggcaagaaggtgatctacttcaactacctgagcgagctgcacgagcacctgaagtacgaccagctggtgatcccccccgaggtgctgagatacgacgagaagctgcagagcctgcacgagggcagaacccccccccccaccaagacccccccccccagaccccccctgcccacccagcagttcggcgtgagcctgcagtacctgaaggacaagaaccagggcgagctgatcccccccgtgctgagattcaccgtgacctacctgagagagaagggcctgagaaccgagggcctgttcagaagaagcgccagcgtgcagaccgtgagagagatccagagactgtacaaccagggcaagcccgtgaacttcgacgactacggcgacatccacatccccgccgtgatcctgaagaccttcctgagagagctgccccagcccctgctgaccttccaggcctacgagcagatcctgggcatcacctgcgtggagagcagcctgagagtgaccggctgcagacagatcctgagaagcctgcccgagcacaactacgtggtgctgagatacctgatgggcttcctgcacgccgtgagcagagagagcatcttcaacaagatgaacagcagcaacctggcctgcgtgttcggcctgaacctgatctggcccagccagggcgtgagcagcctgagcgccctggtgcccctgaacatgttcaccgagctgctgatcgagtactacgagaagatcttcagcacccccgaggcccccggcgagcacggcctggccccctgggagcagggcagcagagccgcccccctgcaggaggccgtgcccagaacccaggccaccggcctgaccaagcccaccctgccccccagccccctgatggccgccagaagaagactgtag

SEQ ID NO: 97165 - DNA, 1668 bp, Artificial Sequence
  Description of Artificial Sequence: Synthetic coding sequence
atgagcagccccagcctgagcgacctgggcaagagagagcccgccgccgccgccgacgagagaggcacccagcagagaagagcctgcgccaacgccacctggaacagcatccacaacggcgtgatcgccgtgttccagagaaagggcctgcccgaccaggagctgttcagcctgaacgagggcgtgagacagctgctgaagaccgagctgggcagcttcttcaccgagtacctgcagaaccagctgctgaccaagggcatggtgatcctgagagacaagatcagattctacgaggagctgcagagagacaaggccgccgccgccgccgtgctgggcgccgtgagaaagagacccagcgtggtgcccatggccggccaggaccccgccctgagcaccagccaccccttctacgacgtggccagacacggcatcctgcaggtggccggcgacgacagattcggcagaagagtggtgaccttcagctgctgcagaatgccccccagccacgagctggaccaccagagactgctggagtacctgaagtacaccctggaccagtacgtggagaacgactacaccatcgtgtacttccactacggcctgaacagcagaaacaagcccagcctgggctggctgcagagcgcctacaaggagttcgacagaaagtacaagaagaacctgaaggccctgtacgtggtgcaccccaccagcttcatcaaggtgctgtggaacatcctgaagcccctgatcagccacaagttcggcaagaaggtgatctacttcaactacctgagcgagctgcacgagcacctgaagtacgaccagctggtgatcccccccgaggtgctgagatacgacgagaagctgcagagcctgcacgagggcagaacccccccccccaccaagacccccccccccagaccccccctgcccacccagcagttcggcgtgagcctgcagtacctgaaggacaagaaccagggcgagctgatcccccccgtgctgagattcaccgtgacctacctgagagagaagggcctgagaaccgagggcctgttcagaagaagcgccagcgtgcagaccgtgagagagatccagagactgtacaaccagggcaagcccgtgaacttcgacgactacggcgacatccacatccccgccgtgatcctgaagaccttcctgagagagctgccccagcccctgctgaccttccaggcctacgagcagatcctgggcatcacctgcgtggagagcagcctgagagtgaccggctgcagacagatcctgagaagcctgcccgagcacaactacgtggtgctgagatacctgatgggcttcctgcacgccgtgagcagagagagcatcttcaacaagatgaacagcagcaacctggcctgcgtgttcggcctgaacctgatctggcccagccagggcgtgagcagcctgagcgccctggtgcccctgaacatgttcaccgagctgctgatcgagtactacgagaagatcttcagcacccccgaggcccccggcgagcacggcctggccccctgggagcagggcagcagagccgcccccctgcaggaggccgtgcccagaacccaggccaccggcctgaccaagcccaccctgccccccagccccctgatggccgccagaagaagactgtag

SEQ ID NO: 97166 - DNA, 1395 bp, Artificial Sequence
  Description of Artificial Sequence: Synthetic coding sequence
atggccggccaggaccccgccctgagcaccagccaccccttctacgacgtggccagacacggcatcctgcaggtggccggcgacgacagattcggcagaagagtggtgaccttcagctgctgcagaatgccccccagccacgagctggaccaccagagactgctggagtacctgaagtacaccctggaccagtacgtggagaacgactacaccatcgtgtacttccactacggcctgaacagcagaaacaagcccagcctgggctggctgcagagcgcctacaaggagttcgacagaaaggacggcgacctgaccatgtggcccagactggtgagcaacagcaagctgaagagaagcagccacctgagcctgcccaagtactgggactacagatacaagaagaacctgaaggccctgtacgtggtgcaccccaccagcttcatcaaggtgctgtggaacatcctgaagcccctgatcagccacaagttcggcaagaaggtgatctacttcaactacctgagcgagctgcacgagcacctgaagtacgaccagctggtgatcccccccgaggtgctgagatacgacgagaagctgcagagcctgcacgagggcagaacccccccccccaccaagacccccccccccagaccccccctgcccacccagcagttcggcgtgagcctgcagtacctgaaggacaagaaccagggcgagctgatcccccccgtgctgagattcaccgtgacctacctgagagagaagggcctgagaaccgagggcctgttcagaagaagcgccagcgtgcagaccgtgagagagatccagagactgtacaaccagggcaagcccgtgaacttcgacgactacggcgacatccacatccccgccgtgatcctgaagaccttcctgagagagctgccccagcccctgctgaccttccaggcctacgagcagatcctgggcatcacctgcgtggagagcagcctgagagtgaccggctgcagacagatcctgagaagcctgcccgagcacaactacgtggtgctgagatacctgatgggcttcctgcacgccgtgagcagagagagcatcttcaacaagatgaacagcagcaacctggcctgcgtgttcggcctgaacctgatctggcccagccagggcgtgagcagcctgagcgccctggtgcccctgaacatgttcaccgagctgctgatcgagtactacgagaagatcttcagcacccccgaggcccccggcgagcacggcctggccccctgggagcagggcagcagagccgcccccctgcaggaggccgtgcccagaacccaggccaccggcctgaccaagcccaccctgccccccagccccctgatggccgccagaagaagactgtag

SEQ ID NO: 97167 - DNA, 393 bp, Artificial Sequence
  Description of Artificial Sequence: Synthetic coding sequence
atggccggccaggaccccgccctgagcaccagccaccccttctacgacgtggccagacacggcatcctgcaggtggccggcgacgacagattcggcagaagagtggtgaccttcagctgctgcagaatgccccccagccacgagctggaccaccagagactgctggagtacctgaagtacaccctggaccagtacgtggagaacgactacaccatcgtgtacttccactacggcctgaacagcagaaacaagcccagcctgggctggctgcagagcgcctacaaggagttcgacagaaaggacggcgacctgaccatgtggcccagactggtgagcaacagcaagctgaagagaagcagccacctgagcctgcccaagtactgggactactag

SEQ ID NO: 97168 - DNA, 348 bp, Artificial Sequence
  Description of Artificial Sequence: Synthetic coding sequence
atggccggccaggaccccgccctgagcaccagccaccccttctacgacgtggccagacacggcatcctgcaggtggccggcgacgacagattcggcagaagagtggtgaccttcagctgctgcagaatgccccccagccacgagctggaccaccagagactgctggagtacctgaagtacaccctggaccagtacgtggagaacgactacaccatcgtgtacttccactacggcctgaacagcagaaacaagcccagcctgggctggctgcagagcgcctacaaggagttcgacagaaagtacaagaagaacctgaaggccctgtacgtggtgcaccccaccagctag

SEQ ID NO: 97169 - DNA, 1932 bp, Artificial Sequence
  Description of Artificial Sequence: Synthetic coding sequence
atgagaaccctgagaagactgaagttcatgagcagccccagcctgagcgacctgggcaagagagagcccgccgccgccgccgacgagagaggcacccagcagagaagagcctgcgccaacgccacctggaacagcatccacaacggcgtgatcgccgtgttccagagaaagggcctgcccgaccaggagctgttcagcctgaacgagggcgtgagacagctgctgaagaccgagctgggcagcttcttcaccgagtacctgcagaaccagctgctgaccaagggcatggtgatcctgagagacaagatcagattctacgagggccagaagctgctggacagcctggccgagacctgggacttcttcttcagcgacgtgctgcccatgctgcaggccatcttctaccccgtgcagggcaaggagcccagcgtgagacagctggccctgctgcacttcagaaacgccatcaccctgagcgtgaagctggaggacgccctggccagagcccacgccagagtgccccccgccatcgtgcagatgctgctggtgctgcagggcgtgcacgagagcagaggcgtgaccgaggactacctgagactggagaccctggtgcagaaggtggtgagcccctacctgggcacctacggcctgcacagcagcgagggccccttcacccacagctgcatcctggagctgcagagagacaaggccgccgccgccgccgtgctgggcgccgtgagaaagagacccagcgtggtgcccatggccggccaggaccccgccctgagcaccagccaccccttctacgacgtggccagacacggcatcctgcaggtggccggcgacgacagattcggcagaagagtggtgaccttcagctgctgcagaatgccccccagccacgagctggaccaccagagactgctggagtacaagaagaacctgaaggccctgtacgtggtgcaccccaccagcttcatcaaggtgctgtggaacatcctgaagcccctgatcagccacaagttcggcaagaaggtgatctacttcaactacctgagcgagctgcacgagcacctgaagtacgaccagctggtgatcccccccgaggtgctgagatacgacgagaagctgcagagcctgcacgagggcagaacccccccccccaccaagacccccccccccagaccccccctgcccacccagcagttcggcgtgagcctgcagtacctgaaggacaagaaccagggcgagctgatcccccccgtgctgagattcaccgtgacctacctgagagagaagggcctgagaaccgagggcctgttcagaagaagcgccagcgtgcagaccgtgagagagatccagagactgtacaaccagggcaagcccgtgaacttcgacgactacggcgacatccacatccccgccgtgatcctgaagaccttcctgagagagctgccccagcccctgctgaccttccaggcctacgagcagatcctgggcatcacctgcgtggagagcagcctgagagtgaccggctgcagacagatcctgagaagcctgcccgagcacaactacgtggtgctgagatacctgatgggcttcctgcacgccgtgagcagagagagcatcttcaacaagatgaacagcagcaacctggcctgcgtgttcggcctgaacctgatctggcccagccagggcgtgagcagcctgagcgccctggtgcccctgaacatgttcaccgagctgctgatcgagtactacgagaagatcttcagcacccccgaggcccccggcgagcacggcctggccccctgggagcagggcagcagagccgcccccctgcaggaggccgtgcccagaacccaggccaccggcctgaccaagcccaccctgccccccagccccctgatggccgccagaagaagactgtag

SEQ ID NO: 97170 - DNA, 2322 bp, Artificial Sequence
  Description of Artificial Sequence: Synthetic coding sequence
cagacccagaccgagagcctgaccctgtgcagcggcgaggccgagagaagaggcaaggaggagtggcccgacagccaccactaccccggccccacccccgcccccgagagcagcgacggcccccacaaggtgaccgtgctggccaccatgctgagcagcagatggtggcccagcagctggggcatcctgggcctgggccccagaagcccccccagaggcagccagctgtgcgccctgtacgccttcacctacaccggcgccgacggccagcaggtgagcctggccgagggcgacagattcctgctgctgagaaagaccaacagcgactggtggctggccagaagactggaggcccccagcaccagcagacccatcttcgtgcccgccgcctacatgatcgaggagagcatccccagccagagccccaccaccgtgatccccggccagctgctgtggacccccggccccaagctgttccacggcagcctggaggagctgagccaggccctgcccagcagagcccaggccagcagcgagcagcccccccccctgcccagaaagatgtgcagaagcgtgagcaccgacaacctgagccccagcctgctgaagcccttccaggagggccccagcggcagaagcctgagccaggaggacctgcccagcgaggccagcgccagcaccgccggcccccagcccctgatgagcgagccccccgtgtactgcaacctggtggacctgagaagatgccccagaagccccccccccggccccgcctgccccctgctgcagagactggacgcctgggagcagcacctggaccccaacagcggcagatgcttctacatcaacagcctgaccggctgcaagagctggaagccccccagaagaagcagaagcgagaccaaccccggcagcatggagggcacccagaccctgaagagaaacaacgacgtgctgcagccccaggccaagggcttcagaagcgacaccggcacccccgagcccctggacccccagggcagcctgagcctgagccagagaaccagccagctggacccccccgccctgcaggcccccagacccctgccccagctgctggacgacccccacgaggtggagaagagcggcctgctgaacatgaccaagatcgcccagggcggcagaaagctgagaaagaactggggccccagctgggtggtgctgaccggcaacagcctggtgttctacagagagcccccccccaccgcccccagcagcggctggggccccgccggcagcagacccgagagcagcgtggacctgagaggcgccgccctggcccacggcagacacctgagcagcagaagaaacgtgctgcacatcagaaccatccccggccacgagttcctgctgcagagcgaccacgagaccgagctgagagcctggcacagagccctgagaaccgtgatcgagagactggacagagagaaccccctggagctgagactgagcggcagcggccccgccgagctgagcgccggcgaggacgaggaggaggagagcgagctggtgagcaagcccctgctgagactgagcagcagaagaagcagcatcagaggccccgagggcaccgagcagaacagagtgagaaacaagctgaagagactgatcgccaagagaccccccctgcagagcctgcaggagagaggcctgctgagagaccaggtgttcggctgccagctggagagcctgtgccagagagagggcgacaccgtgcccagcttcctgagactgtgcatcgccgccgtggacaagagaggcctggacgtggacggcatctacagagtgagcggcaacctggccgtggtgcagaagctgagattcctggtggacagagagagagccgtgaccagcgacggcagatacgtgttccccgagcagcccggccaggagggcagactggacctggacagcaccgagtgggacgacatccacgtggtgaccggcgccctgaagctgttcctgagagagctgccccagcccctggtgccccccctgctgctgccccacttcagagccgccctggccctgagccagatccaggagctgatcggcagcatgcccaagcccaaccacgacaccctgagatacctgctggagcacctgtgcagagtgatcgcccacagcgacaagaacagaatgaccccccacaacctgggcatcgtgttcggccccaccctgttcagacccgagcaggagaccagcgaccccgccgcccacgccctgtaccccggccagctggtgcagctgatgctgaccaacttcaccagcctgttcccctag

SEQ ID NO: 97171 - DNA, 2253 bp, Artificial Sequence
  Description of Artificial Sequence: Synthetic coding sequence
atgctgagcagcagatggtggcccagcagctggggcatcctgggcctgggccccagaagcccccccagaggcagccagctgtgcgccctgtacgccttcacctacaccggcgccgacggccagcaggtgagcctggccgagggcgacagattcctgctgctgagaaagaccaacagcgactggtggctggccagaagactggaggcccccagcaccagcagacccatcttcgtgcccgccgcctacatgatcgaggagagcatccccagccagagccccaccaccgtgatccccggccagctgctgtggacccccggccccaagctgttccacggcagcctggaggagctgagccaggccctgcccagcagagcccaggccagcagcgagcagcccccccccctgcccagaaagatgtgcagaagcgtgagcaccgacaacctgagccccagcctgctgaagcccttccaggagggccccagcggcagaagcctgagccaggaggacctgcccagcgaggccagcgccagcaccgccggcccccagcccctgatgagcgagccccccgtgtactgcaacctggtggacctgagaagatgccccagaagccccccccccggccccgcctgccccctgctgcagagactggacgcctgggagcagcacctggaccccaacagcggcagatgcttctacatcaacagcctgaccggctgcaagagctggaagccccccagaagaagcagaagcgagaccaaccccggcagcatggagggcacccagaccctgaagagaaacaacgacgtgctgcagccccaggccaagggcttcagaagcgacaccggcacccccgagcccctggacccccagggcagcctgagcctgagccagagaaccagccagctggacccccccgccctgcaggcccccagacccctgccccagctgctggacgacccccacgaggtggagaagagcggcctgctgaacatgaccaagatcgcccagggcggcagaaagctgagaaagaactggggccccagctgggtggtgctgaccggcaacagcctggtgttctacagagagcccccccccaccgcccccagcagcggctggggccccgccggcagcagacccgagagcagcgtggacctgagaggcgccgccctggcccacggcagacacctgagcagcagaagaaacgtgctgcacatcagaaccatccccggccacgagttcctgctgcagagcgaccacgagaccgagctgagagcctggcacagagccctgagaaccgtgatcgagagactggtgagatgggtggaggccagaagagaggcccccaccggcagagaccagggcagcggcgacagagagaaccccctggagctgagactgagcggcagcggccccgccgagctgagcgccggcgaggacgaggaggaggagagcgagctggtgagcaagcccctgctgagactgagcagcagaagaagcagcatcagaggccccgagggcaccgagcagaacagagtgagaaacaagctgaagagactgatcgccaagagaccccccctgcagagcctgcaggagagaggcctgctgagagaccaggtgttcggctgccagctggagagcctgtgccagagagagggcgacaccgtgcccagcttcctgagactgtgcatcgccgccgtggacaagagaggcctggacgtggacggcatctacagagtgagcggcaacctggccgtggtgcagaagctgagattcctggtggacagagagagagccgtgaccagcgacggcagatacgtgttccccgagcagcccggccaggagggcagactggacctggacagcaccgagtgggacgacatccacgtggtgaccggcgccctgaagctgttcctgagagagctgccccagcccctggtgccccccctgctgctgccccacttcagagccgccctggccctgagcgagagcgagcagtgcctgagccagatccaggagctgatcggcagcatgcccaagcccaaccacgacaccctgagatacctgctggagcacctgtgcagagtgatcgcccacagcgacaagaacagaatgaccccccacaacctgggcatcgtgttcggccccaccctgttcagacccgagcaggagaccagcgaccccgccgcccacgccctgtaccccggccagctggtgcagctgatgctgaccaacttcaccagcctgttcccctag

SEQ ID NO: 97172 - DNA, 2196 bp, Artificial Sequence
  Description of Artificial Sequence: Synthetic coding sequence
atgctgagcagcagatggtggcccagcagctggggcatcctgggcctgggccccagaagcccccccagaggcagccagctgtgcgccctgtacgccttcacctacaccggcgccgacggccagcaggtgagcctggccgagggcgacagattcctgctgctgagaaagaccaacagcgactggtggctggccagaagactggaggcccccagcaccagcagacccatcttcgtgcccgccgcctacatgatcgaggagagcatccccagccagagccccaccaccgtgatccccggccagctgctgtggacccccggccccaagctgttccacggcagcctggaggagctgagccaggccctgcccagcagagcccaggccagcagcgagcagcccccccccctgcccagaaagatgtgcagaagcgtgagcaccgacaacctgagccccagcctgctgaagcccttccaggagggccccagcggcagaagcctgagccaggaggacctgcccagcgaggccagcgccagcaccgccggcccccagcccctgatgagcgagccccccgtgtactgcaacctggtggacctgagaagatgccccagaagccccccccccggccccgcctgccccctgctgcagagactggacgcctgggagcagcacctggaccccaacagcggcagatgcttctacatcaacagcctgaccggctgcaagagctggaagccccccagaagaagcagaagcgagaccaaccccggcagcatggagggcacccagaccctgaagagaaacaacgacgtgctgcagccccaggccaagggcttcagaagcgacaccggcacccccgagcccctggacccccagggcagcctgagcctgagccagagaaccagccagctggacccccccgccctgcaggcccccagacccctgccccagctgctggacgacccccacgaggtggagaagagcggcctgctgaacatgaccaagatcgcccagggcggcagaaagctgagaaagaactggggccccagctgggtggtgctgaccggcaacagcctggtgttctacagagagcccccccccaccgcccccagcagcggctggggccccgccggcagcagacccgagagcagcgtggacctgagaggcgccgccctggcccacggcagacacctgagcagcagaagaaacgtgctgcacatcagaaccatccccggccacgagttcctgctgcagagcgaccacgagaccgagctgagagcctggcacagagccctgagaaccgtgatcgagagactggacagagagaaccccctggagctgagactgagcggcagcggccccgccgagctgagcgccggcgaggacgaggaggaggagagcgagctggtgagcaagcccctgctgagactgagcagcagaagaagcagcatcagaggccccgagggcaccgagcagaacagagtgagaaacaagctgaagagactgatcgccaagagaccccccctgcagagcctgcaggagagaggcctgctgagagaccaggtgttcggctgccagctggagagcctgtgccagagagagggcgacaccgtgcccagcttcctgagactgtgcatcgccgccgtggacaagagaggcctggacgtggacggcatctacagagtgagcggcaacctggccgtggtgcagaagctgagattcctggtggacagagagagagccgtgaccagcgacggcagatacgtgttccccgagcagcccggccaggagggcagactggacctggacagcaccgagtgggacgacatccacgtggtgaccggcgccctgaagctgttcctgagagagctgccccagcccctggtgccccccctgctgctgccccacttcagagccgccctggccctgagcgagagcgagcagtgcctgagccagatccaggagctgatcggcagcatgcccaagcccaaccacgacaccctgagatacctgctggagcacctgtgcagagtgatcgcccacagcgacaagaacagaatgaccccccacaacctgggcatcgtgttcggccccaccctgttcagacccgagcaggagaccagcgaccccgccgcccacgccctgtaccccggccagctggtgcagctgatgctgaccaacttcaccagcctgttcccctag

SEQ ID NO: 97173 - DNA, 2466 bp, Artificial Sequence
  Description of Artificial Sequence: Synthetic coding sequence
atgagaagaggcagcagcgacagctgcgccagcggcagccaggtggccggcaccaccgtggccggccccgcccaccccgagagcctgaccctgtgcagcggcgaggccgagagaagaggcaaggaggagtggcccgacagccaccactaccccggccccacccccgcccccgagagcagcgacggcccccacaaggtgaccgtgctggccaccatgctgagcagcagatggtggcccagcagctggggcatcctgggcctgggccccagaagcccccccagaggcagccagctgtgcgccctgtacgccttcacctacaccggcgccgacggccagcaggtgagcctggccgagggcgacagattcctgctgctgagaaagaccaacagcgactggtggctggccagaagactggaggcccccagcaccagcagacccatcttcgtgcccgccgcctacatgatcgaggagagcatccccagccagagccccaccaccgtgatccccggccagctgctgtggacccccggccccaagctgttccacggcagcctggaggagctgagccaggccctgcccagcagagcccaggccagcagcgagcagcccccccccctgcccagaaagatgtgcagaagcgtgagcaccgacaacctgagccccagcctgctgaagcccttccaggagggccccagcggcagaagcctgagccaggaggacctgcccagcgaggccagcgccagcaccgccggcccccagcccctgatgagcgagccccccgtgtactgcaacctggtggacctgagaagatgccccagaagccccccccccggccccgcctgccccctgctgcagagactggacgcctgggagcagcacctggaccccaacagcggcagatgcttctacatcaacagcctgaccggctgcaagagctggaagccccccagaagaagcagaagcgagaccaaccccggcagcatggagggcacccagaccctgaagagaaacaacgacgtgctgcagccccaggccaagggcttcagaagcgacaccggcacccccgagcccctggacccccagggcagcctgagcctgagccagagaaccagccagctggacccccccgccctgcaggcccccagacccctgccccagctgctggacgacccccacgaggtggagaagagcggcctgctgaacatgaccaagatcgcccagggcggcagaaagctgagaaagaactggggccccagctgggtggtgctgaccggcaacagcctggtgttctacagagagcccccccccaccgcccccagcagcggctggggccccgccggcagcagacccgagagcagcgtggacctgagaggcgccgccctggcccacggcagacacctgagcagcagaagaaacgtgctgcacatcagaaccatccccggccacgagttcctgctgcagagcgaccacgagaccgagctgagagcctggcacagagccctgagaaccgtgatcgagagactggtgagatgggtggaggccagaagagaggcccccaccggcagagaccagggcagcggcgacagagagaaccccctggagctgagactgagcggcagcggccccgccgagctgagcgccggcgaggacgaggaggaggagagcgagctggtgagcaagcccctgctgagactgagcagcagaagaagcagcatcagaggccccgagggcaccgagcagaacagagtgagaaacaagctgaagagactgatcgccaagagaccccccctgcagagcctgcaggagagaggcctgctgagagaccaggtgttcggctgccagctggagagcctgtgccagagagagggcgacaccgtgcccagcttcctgagactgtgcatcgccgccgtggacaagagaggcctggacgtggacggcatctacagagtgagcggcaacctggccgtggtgcagaagctgagattcctggtggacagagagagagccgtgaccagcgacggcagatacgtgttccccgagcagcccggccaggagggcagactggacctggacagcaccgagtgggacgacatccacgtggtgaccggcgccctgaagctgttcctgagagagctgccccagcccctggtgccccccctgctgctgccccacttcagagccgccctggccctgagcgagagcgagcagtgcctgagccagatccaggagctgatcggcagcatgcccaagcccaaccacgacaccctgagatacctgctggagcacctgtgcagagtgatcgcccacagcgacaagaacagaatgaccccccacaacctgggcatcgtgttcggccccaccctgttcagacccgagcaggagaccagcgaccccgccgcccacgccctgtaccccggccagctggtgcagctgatgctgaccaacttcaccagcctgttcccctag

SEQ ID NO: 97174 - DNA, 900 bp, Artificial Sequence
  Description of Artificial Sequence: Synthetic coding sequence
atgaccaagatcgcccagggcggcagaaagctgagaaagaactggggccccagctgggtggtgctgaccggcaacagcctggtgttctacagagagcccccccccaccgcccccagcagcggctggggccccgccggcagcagacccgagagcagcgtggacctgagaggcgccgccctggcccacggcagacacctgagcagcagaagaaacgtgctgcacatcagaaccatccccggccacgagttcctgctgcagagcgaccacgagaccgagctgagagcctggcacagagccctgagaaccgtgatcgagagactggacagagagaaccccctggagctgagactgagcggcagcggccccgccgagctgagcgccggcgaggacgaggaggaggagagcgagctggtgagcaagcccctgctgagactgagcagcagaagaagcagcatcagaggccccgagggcaccgagcagaacagagtgagaaacaagctgaagagactgatcgccaagagaccccccctgcagagcctgcaggagagaggcctgctgagagaccaggtgttcggctgccagctggagagcctgtgccagagagagggcgacaccgtgcccagcttcctgagactgtgcatcgccgccgtggacaagagaggcctggacgtggacggcatctacagagtgagcggcaacctggccgtggtgcagaagctgagattcctggtggacagagagagagccgtgaccagcgacggcagatacgtgttccccgagcagcccggccaggccctgagcgagagcgagcagtgcctgagccagatccaggagctgatcggcagcatgcccaagcccaaccacgacaccctgagatacctgctggagcacctgtgctag

SEQ ID NO: 97175 - DNA, 1923 bp, Artificial Sequence
  Description of Artificial Sequence: Synthetic coding sequence
atgctgagcagcagatggtggcccagcagctggggcatcctgggcctgggccccagaagcccccccagaggcagccagctgtgcgccctgtacgccttcacctacaccggcgccgacggccagcaggtgagcctggccgagggcgacagattcctgctgctgagaaagaccaacagcgactggtggctggccagaagactggaggcccccagcaccagcagacccatcttcgtgcccgccgcctacatgatcgaggagagcatccccagccagagccccaccaccgtgatccccggccagctgctgtggacccccggccccaagctgttccacggcagcctggaggagctgagccaggccctgcccagcagagcccaggccagcagcgagcagcccccccccctgcccagaaagatgtgcagaagcgtgagcaccgacaacctgagccccagcctgctgaagcccttccaggagggccccagcggcagaagcctgagccaggaggacctgcccagcgaggccagcgccagcaccgccggcccccagcccctgatgagcgagccccccgtgtactgcaacctggtggacctgagaagatgccccagaagccccccccccggccccgcctgccccctgctgcagagactggacgcctgggagcagcacctggaccccaacagcggcagatgcttctacatcaacagcctgaccggctgcaagagctggaagccccccagaagaagcagaagcgagaccaaccccggcagcatggagggcacccagaccctgaagagaaacaacgacgtgctgcagccccaggccaagggcttcagaagcgacaccggcacccccgagcccctggacccccagggcagcctgagcctgagccagagaaccagccagctggacccccccgccctgcaggcccccagacccctgccccagctgctggacgacccccacgaggtggagaagagcggcctgctgaacatgaccaagatcgcccagggcggcagaaagctgagaaagaactggggccccagctgggtggtgctgaccggcaacagcctggtgttctacagagagcccccccccaccgcccccagcagcggctggggccccgccggcagcagacccgagagcagcgtggacctgagaggcgccgccctggcccacggcagacacctgagcagcagaagaaacgtgctgcacatcagaaccatccccggccacgagttcctgctgcagagcgaccacgagaccgagctgagagcctggcacagagccctgagaaccgtgatcgagagactggacagagagaaccccctggagctgagactgagcggcagcggccccgccgagctgagcgccggcgaggacgaggaggaggagagcgagctggtgagcaagcccctgctgagactgagcagcagaagaagcagcatcagaggccccgagggcaccgagcagaacagagtgagaaacaagctgaagagactgatcgccaagagaccccccctgcagagcctgcaggagagaggcctgctgagagaccaggtgttcggctgccagctggagagcctgtgccagagagagggcgacaccgtgcccagcttcctgagactgtgcatcgccgccgtggacaagagaggcctggacgtggacggcatctacagagtgagcggcaacctggccgtggtgcagaagctgagattcctggtggacagagagagagccgtgaccagcgacggcagatacgtgttccccgagcagcccggccaggagggcagactggacctggacagcaccgagtgggacgacatccacgtggtgaccggcgccctgaagctgttcctgagagagctgccccagcccctggtgccccccctgctgctgccccacttcagagccgccctgggctag

SEQ ID NO: 97176 - DNA, 1644 bp, Artificial Sequence
  Description of Artificial Sequence: Synthetic coding sequence
atgagcgagccccccgtgtactgcaacctggtggacctgagaagatgccccagaagccccccccccggccccgcctgccccctgctgcagagactggacgcctgggagcagcacctggaccccaacagcggcagatgcttctacatcaacagcctgaccggctgcaagagctggaagccccccagaagaagcagaagcgagaccaaccccggcagcatggagggcacccagaccctgaagagaaacaacgacgtgctgcagccccaggccaagggcttcagaagcgacaccggcacccccgagcccctggacccccagggcagcctgagcctgagccagagaaccagccagctggacccccccgccctgcaggcccccagacccctgccccagctgctggacgacccccacgaggtggagaagagcggcctgctgaacatgaccaagatcgcccagggcggcagaaagctgagaaagaactggggccccagctgggtggtgctgaccggcaacagcctggtgttctacagagagcccccccccaccgcccccagcagcggctggggccccgccggcagcagacccgagagcagcgtggacctgagaggcgccgccctggcccacggcagacacctgagcagcagaagaaacgtgctgcacatcagaaccatccccggccacgagttcctgctgcagagcgaccacgagaccgagctgagagcctggcacagagccctgagaaccgtgatcgagagactggacagagagaaccccctggagctgagactgagcggcagcggccccgccgagctgagcgccggcgaggacgaggaggaggagagcgagctggtgagcaagcccctgctgagactgagcagcagaagaagcagcatcagaggccccgagggcaccgagcagaacagagtgagaaacaagctgaagagactgatcgccaagagaccccccctgcagagcctgcaggagagaggcctgctgagagaccaggtgttcggctgccagctggagagcctgtgccagagagagggcgacaccgtgcccagcttcctgagactgtgcatcgccgccgtggacaagagaggcctggacgtggacggcatctacagagtgagcggcaacctggccgtggtgcagaagctgagattcctggtggacagagagagagccgtgaccagcgacggcagatacgtgttccccgagcagcccggccaggagggcagactggacctggacagcaccgagtgggacgacatccacgtggtgaccggcgccctgaagctgttcctgagagagctgccccagcccctggtgccccccctgctgctgccccacttcagagccgccctggccctgagcgagagcgagcagtgcctgagccagatccaggagctgatcggcagcatgcccaagcccaaccacgacaccctgagatacctgctggagcacctgtgcagagtgatcgcccacagcgacaagaacagaatgaccccccacaacctgggcatcgtgttcggccccaccctgttcagacccgagcaggagaccagcgaccccgccgcccacgccctgtaccccggccagctggtgcagctgatgctgaccaacttcaccagcctgttcccctag

SEQ ID NO: 97177 - DNA, 894 bp, Artificial Sequence
  Description of Artificial Sequence: Synthetic coding sequence
atgagcgagccccccgtgtactgcaacctggtggacctgagaagatgccccagaagccccccccccggccccgcctgccccctgctgcagagactggacgcctgggagcagcacctggaccccaacagcggcagatgcttctacatcaacagcctgaccggctgcaagagctggaagccccccagaagaagcagaagcgagaccaaccccggcagcatggagggcacccagaccctgaagagaaacaacgacgtgctgcagccccaggccaagggcttcagaagcgacaccggcacccccgagcccctggacccccagggcagcctgagcctgagccagagaaccagccagctggacccccccgccctgcaggcccccagacccctgccccagctgctggacgacccccacgaggtggagaagagcggcctgctgaacatgaccaagatcgcccagggcggcagaaagctgagaaagaactggggccccagctgggtggtgctgaccggcaacagcctggtgttctacagagagcccccccccaccgcccccagcagcggctggggccccgccggcagcagacccgagagcagcgtggacctgagaggcgccgccctggcccacggcagacacctgagcagcagaagaaacgtgctgcacatcagaaccatccccggccacgagttcctgctgcagagcgaccacgagaccgagctgagagcctggcacagagccctgagaaccgtgatcgagagactggacagagagaaccccctggagctgagactgagcggcagcggccccgccgagctgagcgccggcgaggacgaggaggaggagagcgagctggtgagcaagcccctgctgagactgagcagcagaagaagcagctag

SEQ ID NO: 97178 - DNA, 186 bp, Artificial Sequence
  Description of Artificial Sequence: Synthetic coding sequence
atgagcgagccccccgtgtactgcaacctggtggacctgagaagatgccccagaagccccccccccggccccgcctgccccctgctgcagagactggacgcctgggagcagcacctggaccccaacagcggcagatgcttctacatcaacagcctgaccggctgcaagagctggaagcccccctag

SEQ ID NO: 97179 - DNA, 471 bp, Artificial Sequence
  Description of Artificial Sequence: Synthetic coding sequence
tgagagggcgacaccgtgcccagcttcctgagactgtgcatcgccgccgtggacaagagaggcctggacgtggacggcatctacagagtgagcggcaacctggccgtggtgcagaagctgagattcctggtggacagagagagagccgtgaccagcgacggcagatacgtgttccccgagcagcccggccaggccctgagcgagagcgagcagtgcctgagccagatccaggagctgatcggcagcatgcccaagcccaaccacgacaccctgagatacctgctggagcacctgtgcagagtgatcgcccacagcgacaagaacagaatgaccccccacaacctgggcatcgtgttcggccccaccctgttcagacccgagcaggagaccagcgaccccgccgcccacgccctgtaccccggccagctggtgcagctgatgctgaccaacttcaccagcctgttcccctag

SEQ ID NO: 97180 - DNA, 396 bp, Artificial Sequence
  Description of Artificial Sequence: Synthetic coding sequence
atgagcgagccccccgtgtactgcaacctggtggacctgagaagatgccccagaagccccccccccggccccgcctgccccctgctgcagagactggacgcctgggagcagcacctggaccccaacagcggcagatgcttctacatcaacagcctgaccggctgcaagagctggaagccccccagaagaagcagaagcgagaccaaccccggcagcatggagggcacccagaccctgaagagaaacaacgacgtgctgcagccccaggccaagggcttcagaagcgacaccggcacccccgagcccctggacccccagggcagcctgagcctgagccagagaaccagccagctggacccccccgccctgcaggcccccagacccctgccccagtag

SEQ ID NO: 97181 - DNA, 2028 bp, Artificial Sequence
  Description of Artificial Sequence: Synthetic coding sequence
gagcccggcagcggcagcagagaccccggccccggcatcgccgagcccgacctgggcagacccgccggccacctgagagccgacaccagccccgccgagcccagagagatggaggacttcgccagaggcgccgccagccccggccccagcagacccggcctggtgcccgtgagcatcatcggcgccgaggacgaggacttcgagaacgagctggagaccaacagcgaggagcagaacagccagttccagagcctggagcaggtgaagagaagacccgcccacctgatggccctgctgcagcacgtggccctgcagttcgagcccggccccctgctgtgctgcctgcacgccgacatgctgggcagcctgggccccaaggaggccaagaaggccttcctggacttctaccacagcttcctggagaagaccgccgtgctgagagtgcccgtgccccccaacgtggccttcgagctggacagaaccagagccgacctgatcagcgaggacgtgcagagaagattcgtgcaggaggtggtgcagagccagcaggtggccgtgggcagacagctggaggacttcagaagcaagagactgatgggcatgaccccctgggagcaggagctggcccagctggaggcctgggtgggcagagacagagccagctacgaggccagagagagacacgtggccgagagactgctgatgcacctggaggagatgcagcacaccatcagcaccgacgaggagaagagcgccgccgtggtgaacgccatcggcctgtacatgagacacctgggcgtgagaaccaagagcggcgacaagaagagcggcagaaacttcttcagaaagaaggtgatgggcaacagaagaagcgacgagcccgccaagaccaagaagggcctgagcagcatcctggacgccgccagatggaacagaggcgagccccaggtgcccgacttcagacacctgaaggccgaggtggacgccgagaagcccggcgccaccgacagaaagggcggcgtgggcatgcccagcagagacagaaacatcggcgcccccggccaggacacccccggcgtgagcctgcaccccctgagcctggacagccccgacagagagcccggcgccgacgcccccctggagctgggcgacagcagcccccagggccccatgagcctggagagcctggccccccccgagagcaccgacgagggcgccgagaccgagagatgccccggctggggcgccggcgccggcggcgtggcctactgggccctggtgggcggctgcagagtgaccgccgccatctgcgcctgcctgagccaggccctggccccccacgcccccctgctgctgagcggcagcggccacagcagccccttcttcttccccttcctgatcagcctgctgctgccccactgcccccccttcctgctgagcttcctgttccccctgctgctgcccctgctgcccttcttcaccaaccccagccccccccccttcctgagcaccacccccagcatcagcttcatcagcagccccctgctgagccacctgcccccccccctgttccccccccacagcagcctgacctgggtgttcttcccccacctgcccagccccagcgacctgcccgccaccttccacttcttcagccccagccccttcagcttcaagcccccctgccccctgccccccacccccagactggcccccgccagctggtgccccagcctgaaccccccccccctgtgcagcgtgccctggggcccctgccccccctacagctggggcgccggcagcgccagctgccccagcctgtgcagatgcttcggcgaccccctggtgggcgccggcagatgggtgagattccacctgggcccccccctgaccctgtgccccagcctgcccagaagatggaagagatgggtgcccggcccctgggtgggcgagggcctggcccccccccccttcctgcccgccccccccctgagcccctggcccctgccccccctgcacagcctgtag

SEQ ID NO: 97182 - DNA, 2784 bp, Artificial Sequence
  Description of Artificial Sequence: Synthetic coding sequence
atggccagcctgagcacctggagcagccccgccgagcccagagagatggaggacttcgccagaggcgccgccagccccggccccagcagacccggcctggtgcccgtgagcatcatcggcgccgaggacgaggacttcgagaacgagctggagaccaacagcgaggagcagaacagccagttccagagcctggagcaggtgaagagaagacccgcccacctgatggccctgctgcagcacgtggccctgcagttcgagcccggccccctgctgtgctgcctgcacgccgacatgctgggcagcctgggccccaaggaggccaagaaggccttcctggacttctaccacagcttcctggagaagaccgccgtgctgagagtgcccgtgccccccaacgtggccttcgagctggacagaaccagagccgacctgatcagcgaggacgtgcagagaagattcgtgcaggaggtggtgcagagccagcaggtggccgtgggcagacagctggaggacttcagaagcaagagactgatgggcatgaccccctgggagcaggagctggcccagctggaggcctgggtgggcagagacagagccagctacgaggccagagagagacacgtggccgagagactgctgatgcacctggaggagatgcagcacaccatcagcaccgacgaggagaagagcgccgccgtggtgaacgccatcggcctgtacatgagacacctgggcgtgagaaccaagagcggcgacaagaagagcggcagaaacttcttcagaaagaaggtgatgggcaacagaagaagcgacgagcccgccaagaccaagaagggcctgagcagcatcctggacgccgccagatggaacagaggcgagccccaggtgcccgacttcagacacctgaaggccgaggtggacgccgagaagcccggcgccaccgacagaaagggcggcgtgggcatgcccagcagagacagaaacatcggcgcccccggccaggacacccccggcgtgagcctgcaccccctgagcctggacagccccgacagagagcccggcgccgacgcccccctggagctgggcgacagcagcccccagggccccatgagcctggagagcctggccccccccgagagcaccgacgagggcgccgagaccgagagccccgagcccggcgacgagggcgagcccggcagaagcggcctggagctggagcccgaggagccccccggctggagagagctggtgccccccgacaccctgcacagcctgcccaagagccaggtgaagagacaggaggtgatcagcgagctgctggtgaccgaggccgcccacgtgagaatgctgagagtgctgcacgacctgttcttccagcccatggccgagtgcctgttcttccccctggaggagctgcagaacatcttccccagcctggacgagctgatcgaggtgcacagcctgttcctggacagactgatgaagagaagacaggagagcggctacctgatcgaggagatcggcgacgtgctgctggccagattcgacggcgccgagggcagctggttccagaagatcagcagcagattctgcagcagacagagcttcgccctggagcagctgaaggccaagcagagaaaggaccccagattctgcgccttcgtgcaggaggccgagagcagacccagatgcagaagactgcagctgaaggacatgatccccaccgagatgcagagactgaccaagtaccccctgctgctgcagagcatcggccagaacaccgaggagcccaccgagagagagaaggtggagctggccgccgagtgctgcagagagatcctgcaccacgtgaaccaggccgtgagagacatggaggacctgctgagactgaaggactaccagagaagactggacctgagccacctgagacagagcagcgaccccatgctgagcgagttcaagaacctggacatcaccaagaagaagctggtgcacgagggccccctgacctggagagtgaccaaggacaaggccgtggaggtgcacgtgctgctgctggacgacctgctgctgctgctgcagagacaggacgagagactgctgctgaagagccacagcagaaccctgacccccacccccgacggcaagaccatgctgagacccgtgctgagactgaccagcgccatgaccagagaggtggccaccgaccacaaggccttctacgtgctgttcacctgggaccaggaggcccagatctacgagctggtggcccagaccgtgagcgagagaaagaactggtgcgccctgatcaccgagaccgccggcagcctgaaggtgcccgcccccgccagcagacccaagcccagacccagccccagcagcaccagagagcccctgctgagcagcagcgagaacggcaacggcggcagagagaccagccccgccgacgccagaaccgagagaatcctgagcgacctgctgcccttctgcagacccggccccgagggccagctggccgccaccgccctgagaaaggtgctgagcctgaagcagctgctgttccccgccgaggaggacaacggcgccggcccccccagagacggcgacggcgtgcccggcggcggccccctgagccccgccagaacccaggagatccaggagaacctgctgagcctggaggagaccatgaagcagctggaggagctggaggaggagttctgcagactgagacccctgctgagccagctgggcggcaacagcgtgccccagcccggctgcacctag

SEQ ID NO: 97183 - DNA, 2640 bp, Artificial Sequence
  Description of Artificial Sequence: Synthetic coding sequence
atggaggacttcgccagaggcgccgccagccccggccccagcagacccggcctggtgcccgtgagcatcatcggcgccgaggacgaggacttcgagaacgagctggagaccaacagcgaggagcagaacagccagttccagagcctggagcaggtgaagagaagacccgcccacctgatggccctgctgcagcacgtggccctgcagttcgagcccggccccctggtgctgagagtgcccgtgccccccaacgtggccttcgagctggacagaaccagagccgacctgatcagcgaggacgtgcagagaagattcgtgcaggaggtggtgcagagccagcaggtggccgtgggcagacagctggaggacttcagaagcaagagactgatgggcatgaccccctgggagcaggagctggcccagctggaggcctgggtgggcagagacagagccagctacgaggccagagagagacacgtggccgagagactgctgatgcacctggaggagatgcagcacaccatcagcaccgacgaggagaagagcgccgccgtggtgaacgccatcggcctgtacatgagacacctgggcgtgagaaccaagagcggcgacaagaagagcggcagaaacttcttcagaaagaaggtgatgggcaacagaagaagcgacgagcccgccaagaccaagaagggcctgagcagcatcctggacgccgccagatggaacagaggcgagccccaggtgcccgacttcagacacctgaaggccgaggtggacgccgagaagcccggcgccaccgacagaaagggcggcgtgggcatgcccagcagagacagaaacatcggcgcccccggccaggacacccccggcgtgagcctgcaccccctgagcctggacagccccgacagagagcccggcgccgacgcccccctggagctgggcgacagcagcccccagggccccatgagcctggagagcctggccccccccgagagcaccgacgagggcgccgagaccgagagccccgagcccggcgacgagggcgagcccggcagaagcggcctggagctggagcccgaggagccccccggctggagagagctggtgccccccgacaccctgcacagcctgcccaagagccaggtgaagagacaggaggtgatcagcgagctgctggtgaccgaggccgcccacgtgagaatgctgagagtgctgcacgacctgttcttccagcccatggccgagtgcctgttcttccccctggaggagctgcagaacatcttccccagcctggacgagctgatcgaggtgcacagcctgttcctggacagactgatgaagagaagacaggagagcggctacctgatcgaggagatcggcgacgtgctgctggccagattcgacggcgccgagggcagctggttccagaagatcagcagcagattctgcagcagacagagcttcgccctggagcagctgaaggccaagcagagaaaggaccccagattctgcgccttcgtgcaggaggccgagagcagacccagatgcagaagactgcagctgaaggacatgatccccaccgagatgcagagactgaccaagtaccccctgctgctgcagagcatcggccagaacaccgaggagcccaccgagagagagaaggtggagctggccgccgagtgctgcagagagatcctgcaccacgtgaaccaggccgtgagagacatggaggacctgctgagactgaaggactaccagagaagactggacctgagccacctgagacagagcagcgaccccatgctgagcgagttcaagaacctggacatcaccaagaagaagctggtgcacgagggccccctgacctggagagtgaccaaggacaaggccgtggaggtgcacgtgctgctgctggacgacctgctgctgctgctgcagagacaggacgagagactgctgctgaagagccacagcagaaccctgacccccacccccgacggcaagaccatgctgagacccgtgctgagactgaccagcgccatgaccagagaggtggccaccgaccacaaggccttctacgtgctgttcacctgggaccaggaggcccagatctacgagctggtggcccagaccgtgagcgagagaaagaactggtgcgccctgatcaccgagaccgccggcagcctgaaggtgcccgcccccgccagcagacccaagcccagacccagccccagcagcaccagagagcccctgctgagcagcagcgagaacggcaacggcggcagagagaccagccccgccgacgccagaaccgagagaatcctgagcgacctgctgcccttctgcagacccggccccgagggccagctggccgccaccgccctgagaaaggtgctgagcctgaagcagctgctgttccccgccgaggaggacaacggcgccggcccccccagagacggcgacggcgtgcccggcggcggccccctgagccccgccagaacccaggagatccaggagaacctgctgagcctggaggagaccatgaagcagctggaggagctggaggaggagttctgcagactgagacccctgctgagccagctgggcggcaacagcgtgccccagcccggctgcacctag

SEQ ID NO: 97184 - DNA, 2739 bp, Artificial Sequence
  Description of Artificial Sequence: Synthetic coding sequence
atggaggacttcgccagaggcgccgccagccccggccccagcagacccggcctggtgcccgtgagcatcatcggcgccgaggacgaggacttcgagaacgagctggagaccaacagcgaggagcagaacagccagttccagagcctggagcaggtgaagagaagacccgcccacctgatggccctgctgcagcacgtggccctgcagttcgagcccggccccctgctgtgctgcctgcacgccgacatgctgggcagcctgggccccaaggaggccaagaaggccttcctggacttctaccacagcttcctggagaagaccgccgtgctgagagtgcccgtgccccccaacgtggccttcgagctggacagaaccagagccgacctgatcagcgaggacgtgcagagaagattcgtgcaggaggtggtgcagagccagcaggtggccgtgggcagacagctggaggacttcagaagcaagagactgatgggcatgaccccctgggagcaggagctggcccagctggaggcctgggtgggcagagacagagccagctacgaggccagagagagacacgtggccgagagactgctgatgcacctggaggagatgcagcacaccatcagcaccgacgaggagaagagcgccgccgtggtgaacgccatcggcctgtacatgagacacctgggcgtgagaaccaagagcggcgacaagaagagcggcagaaacttcttcagaaagaaggtgatgggcaacagaagaagcgacgagcccgccaagaccaagaagggcctgagcagcatcctggacgccgccagatggaacagaggcgagccccaggtgcccgacttcagacacctgaaggccgaggtggacgccgagaagcccggcgccaccgacagaaagggcggcgtgggcatgcccagcagagacagaaacatcggcgcccccggccaggacacccccggcgtgagcctgcaccccctgagcctggacagccccgacagagagcccggcgccgacgcccccctggagctgggcgacagcagcccccagggccccatgagcctggagagcctggccccccccgagagcaccgacgagggcgccgagaccgagagccccgagcccggcgacgagggcgagcccggcagaagcggcctggagctggagcccgaggagccccccggctggagagagctggtgccccccgacaccctgcacagcctgcccaagagccaggtgaagagacaggaggtgatcagcgagctgctggtgaccgaggccgcccacgtgagaatgctgagagtgctgcacgacctgttcttccagcccatggccgagtgcctgttcttccccctggaggagctgcagaacatcttccccagcctggacgagctgatcgaggtgcacagcctgttcctggacagactgatgaagagaagacaggagagcggctacctgatcgaggagatcggcgacgtgctgctggccagattcgacggcgccgagggcagctggttccagaagatcagcagcagattctgcagcagacagagcttcgccctggagcagctgaaggccaagcagagaaaggaccccagattctgcgccttcgtgcaggaggccgagagcagacccagatgcagaagactgcagctgaaggacatgatccccaccgagatgcagagactgaccaagtaccccctgctgctgcagagcatcggccagaacaccgaggagcccaccgagagagagaaggtggagctggccgccgagtgctgcagagagatcctgcaccacgtgaaccaggccgtgagagacatggaggacctgctgagactgaaggactaccagagaagactggacctgagccacctgagacagagcagcgaccccatgctgagcgagttcaagaacctggacatcaccaagaagaagctggtgcacgagggccccctgacctggagagtgaccaaggacaaggccgtggaggtgcacgtgctgctgctggacgacctgctgctgctgctgcagagacaggacgagagactgctgctgaagagccacagcagaaccctgacccccacccccgacggcaagaccatgctgagacccgtgctgagactgaccagcgccatgaccagagaggtggccaccgaccacaaggccttctacgtgctgttcacctgggaccaggaggcccagatctacgagctggtggcccagaccgtgagcgagagaaagaactggtgcgccctgatcaccgagaccgccggcagcctgaaggtgcccgcccccgccagcagacccaagcccagacccagccccagcagcaccagagagcccctgctgagcagcagcgagaacggcaacggcggcagagagaccagccccgccgacgccagaaccgagagaatcctgagcgacctgctgcccttctgcagacccggccccgagggccagctggccgccaccgccctgagaaaggtgctgagcctgaagcagctgctgttccccgccgaggaggacaacggcgccggcccccccagagacggcgacggcgtgcccggcggcggccccctgagccccgccagaacccaggagatccaggagaacctgctgagcctggaggagaccatgaagcagctggaggagctggaggaggagttctgcagactgagacccctgctgagccagctgggcggcaacagcgtgccccagcccggctgcacctag

SEQ ID NO: 97185 - DNA, 2847 bp, Artificial Sequence
  Description of Artificial Sequence: Synthetic coding sequence
atggccagcctgagcacctggagcagccccgccgagcccagagagatggaggacttcgccagaggcgccgccagccccggccccagcagacccggcctggtgcccgtgagcatcatcggcgccgaggacgaggacttcgagaacgagctggagaccaacagcgaggagcagaacagccagttccagagcctggagcaggtgaagagaagacccgcccacctgatggccctgctgcagcacgtggccctgcagttcgagcccggccccctggtgctgagagtgcccgtgccccccaacgtggccttcgagctggacagaaccagagccgacctgatcagcgaggacgtgcagagaagattcgtgcaggaggtggtgcagagccagcaggtggccgtgggcagacagctggaggacttcagaagcaagagactgatgggcatgaccccctgggagcaggagctggcccagctggaggcctgggtgggcagagacagagccagctacgaggccagagagagacacgtggccgagagactgctgatgcacctggaggagatgcagcacaccatcagcaccgacgaggagaagagcgccgccgtggtgaacgccatcggcctgtacatgagacacctgggcgtgagaaccaagagcggcgacaagaagagcggcagaaacttcttcagaaagaaggtgatgggcaacagaagaagcgacgagcccgccaagaccaagaagggcctgagcagcatcctggacgccgccagatggaacagaggcgagccccaggtgcccgacttcagacacctgaaggccgaggtggacgccgagaagcccggcgccaccgacagaaagggcggcgtgggcatgcccagcagagacagaaacatcggcgcccccggccaggacacccccggcgtgagcctgcaccccctgagcctggacagccccgacagagagcccggcgccgacgcccccctggagctgggcgacagcagcccccagggccccatgagcctggagagcctggccccccccgagagcaccgacgagggcgccgagaccgagagccccgagcccggcgacgagggcgagcccggcagaagcggcctggagctggagcccgaggagccccccggctggagagagctggtgccccccgacaccctgcacagcctgcccaagagccaggtgaagagacaggaggtgatcagcgagctgctggtgaccgaggccgcccacgtgagaatgctgagagtgctgcacgacctgttcttccagcccatggccgagtgcctgttcttccccctggaggagctgcagaacatcttccccagcctggacgagctgatcgaggtgcacagcctgttcctggacagactgatgaagagaagacaggagagcggctacctgatcgaggagatcggcgacgtgctgctggccagattcgacggcgccgagggcagctggttccagaagatcagcagcagattctgcagcagacagagcttcgccctggagcagctgaaggccaagcagagaaaggaccccagattctgcgccttcgtgcaggaggccgagagcagacccagatgcagaagactgcagctgaaggacatgatccccaccgagatgcagagactgaccaagtaccccctgctgctgcagagcatcggccagaacaccgaggagcccaccgagagagagaaggtggagctggccgccgagtgctgcagagagatcctgcaccacgtgaaccaggccgtgagagacatggaggacctgctgagactgaaggactaccagagaagactggacctgagccacctgagacagagcagcgaccccatgctgagcgagttcaagaacctggacatcaccaagaagaagctggtgcacgagggccccctgacctggagagtgaccaaggacaaggccgtggaggtgcacgtgctgctgctggacgacctgctgctgctgctgcagagacaggacgagagactgctgctgaagagccacagcagaaccctgacccccacccccgacggcaagaccatgctgagacccgtgctgagactgaccagcgccatgaccagagaggtggccaccgaccacaaggccttctacgtgctgttcacctgggaccaggaggcccagatctacgagctggtggcccagaccgtgagcgagagaaagaactggtgcgccctgatcaccgagaccgccggcagcctgaaggtgcccgcccccgccagcagacccaagcccagacccagccccagcagcaccagagagcccctgctgagcagcagcgagaacggcaacggcggcagagagaccagccccgccgacgccagaaccgagagaatcctgagcgacctgctgcccttctgcagacccggccccgagggccagctggccgccaccgccctgagaaagggcgtgggcggcggcatcctgccccccgagaccccccccgtgagcgcctggggcgagctgtgcccccccgcctggctgcacctgagattcccccccagaaaggccttctgcaagaaggagagaaacggcggcgaggacgtgagagaccacccccacccccacagctgcagaagcatcagccaccccgagggcctgagaagaggcagctgcggccccagactgggcggcgcccagctgggcctgctggccccccacgagcccagacccagcctgccccccgccctgtgcctgggcgacagcggcctgcacagcggcggccaccacggcgaccccggccacctgagcatcgcctgcggcggccaccccagcacccccacccccaagtgcctgagaagcgtgttcatcccctag

SEQ ID NO: 97186 - DNA, 4023 bp, Artificial Sequence
  Description of Artificial Sequence: Synthetic coding sequence
atgagaccccccggcttcctgagcagagcccccagcctgaacagagccgagagaggcatctggagctgcagcatggaccagagagagcccctgccccccgcccccgccgagaacgagatgaagtacgacaccaacaacaacgaggaggaggagggcgagcagttcgacttcgacagcggcgacgagatccccgaggccgacagacaggcccccagcgcccccgagaccggcggcgccggcgccagcgaggcccccgcccccaccggcggcgaggacggcgccggcgccgagaccacccccgtggccgagcccaccaagctggtgctgcccatgaaggtgaacccctacagcgtgatcgacatcacccccttccaggaggaccagccccccacccccgtgcccagcgccgaggaggagaacgtgggcctgcacgtgccctgcggctacctggtgcccgtgccctgcggctacgccgtgcccagcaacctgcccctgctgctgcccgcctacagcagccccgtgatcatctgcgccaccagcctggacgaggaggccgagacccccgaggtgaccgaggacagacagcccaacagcctgagcagcgaggagccccccaccagcgaggaccaggtgggcagagaggacagcgccctggccagatgggccgccgaccccgccaacaccgcctggatggagaaccccgaggaggccatctacgacgacgtgcccagagagaacagcgacagcgagcccgacgagatgatctacgacgacgtggagaacggcgacgagggcggcaacagcagcctggagtacggctggagcagcagcgagttcgagagctacgaggagcagagcgacagcgagtgcaagaacggcatccccagaagcttcctgagaagcaaccacaagaagcagctgagccacgacctgaccagactgaaggagcactacgagaagaagatgagagacctgatggccagcaccgtgggcgtggtggagatccagcagctgagacagaagcacgagctgaagatgcagaagctggtgaaggccgccaaggacggcaccaaggacggcctggagagaaccagagccgccgtgaagagaggcagaagcttcatcagaaccaagagcctgatcgcccaggaccacagaagcagcctggaggaggagcagaacctgttcatcgacgtggactgcaagcaccccgaggccatcctgacccccatgcccgagggcctgagccagcagcaggtggtgagaagatacatcctgggcagcgtggtggacagcgagaagaactacgtggacgccctgaagagaatcctggagcagtacgagaagcccctgagcgagatggagcccaaggtgctgagcgagagaaagctgaagaccgtgttctacagagtgaaggagatcctgcagtgccacagcctgttccagatcgccctggccagcagagtgagcgagtgggacagcgtggagatgatcggcgacgtgttcgtggccagcttcagcaagagcatggtgctggacgcctacagcgagtacgtgaacaacttcagcaccgccgtggccgtgctgaagaagacctgcgccaccaagcccgccttcctggagttcctgaagcaggagcaggaggccagccccgacagaaccaccctgtacagcctgatgatgaagcccatccagagattcccccagttcatcctgctgctgcaggacatgctgaagaacaccagcaagggccaccccgacagactgcccctgcagatggccctgaccgagctggagaccctggccgagaagctgaacgagagaaagagagacgccgaccagagatgcgaggtgaagcagatcgccaaggccatcaacgagagatacctgaacaagctgctgagcagcggcagcagatacctgatcagaagcgacgacatgatcgagaccgtgtacaacgacagaggcgagatcgtgaagaccaaggagagaagagtgttcatgctgaacgacgtgctgatgtgcgccaccgtgagcagcagacccagccacgacagcagagtgatgagcagccagagatacctgctgaagtggagcgtgcccctgggccacgtggacgccatcgagtacggcagcagcgccggcaccggcgagcacagcagacacctggccgtgcacccccccgagagcctggccgtggtggccaacgccaagcccaacaaggtgtacatgggccccggccagctgtaccaggacctgcagaacctgctgcacgacctgaacgtgatcggccagatcacccagctgatcggcaacctgaagggcaactaccagaacctgaaccagagcgtggcccacgactggaccagcggcctgcagagactgatcctgaagaaggaggacgagatcagagccgccgactgctgcagaatccagctgcagctgcccggcaagcaggacaagagcggcagacccaccttcttcaccgccgtgttcaacaccttcacccccgccatcaaggagagctgggtgaacagcctgcagatggccaagctggccctggaggaggagaaccacatgggctggttctgcgtggaggacgacggcaaccacatcaagaaggagaagcaccccctgctggtgggccacatgcccgtgatggtggccaagcagcaggagttcaagatcggcagctgcacccaccagatgggccagatcgccatcgtgagcttccagaacagcacccccaaggtgatcgagtgcttcaacgtggagagcagaatcctgtgcatgctgtacgtgcccgtggaggagaagagaagagagcccggcgccccccccgaccccgagacccccgccgtgagagccagcgacgtgcccaccatctgcgtgggcaccgaggagggcagcatcagcatctacaagagcagccagggcagcaagaaggtgagactgcagcacttcttcacccccgagaagagcaccgtgatgagcctggcctgcaccagccagagcctgtacgccggcctggtgaacggcgccgtggccagctacgccagagcccccgacggcagctgggacagcgagccccagaaggtgatcaagctgggcgtgctgcccgtgagaagcctgctgatgatggaggacaccctgtgggccgccagcggcggccaggtgttcatcatcagcgtggagacccacgccgtggagggccagctggaggcccaccaggaggagggcatggtgatcagccacatggccgtgagcggcgtgggcatctggatcgccttcaccagcggcagcaccctgagactgttccacaccgagaccctgaagcacctgcaggacatcaacatcgccacccccgtgcacaacatgctgcccggccaccagagactgagcgtgaccagcctgctggtgtgccacggcctgctgatggtgggcaccagcctgggcgtgctggtggccctgcccgtgcccagactgcagggcatccccaaggtgaccggcagaggcatggtgagctaccacgcccacaacagccccgtgaagttcatcgtgctggccaccgccctgcacgagaaggacaaggacaagagcagagacagcctggcccccggccccgagccccaggacgaggaccagaaggacgccctgcccagcggcggcgccggcagcagcctgagccagggcgaccccgacgccgccatctggctgggcgacagcctgggcagcatgacccagaagagcgacctgagcagcagcagcggcagcctgagcctgagccacggcagcagcagcctggagcacagaagcgaggacagcaccatctacgacctgctgaaggaccccgtgagcctgagaagcaaggccagaagagccaagaaggccaaggccagcagcgccctggtggtgtgcggcggccagggccacagaagagtgcacagaaaggccagacagccccaccaggaggagctggcccccaccgtgatggtgtggcagatccccctgctgaacatctag

SEQ ID NO: 97187 - DNA, 4035 bp, Artificial Sequence
  Description of Artificial Sequence: Synthetic coding sequence
atggaccagagagagcccctgccccccgcccccgccgagaacgagatgaagtacgacaccaacaacaacgaggaggaggagggcgagcagttcgacttcgacagcggcgacgagatccccgaggccgacagacaggcccccagcgcccccgagaccggcggcgccggcgccagcgaggcccccgcccccaccggcggcgaggacggcgccggcgccgagaccacccccgtggccgagcccaccaagctggtgctgcccatgaaggtgaacccctacagcgtgatcgacatcacccccttccaggaggaccagccccccacccccgtgcccagcgccgaggaggagaacgtgggcctgcacgtgccctgcggctacctggtgcccgtgccctgcggctacgccgtgcccagcaacctgcccctgctgctgcccgcctacagcagccccgtgatcatctgcgccaccagcctggacgaggaggagacccccgaggtgaccgaggacagacagcccaacagcctgagcagcgaggagccccccaccagcgaggaccaggtgggcagagaggacagcgccctggccagatgggccgccgaccccgccaacaccgcctggatggagaaccccgaggaggccatctacgacgacgtgcccagagagaacagcgacagcgagcccgacgagatgatctacgacgacgtggagaacggcgacgagggcggcaacagcagcctggagtacggctggagcagcagcgagttcgagagctacgaggagcagagcgacagcgagtgcaagaacggcatccccagaagcttcctgagaagcaaccacaagaagcagctgagccacgacctgaccagactgaaggagcactacgagaagaagatgagagacctgatggccagcaccgtgggcgtggtggagatccagcagctgagacagaagcacgagctgaagatgcagaagctggtgaaggccgccaaggacggcaccaaggacggcctggagagaaccagagccgccgtgaagagaggcagaagcttcatcagaaccaagagcctgatcgcccaggaccacagaagcagcctggaggaggagcagaacctgttcatcgacgtggactgcaagcaccccgaggccatcctgacccccatgcccgagggcctgagccagcagcaggtggtgagaagatacatcctgggcagcgtggtggacagcgagaagaactacgtggacgccctgaagagaatcctggagcagtacgagaagcccctgagcgagatggagcccaaggtgctgagcgagagaaagctgaagaccgtgttctacagagtgaaggagatcctgcagtgccacagcctgttccagatcgccctggccagcagagtgagcgagtgggacagcgtggagatgatcggcgacgtgttcgtggccagcttcagcaagagcatggtgctggacgcctacagcgagtacgtgaacaacttcagcaccgccgtggccgtgctgaagaagacctgcgccaccaagcccgccttcctggagttcctgaagcaggagcaggaggccagccccgacagaaccaccctgtacagcctgatgatgaagcccatccagagattcccccagttcatcctgctgctgcaggacatgctgaagaacaccagcaagggccaccccgacagactgcccctgcagatggccctgaccgagctggagaccctggccgagaagctgaacgagagaaagagagacgccgaccagagatgcgaggtgaagcagatcgccaaggccatcaacgagagatacctgaacaagctgctgagcagcggcagcagatacctgatcagaagcgacgacatgatcgagaccgtgtacaacgacagaggcgagatcgtgaagaccaaggagagaagagtgttcatgctgaacgacgtgctgatgtgcgccaccgtgagcagcagacccagccacgacagcagagtgatgagcagccagagatacctgctgaagtggagcgtgcccctgggccacgtggacgccatcgagtacggcagcagcgccggcaccggcgagcacagcagacacctggccgtgcacccccccgagagcctggccgtggtggccaacgccaagcccaacaaggtgtacatgggccccggccagctgtaccaggacctgcagaacctgctgcacgacctgaacgtgatcggccagatcacccagctgatcggcaacctgaagggcaactaccagaacctgaaccagagcgtggcccacgactggaccagcggcctgcagagactgatcctgaagaaggaggacgagatcagagccgccgactgctgcagaatccagctgcagctgcccggcaagcaggacaagagcggcagacccaccttcttcaccgccgtgttcaacaccttcacccccgccatcaaggagagctgggtgaacagcctgcagatggccaagctggccctggaggaggagaaccacatgggctggttctgcgtggaggacgacggcaaccacatcaagaaggagaagcaccccctgctggtgggccacatgcccgtgatggtggccaagcagcaggagttcaagatcgagtgcgccgcctacaaccccgagccctacctgaacaacgagagccagcccgacagcttcagcaccgcccacggcttcctgtggatcggcagctgcacccaccagatgggccagatcgccatcgtgagcttccagaacagcacccccaaggtgatcgagtgcttcaacgtggagagcagaatcctgtgcatgctgtacgtgcccgtggaggagaagagaagagagcccggcgccccccccgaccccgagacccccgccgtgagagccagcgacgtgcccaccatctgcgtgggcaccgaggagggcagcatcagcatctacaagagcagccagggcagcaagaaggtgagactgcagcacttcttcacccccgagaagagcaccgtgatgagcctggcctgcaccagccagagcctgtacgccggcctggtgaacggcgccgtggccagctacgccagagcccccgacggcagctgggacagcgagccccagaaggtgatcaagctgggcgtgctgcccgtgagaagcctgctgatgatggaggacaccctgtgggccgccagcggcggccaggtgttcatcatcagcgtggagacccacgccgtggagggccagctggaggcccaccaggaggagggcatggtgatcagccacatggccgtgagcggcgtgggcatctggatcgccttcaccagcggcagcaccctgagactgttccacaccgagaccctgaagcacctgcaggacatcaacatcgccacccccgtgcacaacatgctgcccggccaccagagactgagcgtgaccagcctgctggtgtgccacggcctgctgatggtgggcaccagcctgggcgtgctggtggccctgcccgtgcccagactgcagggcatccccaaggtgaccggcagaggcatggtgagctaccacgcccacaacagccccgtgaagttcatcgtgctggccaccgccctgcacgagaaggacaaggacaagagcagagacagcctggcccccggccccgagccccaggacgaggaccagaaggacgccctgcccagcggcggcgccggcagcagcctgagccagggcgaccccgacgccgccatctggctgggcgacagcctgggcagcatgacccagaagagcgacctgagcagcagcagcggcagcctgagcctgagccacggcagcagcagcctggagcacagaagcgaggacagcaccatctacgacctgctgaaggaccccgtgagcctgagaagcaaggccagaagagccaagaaggccaaggccagcagcgccctggtggtgtgcggcggccagggccacagaagagtgcacagaaaggccagacagccccaccaggaggagctggcccccaccgtgatggtgtggcagatccccctgctgaacatctag

SEQ ID NO: 97188 - DNA, 1833 bp, Artificial Sequence
  Description of Artificial Sequence: Synthetic coding sequence
atgagaccccccggcttcctgagcagagcccccagcctgaacagagccgagagaggcatctggagctgcagcatggaccagagagagcccctgccccccgcccccgccgagaacgagatgaagtacgacaccaacaacaacgaggaggaggagggcgagcagttcgacttcgacagcggcgacgagatccccgaggccgacagacaggcccccagcgcccccgagaccggcggcgccggcgccagcgaggcccccgcccccaccggcggcgaggacggcgccggcgccgagaccacccccgtggccgagcccaccaagctggtgctgcccatgaaggtgaacccctacagcgtgatcgacatcacccccttccaggaggaccagccccccacccccgtgcccagcgccgaggaggagaacgtgggcctgcacgtgccctgcggctacctggtgcccgtgccctgcggctacgccgtgcccagcaacctgcccctgctgctgcccgcctacagcagccccgtgatcatctgcgccaccagcctggacgaggaggccgagacccccgaggtgaccgaggacagacagcccaacagcctgagcagcgaggagccccccaccagcgaggaccaggtgggcagagaggacagcgccctggccagatgggccgccgaccccgccaacaccgcctggatggagaaccccgaggaggccatctacgacgacgtgcccagagagaacagcgacagcgagcccgacgagatgatctacgacgacgtggagaacggcgacgagggcggcaacagcagcctggagtacggctggagcagcagcgagttcgagagctacgaggagcagagcgacagcgagtgcaagaacggcatccccagaagcttcctgagaagcaaccacaagaagcagatgcagaagctggtgaaggccgccaaggacggcaccaaggacggcctggagagaaccagagccgccgtgaagagaggcagaagcttcatcagaaccaagagcctgatcgcccaggaccacagaagcagcctggaggaggagcagaacctgttcatcgacgtggactgcaagcaccccgaggccatcctgacccccatgcccgagggcctgagccagcagcaggtggtgagaagatacatcctgggcagcgtggtggacagcgagaagaactacgtggacgccctgaagagaatcctggagcagtacgagaagcccctgagcgagatggagcccaaggtgctgagcgagagaaagctgaagaccgtgttctacagagtgaaggagatcctgcagtgccacagcctgttccagatcgccctggccagcagagtgagcgagtgggacagcgtggagatgatcggcgacgtgttcgtggccagcttcagcaagagcatggtgctggacgcctacagcgagtacgtgaacaacttcagcaccgccgtggccgtgctgaagaagacctgcgccaccaagcccgccttcctggagttcctgaagcaggagcaggaggccagccccgacagaaccaccctgtacagcctgatgatgaagcccatccagagattcccccagttcatcctgctgctgcaggacatgctgaagaacaccagcaagggccaccccgacagactgcccctgcagatggccctgaccgagctggagaccctggccgagaagctgaacgagagaaagagagacgccgaccagagatgcgaggtgaagcagatcgccaaggccatcaacgagagatacctgaacaaggtggagagaggcttcctgcagctgtacagcaagatcatcttcgccctgtgctag

SEQ ID NO: 97189 - DNA, 4110 bp, Artificial Sequence
  Description of Artificial Sequence: Synthetic coding sequence
atgagaccccccggcttcctgagcagagcccccagcctgaacagagccgagagaggcatctggagctgcagcatggaccagagagagcccctgccccccgcccccgccgagaacgagatgaagtacgacaccaacaacaacgaggaggaggagggcgagcagttcgacttcgacagcggcgacgagatccccgaggccgacagacaggcccccagcgcccccgagaccggcggcgccggcgccagcgaggcccccgcccccaccggcggcgaggacggcgccggcgccgagaccacccccgtggccgagcccaccaagctggtgctgcccatgaaggtgaacccctacagcgtgatcgacatcacccccttccaggaggaccagccccccacccccgtgcccagcgccgaggaggagaacgtgggcctgcacgtgccctgcggctacctggtgcccgtgccctgcggctacgccgtgcccagcaacctgcccctgctgctgcccgcctacagcagccccgtgatcatctgcgccaccagcctggacgaggaggccgagacccccgaggtgaccgaggacagacagcccaacagcctgagcagcgaggagccccccaccagcgaggaccaggtgggcagagaggacagcgccctggccagatgggccgccgaccccgccaacaccgcctggatggagaaccccgaggaggccatctacgacgacgtgcccagagagaacagcgacagcgagcccgacgagatgatctacgacgacgtggagaacggcgacgagggcggcaacagcagcctggagtacggctggagcagcagcgagttcgagagctacgaggagcagagcgacagcgagtgcaagaacggcatccccagaagcttcctgagaagcaaccacaagaagcagctgagccacgacctgaccagactgaaggagcactacgagaagaagatgagagacctgatggccagcaccgtgggcgtggtggagatccagcagctgagacagaagcacgagctgaagatgcagaagctggtgaaggccgccaaggacggcaccaaggacggcctggagagaaccagagccgccgtgaagagaggcagaagcttcatcagaaccaagagcctgatcgcccaggaccacagaagcagcctggaggaggagcagaacctgttcatcgacgtggactgcaagcaccccgaggccatcctgacccccatgcccgagggcctgagccagcagcaggtggtgagaagatacatcctgggcagcgtggtggacagcgagaagaactacgtggacgccctgaagagaatcctggagcagtacgagaagcccctgagcgagatggagcccaaggtgctgagcgagagaaagctgaagaccgtgttctacagagtgaaggagatcctgcagtgccacagcctgttccagatcgccctggccagcagagtgagcgagtgggacagcgtggagatgatcggcgacgtgttcgtggccagcttcagcaagagcatggtgctggacgcctacagcgagtacgtgaacaacttcagcaccgccgtggccgtgctgaagaagacctgcgccaccaagcccgccttcctggagttcctgaagcaggagcaggaggccagccccgacagaaccaccctgtacagcctgatgatgaagcccatccagagattcccccagttcatcctgctgctgcaggacatgctgaagaacaccagcaagggccaccccgacagactgcccctgcagatggccctgaccgagctggagaccctggccgagaagctgaacgagagaaagagagacgccgaccagagatgcgaggtgaagcagatcgccaaggccatcaacgagagatacctgaacaagctgctgagcagcggcagcagatacctgatcagaagcgacgacatgatcgagaccgtgtacaacgacagaggcgagatcgtgaagaccaaggagagaagagtgttcatgctgaacgacgtgctgatgtgcgccaccgtgagcagcagacccagccacgacagcagagtgatgagcagccagagatacctgctgaagtggagcgtgcccctgggccacgtggacgccatcgagtacggcagcagcgccggcaccggcgagcacagcagacacctggccgtgcacccccccgagagcctggccgtggtggccaacgccaagcccaacaaggtgtacatgggccccggccagctgtaccaggacctgcagaacctgctgcacgacctgaacgtgatcggccagatcacccagctgatcggcaacctgaagggcaactaccagaacctgaaccagagcgtggcccacgactggaccagcggcctgcagagactgatcctgaagaaggaggacgagatcagagccgccgactgctgcagaatccagctgcagctgcccggcaagcaggacaagagcggcagacccaccttcttcaccgccgtgttcaacaccttcacccccgccatcaaggagagctgggtgaacagcctgcagatggccaagctggccctggaggaggagaaccacatgggctggttctgcgtggaggacgacggcaaccacatcaagaaggagaagcaccccctgctggtgggccacatgcccgtgatggtggccaagcagcaggagttcaagatcgagtgcgccgcctacaaccccgagccctacctgaacaacgagagccagcccgacagcttcagcaccgcccacggcttcctgtggatcggcagctgcacccaccagatgggccagatcgccatcgtgagcttccagaacagcacccccaaggtgatcgagtgcttcaacgtggagagcagaatcctgtgcatgctgtacgtgcccgtggaggagaagagaagagagcccggcgccccccccgaccccgagacccccgccgtgagagccagcgacgtgcccaccatctgcgtgggcaccgaggagggcagcatcagcatctacaagagcagccagggcagcaagaaggtgagactgcagcacttcttcacccccgagaagagcaccgtgatgagcctggcctgcaccagccagagcctgtacgccggcctggtgaacggcgccgtggccagctacgccagagcccccgacggcagctgggacagcgagccccagaaggtgatcaagctgggcgtgctgcccgtgagaagcctgctgatgatggaggacaccctgtgggccgccagcggcggccaggtgttcatcatcagcgtggagacccacgccgtggagggccagctggaggcccaccaggaggagggcatggtgatcagccacatggccgtgagcggcgtgggcatctggatcgccttcaccagcggcagcaccctgagactgttccacaccgagaccctgaagcacctgcaggacatcaacatcgccacccccgtgcacaacatgctgcccggccaccagagactgagcgtgaccagcctgctggtgtgccacggcctgctgatggtgggcaccagcctgggcgtgctggtggccctgcccgtgcccagactgcagggcatccccaaggtgaccggcagaggcatggtgagctaccacgcccacaacagccccgtgaagttcatcgtgctggccaccgccctgcacgagaaggacaaggacaagagcagagacagcctggcccccggccccgagccccaggacgaggaccagaaggacgccctgcccagcggcggcgccggcagcagcctgagccagggcgaccccgacgccgccatctggctgggcgacagcctgggcagcatgacccagaagagcgacctgagcagcagcagcggcagcctgagcctgagccacggcagcagcagcctggagcacagaagcgaggacagcaccatctacgacctgctgaaggaccccgtgagcctgagaagcaaggccagaagagccaagaaggccaaggccagcagcgccctggtggtgtgcggcggccagggccacagaagagtgcacagaaaggccagacagccccaccaggaggagctggcccccaccgtgatggtgtggcagatccccctgctgaacatctag

SEQ ID NO: 97190 - DNA, 4107 bp, Artificial Sequence
  Description of Artificial Sequence: Synthetic coding sequence
atgagaccccccggcttcctgagcagagcccccagcctgaacagagccgagagaggcatctggagctgcagcatggaccagagagagcccctgccccccgcccccgccgagaacgagatgaagtacgacaccaacaacaacgaggaggaggagggcgagcagttcgacttcgacagcggcgacgagatccccgaggccgacagacaggcccccagcgcccccgagaccggcggcgccggcgccagcgaggcccccgcccccaccggcggcgaggacggcgccggcgccgagaccacccccgtggccgagcccaccaagctggtgctgcccatgaaggtgaacccctacagcgtgatcgacatcacccccttccaggaggaccagccccccacccccgtgcccagcgccgaggaggagaacgtgggcctgcacgtgccctgcggctacctggtgcccgtgccctgcggctacgccgtgcccagcaacctgcccctgctgctgcccgcctacagcagccccgtgatcatctgcgccaccagcctggacgaggaggccgagacccccgaggtgaccgaggacagacagcccaacagcctgagcagcgaggagccccccaccagcgaggaccaggtgggcagagaggacagcgccctggccagatgggccgccgaccccgccaacaccgcctggatggagaaccccgaggaggccatctacgacgacgtgcccagagagaacagcgacagcgagcccgacgagatgatctacgacgacgtggagaacggcgacgagggcggcaacagcagcctggagtacggctggagcagcagcgagttcgagagctacgaggagcagagcgacagcgagtgcaagaacggcatccccagaagcttcctgagaagcaaccacaagaagcagctgagccacgacctgaccagactgaaggagcactacgagaagaagatgagagacctgatggccagcaccgtgggcgtggtggagatccagcagctgagacagaagcacgagctgaagatgcagaagctggtgaaggccgccaaggacggcaccaaggacggcctggagagaaccagagccgccgtgaagagaggcagaagcttcatcagaaccaagagcctgatcgcccaggaccacagaagcagcctggaggaggagcagaacctgttcatcgacgtggactgcaagcaccccgaggccatcctgacccccatgcccgagggcctgagccagcagcaggtggtgagaagatacatcctgggcagcgtggtggacagcgagaagaactacgtggacgccctgaagagaatcctggagcagtacgagaagcccctgagcgagatggagcccaaggtgctgagcgagagaaagctgaagaccgtgttctacagagtgaaggagatcctgcagtgccacagcctgttccagatcgccctggccagcagagtgagcgagtgggacagcgtggagatgatcggcgacgtgttcgtggccagcttcagcaagagcatggtgctggacgcctacagcgagtacgtgaacaacttcagcaccgccgtggccgtgctgaagaagacctgcgccaccaagcccgccttcctggagttcctgaaggagcaggaggccagccccgacagaaccaccctgtacagcctgatgatgaagcccatccagagattcccccagttcatcctgctgctgcaggacatgctgaagaacaccagcaagggccaccccgacagactgcccctgcagatggccctgaccgagctggagaccctggccgagaagctgaacgagagaaagagagacgccgaccagagatgcgaggtgaagcagatcgccaaggccatcaacgagagatacctgaacaagctgctgagcagcggcagcagatacctgatcagaagcgacgacatgatcgagaccgtgtacaacgacagaggcgagatcgtgaagaccaaggagagaagagtgttcatgctgaacgacgtgctgatgtgcgccaccgtgagcagcagacccagccacgacagcagagtgatgagcagccagagatacctgctgaagtggagcgtgcccctgggccacgtggacgccatcgagtacggcagcagcgccggcaccggcgagcacagcagacacctggccgtgcacccccccgagagcctggccgtggtggccaacgccaagcccaacaaggtgtacatgggccccggccagctgtaccaggacctgcagaacctgctgcacgacctgaacgtgatcggccagatcacccagctgatcggcaacctgaagggcaactaccagaacctgaaccagagcgtggcccacgactggaccagcggcctgcagagactgatcctgaagaaggaggacgagatcagagccgccgactgctgcagaatccagctgcagctgcccggcaagcaggacaagagcggcagacccaccttcttcaccgccgtgttcaacaccttcacccccgccatcaaggagagctgggtgaacagcctgcagatggccaagctggccctggaggaggagaaccacatgggctggttctgcgtggaggacgacggcaaccacatcaagaaggagaagcaccccctgctggtgggccacatgcccgtgatggtggccaagcagcaggagttcaagatcgagtgcgccgcctacaaccccgagccctacctgaacaacgagagccagcccgacagcttcagcaccgcccacggcttcctgtggatcggcagctgcacccaccagatgggccagatcgccatcgtgagcttccagaacagcacccccaaggtgatcgagtgcttcaacgtggagagcagaatcctgtgcatgctgtacgtgcccgtggaggagaagagaagagagcccggcgccccccccgaccccgagacccccgccgtgagagccagcgacgtgcccaccatctgcgtgggcaccgaggagggcagcatcagcatctacaagagcagccagggcagcaagaaggtgagactgcagcacttcttcacccccgagaagagcaccgtgatgagcctggcctgcaccagccagagcctgtacgccggcctggtgaacggcgccgtggccagctacgccagagcccccgacggcagctgggacagcgagccccagaaggtgatcaagctgggcgtgctgcccgtgagaagcctgctgatgatggaggacaccctgtgggccgccagcggcggccaggtgttcatcatcagcgtggagacccacgccgtggagggccagctggaggcccaccaggaggagggcatggtgatcagccacatggccgtgagcggcgtgggcatctggatcgccttcaccagcggcagcaccctgagactgttccacaccgagaccctgaagcacctgcaggacatcaacatcgccacccccgtgcacaacatgctgcccggccaccagagactgagcgtgaccagcctgctggtgtgccacggcctgctgatggtgggcaccagcctgggcgtgctggtggccctgcccgtgcccagactgcagggcatccccaaggtgaccggcagaggcatggtgagctaccacgcccacaacagccccgtgaagttcatcgtgctggccaccgccctgcacgagaaggacaaggacaagagcagagacagcctggcccccggccccgagccccaggacgaggaccagaaggacgccctgcccagcggcggcgccggcagcagcctgagccagggcgaccccgacgccgccatctggctgggcgacagcctgggcagcatgacccagaagagcgacctgagcagcagcagcggcagcctgagcctgagccacggcagcagcagcctggagcacagaagcgaggacagcaccatctacgacctgctgaaggaccccgtgagcctgagaagcaaggccagaagagccaagaaggccaaggccagcagcgccctggtggtgtgcggcggccagggccacagaagagtgcacagaaaggccagacagccccaccaggaggagctggcccccaccgtgatggtgtggcagatccccctgctgaacatctag

SEQ ID NO: 97191 - DNA, 2949 bp, Artificial Sequence
  Description of Artificial Sequence: Synthetic coding sequence
atgctgcccagcagcagctggggcaagagaaagctgagaggcagactgggctgggtgagaagcgacgccagaggcgtgatgtgggccagacaggagggcctgcaccacccccacccccacgccgtgatcagatgccccagcagcagcagcagcagcgtgagctgcagcggcgacagcgaggaggaggacatgggcctgctggaggtgagcgtgagcgacatcaagccccccgcccccgagctgggccccatgcccgagggcctgagcccccagcaggtggtgagaagacacatcctgggcagcatcgtgcagagcgagggcagctacgtggagagcctgaagagaatcctgcaggactacagaaaccccctgatggagatggagcccaaggccctgagcgccagaaagtgccaggtggtgttcttcagagtgaaggagatcctgcactgccacagcatgttccagatcgccctgagcagcagagtggccgagtgggacagcaccgagaagatcggcgacctgttcgtggccagcgacatgctgaagaacacccccagaggccaccccgacagactgagcctgcagctggccctgaccgagctggagaccctggccgagaagctgaacgagcagaagagactggccgaccaggtggccgagatccagcagctgaccaagagcgtgagcgacagaagcagcctgaacaagctgctgaccagcggccagagacagctgctgctgtgcgagaccctgaccgagaccgtgtacggcgacagaggccagctgatcaagagcaaggagagaagagtgttcctgctgaacgacatgctggtgtgcgccaacatcaacttcaagggccagctggagatcagcagcctggtgcccctgggccccaagtacgtggtgaagtggaacaccgccctgccccaggtgcaggtggtggaggtgggccaggacggcggcacctacgacaaggacaacgtgctgatccagcacagcggcgccaagaaggccagcgccagcggccaggcccagaacaaggtgtacctgggcccccccagactgttccaggagctgcaggacctgcagaaggacctggccgtggtggagcagatcaccctgctgatcagcaccctgcacggcacctaccagaacctgaacatgaccgtggcccaggactggtgcctggccctgcagagactgatgagagtgaaggaggaggagatccacagcgccaacaagtgcagactgagactgctgctgcccggcaagcccgacaagagcggcagacccatcagcttcatggtggtgttcatcacccccaaccccctgagcaagatcagctgggtgaacagactgcacctggccaagatcggcctgagagaggagaaccagcccggctggctgtgccccgacgaggacaagaagagcaaggcccccttctggtgccccatcctggcctgctgcatccccgccttcagcagcagagccctgagcctgcagctgggcgccctggtgcacagccccgtgaactgccccctgctgggcttcagcgccgtgagcaccagcctgccccagggctacctgtgggtgggcggcggccaggagggcgccggcggccaggtggagatcttcagcctgaacagacccagccccagaaccgtgaagagcttccccctggccgcccccgtgctgtgcatggagtacatccccgagctggaggaggaggccgagagcagagacgagagccccaccgtggccgaccccagcgccaccgtgcaccccaccatctgcctgggcctgcaggacggcagcatcctgctgtacagcagcgtggacaccggcacccagtgcctggtgagctgcagaagccccggcctgcagcccgtgctgtgcctgagacacagccccttccacctgctggccggcctgcaggacggcaccctggccgcctaccccagaaccagcggcggcgtgctgtgggacctggagagcccccccgtgtgcctgaccgtgggccccggccccgtgagaaccctgctgagcctggaggacgccgtgtgggccagctgcggcccctgggtgaccgtgctggaggccaccaccctgcagccccagcagagcttcgaggcccaccaggacgaggccgtgagcgtgacccacatggtgaaggccggcagcggcgtgtggatggccttcagcagcggcaccagcatcagactgttccacaccgagaccctggagcacctgcaggagatcaacatcgccaccagaaccaccttcctgctgcccggccagaagcacctgtgcgtgaccagcctgctgatctgccagggcctgctgtgggtgggcaccgaccagggcgtgatcgtgctgctgcccgtgcccagactggagggcatccccaagatcaccggcaagggcatggtgagcctgaacggccactgcggccccgtggccttcctggccgtggccaccagcatcctggcccccgacatcctgagaagcgaccaggaggaggccgagggccccagagccgaggaggacaagcccgacggccaggcccacgagcccatgcccgacagccacgtgggcagagagctgaccagaaagaagggcatcctgctgcagtacagactgagaagcaccgcccacctgcccggccccctgctgagcatgagagagcccgcccccgccgacggcgccgccctggagcacagcgaggaggacggcagcatctacgagatggccgacgaccccgacatctgggtgagaagcagaccctgcgccagagacgcccacagaaaggagatctgcagcgtggccatcatcagcggcggccagggctacagaaacttcggcagcgccctgggcagcagcggcagacaggccccctgcggcgagaccgacagcaccctgctgatctggcaggtgcccctgatgctgtag

SEQ ID NO: 97192 - DNA, 3840 bp, Artificial Sequence
  Description of Artificial Sequence: Synthetic coding sequence
atggccagcagcaacccccccccccagcccgccatcggcgaccagctggtgcccggcgtgcccggccccagcagcgaggccgaggacgaccccggcgaggccttcgagttcgacgacagcgacgacgaggaggacaccagcgccgccctgggcgtgcccagcctggcccccgagagagacaccgacccccccctgatccacctggacagcatccccgtgaccgaccccgaccccgccgccgccccccccggcaccggcgtgcccgcctgggtgagcaacggcgacgccgccgacgccgccttcagcggcgccagacacagcagctggaagagaaagagcagcagaagaatcgacagattcaccttccccgccctggaggaggacgtgatctacgacgacgtgccctgcgagagccccgacgcccaccagcccggcgccgagagaaacctgctgtacgaggacgcccacagagccggcgcccccagacaggccgaggacctgggctggagcagcagcgagttcgagagctacagcgaggacagcggcgaggaggccaagcccgaggtggaggtggagcccgccaagcacagagtgagcttccagcccaagctgagccccgacctgaccagactgaaggagagatacgccagaaccaagagagacatcctggccctgagagtgggcggcagagacatgcaggagctgaagcacaagtacgactgcaagatgacccagctgatgaaggccgccaagagcggcaccaaggacggcctggagaagaccagaatggccgtgatgagaaaggtgagcttcctgcacagaaaggacgtgctgggcgacagcgaggaggaggacatgggcctgctggaggtgagcgtgagcgacatcaagccccccgcccccgagctgggccccatgcccgagggcctgagcccccagcaggtggtgagaagacacatcctgggcagcatcgtgcagagcgagggcagctacgtggagagcctgaagagaatcctgcaggactacagaaaccccctgatggagatggagcccaaggccctgagcgccagaaagtgccaggtggtgttcttcagagtgaaggagatcctgcactgccacagcatgttccagatcgccctgagcagcagagtggccgagtgggacagcaccgagaagatcggcgacctgttcgtggccagcttcagcaagagcatggtgctggacgtgtacagcgactacgtgaacaacttcaccagcgccatgagcatcatcaagaaggcctgcctgaccaagcccgccttcctggagttcctgaagagaagacaggtgtgcagccccgacagagtgaccctgtacggcctgatggtgaagcccatccagagattcccccagttcatcctgctgctgcaggacatgctgaagaacacccccagaggccaccccgacagactgagcctgcagctggccctgaccgagctggagaccctggccgagaagctgaacgagcagaagagactggccgaccaggtggccgagatccagcagctgaccaagagcgtgagcgacagaagcagcctgaacaagctgctgaccagcggccagagacagctgctgctgtgcgagaccctgaccgagaccgtgtacggcgacagaggccagctgatcaagagcaaggagagaagagtgttcctgctgaacgacatgctggtgtgcgccaacatcaacttcaagcccgccaaccacagaggccagctggagatcagcagcctggtgcccctgggccccaagtacgtggtgaagtggaacaccgccctgccccaggtgcaggtggtggaggtgggccaggacggcggcacctacgacaaggacaacgtgctgatccagcacagcggcgccaagaaggccagcgccagcggccaggcccagaacaaggtgtacctgggcccccccagactgttccaggagctgcaggacctgcagaaggacctggccgtggtggagcagatcaccctgctgatcagcaccctgcacggcacctaccagaacctgaacatgaccgtggcccaggactggtgcctggccctgcagagactgatgagagtgaaggaggaggagatccacagcgccaacaagtgcagactgagactgctgctgcccggcaagcccgacaagagcggcagacccatcagcttcatggtggtgttcatcacccccaaccccctgagcaagatcagctgggtgaacagactgcacctggccaagatcggcctgagagaggagaaccagcccggctggctgtgccccgacgaggacaagaagagcaaggcccccttctggtgccccatcctggcctgctgcatccccgccttcagcagcagagccctgagcctgcagctgggcgccctggtgcacagccccgtgaactgccccctgctgggcttcagcgccgtgagcaccagcctgccccagggctacctgtgggtgggcggcggccaggagggcgccggcggccaggtggagatcttcagcctgaacagacccagccccagaaccgtgaagagcttccccctggccgcccccgtgctgtgcatggagtacatccccgagctggaggaggaggccgagagcagagacgagagccccaccgtggccgaccccagcgccaccgtgcaccccaccatctgcctgggcctgcaggacggcagcatcctgctgtacagcagcgtggacaccggcacccagtgcctggtgagctgcagaagccccggcctgcagcccgtgctgtgcctgagacacagccccttccacctgctggccggcctgcaggacggcaccctggccgcctaccccagaaccagcggcggcgtgctgtgggacctggagagcccccccgtgtgcctgaccgtgggccccggccccgtgagaaccctgctgagcctggaggacgccgtgtgggccagctgcggcccctgggtgaccgtgctggaggccaccaccctgcagccccagcagagcttcgaggcccaccaggacgaggccgtgagcgtgacccacatggtgaaggccggcagcggcgtgtggatggccttcagcagcggcaccagcatcagactgttccacaccgagaccctggagcacctgcaggagatcaacatcgccaccagaaccaccttcctgctgcccggccagaagcacctgtgcgtgaccagcctgctgatctgccagggcctgctgtgggtgggcaccgaccagggcgtgatcgtgctgctgcccgtgcccagactggagggcatccccaagatcaccggcaagggcatggtgagcctgaacggccactgcggccccgtggccttcctggccgtggccaccagcatcctggcccccgacatcctgagaagcgaccaggaggaggccgagggccccagagccgaggaggacaagcccgacggccaggcccacgagcccatgcccgacagccacgtgggcagagagctgaccagaaagaagggcatcctgctgcagtacagactgagaagcaccgcccacctgcccggccccctgctgagcatgagagagcccgcccccgccgacggcgccgccctggagcacagcgaggaggacggcagcatctacgagatggccgacgaccccgacatctgggtgagaagcagaccctgcgccagagacgcccacagaaaggagatctgcagcgtggccatcatcagcggcggccagggctacagaaacttcggcagcgccctgggcagcagcggcagacaggccccctgcggcgagaccgacagcaccctgctgatctggcaggtgcccctgatgctgtag

SEQ ID NO: 97193 - DNA, 3159 bp, Artificial Sequence
  Description of Artificial Sequence: Synthetic coding sequence
atgctgcccagcagcagctggggcaagagaaagctgagaggcagactgggctgggtgagaagcgacgccagaggcgtgatgtgggccagacaggagggcctgcaccacccccacccccacgccgtgatcagatgccccagcagcagcagcagcagcgtgagctgcagcggcgacagcgaggaggaggacatgggcctgctggaggtgagcgtgagcgacatcaagccccccgcccccgagctgggccccatgcccgagggcctgagcccccagcaggtggtgagaagacacatcctgggcagcatcgtgcagagcgagggcagctacgtggagagcctgaagagaatcctgcaggactacagaaaccccctgatggagatggagcccaaggccctgagcgccagaaagtgccaggtggtgttcttcagagtgaaggagatcctgcactgccacagcatgttccagatcgccctgagcagcagagtggccgagtgggacagcaccgagaagatcggcgacctgttcgtggccagcttcagcaagagcatggtgctggacgtgtacagcgactacgtgaacaacttcaccagcgccatgagcatcatcaagaaggcctgcctgaccaagcccgccttcctggagttcctgaagagaagacaggtgtgcagccccgacagagtgaccctgtacggcctgatggtgaagcccatccagagattcccccagttcatcctgctgctgcaggacatgctgaagaacacccccagaggccaccccgacagactgagcctgcagctggccctgaccgagctggagaccctggccgagaagctgaacgagcagaagagactggccgaccaggtggccgagatccagcagctgaccaagagcgtgagcgacagaagcagcctgaacaagctgctgaccagcggccagagacagctgctgctgtgcgagaccctgaccgagaccgtgtacggcgacagaggccagctgatcaagagcaaggagagaagagtgttcctgctgaacgacatgctggtgtgcgccaacatcaacttcaagggccagctggagatcagcagcctggtgcccctgggccccaagtacgtggtgaagtggaacaccgccctgccccaggtgcaggtggtggaggtgggccaggacggcggcacctacgacaaggacaacgtgctgatccagcacagcggcgccaagaaggccagcgccagcggccaggcccagaacaaggtgtacctgggcccccccagactgttccaggagctgcaggacctgcagaaggacctggccgtggtggagcagatcaccctgctgatcagcaccctgcacggcacctaccagaacctgaacatgaccgtggcccaggactggtgcctggccctgcagagactgatgagagtgaaggaggaggagatccacagcgccaacaagtgcagactgagactgctgctgcccggcaagcccgacaagagcggcagacccatcagcttcatggtggtgttcatcacccccaaccccctgagcaagatcagctgggtgaacagactgcacctggccaagatcggcctgagagaggagaaccagcccggctggctgtgccccgacgaggacaagaagagcaaggcccccttctggtgccccatcctggcctgctgcatccccgccttcagcagcagagccctgagcctgcagctgggcgccctggtgcacagccccgtgaactgccccctgctgggcttcagcgccgtgagcaccagcctgccccagggctacctgtgggtgggcggcggccaggagggcgccggcggccaggtggagatcttcagcctgaacagacccagccccagaaccgtgaagagcttccccctggccgcccccgtgctgtgcatggagtacatccccgagctggaggaggaggccgagagcagagacgagagccccaccgtggccgaccccagcgccaccgtgcaccccaccatctgcctgggcctgcaggacggcagcatcctgctgtacagcagcgtggacaccggcacccagtgcctggtgagctgcagaagccccggcctgcagcccgtgctgtgcctgagacacagccccttccacctgctggccggcctgcaggacggcaccctggccgcctaccccagaaccagcggcggcgtgctgtgggacctggagagcccccccgtgtgcctgaccgtgggccccggccccgtgagaaccctgctgagcctggaggacgccgtgtgggccagctgcggcccctgggtgaccgtgctggaggccaccaccctgcagccccagcagagcttcgaggcccaccaggacgaggccgtgagcgtgacccacatggtgaaggccggcagcggcgtgtggatggccttcagcagcggcaccagcatcagactgttccacaccgagaccctggagcacctgcaggagatcaacatcgccaccagaaccaccttcctgctgcccggccagaagcacctgtgcgtgaccagcctgctgatctgccagggcctgctgtgggtgggcaccgaccagggcgtgatcgtgctgctgcccgtgcccagactggagggcatccccaagatcaccggcaagggcatggtgagcctgaacggccactgcggccccgtggccttcctggccgtggccaccagcatcctggcccccgacatcctgagaagcgaccaggaggaggccgagggccccagagccgaggaggacaagcccgacggccaggcccacgagcccatgcccgacagccacgtgggcagagagctgaccagaaagaagggcatcctgctgcagtacagactgagaagcaccgcccacctgcccggccccctgctgagcatgagagagcccgcccccgccgacggcgccgccctggagcacagcgaggaggacggcagcatctacgagatggccgacgaccccgacatctgggtgagaagcagaccctgcgccagagacgcccacagaaaggagatctgcagcgtggccatcatcagcggcggccagggctacagaaacttcggcagcgccctgggcagcagcggcagacaggccccctgcggcgagaccgacagcaccctgctgatctggcaggtgcccctgatgctgtag

SEQ ID NO: 97194 - DNA, 3723 bp, Artificial Sequence
  Description of Artificial Sequence: Synthetic coding sequence
atggccagcagcaacccccccccccagcccgccatcggcgaccagctggtgcccggcgtgcccggccccagcagcgaggccgaggacgaccccggcgaggccttcgagttcgacgacagcgacgacgaggaggacaccagcgccgccctgggcgtgcccagcctggcccccgagagagacaccgacccccccctgatccacctggacagcatccccgtgaccgaccccgaccccgccgccgccccccccggcaccggcgtgcccgcctgggtgagcaacggcgacgccgccgacgccgccttcagcggcgccagacacagcagctggaagagaaagagcagcagaagaatcgacagattcaccttccccgccctggaggaggacgtgatctacgacgacgtgccctgcgagagccccgacgcccaccagcccggcgccgagagaaacctgctgtacgaggacgcccacagagccggcgcccccagacaggccgaggacctgggctggagcagcagcgagttcgagagctacagcgaggacagcggcgaggaggccaagcccgaggtggaggtggagcccgccaagcacagagtgagcttccagcccaagatgacccagctgatgaaggccgccaagagcggcaccaaggacggcctggagaagaccagaatggccgtgatgagaaaggtgagcttcctgcacagaaaggacgtgctgggcgacagcgaggaggaggacatgggcctgctggaggtgagcgtgagcgacatcaagccccccgcccccgagctgggccccatgcccgagggcctgagcccccagcaggtggtgagaagacacatcctgggcagcatcgtgcagagcgagggcagctacgtggagagcctgaagagaatcctgcaggactacagaaaccccctgatggagatggagcccaaggccctgagcgccagaaagtgccaggtggtgttcttcagagtgaaggagatcctgcactgccacagcatgttccagatcgccctgagcagcagagtggccgagtgggacagcaccgagaagatcggcgacctgttcgtggccagcttcagcaagagcatggtgctggacgtgtacagcgactacgtgaacaacttcaccagcgccatgagcatcatcaagaaggcctgcctgaccaagcccgccttcctggagttcctgaagagaagacaggtgtgcagccccgacagagtgaccctgtacggcctgatggtgaagcccatccagagattcccccagttcatcctgctgctgcaggacatgctgaagaacacccccagaggccaccccgacagactgagcctgcagctggccctgaccgagctggagaccctggccgagaagctgaacgagcagaagagactggccgaccaggtggccgagatccagcagctgaccaagagcgtgagcgacagaagcagcctgaacaagctgctgaccagcggccagagacagctgctgctgtgcgagaccctgaccgagaccgtgtacggcgacagaggccagctgatcaagagcaaggagagaagagtgttcctgctgaacgacatgctggtgtgcgccaacatcaacttcaagcccgccaaccacagaggccagctggagatcagcagcctggtgcccctgggccccaagtacgtggtgaagtggaacaccgccctgccccaggtgcaggtggtggaggtgggccaggacggcggcacctacgacaaggacaacgtgctgatccagcacagcggcgccaagaaggccagcgccagcggccaggcccagaacaaggtgtacctgggcccccccagactgttccaggagctgcaggacctgcagaaggacctggccgtggtggagcagatcaccctgctgatcagcaccctgcacggcacctaccagaacctgaacatgaccgtggcccaggactggtgcctggccctgcagagactgatgagagtgaaggaggaggagatccacagcgccaacaagtgcagactgagactgctgctgcccggcaagcccgacaagagcggcagacccatcagcttcatggtggtgttcatcacccccaaccccctgagcaagatcagctgggtgaacagactgcacctggccaagatcggcctgagagaggagaaccagcccggctggctgtgccccgacgaggacaagaagagcaaggcccccttctggtgccccatcctggcctgctgcatccccgccttcagcagcagagccctgagcctgcagctgggcgccctggtgcacagccccgtgaactgccccctgctgggcttcagcgccgtgagcaccagcctgccccagggctacctgtgggtgggcggcggccaggagggcgccggcggccaggtggagatcttcagcctgaacagacccagccccagaaccgtgaagagcttccccctggccgcccccgtgctgtgcatggagtacatccccgagctggaggaggaggccgagagcagagacgagagccccaccgtggccgaccccagcgccaccgtgcaccccaccatctgcctgggcctgcaggacggcagcatcctgctgtacagcagcgtggacaccggcacccagtgcctggtgagctgcagaagccccggcctgcagcccgtgctgtgcctgagacacagccccttccacctgctggccggcctgcaggacggcaccctggccgcctaccccagaaccagcggcggcgtgctgtgggacctggagagcccccccgtgtgcctgaccgtgggccccggccccgtgagaaccctgctgagcctggaggacgccgtgtgggccagctgcggcccctgggtgaccgtgctggaggccaccaccctgcagccccagcagagcttcgaggcccaccaggacgaggccgtgagcgtgacccacatggtgaaggccggcagcggcgtgtggatggccttcagcagcggcaccagcatcagactgttccacaccgagaccctggagcacctgcaggagatcaacatcgccaccagaaccaccttcctgctgcccggccagaagcacctgtgcgtgaccagcctgctgatctgccagggcctgctgtgggtgggcaccgaccagggcgtgatcgtgctgctgcccgtgcccagactggagggcatccccaagatcaccggcaagggcatggtgagcctgaacggccactgcggccccgtggccttcctggccgtggccaccagcatcctggcccccgacatcctgagaagcgaccaggaggaggccgagggccccagagccgaggaggacaagcccgacggccaggcccacgagcccatgcccgacagccacgtgggcagagagctgaccagaaagaagggcatcctgctgcagtacagactgagaagcaccgcccacctgcccggccccctgctgagcatgagagagcccgcccccgccgacggcgccgccctggagcacagcgaggaggacggcagcatctacgagatggccgacgaccccgacatctgggtgagaagcagaccctgcgccagagacgcccacagaaaggagatctgcagcgtggccatcatcagcggcggccagggctacagaaacttcggcagcgccctgggcagcagcggcagacaggccccctgcggcgagaccgacagcaccctgctgatctggcaggtgcccctgatgctgtag

SEQ ID NO: 97195 - DNA, 1467 bp, Artificial Sequence
  Description of Artificial Sequence: Synthetic coding sequence
atgacccagctgatgaaggccgccaagagcggcaccaaggacggcctggagaagaccagaatggccgtgatgagaaaggtgagcttcctgcacagaaaggacgtgctgggcgacagcgaggaggaggacatgggcctgctggaggtgagcgtgagcgacatcaagccccccgcccccgagctgggccccatgcccgagggcctgagcccccagcaggtggtgagaagacacatcctgggcagcatcgtgcagagcgagggcagctacgtggagagcctgaagagaatcctgcaggactacagaaaccccctgatggagatggagcccaaggccctgagcgccagaaagtgccaggtggtgttcttcagagtgaaggagatcctgcactgccacagcatgttccagatcgccctgagcagcagagtggccgagtgggacagcaccgagaagatcggcgacctgttcgtggccagcttcagcaagagcatggtgctggacgtgtacagcgactacgtgaacaacttcaccagcgccatgagcatcatcaagaaggcctgcctgaccaagcccgccttcctggagttcctgaagagaagacaggtgtgcagccccgacagagtgaccctgtacggcctgatggtgaagcccatccagagattcccccagttcatcctgctgctgcaggacatgctgaagaacacccccagaggccaccccgacagactgagcctgcagctggccctgaccgagctggagaccctggccgagaagctgaacgagcagaagagactggccgaccaggtggccgagatccagcagctgaccaagagcgtgagcgacagaagcagcctgaacaagctgctgaccagcggccagagacagctgctgctgtgcgagaccctgaccgagaccgtgtacggcgacagaggccagctgatcaagagcaaggagagaagagtgttcctgctgaacgacatgctggtgtgcgccaacatcaacttcaagcccgccaaccacagaggccagctggagatcagcagcctggtgcccctgggccccaagtacgtggtgaagtggaacaccgccctgccccaggtgcaggtggtggaggtgggccaggacggcggcacctacgacaaggacaacgtgctgatccagcacagcggcgccaagaaggccagcgccagcggccaggcccagaacaaggtgtacctgggcccccccagactgttccaggagctgcaggacctgcagaaggacctggccgtggtggagcagatcaccctgctgatcagcaccctgcacggcacctaccagaacctgaacatgaccgtggcccaggactggtgcctggccctgcagagactgatgagagtgaaggaggaggagatccacagcgccaacaagtgcagactgagactgctgctgcccggcaagcccgacaagggcacctggagcgacatgtag

SEQ ID NO: 97196 - DNA, 3204 bp, Artificial Sequence
  Description of Artificial Sequence: Synthetic coding sequence
atggccagcagcaacccccccccccagcccgccatcggcgaccagctggtgcccggcgtgcccggccccagcagcgaggccgaggacgaccccggcgaggccttcgagttcgacgacagcgacgacgaggaggacaccagcgccgccctgggcgtgcccagcctggcccccgagagagacaccgacccccccctgatccacctggacagcatccccgtgaccgaccccgaccccgccgccgccccccccggcaccggcgtgcccgcctgggtgagcaacggcgacgccgccgacgccgccttcagcggcgccagacacagcagctggaagagaaagagcagcagaagaatcgacagattcaccttccccgccctggaggaggacgtgatctacgacgacgtgccctgcgagagccccgacgcccaccagcccggcgccgagagaaacctgctgtacgaggacgcccacagagccggcgcccccagacaggccgaggacctgggctggagcagcagcgagttcgagagctacagcgaggacagcggcgaggaggccaagcccgaggtggaggtggagcccgccaagcacagagtgagcttccagcccaagctgagccccgacctgaccagactgaaggagagatacgccagaaccaagagagacatcctggccctgagagtgggcggcagagacatgcaggagctgaagcacaagtacgactgcaagatgacccagctgatgaaggccgccaagagcggcaccaaggacggcctggagaagaccagaatggccgtgatgagaaaggtgagcttcctgcacagaaaggacgtgctgggcgacagcgaggaggaggacatgggcctgctggaggtgagcgtgagcgacatcaagccccccgcccccgagctgggccccatgcccgagggcctgagcccccagcaggtggtgagaagacacatcctgggcagcatcgtgcagagcgagggcagctacgtggagagcctgaagagaatcctgcaggactacagaaaccccctgatggagatggagcccaaggccctgagcgccagaaagtgccaggtggtgttcttcagagtgaaggagatcctgcactgccacagcatgttccagatcgccctgagcagcagagtggccgagtgggacagcaccgagaagatcggcgacctgttcgtggccagcttcagcaagagcatggtgctggacgtgtacagcgactacgtgaacaacttcaccagcgccatgagcatcatcaagaaggcctgcctgaccaagcccgccttcctggagttcctgaagagaagacaggtgtgcagccccgacagagtgaccctgtacggcctgatggtgaagcccatccagagattcccccagttcatcctgctgctgcaggacatgctgaagaacacccccagaggccaccccgacagactgagcctgcagctggccctgaccgagctggagaccctggccgagaagctgaacgagcagaagagactggccgaccaggtggccgagatccagcagctgaccaagagcgtgagcgacagaagcagcctgaacaagctgctgaccagcggccagagacagctgctgctgtgcgagaccctgaccgagaccgtgtacggcgacagaggccagctgatcaagagcaaggagagaagagtgttcctgctgaacgacatgctggtgtgcgccaacatcaacttcaagggccagctggagatcagcagcctggtgcccctgggccccaagtacgtggtgaagtggaacaccgccctgccccaggtgcaggtggtggaggtgggccaggacggcggcacctacgacaaggacaacgtgctgatccagcacagcggcgccaagaaggccagcgccagcggccaggcccagaacaaggtgtacctgggcccccccagactgttccaggagctgcaggacctgcagaaggacctggccgtggtggagcagatcaccctgctgatcagcaccctgcacggcacctaccagaacctgaacatgaccgtggcccaggactggtgcctggccctgcagagactgatgagagtgaaggaggaggagatccacagcgccaacaagtgcagactgagactgctgctgcccggcaagcccgacaagagcggcagacccatcagcttcatggtggtgttcatcacccccaaccccctgagcaagatcagctgggtgaacagactgcacctggccaagatcggcctgagagaggagaaccagcccggctggctgtgccccgacgaggacaagaagagcaaggcccccttctggtgccccatcctggcctgctgcatccccgccttcagcagcagagccctgagcctgcagctgggcgccctggtgcacagccccgtgaactgccccctgctgggcttcagcgccgtgagcaccagcctgccccagggctacctgtgggtgggcggcggccaggagggcgccggcggccaggtggagatcttcagcctgaacagacccagccccagaaccgtgaagagcttccccctggccgcccccgtgctgtgcatggagtacatccccgagctggaggaggaggccgagagcagagacgagagccccaccgtggccgaccccagcgccaccgtgcaccccaccatctgcctgggcctgcaggacggcagcatcctgctgtacagcagcgtggacaccggcacccagtgcctggtgagctgcagaagccccggcctgcagcccgtgctgtgcctgagacacagccccttccacctgctggccggcctgcaggacggcaccctggccgcctaccccagaaccagcggcggcgtgctgtgggacctggagagcccccccgtgtgcctgaccgtgggccccggccccgtgagaaccctgctgagcctggaggacgccgtgtgggccagctgcggcccctgggtgaccgtgctggaggccaccaccctgcagccccagcagagcttcgaggcccaccaggacgaggccgtgagcgtgacccacatggtgaaggccggcagcggcgtgtggatggccttcagcagcggcaccagcatcagactgttccacaccgagaccctggagcacctgcaggagatcaacatcgccaccagaaccaccttcctgctgcccgacagaagcctgatcaagtgcagccccagagcctag

SEQ ID NO: 97197 - DNA, 3723 bp, Artificial Sequence; identical to SEQ ID NO: 97194
  Description of Artificial Sequence: Synthetic coding sequence

SEQ ID NO: 97198 - DNA, 3129 bp, Artificial Sequence
  Description of Artificial Sequence: Synthetic coding sequence
atgctgcccagcagcagctggggcaagagaaagctgagaggcagactgggctgggtgagaagcgacgccagaggcgtgatgtgggccagacaggagggcctgcaccacccccacccccacgccgtgatcagatgccccagcagcagcagcagcagcgtgagctgcagcggcgacagcgaggaggaggacatgggcctgctggaggtgagcgtgagcgacatcaagccccccgcccccgagctgggccccatgcccgagggcctgagcccccagcaggtggtgagaagacacatcctgggcagcatcgtgcagagcgagggcagctacgtggagagcctgaagagaatcctgcaggactacagaaaccccctgatggagatggagcccaaggccctgagcgccagaaagtgccaggtggtgttcttcagagtgaaggagatcctgcactgccacagcatgttccagatcgccctgagcagcagagtggccgagtgggacagcaccgagaagatcggcgacctgttcgtggccagcttcagcaagagcatggtgctggacgtgtacagcgactacgtgaacaacttcaccagcgccatgagcatcatcaagaaggcctgcctgaccaagcccgccttcctggagttcctgaagagaagacaggtgtgcagccccgacagagtgaccctgtacggcctgatggtgaagcccatccagagattcccccagttcatcctgctgctgcaggacatgctgaagaacacccccagaggccaccccgacagactgagcctgcagctggccctgaccgagctggagaccctggccgagaagctgaacgagcagaagagactggccgaccaggtggccgagatccagcagctgaccaagagcgtgagcgacagaagcagcctgaacaagctgctgaccagcggccagagacagctgctgctgtgcgagaccctgaccgagaccgtgtacggcgacagaggccagctgatcaagagcaaggagagaagagtgttcctgctgaacgacatgctggtgtgcgccaacatcaacttcaagggccagctggagatcagcagcctggtgcccctgggccccaagtacgtggtgaagtggaacaccgccctgccccaggtgcaggtggtggaggtgggccaggacggcggcacctacgacaaggacaacgtgctgatccagcacagcggcgccaagaaggccagcgccagcggccaggcccagaacaaggtgtacctgggcccccccagactgttccaggagctgcaggacctgcagaaggacctggccgtggtggagcagatcaccctgctgatcagcaccctgcacggcacctaccagaacctgaacatgaccgtggcccaggactggtgcctggccctgcagagactgatgagagtgaaggaggaggagatccacagcgccaacaagtgcagactgagactgctgctgcccggcaagcccgacaagagcggcagacccatcagcttcatggtggtgttcatcacccccaaccccctgagcaagatcagctgggtgaacagactgcacctggccaagatcggcctgagagaggagaaccagcccggctggctgtgccccgacgaggacaagaagagcaaggcccccttctggtgccccatcctggcctgctgcatccccgccttcagcagcagagccctgagcctgcagctgggcgccctggtgcacagccccgtgaactgccccctgctgggcttcagcgccgtgagcaccagcctgccccagggctacctgtgggtgggcggcggccaggagggcgccggcggccaggtggagatcttcagcctgaacagacccagccccagaaccgtgaagagcttccccctggccgcccccgtgctgtgcatggagtacatccccgagctggaggaggaggccgagagcagagacgagagccccaccgtggccgaccccagcgccaccgtgcaccccaccatctgcctgggcctgcaggacggcagcatcctgctgtacagcagcgtggacaccggcacccagtgcctggtgagctgcagaagccccggcctgcagcccgtgctgtgcctgagacacagccccttccacctgctggccggcctgcaggacggcaccctggccgcctaccccagaaccagcggcggcgtgctgtgggacctggagagcccccccgtgtgcctgaccgtgggccccggccccgtgagaaccctgctgagcctggaggacgccgtgtgggccagctgcggcccctgggtgaccgtgctggaggccaccaccctgcagccccagcagagcttcgaggcccaccaggacgaggccgtgagcgtgacccacatggtgaaggccggcagcggcgtgtggatggccttcagcagcggcaccagcatcagactgttccacaccgagaccctggagcacctgcaggagatcaacatcgccaccagaaccaccttcctgctgcccggccagaagcacctgtgcgtgaccagcctgctgatctgccagggcctgctgtgggtgggcaccgaccagggcgtgatcgtgctgctgcccgtgcccagactggagggcatccccaagatcaccggcaagggcatggtgagcctgaacggccactgcggccccgtggccttcctggccgtggccaccagcatcctggcccccgacatcctgagaagcgaccaggaggaggccgagggccccagagccgaggaggacaagcccgacggccaggcccacgagcccatgcccgacagccacgtgggcagagagctgaccagaaagaagggcatcctgctgcagtacagactgagaagcaccgcccacctgcccggccccctgctgagcatgagagagcccgcccccgccgacggcgccgccctggagcacagcgaggaggacggcagcatctacgagatggccttcttcctgaaggccaagaacaccaagccccacaactgcctggccagccccgtgagcctggtgtgggccctggccggcctgcagggcagccacacccccctgctggagggctgcgtgagagtgagcgtgtgcgagtgcgtgggctggtgcgtgaacatctacaagtag

SEQ ID NO: 97199 - DNA, 4578 bp, Artificial Sequence
  Description of Artificial Sequence: Synthetic coding sequence
atgagcggcacccagagcaccatcaccgacagattccccctgaagaagcccatcagacacggcagcatcctgaacagagagagccccaccgacaagaagcagaaggtggagagaatcgccagccacgacttcgaccccaccggcctggtgcagagatgcgtgatcatccagaaggacgacaacggcttcggcctgaccgtgagcggcgacaaccccgtgttcgtgcagagcgtgaaggaggacggcgccgccatgagagccggcgtgcagaccggcgacagaatcatcaaggtgaacggcaccctggtgacccacagcaaccacctggaggtggtgaagctgatcaagagcggcagctacgtggccctgaccgtgcagggcagaccccccggcagcccccagatccccctggccgacagcgaggtggagcccagcgtgatcggccacatgagccccatcatgaccagcccccacagccccggcgccagcggcaacatggagagaatcaccagccccgtgctgatgggcgaggagaacaacgtggtgcacaaccagaaggtggagatcctgagaaagatgctgcagaaggagcaggagagactgcagctgctgcaggaggactacaacagaacccccgcccagagactgctgaaggagatccaggaggccaagaagcacatcccccagctgcaggagcagctgagcaaggccaccggcagcgcccaggacggcgccgtggtgacccccagcagacccctgggcgacaccctgaccgtgagcgaggccgagaccgaccccggcgacgtgctgggcagaaccgactgcagcagcggcgacgccagcagacccagcagcgacaacgccgacagccccaagagcggccccaaggagagaatctacctggaggagaaccccgagaagagcgagaccatccaggacaccgacacccagagcctggtgggcagccccagcaccagaatcgccccccacatcatcggcgccgaggacgacgacttcggcaccgagcacgagcagatcaacggccagtgcagctgcttccagagcatcgagctgctgaagagcagacccgcccacctggccgtgttcctgcaccacgtggtgagccagttcgaccccgccaccctgctgtgctacctgtacagcgacctgtacaagcacaccaacagcaaggagaccagaagaatcttcctggagttccaccagttcttcctggacagaagcgcccacctgaaggtgagcgtgcccgacgagatgagcgccgacctggagaagagaagacccgagctgatccccgaggacctgcacagacactacatccagaccatgcaggagagagtgcaccccgaggtgcagagacacctggaggacttcagacagaagagaagcatgggcctgaccctggccgagagcgagctgaccaagctggacgccgagagagacaaggacagactgaccctggagaaggagagaacctgcgccgagcagatcgtggccaagatcgaggaggtgctgatgaccgcccaggccgtggaggaggacaagagcagcaccatgcagtacgtgatcctgatgtacatgaagcacctgggcgtgaaggtgaaggagcccagaaacctggagcacaagagaggcagaatcggcttcctgcccaagatcaagcagagcatgaagaaggacaaggagggcgaggagaagggcaagagaagaggcttccccagcatcctgggcccccccagaagacccagcagacacgacaacagcgccatcggcagagccatggagctgcagaaggccagacaccccaagcacctgagcacccccagcagcgtgagccccgagccccaggacagcgccaagctgagacagagcggcctggccaacgagggcaccgacgccggctacctgcccgccaacagcatgagcagcgtggccagcggcgccagcttcagccaggagggcggcaaggagaacgacaccggcagcaagcaggtgggcgagaccagcgcccccggcgacaccctggacggcacccccagaaccctgaacaccgtgttcgacttcccccccccccccctggaccaggtgcaggaggaggagtgcgaggtggagagagtgaccgagcacggcacccccaagcccttcagaaagttcgacagcgtggccttcggcgagagccagagcgaggacgagcagttcgagaacgacctggagaccgacccccccaactggcagcagctggtgagcagagaggtgctgctgggcctgaagccctgcgagatcaagagacaggaggtgatcaacgagctgttctacaccgagagagcccacgtgagaaccctgaaggtgctggaccaggtgttctaccagagagtgagcagagagggcatcctgagccccagcgagctgagaaagatcttcagcaacctggaggacatcctgcagctgcacatcggcctgaacgagcagatgaaggccgtgagaaagagaaacgagaccagcgtgatcgaccagatcggcgaggacctgctgacctggttcagcggccccggcgaggagaagctgaagcacgccgccgccaccttctgcagcaaccagcccttcgccctggagatgatcaagagcagacagaagaaggacagcagattccagaccttcgtgcaggacgccgagagcaaccccctgtgcagaagactgcagctgaaggacatcatccccacccagatgcagagactgaccaagtaccccctgctgctggacaacatcgccaagtacaccgagtggcccaccgagagagagaaggtgaagaaggccgccgaccactgcagacagatcctgaactacgtgaaccaggccgtgaaggaggccgagaacaagcagagactggaggactaccagagaagactggacaccagcagcctgaagctgagcgagtaccccaacgtggaggagctgagaaacctggacctgaccaagagaaagatgatccacgagggccccctggtgtggaaggtgaacagagacaagaccatcgacctgtacaccctgctgctggaggacatcctggtgctgctgcagaagcaggacgacagactggtgctgagatgccacagcaagatcctggccagcaccgccgacagcaagcacaccttcagccccgtgatcaagctgagcaccgtgctggtgagacaggtggccaccgacaacaaggccctgttcgtgatcagcatgagcgacaacggcgcccagatctacgagctggtggcccagaccgtgagcgagaagaccgtgtggcaggacctgatctgcagaatggccgccagcgtgaaggagcagagcaccaagcccatccccctgccccagagcacccccggcgagggcgacaacgacgaggaggaccccagcaagctgaaggaggagcagcacggcatcagcgtgaccggcctgcagagccccgacagagacctgggcctggagagcaccctgatcagcagcaagccccagagccacagcctgagcaccagcggcaagagcgaggtgagagacctgttcgtggccgagagacagttcgccaaggagcagcacaccgacggcaccctgaaggaggtgggcgaggactaccagatcgccatccccgacagccacctgcccgtgagcgaggagagatgggccctggacgccctgagaaacctgggcctgctgaagcagctgctggtgcagcagctgggcctgaccgagaagagcgtgcaggaggactggcagcacttccccagatacagaaccgccagccagggcccccagaccgacagcgtgatccagaacagcgagaacatcaaggcctaccacagcggcgagggccacatgcccttcagaaccggcaccggcgacatcgccacctgctacagccccagaaccagcaccgagagcttcgcccccagagacagcgtgggcctggccccccaggacagccaggccagcaacatcctggtgatggaccacatgatcatgacccccgagatgcccaccatggagcccgagggcggcctggacgacagcggcgagcacttcttcgacgccagagaggcccacagcgacgagaaccccagcgagggcgacggcgccgtgaacaaggaggagaaggacgtgaacctgagaatcagcggcaactacctgatcctggacggctacgaccccgtgcaggagagcagcaccgacgaggaggtggccagcagcctgaccctgcagcccatgaccggcatccccgccgtggagagcacccaccagcagcagcacagcccccagaacacccacagcgacggcgccatcagccccttcacccccgagttcctggtgcagcagagatggggcgccatggagtacagctgcttcgagatccagagccccagcagctgcgccgacagccagagccagatcatggagtacatccacaagatcgaggccgacctggagcacctgaagaaggtggaggagagctacaccatcctgtgccagagactggccggcagcgccctgaccgacaagcacagcgacaagagctag

SEQ ID NO: 97200 - DNA, 4635 bp, Artificial Sequence
  Description of Artificial Sequence: Synthetic coding sequence
atgagcggcacccagagcaccatcaccgacagattccccctgaagaagcccatcagacacggcagcatcctgaacagagagagccccaccgacaagaagcagaaggtggagagaatcgccagccacgacttcgaccccaccgacagcagcagcaagaagaccaagagcagcagcgaggagagcagaagcgagatctacggcctggtgcagagatgcgtgatcatccagaaggacgacaacggcttcggcctgaccgtgagcggcgacaaccccgtgttcgtgcagagcgtgaaggaggacggcgccgccatgagagccggcgtgcagaccggcgacagaatcatcaaggtgaacggcaccctggtgacccacagcaaccacctggaggtggtgaagctgatcaagagcggcagctacgtggccctgaccgtgcagggcagaccccccggcagcccccagatccccctggccgacagcgaggtggagcccagcgtgatcggccacatgagccccatcatgaccagcccccacagccccggcgccagcggcaacatggagagaatcaccagccccgtgctgatgggcgaggagaacaacgtggtgcacaaccagaaggtggagatcctgagaaagatgctgcagaaggagcaggagagactgcagctgctgcaggaggactacaacagaacccccgcccagagactgctgaaggagatccaggaggccaagaagcacatcccccagctgcaggagcagctgagcaaggccaccggcagcgcccaggacggcgccgtggtgacccccagcagacccctgggcgacaccctgaccgtgagcgaggccgagaccgaccccggcgacgtgctgggcagaaccgactgcagcagcggcgacgccagcagacccagcagcgacaacgccgacagccccaagagcggccccaaggagagaatctacctggaggagaaccccgagaagagcgagaccatccaggacaccgacacccagagcctggtgggcagccccagcaccagaatcgccccccacatcatcggcgccgaggacgacgacttcggcaccgagcacgagcagatcaacggccagtgcagctgcttccagagcatcgagctgctgaagagcagacccgcccacctggccgtgttcctgcaccacgtggtgagccagttcgaccccgccaccctgctgtgctacctgtacagcgacctgtacaagcacaccaacagcaaggagaccagaagaatcttcctggagttccaccagttcttcctggacagaagcgcccacctgaaggtgagcgtgcccgacgagatgagcgccgacctggagaagagaagacccgagctgatccccgaggacctgcacagacactacatccagaccatgcaggagagagtgcaccccgaggtgcagagacacctggaggacttcagacagaagagaagcatgggcctgaccctggccgagagcgagctgaccaagctggacgccgagagagacaaggacagactgaccctggagaaggagagaacctgcgccgagcagatcgtggccaagatcgaggaggtgctgatgaccgcccaggccgtggaggaggacaagagcagcaccatgcagtacgtgatcctgatgtacatgaagcacctgggcgtgaaggtgaaggagcccagaaacctggagcacaagagaggcagaatcggcttcctgcccaagatcaagcagagcatgaagaaggacaaggagggcgaggagaagggcaagagaagaggcttccccagcatcctgggcccccccagaagacccagcagacacgacaacagcgccatcggcagagccatggagctgcagaaggccagacaccccaagcacctgagcacccccagcagcgtgagccccgagccccaggacagcgccaagctgagacagagcggcctggccaacgagggcaccgacgccggctacctgcccgccaacagcatgagcagcgtggccagcggcgccagcttcagccaggagggcggcaaggagaacgacaccggcagcaagcaggtgggcgagaccagcgcccccggcgacaccctggacggcacccccagaaccctgaacaccgtgttcgacttcccccccccccccctggaccaggtgcaggaggaggagtgcgaggtggagagagtgaccgagcacggcacccccaagcccttcagaaagttcgacagcgtggccttcggcgagagccagagcgaggacgagcagttcgagaacgacctggagaccgacccccccaactggcagcagctggtgagcagagaggtgctgctgggcctgaagccctgcgagatcaagagacaggaggtgatcaacgagctgttctacaccgagagagcccacgtgagaaccctgaaggtgctggaccaggtgttctaccagagagtgagcagagagggcatcctgagccccagcgagctgagaaagatcttcagcaacctggaggacatcctgcagctgcacatcggcctgaacgagcagatgaaggccgtgagaaagagaaacgagaccagcgtgatcgaccagatcggcgaggacctgctgacctggttcagcggccccggcgaggagaagctgaagcacgccgccgccaccttctgcagcaaccagcccttcgccctggagatgatcaagagcagacagaagaaggacagcagattccagaccttcgtgcaggacgccgagagcaaccccctgtgcagaagactgcagctgaaggacatcatccccacccagatgcagagactgaccaagtaccccctgctgctggacaacatcgccaagtacaccgagtggcccaccgagagagagaaggtgaagaaggccgccgaccactgcagacagatcctgaactacgtgaaccaggccgtgaaggaggccgagaacaagcagagactggaggactaccagagaagactggacaccagcagcctgaagctgagcgagtaccccaacgtggaggagctgagaaacctggacctgaccaagagaaagatgatccacgagggccccctggtgtggaaggtgaacagagacaagaccatcgacctgtacaccctgctgctggaggacatcctggtgctgctgcagaagcaggacgacagactggtgctgagatgccacagcaagatcctggccagcaccgccgacagcaagcacaccttcagccccgtgatcaagctgagcaccgtgctggtgagacaggtggccaccgacaacaaggccctgttcgtgatcagcatgagcgacaacggcgcccagatctacgagctggtggcccagaccgtgagcgagaagaccgtgtggcaggacctgatctgcagaatggccgccagcgtgaaggagcagagcaccaagcccatccccctgccccagagcacccccggcgagggcgacaacgacgaggaggaccccagcaagctgaaggaggagcagcacggcatcagcgtgaccggcctgcagagccccgacagagacctgggcctggagagcaccctgatcagcagcaagccccagagccacagcctgagcaccagcggcaagagcgaggtgagagacctgttcgtggccgagagacagttcgccaaggagcagcacaccgacggcaccctgaaggaggtgggcgaggactaccagatcgccatccccgacagccacctgcccgtgagcgaggagagatgggccctggacgccctgagaaacctgggcctgctgaagcagctgctggtgcagcagctgggcctgaccgagaagagcgtgcaggaggactggcagcacttccccagatacagaaccgccagccagggcccccagaccgacagcgtgatccagaacagcgagaacatcaaggcctaccacagcggcgagggccacatgcccttcagaaccggcaccggcgacatcgccacctgctacagccccagaaccagcaccgagagcttcgcccccagagacagcgtgggcctggccccccaggacagccaggccagcaacatcctggtgatggaccacatgatcatgacccccgagatgcccaccatggagcccgagggcggcctggacgacagcggcgagcacttcttcgacgccagagaggcccacagcgacgagaaccccagcgagggcgacggcgccgtgaacaaggaggagaaggacgtgaacctgagaatcagcggcaactacctgatcctggacggctacgaccccgtgcaggagagcagcaccgacgaggaggtggccagcagcctgaccctgcagcccatgaccggcatccccgccgtggagagcacccaccagcagcagcacagcccccagaacacccacagcgacggcgccatcagccccttcacccccgagttcctggtgcagcagagatggggcgccatggagtacagctgcttcgagatccagagccccagcagctgcgccgacagccagagccagatcatggagtacatccacaagatcgaggccgacctggagcacctgaagaaggtggaggagagctacaccatcctgtgccagagactggccggcagcgccctgaccgacaagcacagcgacaagagctag

SEQ ID NO: 97201 - DNA, 2409 bp, Artificial Sequence
  Description of Artificial Sequence: Synthetic coding sequence
atggactgcggcccccccgccaccctgcagccccacctgaccggcccccccggcaccgcccaccaccccgtggccgtgtgccagcaggagagcctgagcttcgccgagctgcccgccctgaagccccccagccccgtgtgcctggacctgttccccgtggcccccgaggagctgagagcccccggcagcagatggagcctgggcacccccgcccccctgcagggcctgctgtggcccctgagccccggcggcagcgacaccgagatcaccagcggcggcatgagacccagcagagccggcagctggccccactgccccggcgcccagccccccgccctggagggcccctggagccccagacacacccagccccagagaagagccagccacggcagcgagaagaagagcgcctggagaaagatgagagtgtaccagagagaggaggtgcccggctgccccgaggcccacgccgtgttcctggagcccggccaggtggtgcaggagcaggccctgagcaccgaggagcccagagtggagctgagcggcagcaccagagtgagcctggagggccccgagagaagaagattcagcgccagcgagctgatgaccagactgcacagcagcctgagactgggcagaaacagcgccgccagagccctgatcagcggcagcggcaccggcgccgccagagagggcaaggccagcggcatggaggccagaagcgtggagatgagcggcgacagagtgagcagacccgcccccggcgacagcagagagggcgactggagcgagcccagactggacacccaggaggagccccccctgggcagcagaagcaccaacgagagaagacagagcagattcctgctgaacagcgtgctgtaccaggagtacagcgacgtggccagcgccagagagctgagaagacagcagagagaggaggagggccccggcgacgaggccgagggcgccgaggagggccccggcccccccagagccaacctgagccccagcagcagcttcagagcccagagaagcgccagaggcagcaccttcagcctgtggcaggacatccccgacgtgagaggcagcggcgtgctggccaccctgagcctgagagactgcaagctgcaggaggccaagttcgagctgatcaccagcgaggccagctacatccacagcctgagcgtggccgtgggccacttcctgggcagcgccgagctgagcgagtgcctgggcgcccaggacaagcagtggctgttcagcaagctgcccgaggtgaagagcaccagcgagagattcctgcaggacctggagcagagactggaggccgacgtgctgagattcagcgtgtgcgacgtggtgctggaccactgccccgccttcagaagagtgtacctgccctacgtgaccaaccaggcctaccaggagagaacctaccagagactgctgctggagaaccccagattccccggcatcctggccagactggaggagagccccgtgtgccagagactgcccctgaccagcttcctgatcctgcccttccagagaatcaccagactgaagatgctggtggagaacatcctgaagagaaccgcccagggcagcgaggacgaggacatggccaccaaggccttcaacgccctgaaggagctggtgcaggagtgcaacgccagcgtgcagagcatgaagagaaccgaggagctgatccacctgagcaagaagatccacttcgagggcaagatcttccccctgatcagccaggccagatggctggtgagacacggcgagctggtggagctggcccccctgcccgccgccccccccgccaagctgaagctgagcagcaaggccgtgtacctgcacctgttcaacgactgcctgctgctgagcagaagaaaggagctgggcaagttcgccgtgttcgtgcacgccaagatggccgagctgcaggtgagagacctgagcctgaagctgcagggcatccccggccacgtgttcctgctgcagctgctgcacggccagcacatgaagcaccagttcctgctgagagccagaaccgagagcgagaagcagagatggatcagcgccctgtgccccagcagcccccaggaggacaaggaggtgatcagcgagggcgaggactgcccccaggtgcagtgcgtgagaacctacaaggccctgcaccccgacgagctgaccctggagaagaccgacatcctgagcgtgagaacctggaccagcgacggctggctggagggcgtgagactggccgacggcgagaagggctgggtgccccaggcctacgtggaggagatcagcagcctgagcgccagactgagaaacctgagagagaacaagagagtgaccagcgccaccagcaagctgggcgaggcccccgtgtag

SEQ ID NO: 97202 - DNA, 1575 bp, Artificial Sequence
  Description of Artificial Sequence: Synthetic coding sequence
atggactgcggcccccccgccaccctgcagccccacctgaccggcccccccggcaccgcccaccaccccgtggccgtgtgccagcaggagagcctgagcttcgccgagctgcccgccctgaagccccccagccccgtgtgcctggacctgttccccgtggcccccgaggagctgagagcccccggcagcagatggagcctgggcacccccgcccccctgcagggcctgctgtggcccctgagccccggcggcagcgacaccgagatcaccagcggcggcatgagacccagcagagccggcagctggccccactgccccggcgcccagccccccgccctggagggcccctggagccccagacacacccagccccagagaagagccagccacggcagcgagaagaagagcgcctggagaaagatgagagtgtaccagagagaggaggtgcccggctgccccgaggcccacgccgtgttcctggagcccggccaggtggtgcaggagcaggccctgagcaccgaggagcccagagtggagctgagcggcagcaccagagtgagcctggagggccccgagagaagaagattcagcgccagcgagctgatgaccagactgcacagcagcctgagactgggcagaaacagcgccgccagagccctgatcagcggcagcggcaccggcgccgccagagagggcaaggccagcggcatggaggccagaagcgtggagatgagcggcgacagagtgagcagacccgcccccggcgacagcagagagggcgactggagcgagcccagactggacacccaggaggagccccccctgggcagcagaagcaccaacgagagaagacagagcagattcctgctgaacagcgtgctgtaccaggagtacagcgacgtggccagcgccagagagctgagaagacagcagagagaggaggagggccccggcgacgaggccgagggcgccgaggagggccccggcccccccagagccaacctgagccccagcagcagcttcagagcccagagaagcgccagaggcagcaccttcagcctgtggcaggacatccccgacgtgagaggcagcggcgtgctggccaccctgagcctgagagactgcaagctgcaggaggccaagttcgagctgatcaccagcgaggccagctacatccacagcctgagcgtggccgtgggccacttcctgggcagcgccgagctgagcgagtgcctgggcgcccaggacaagcagtggctgttcagcaagctgcccgaggtgaagagcaccagcgagagattcctgcaggacctggagcagagactggaggccgacgtgctgagattcagcgtgtgcgacgtggtgctggaccactgccccgccttcagaagagtgtacctgccctacgtgaccaaccaggcctaccaggagagaacctaccagagactgctgctggagaaccccagattccccggcatcctggccagactggaggagagccccgtgtgccagagactgcccctgaccagcttcctgatcctgcagccccccggcggccagggcggccaccagtag

SEQ ID NO: 97203 - DNA, 1509 bp, Artificial Sequence
  Description of Artificial Sequence: Synthetic coding sequence
atggactgcggcccccccgccaccctgcagccccacctgaccggcccccccggcaccgcccaccaccccgtggccgtgtgccagcaggagagcctgagcttcgccgagctgcccgccctgaagccccccagccccgtgtgcctggacctgttccccgtggcccccgaggagctgagagcccccggcagcagatggagcctgggcacccccgcccccctgcagggcctgctgtggcccctgagccccggcggcagcgacaccgagatcaccagcggcggcatgagacccagcagagccggcagctggccccactgccccggcgcccagccccccgccctggagggcccctggagccccagacacacccagccccagagaagagccagccacggcagcgagaagaagagcgcctggagaaagatgagagtgtaccagagagaggaggtgcccggctgccccgaggcccacgccgtgttcctggagcccggccaggtggtgcaggagcaggccctgagcaccgaggagcccagagtggagctgagcggcagcaccagagtgagcctggagggccccgagagaagaagattcagcgccagcgagctgatgaccagactgcacagcagcctgagactgggcagaaacagcgccgccagagccctgatcagcggcagcggcaccggcgccgccagagagggcaaggccagcggcatggaggccagaagcgtggagatgagcggcgacagagtgagcagacccgcccccggcgacagcagagagggcgactggagcgagcccagactggacacccaggaggagccccccctgggcagcagaagcaccaacgagagaagacagagcagattcctgctgaacagcgtgctgtaccaggagtacagcgacgtggccagcgccagagagctgagaagacagcagagagaggaggagggccccggcgacgaggccgagggcgccgaggagggccccggcccccccagagccaacctgagccccagcagcagcttcagagcccagagaagcgccagaggcagcaccttcagcctgtggcaggacatccccgacgtgagaggcagcggcgtgctggccaccctgagcctgagagactgcaagctgcaggaggccaagttcgagctgatcaccagcgaggccagctacatccacagcctgagcgtggccgtgggccacttcctgggcagcgccgagctgagcgagtgcctgggcgcccaggacaagcagtggctgttcagcaagctgcccgaggtgaagagcaccagcgagagattcctgcaggacctggagcagagactggaggccgacgtgctgagattcagcgtgtgcgacgtggtgctggaccactgccccgccttcagaagagtgtacctgccctacgtgaccaaccaggcctaccaggagagaacctaccagagactgctgagagagaacaagagagtgaccagcgccaccagcaagctgggcgaggcccccgtgtag

SEQ ID NO: 97204 - DNA, 504 bp, Artificial Sequence
  Description of Artificial Sequence: Synthetic coding sequence
gagagactggcccagttccccgccgccggcagaggcagccccggcccccccggcgccagactgggcgtgggcctggagaagggcagaggcagagaggtgtggagacccggcgtgtggggctgcgaggccagagccagcgaggtgaactggagctgccccttcgaccccgtgtgcgccctgccccaggccaagttcgagctgatcaccagcgaggccagctacatccacagcctgagcgtggccgtgggccacttcctgggcagcgccgagctgagcgagtgcctgggcgcccaggacaagcagtggctgttcagcaagctgcccgaggtgaagagcaccagcgagagattcctgcaggacctggagcagagactggaggccgacgtgctgagattcagcgtgtgcgacgtggtgctggaccactgccccgccttcagaagagtgtacctgccctacgtgaccaaccaggcctaccaggagagaacctaccagagactgctgtag

SEQ ID NO: 97205 - DNA, 924 bp, Artificial Sequence
  Description of Artificial Sequence: Synthetic coding sequence
tgaagagacagaggccaggagagactggcccagttccccgccgccggcagaggcagccccggcccccccggcgccagactgggcgtgggcctggagaagggcagaggcagagaggtgtggagacccggcgtgtggggctgcgaggccagagccagcgaggtgaactggagctgccccttcgaccccgtgtgcgccctgccccaggccaagttcgagctgatcaccagcgaggccagctacatccacagcctgagcgtggccgtgggccacttcctgggcagcgccgagctgagcgagtgcctgggcgcccaggacaagcagtggctgttcagcaagctgcccgaggtgaagagcaccagcgagagattcctgcaggacctggagcagagactggaggccgacgtgctgagattcagcgtgtgcgacgtggtgctggaccactgccccgccttcagaagagtgtacctgccctacgtgaccaaccaggcctaccaggagagaacctaccagagactgctgctggagaaccccagattccccggcatcctggccagactggaggagagccccgtgtgccagagactgcccctgaccagcttcctgatcctgcccttccagagaatcaccagactgaagatgctggtggagaacatcctgaagagaaccgcccagggcagcgaggacgaggacatggccaccaaggccttcaacgccctgaaggagctggtgcaggagtgcaacgccagcgtgcagagcatgaagagaaccgaggagctgatccacctgagcaagaagatccacttcgagggcaagatcttccccctgatcagccaggccagatggctggtgagacacggcgagctggtggagctggcccccctgcccgccgccccccccgccaagctgaagctgagcagcaagtag

SEQ ID NO: 97206 - DNA, 1581 bp, Artificial Sequence
  Description of Artificial Sequence: Synthetic coding sequence
atggtggccaaggactaccccttctacctgaccgtgaagagagccaactgcagcctggagctgccccccgccagcggccccgccaaggacgccgaggagcccagcaacaagagagtgaagcccctgagcagagtgaccagcctggccaacctgatcccccccgtgaaggccacccccctgaagagattcagccagaccctgcagagaagcatcagcttcagaagcgagagcagacccgacatcctggcccccagaccctggagcagaaacgccgcccccagcagcaccaagagaagagacagcaagctgtggagcgagaccttcgacgtgtgcgtgaaccagatgctgaccagcaaggagatcaagagacaggaggccatcttcgagctgagccagggcgaggaggacctgatcgaggacctgaagctggccaagaaggcctaccacgaccccatgctgaagctgagcatcatgaccgagcaggagctgaaccagatcttcggcaccctggacagcctgatccccctgcacgaggagctgctgagccagctgagagacgtgagaaagcccgacggcagcaccgagcacgtgggccccatcctggtgggctggctgccctgcctgagcagctacgacagctactgcagcaaccaggtggccgccaaggccctgctggaccacaagaagcaggaccacagagtgcaggacttcctgcagagatgcctggagagccccttcagcagaaagctggacctgtggaacttcctggacatccccagaagcagactggtgaagtaccccctgctgctgagagagatcctgagacacacccccaacgacaaccccgaccagcagcacctggaggaggccatcaacatcatccagggcatcgtggccgagatcaacaccaagaccggcgagagcgagtgcagatactacaaggagagactgctgtacctggaggagggccagaaggacagcctgatcgacagcagcagagtgctgtgctgccacggcgagctgaagaacaacagaggcgtgaagctgcacgtgttcctgttccaggaggtgctggtgatcaccagagccgtgacccacaacgagcagctgtgctaccagctgtacagacagcccatccccgtgaaggacctgctgctggaggacctgcaggacggcgaggtgagactgggcggcagcctgagaggcgccttcagcaacaacgagagaatcaagaacttcttcagagtgagcttcaagaacggcagccagagccagacccacagcctgcaggccaacgacaccttcaacaagcagcagtggctgaactgcatcagacaggccaaggagaccgtgctgtgcgccgccggccaggccggcgtgctggacagcgagggcagcttcctgaaccccaccaccggcagcagagagctgcagggcgagaccaagctggagcagatggaccagagcgacagcgagagcgactgcagcatggacaccagcgaggtgagcctggactgcgagagaatggagcagaccgacagcagctgcggcaacagcagacacggcgagagcaacgtgtag

SEQ ID NO: 97207 - DNA, 1677 bp, Artificial Sequence
  Description of Artificial Sequence: Synthetic coding sequence
atggacagcagcaccgccatgaaccagtgcagctgcagaggcatggaggagaacaaggagagacccaagagacagagacagaacaacttccccatgttccccagccccaaggcctggaacttcagaggcagaaagagaaagcagagcacccaggacgaggacgccgtgagcctgtgcagcctggacatcagcgagcccagcaacaagagagtgaagcccctgagcagagtgaccagcctggccaacctgatcccccccgtgaaggccacccccctgaagagattcagccagaccctgcagagaagcatcagcttcagaagcgagagcagacccgacatcctggcccccagaccctggagcagaaacgccgcccccagcagcaccaagagaagagacagcaagctgtggagcgagaccttcgacgtgtgcgtgaaccagatgctgaccagcaaggagatcaagagacaggaggccatcttcgagctgagccagggcgaggaggacctgatcgaggacctgaagctggccaagaaggcctaccacgaccccatgctgaagctgagcatcatgaccgagcaggagctgaaccagatcttcggcaccctggacagcctgatccccctgcacgaggagctgctgagccagctgagagacgtgagaaagcccgacggcagcaccgagcacgtgggccccatcctggtgggctggctgccctgcctgagcagctacgacagctactgcagcaaccaggtggccgccaaggccctgctggaccacaagaagcaggaccacagagtgcaggacttcctgcagagatgcctggagagccccttcagcagaaagctggacctgtggaacttcctggacatccccagaagcagactggtgaagtaccccctgctgctgagagagatcctgagacacacccccaacgacaaccccgaccagcagcacctggaggaggccatcaacatcatccagggcatcgtggccgagatcaacaccaagaccggcgagagcgagtgcagatactacaaggagagactgctgtacctggaggagggccagaaggacagcctgatcgacagcagcagagtgctgtgctgccacggcgagctgaagaacaacagaggcgtgaagctgcacgtgttcctgttccaggaggtgctggtgatcaccagagccgtgacccacaacgagcagctgtgctaccagctgtacagacagcccatccccgtgaaggacctgctgctggaggacctgcaggacggcgaggtgagactgggcggcagcctgagaggcgccttcagcaacaacgagagaatcaagaacttcttcagagtgagcttcaagaacggcagccagagccagacccacagcctgcaggccaacgacaccttcaacaagcagcagtggctgaactgcatcagacaggccaaggagaccgtgctgtgcgccgccggccaggccggcgtgctggacagcgagggcagcttcctgaaccccaccaccggcagcagagagctgcagggcgagaccaagctggagcagatggaccagagcgacagcgagagcgactgcagcatggacaccagcgaggtgagcctggactgcgagagaatggagcagaccgacagcagctgcggcaacagcagacacggcgagagcaacgtgtag

SEQ ID NO: 97208 - DNA, 1599 bp, Artificial Sequence
  Description of Artificial Sequence: Synthetic coding sequence
atgatcgaggtgtgccaccacaactggctgctgtggctgtgccccagcaagttcggcatcttcatgtgctgcctggccagcaccaccggccagatggagctgagaagaaccagagagcccagcaacaagagagtgaagcccctgagcagagtgaccagcctggccaacctgatcccccccgtgaaggccacccccctgaagagattcagccagaccctgcagagaagcatcagcttcagaagcgagagcagacccgacatcctggcccccagaccctggagcagaaacgccgcccccagcagcaccaagagaagagacagcaagctgtggagcgagaccttcgacgtgtgcgtgaaccagatgctgaccagcaaggagatcaagagacaggaggccatcttcgagctgagccagggcgaggaggacctgatcgaggacctgaagctggccaagaaggcctaccacgaccccatgctgaagctgagcatcatgaccgagcaggagctgaaccagatcttcggcaccctggacagcctgatccccctgcacgaggagctgctgagccagctgagagacgtgagaaagcccgacggcagcaccgagcacgtgggccccatcctggtgggctggctgccctgcctgagcagctacgacagctactgcagcaaccaggtggccgccaaggccctgctggaccacaagaagcaggaccacagagtgcaggacttcctgcagagatgcctggagagccccttcagcagaaagctggacctgtggaacttcctggacatccccagaagcagactggtgaagtaccccctgctgctgagagagatcctgagacacacccccaacgacaaccccgaccagcagcacctggaggaggccatcaacatcatccagggcatcgtggccgagatcaacaccaagaccggcgagagcgagtgcagatactacaaggagagactgctgtacctggaggagggccagaaggacagcctgatcgacagcagcagagtgctgtgctgccacggcgagctgaagaacaacagaggcgtgaagctgcacgtgttcctgttccaggaggtgctggtgatcaccagagccgtgacccacaacgagcagctgtgctaccagctgtacagacagcccatccccgtgaaggacctgctgctggaggacctgcaggacggcgaggtgagactgggcggcagcctgagaggcgccttcagcaacaacgagagaatcaagaacttcttcagagtgagcttcaagaacggcagccagagccagacccacagcctgcaggccaacgacaccttcaacaagcagcagtggctgaactgcatcagacaggccaaggagaccgtgctgtgcgccgccggccaggccggcgtgctggacagcgagggcagcttcctgaaccccaccaccggcagcagagagctgcagggcgagaccaagctggagcagatggaccagagcgacagcgagagcgactgcagcatggacaccagcgaggtgagcctggactgcgagagaatggagcagaccgacagcagctgcggcaacagcagacacggcgagagcaacgtgtag

SEQ ID NO: 97209 - DNA, 2073 bp, Artificial Sequence
  Description of Artificial Sequence: Synthetic coding sequence
atgccctgggaggagcccgccggcgagaagcccagctgcagccacagccagaaggccttccacatggagcccgcccagaagccctgcttcaccaccgacatggtgacctgggccctgctgtgcatcagcgccgagaccgtgagaggcgaggcccccagccagcccagaggcatcccccacagaagccccgtgagcgtggacgacctgtggctggagaagacccagagaaagaagctgcagaagcaggcccacgtggagagaagactgcacatcggcgccgtgcacaaggacggcgtgaagtgctggagaaagaccatcatcaccagccccgagagcctgaacctgcccagaagaagccaccccctgagccagagcgcccccaccggcctgaaccacatgggctggcccgagcacacccccggcaccgccatgcccgacggcgccctggacaccgccgtgtgcgccgacgaggtgggcagcgaggaggacctgtacgacgacctgcacagcagcagccaccactacagccaccccggcggcggcggcgagcagctggccatcaacgagctgatcagcgacggcagcgtggtgtgcgccgaggccctgtgggaccacgtgaccatggacgaccaggagctgggcttcaaggccggcgacgtgatcgaggtgatggacgccaccaacagagagtggtggtggggcagagtggccgacggcgagggctggttccccgccagcttcgtgagactgagagtgaaccaggacgagcccgccgacgacgacgcccccctggccggcaacagcggcgccgaggacggcggcgccgaggcccagagcagcaaggaccagatgagaaccaacgtgatcaacgagatcctgagcaccgagagagactacatcaagcacctgagagacatctgcgagggctacgtgagacagtgcagaaagagagccgacatgttcagcgaggagcagctgagaaccatcttcggcaacatcgaggacatctacagatgccagaaggccttcgtgaaggccctggagcagagattcaacagagagagaccccacctgagcgagctgggcgcctgcttcctggagcaccaggccgacttccagatctacagcgagtactgcaacaaccaccccaacgcctgcgtggagctgagcagactgaccaagctgagcaagtacgtgtacttcttcgaggcctgcagactgctgcagaagatgatcgacatcagcctggacggcttcctgctgacccccgtgcagaagatctgcaagtaccccctgcagctggccgagctgctgaagtacacccacccccagcacagagacttcaaggacgtggaggccgccctgcacgccatgaagaacgtggcccagctgatcaacgagagaaagagaagactggagaacatcgacaagatcgcccagtggcagagcagcatcgaggactgggagggcgaggacctgctggtgagaagcagcgagctgatctacagcggcgagctgaccagagtgacccagccccaggccaagagccagcagagaatgttcttcctgttcgaccaccagctgatctactgcaagaaggacctgctgagaagagacgtgctgtactacaagggcagactggacatggacggcctggaggtggtggacctggaggacggcaaggacagagacctgcacgtgagcatcaagaacgccttcagactgcacagaggcgccaccggcgacagccacctgctgtgcaccagaaagcccgagcagaagcagagatggctgaaggccttcgccagagagagagagcaggtgcagctggaccaggagaccggcttcagcatcaccgagctgcagagaaagcaggccatgctgaacgccagcaagcagcaggtgaccggcaagcccaaggccgtgggcagaccctgctacctgaccagacagaagcaccccgccctgcccagcaacagaccccagcagcaggtgctggtgctggccgagcccagaagaaagcccagcaccttctggcacagcatcagcagactggcccccttcagaaagtag

SEQ ID NO: 97210 - DNA, 1860 bp, Artificial Sequence
  Description of Artificial Sequence: Synthetic coding sequence
atgagacccgacggccagcaggccctggacgccgtggtgagaagcttcgactgccacagcgaggccgccctgagacagagaaacgacgtgatctactgcagcctgcccagaaccgcccagggcatcgtgcagagagaggaccagctggaggtgctggtgagcctgagagaggtgtggggcagaagaagaggcagagacggcacctgcaccggcgccatgcccgacggcgccctggacaccgccgtgtgcgccgacgaggtgggcagcgaggaggacctgtacgacgacctgcacagcagcagccaccactacagccaccccggcggcggcggcgagcagctggccatcaacgagctgatcagcgacggcagcgtggtgtgcgccgaggccctgtgggaccacgtgaccatggacgaccaggagctgggcttcaaggccggcgacgtgatcgaggtgatggacgccaccaacagagagtggtggtggggcagagtggccgacggcgagggctggttccccgccagcttcgtgagactgagagtgaaccaggacgagcccgccgacgacgacgcccccctggccggcaacagcggcgccgaggacggcggcgccgaggcccagagcagcaaggaccagatgagaaccaacgtgatcaacgagatcctgagcaccgagagagactacatcaagcacctgagagacatctgcgagggctacgtgagacagtgcagaaagagagccgacatgttcagcgaggagcagctgagaaccatcttcggcaacatcgaggacatctacagatgccagaaggccttcgtgaaggccctggagcagagattcaacagagagagaccccacctgagcgagctgggcgcctgcttcctggagcaccaggccgacttccagatctacagcgagtactgcaacaaccaccccaacgcctgcgtggagctgagcagactgaccaagctgagcaagtacgtgtacttcttcgaggcctgcagactgctgcagaagatgatcgacatcagcctggacggcttcctgctgacccccgtgcagaagatctgcaagtaccccctgcagctggccgagctgctgaagtacacccacccccagcacagagacttcaaggacgtggaggccgccctgcacgccatgaagaacgtggcccagctgatcaacgagagaaagagaagactggagaacatcgacaagatcgcccagtggcagagcagcatcgaggactgggagggcgaggacctgctggtgagaagcagcgagctgatctacagcggcgagctgaccagagtgacccagccccaggccaagagccagcagagaatgttcttcctgttcgaccaccagctgatctactgcaagaaggacctgctgagaagagacgtgctgtactacaagggcagactggacatggacggcctggaggtggtggacctggaggacggcaaggacagagacctgcacgtgagcatcaagaacgccttcagactgcacagaggcgccaccggcgacagccacctgctgtgcaccagaaagcccgagcagaagcagagatggctgaaggccttcgccagagagagagagcaggtgcagctggaccaggagaccggcttcagcatcaccgagctgcagagaaagcaggccatgctgaacgccagcaagcagcaggtgaccggcaagcccaaggccgtgggcagaccctgctacctgaccagacagaagcaccccgccctgcccagcaacagaccccagcagcaggtgctggtgctggccgagcccagaagaaagcccagcaccttctggcacagcatcagcagactggcccccttcagaaagtag

SEQ ID NO: 97211 - DNA, 2013 bp, Artificial Sequence
  Description of Artificial Sequence: Synthetic coding sequence
atgccctgggaggagcccgccggcgagaagcccagctgcagccacagccagaaggccttccacatggagcccgcccagaagccctgcttcaccaccgacatggtgacctgggccctgctgtgcatcagcgccgagaccgtgagaggcgaggcccccagccagcccagaggcatcccccacagaagccccgtgagcgtggacgacctgtggctggagaagacccagagaaagaagctgcagaagcaggcccacgtggagagaagactgcacatcggcgccgtgcacaaggacggcgtgaagtgctggagaaagaccatcatcaccagccccgagagcctgaacctgcccagaagaagccaccccctgagccagagcgcccccaccggcctgaaccacatgggctggcccgagcacacccccggcaccgccatgcccgacggcgccctggacaccgccgtgtgcgccgacgaggtgggcagcgaggaggacctgtacgacgacctgcacagcagcagccaccactacagccaccccggcggcggcggcgagcagctggccatcaacgagctgatcagcgacggcagcgtggtgtgcgccgaggccctgtgggaccacgtgaccatggacgaccaggagctgggcttcaaggccggcgacgtgatcgaggtgatggacgccaccaacagagagtggtggtggggcagagtggccgacggcgagggctggttccccgccagcttcgtgagactgagagtgaaccaggacgagcccgccgacgacgacgcccccctggccggcaacagcggcgccgaggacggcggcgccgaggcccagagcagcaaggaccagatgagaaccaacgtgatcaacgagatcctgagcaccgagagagactacatcaagcacctgagagacatctgcgagggctacgtgagacagtgcagaaagagagccgacatgttcagcgaggagcagctgagaaccatcttcggcaacatcgaggacatctacagatgccagaaggccttcgtgaaggccctggagcagagattcaacagagagagaccccacctgagcgagctgggcgcctgcttcctggagcaccaggccgacttccagatctacagcgagtactgcaacaaccaccccaacgcctgcgtggagctgagcagactgaccaagctgagcaagtacgtgtacttcttcgaggcctgcagactgctgcagaagatgatcgacatcagcctggacggcttcctgctgacccccgtgcagaagatctgcaagtaccccctgcagctggccgagctgctgaagtacacccacccccagcacagagacttcaaggacgtggaggccgccctgcacgccatgaagaacgtggcccagctgatcaacgagagaaagagaagactggagaacatcgacaagatcgcccagtggcagagcagcatcgaggactgggagggcgaggacctgctggtgagaagcagcgagctgatctacagcggcgagctgaccagagtgacccagccccaggccaagagccagcagagaatgttcttcctgttcgaccaccagctgatctactgcaagaaggacctgctgagaagagacgtgctgtactacaagggcagactggacatggacggcctggaggtggtggacctggaggacggcaaggacagagacctgcacgtgagcatcaagaacgccttcagactgcacagaggcgccaccggcgacagccacctgctgtgcaccagaaagcccgagcagaagcagagatggctgaaggccttcgccagagagagagagcaggtgcagctggaccaggagaccggcttcagcatcaccgagctgcagagaaagcaggccatgctgaacgccagcaagcagcaggtgaccggcaagcccaagggcagaagaaccgccgcccccccccccagactgcccggcccctaccccgccgacatcatccccttcagcgagccccagagccaggccagctag

SEQ ID NO: 97212 - DNA, 1893 bp, Artificial Sequence
  Description of Artificial Sequence: Synthetic coding sequence
atgccctgggaggagcccgccggcgagaagcccagctgcagccacagccagaaggccttccacatggagcccgcccagaagccctgcttcaccaccgacatggtgacctgggccctgctgtgcatcagcgccgagaccgtgagaggcgaggcccccagccagcccagaggcatcccccacagaagccccgtgagcgtggacgacctgtggctggagaagacccagagaaagaagctgcagaagcaggcccacgtggagagaagactgcacatcggcgccgtgcacaaggacggcgtgaagtgctggagaaagaccatcatcaccagccccgagagcctgaacctgcccagaagaagccaccccctgagccagagcgcccccaccggcctgaaccacatgggctggcccgagcacacccccggcaccgccatgcccgacggcgccctggacaccgccgtgtgcgccgacgaggtgggcagcgaggaggacctgtacgacgacctgcacagcagcagccaccactacagccaccccggcggcggcggcgagcagctggccatcaacgagctgatcagcgacggcagcgtggtgtgcgccgaggccctgtgggaccacgtgaccatggacgaccaggagctgggcttcaaggccggcgacgtgatcgaggtgatggacgccaccaacagagagtggtggtggggcagagtggccgacggcgagggctggttccccgccagcttcgtgagactgagagtgaaccaggacgagcccgccgacgacgacgcccccctggccggcaacagcggcgccgaggacggcggcgccgaggcccagagcagcaaggaccagatgagaaccaacgtgatcaacgagatcctgagcaccgagagagactacatcaagcacctgagagacatctgcgagcaggccgacttccagatctacagcgagtactgcaacaaccaccccaacgcctgcgtggagctgagcagactgaccaagctgagcaagtacgtgtacttcttcgaggcctgcagactgctgcagaagatgatcgacatcagcctggacggcttcctgctgacccccgtgcagaagatctgcaagtaccccctgcagctggccgagctgctgaagtacacccacccccagcacagagacttcaaggacgtggaggccgccctgcacgccatgaagaacgtggcccagctgatcaacgagagaaagagaagactggagaacatcgacaagatcgcccagtggcagagcagcatcgaggactgggagggcgaggacctgctggtgagaagcagcgagctgatctacagcggcgagctgaccagagtgacccagccccaggccaagagccagcagagaatgttcttcctgttcgaccaccagctgatctactgcaagaaggacctgctgagaagagacgtgctgtactacaagggcagactggacatggacggcctggaggtggtggacctggaggacggcaaggacagagacctgcacgtgagcatcaagaacgccttcagactgcacagaggcgccaccggcgacagccacctgctgtgcaccagaaagcccgagcagaagcagagatggctgaaggccttcgccagagagagagagcaggtgcagctggaccaggagaccggcttcagcatcaccgagctgcagagaaagcaggccatgctgaacgccagcaagcagcaggtgaccggcaagcccaaggccgtgggcagaccctgctacctgaccagacagaagcaccccgccctgcccagcaacagaccccagcagcaggtgctggtgctggccgagcccagaagaaagcccagcaccttctggcacagcatcagcagactggcccccttcagaaagtag

SEQ ID NO: 97213 - DNA, 579 bp, Artificial Sequence
  Description of Artificial Sequence: Synthetic coding sequence
atgccctgggaggagcccgccggcgagaagcccagctgcagccacagccagaaggccttccacatggagcccgcccagaagccctgcttcaccaccgacatggtgacctgggccctgctgtgcatcagcgccgagaccgtgagaggcgaggcccccagccagcccagaggcatcccccacagaagccccgtgagcgtggacgacctgtggctggagaagacccagagaaagaagctgcagaagcaggcccacgtggagagaagactgcacatcggcgccgtgcacaaggacggcgtgaagtgctggagaaagaccatcatcaccagccccgagagcctgaacctgcccagaagaagccaccccctgagccagagcgcccccaccggcctgaaccacatgggctggcccgagcacacccccggcaccgccgtgggcagaccctgctacctgaccagacagaagcaccccgccctgcccagcaacagaccccagcagcaggtgctggtgctggccgagcccagaagaaagcccagcaccttctggcacagcatcagcagactggcccccttcagaaagtag

SEQ ID NO: 97214 - DNA, 2013 bp, Artificial Sequence; identical to SEQ ID NO: 97211
  Description of Artificial Sequence: Synthetic coding sequence

SEQ ID NO: 97215 - DNA, 4794 bp, Artificial Sequence
  Description of Artificial Sequence: Synthetic coding sequence
atggaggccgaggaggcccagagaggcgccagcccccccatcagcgccatcgaggagttcagcatcatccccgaggcccccatgagaagcagccaggtgagcgccctgggcctggaggcccaggaggacgaggaccccagctacaagtggagagaggagcacagactgagcgccacccagcagagcgagctgagagacgtgtgcgactacgccatcgagaccatgcccagcttccccaaggagggcagcgccgacgtggagcccaaccaggagagcctggtggccgaggcctgcgacacccccgagcactgggaggccgtgccccagagcctggccggcagacaggccagaaccctggccccccccgagctgtgggcctgccccatccagagcgagcacctggacatggcccccttcagcagcgacctgggcagcgaggaggaggaggtggagttctggcccggcctgaccagcctgaccctgggcagcggccaggccgaggaggaggaggagaccagcagcgacaacagcggccagaccagatactacagcccctgcgaggagcaccccgccgagaccaaccagaacgagggcagcgagagcggcaccatcagacagggcgaggagctgccccccgaggagctgcaggagagccagggcctgctgcacccccaggaggtgcaggtgctggaggagcagggccagcaggaggccggcttcagaggcgagggcaccctgagagaggacgtgtgcgccgacggcctgctgggcgaggagcagatgatcgagcaggtgaacgacgagaagggcgagcagaagcagaagcaggagcaggtgcaggacgtgatgctgggcagacagggcgagagaatgggcctgaccggcgagcccgagggcctgaacgacggcgagtgggagcaggaggacatggagagaaaggcccagggccagggcggccccgagcagggcgaggagagaaagagagagctgcaggtgcccgaggagaacagagccgacagccaggacgagaagagccagaccttcctgggcaagagcgaggaggtgaccggcaagcaggaggaccacggcatcaaggagaagggcgtgcccgtgagcggccaggaggccaaggagcccgagagctgggacggcggcagactgggcgccgtgggcagagccagaagcagagaggaggagaacgagcaccacggccccagcatgcccgccctgatcgcccccgaggacagcccccactgcgacctgttccccggcgccagctacctgatgacccagatccccggcacccagaccgagagcagagccgaggagctgagccccgccgccctgagccccagcctggagcccatcagatgcagccaccagcccatcagcctgctgggcagcttcctgaccgaggagagccccgacaaggagatcgaccagaacagccagcaggaggagagcagactgagaaagggcaccgtgagcagccagggcaccgaggtggtgttcgccagcgccagcgtgaccccccccagaacccccgacagcgccccccccagccccgccgaggcctaccccatcacccccgccagcgtgagcgccagaccccccgtggccttccccagaagagagaccagctgcgccgccagagcccccgagaccgccagcgcccccctgagcatggacgaccccagcccctgcggcaccagcgagatgtgccccgccgccctgtacggcttccccagcaccggcaccagcccccccagaccccccgccaacagcaccggcaccgtgcagcacctgagaagcgacagcttccccggcagccacagaaccgagcagacccccgacctggtgggcatgctgctgagctacagccacagcgagctgccccagagaccccccaagcccgccatctacagcagcgtgacccccagaagagacagaagaagcggcagagactacagcaccgtgagcgccagccccaccgccctgagcaccctgaagcaggacagccaggagagcatcagcaacctggagagacccagcagcccccccagcatccagccctgggtgagcccccacaaccccgccttcgccaccgagagccccgcctacggcagcagccccagcttcgtgagcatggaggacgtgagaatccacgagcccctgccccccccccccccccagagaagagacacccaccccagcgtggtggagaccgacggccacgccagagtggtggtgcccaccctgaagcagcacagccaccccccccccctggccctgggcagcggcctgcacgccccccacaagggccccctgccccaggccagcgaccccgccgtggccagacagcacagacccctgcccagcacccccgacagcagccaccacgcccaggccacccccagatggagatacaacaagcccctgccccccacccccgacctgccccagccccacctgccccccatcagcgcccccggcagcagcagaatctacagacccctgccccccctgcccatcatcgacccccccaccgagcccccccccctgccccccaagagcagaggcagaagcagaagcaccagaggcggccacatgaacagcggcggccacgccaagaccagacccgcctgccaggactggaccgtgcccctgcccgccagcgccggcagaaccagctggccccccgccaccgccagaagcaccgagagcttcaccagcaccagcagaagcaagagcgaggtgagccccggcatggccttcagcaacatgaccaacttcctgtgccccagcagccccaccaccccctggacccccgagctgcagggccccaccagcaaggacgaggccggcgtgagcgagcaccccgaggcccccgccagagagcccctgagaagaaccaccccccagcagggcgccagcggccccggcagaagccccgtgggccaggccagacagcccgagaagcccagccacctgcacctggagaaggccagcagctggccccacagaagagacagcggcagaccccccggcgacagcagcggccaggccgtggcccccagcgagggcgccaacaagcacaagggctggagcagacagggcctgagaagacccagcatcctgcccgagggcagcagcgacagcagaggccccgccgtggagaagcaccccggccccagcgacaccgtggtgttcagagagaagaagcccaaggaggtgatgggcggcttcagcagaagatgcagcaagctgatcaacagcagccagctgctgtaccaggagtacagcgacgtggtgctgaacaaggagatccagagccagcagagactggagagcctgagcgagacccccggccccagcagccccagacagcccagaaaggccctggtgagcagcgagagctacctgcagagactgagcatggccagcagcggcagcctgtggcaggagatccccgtggtgagaaacagcaccgtgctgctgagcatgacccacgaggaccagaagctgcaggaggtgaagttcgagctgatcgtgagcgaggccagctacctgagaagcctgaacatcgccgtggaccacttccagctgagcaccagcctgagagccaccctgagcaaccaggagcaccagtggctgttcagcagactgcaggacgtgagagacgtgagcgccaccttcctgagcgacctggaggagaacttcgagaacaacatcttcagcttccaggtgtgcgacgtggtgctgaaccacgcccccgacttcagaagagtgtacctgccctacgtgaccaaccagacctaccaggagagaaccttccagagcctgatgaacagcaacagcaacttcagagaggtgctggagaagctggagagcgaccccgtgtgccagagactgagcctgaagagcttcctgatcctgcccttccagagaatcaccagactgaagctgctgctgcagaacatcctgaagagaacccagcccggcagcagcgaggaggccgaggccaccaaggcccaccacgccctggagcagctgatcagagactgcaacaacaacgtgcagagcatgagaagaaccgaggagctgatctacctgagccagaagatcgagttcgagtgcaagatcttccccctgatcagccagagcagatggctggtgaagagcggcgagctgaccgccctggagttcagcgccagccccggcctgagaagaaagctgaacaccagacccgtgcacctgcacctgttcaacgactgcctgctgctgagcagacccagagagggcagcagattcctggtgttcgaccacgcccccttcagcagcatcagaggcgagaagtgcgagatgaagctgcacggcccccacaagaacctgttcagactgttcctgagacagaacacccagggcgcccaggccgagttcctgttcagaaccgagacccagagcgagaagctgagatggatcagcgccctggccatgcccagagaggagctggacctgctggagtgctacaacagcccccaggtgcagtgcctgagagcctacaagcccagagagaacgacgagctggccctggagaaggccgacgtggtgatggtgacccagcagagcagcgacggctggctggagggcgtgagactgagcgacggcgagagaggctggttccccgtgcagcaggtggagttcatcagcaaccccgaggtgagagcccagaacctgaaggaggcccacagagtgaagaccgccaagctgcagctggtggagcagcaggcctag

SEQ ID NO: 97216 - DNA, 1197 bp, Artificial Sequence
  Description of Artificial Sequence: Synthetic coding sequence
atggccagcagcggcagcctgtggcaggagatccccgtggtgagaaacagcaccgtgctgctgagcatgacccacgaggaccagaagctgcaggaggtgaagttcgagctgatcgtgagcgaggccagctacctgagaagcctgaacatcgccgtggaccacttccagctgagcaccagcctgagagccaccctgagcaaccaggagcaccagtggctgttcagcagactgcaggacgtgagagacgtgagcgccaccttcctgagcgacctggaggagaacttcgagaacaacatcttcagcttccaggtgtgcgacgtggtgctgaaccacgcccccgacttcagaagagtgtacctgccctacgtgaccaaccagacctaccaggagagaaccttccagagcctgatgaacagcaacagcaacttcagagaggtgctggagaagctggagagcgaccccgtgtgccagagactgagcctgaagagcttcctgatcctgcccttccagagaatcaccagactgaagctgctgctgcagaacatcctgaagagaacccagcccggcagcagcgaggaggccgaggccaccaaggcccaccacgccctggagcagctgatcagagactgcaacaacaacgtgcagagcatgagaagaaccgaggagctgatctacctgagccagaagatcgagttcgagtgcaagatcttccccctgatcagccagagcagatggctggtgaagagcggcgagctgaccgccctggagttcagcgccagccccggcctgagaagaaagctgaacaccagacccgtgcacctgcacctgttcaacgactgcctgctgctgagcagacccagagagagcgagaagctgagatggatcagcgccctggccatgcccagagaggagctggacctgctggagtgctacaacagcccccaggtgcagtgcctgagagcctacaagcccagagagaacgacgagctggccctggagaaggccgacgtggtgatggtgacccagcagagcagcgacggctggctggagggcgtgagactgagcgacggcgagagaggctggttccccgtgcagcaggtggagttcatcagcaaccccgaggtgagagcccagaacctgaaggaggcccacagagtgaagaccgccaagctgcagctggtggagcagcaggcctag

SEQ ID NO: 97217 - DNA, 1560 bp, Artificial Sequence
  Description of Artificial Sequence: Synthetic coding sequence
atgggcggcttcagcagaagatgcagcaagctgatcaacagcagccagctgctgtaccaggagtacagcgacgtggtgctgaacaaggagatccagagccagcagagactggagagcctgagcgagacccccggccccagcagccccagacagcccagaaaggccctggtgagcagcgagagctacctgcagagactgagcatggccagcagcggcagcctgtggcaggagatccccgtggtgagaaacagcaccgtgctgctgagcatgacccacgaggaccagaagctgcaggaggtgaagttcgagctgatcgtgagcgaggccagctacctgagaagcctgaacatcgccgtggaccacttccagctgagcaccagcctgagagccaccctgagcaaccaggagcaccagtggctgttcagcagactgcaggacgtgagagacgtgagcgccaccttcctgagcgacctggaggagaacttcgagaacaacatcttcagcttccaggtgtgcgacgtggtgctgaaccacgcccccgacttcagaagagtgtacctgccctacgtgaccaaccagacctaccaggagagaaccttccagagcctgatgaacagcaacagcaacttcagagaggtgctggagaagctggagagcgaccccgtgtgccagagactgagcctgaagagcttcctgatcctgcccttccagagaatcaccagactgaagctgctgctgcagaacatcctgaagagaacccagcccggcagcagcgaggaggccgaggccaccaaggcccaccacgccctggagcagctgatcagagactgcaacaacaacgtgcagagcatgagaagaaccgaggagctgatctacctgagccagaagatcgagttcgagtgcaagatcttccccctgatcagccagagcagatggctggtgaagagcggcgagctgaccgccctggagttcagcgccagccccggcctgagaagaaagctgaacaccagacccgtgcacctgcacctgttcaacgactgcctgctgctgagcagacccagagagggcagcagattcctggtgttcgaccacgcccccttcagcagcatcagaggcgagaagtgcgagatgaagctgcacggcccccacaagaacctgttcagactgttcctgagacagaacacccagggcgcccaggccgagttcctgttcagaaccgagacccagagcgagaagctgagatggatcagcgccctggccatgcccagagaggagctggacctgctggagtgctacaacagcccccaggtgcagtgcctgagagcctacaagcccagagagaacgacgagctggccctggagaaggccgacgtggtgatggtgacccagcagagcagcgacggctggctggagggcgtgagactgagcgacggcgagagaggctggttccccgtgcagcaggtggagttcatcagcaaccccgaggtgagagcccagaacctgaaggaggcccacagagtgaagaccgccaagctgcagctggtggagcagcaggcctag

SEQ ID NO: 97218 - DNA, 2394 bp, Artificial Sequence
  Description of Artificial Sequence: Synthetic coding sequence
tgagtggtggtgcccaccctgaagcagcacagccaccccccccccctggccctgggcagcggcctgcacgccccccacaagggccccctgccccaggccagcgaccccgccgtggccagacagcacagacccctgcccagcacccccgacagcagccaccacgcccaggccacccccagatggagatacaacaagcccctgccccccacccccgacctgccccagccccacctgccccccatcagcgcccccggcagcagcagaatctacagacccctgccccccctgcccatcatcgacccccccaccgagcccccccccctgccccccaagagcagaggcagaagcagaagcaccagaggcggccacatgaacagcggcggccacgccaagaccagacccgcctgccaggactggaccgtgcccctgcccgccagcgccggcagaaccagctggccccccgccaccgccagaagcaccgagagcttcaccagcaccagcagaagcaagagcgaggtgagccccggcatggccttcagcaacatgaccaacttcctgtgccccagcagccccaccaccccctggacccccgagctgcagggccccaccagcaaggacgaggccggcgtgagcgagcaccccgaggcccccgccagagagcccctgagaagaaccaccccccagcagggcgccagcggccccggcagaagccccgtgggccaggccagacagcccgagaagcccagccacctgcacctggagaaggccagcagctggccccacagaagagacagcggcagaccccccggcgacagcagcggccaggccgtggcccccagcgagggcgccaacaagcacaagggctggagcagacagggcctgagaagacccagcatcctgcccgagggcagcagcgacagcagaggccccgccgtggagaagcaccccggccccagcgacaccgtggtgttcagagagaagaagcccaaggaggtgatgggcggcttcagcagaagatgcagcaagctgatcaacagcagccagctgctgtaccaggagtacagcgacgtggtgctgaacaaggagatccagagccagcagagactggagagcctgagcgagacccccggccccagcagccccagacagcccagaaaggccctggtgagcagcgagagctacctgcagagactgagcatggccagcagcggcagcctgtggcaggagatccccgtggtgagaaacagcaccgtgctgctgagcatgacccacgaggaccagaagctgcaggaggtgaagttcgagctgatcgtgagcgaggccagctacctgagaagcctgaacatcgccgtggaccacttccagctgagcaccagcctgagagccaccctgagcaaccaggagcaccagtggctgttcagcagactgcaggacgtgagagacgtgagcgccaccttcctgagcgacctggaggagaacttcgagaacaacatcttcagcttccaggtgtgcgacgtggtgctgaaccacgcccccgacttcagaagagtgtacctgccctacgtgaccaaccagacctaccaggagagaaccttccagagcctgatgaacagcaacagcaacttcagagaggtgctggagaagctggagagcgaccccgtgtgccagagactgagcctgaagagcttcctgatcctgcccttccagagaatcaccagactgaagctgctgctgcagaacatcctgaagagaacccagcccggcagcagcgaggaggccgaggccaccaaggcccaccacgccctggagcagctgatcagagactgcaacaacaacgtgcagagcatgagaagaaccgaggagctgatctacctgagccagaagatcgagttcgagtgcaagatcttccccctgatcagccagagcagatggctggtgaagagcggcgagctgaccgccctggagttcagcgccagccccggcctgagaagaaagctgaacaccagacccgtgcacctgcacctgttcaacgactgcctgctgctgagcagacccagagagagcgagaagctgagatggatcagcgccctggccatgcccagagaggagctggacctgctggagtgctacaacagcccccaggtgcagtgcctgagagcctacaagcccagagagaacgacgagctggccctggagaaggccgacgtggtgatggtgacccagcagagcagcgacggctggctggagggcgtgagactgagcgacggcgagagaggctggttccccgtgcagcaggtggagttcatcagcaaccccgaggtgagagcccagaacctgaaggaggcccacagagtgaagaccgccaagctgcagctggtggagcagcaggcctag

SEQ ID NO: 97219 - DNA, 2958 bp, Artificial Sequence
  Description of Artificial Sequence: Synthetic coding sequence
atgagcagaatcgagagcctgaccagagccagaatcgacagaagcagagagctggccagcaagaccagagagaaggagaagatgaaggaggccaaggacgccagatacaccaacggccacctgttcaccaccatcagcgtgagcggcatgaccatgtgctacgcctgcaacaagagcatcaccgccaaggaggccctgatctgccccacctgcaacgtgaccatccacaacagatgcaaggacaccctggccaactgcaccaaggtgaagcagaagcagcagaaggccgccctgctgaagaacaacaccgccctgcagagcgtgagcctgagaagcaagaccaccatcagagagagacccagcagcgccatctaccccagcgacagcttcagacagagcctgctgggcagcagaagaggcagaagcagcctgagcctggccaagagcgtgagcaccaccaacatcgccggccacttcaacgacgagagccccctgggcctgagaagaatcctgagccagagcaccgacagcctgaacatgagaaacagaaccctgagcgtggagagcctgatcgacgaggaggtgatctacagcgagctgatgagcgacttcgagatggacgagaaggacttcgccgccgacagctggagcctggccgtggacagcagcttcctgcagcagcacaagaaggaggtgatgaagcagcaggacgtgatctacgagctgatccagaccgagctgcaccacgtgagaaccctgaagatcatgaccagactgttcagaaccggcatgctggaggagctgcacctggagcccggcgtggtgcagggcctgttcccctgcgtggacgagctgagcgacatccacaccagattcctgagccagctgctggagagaagaagacaggccctgtgccccggcagcaccagaaacttcgtgatccacagactgggcgacctgctgatcagccagttcagcggccccagcgccgagcagatgtgcaagacctacagcgagttctgcagcagacacagcaaggccctgaagctgtacaaggagctgtacgccagagacaagagattccagcagttcatcagaaaggtgaccagacccgccgtgctgaagagacacggcgtgcaggagtgcatcctgctggtgacccagagaatcaccaagtaccccctgctgatcagcagaatcctgcagcacagccacggcatcgaggaggagagacaggacctgaccaccgccctgggcctggtgaaggagctgctgagcaacgtggacgagggcatctaccagctggagaagggcgccagactgcaggagatctacaacagaatggaccccagagcccagacccccgtgcccggcaagggccccttcggcagagaggagctgctgagaagaaagctgatccacgacggctgcctgctgtggaagaccgccaccggcagattcaaggacgtgctggtgctgctgatgaccgacgtgctggtgttcctgcaggagaaggaccagaagtacatcttccccaccctggacaagcccagcgtggtgagcctgcagaacctgatcgtgagagacatcgccaaccaggagaagggcatgttcctgatcagcgccgccccccccgagatgtacgaggtgcacaccgccagcagagacgacagaagcacctggatcagagtgatccagcagagcgtgagaacctgccccagcagagaggacttccccctgatcgagaccgaggacgaggcctacctgagaagaatcaagatggagctgcagcagaaggacagagccctggtggagctgctgagagagaaggtgggcctgttcgccgagatgacccacttccaggccgaggaggacggcggcagcggcatggccctgcccaccctgcccagaggcctgttcagaagcgagagcctggagagccccagaggcgagagactgctgcaggacgccatcagagaggtggagggcctgaaggacctgctggtgggccccggcgtggagctgctgctgacccccagagagcccgccctgcccctggagcccgacagcggcggcaacaccagccccggcgtgaccgccaacggcgaggccagaaccttcaacggcagcatcgagctgtgcagagccgacagcgacagcagccagagagacagaaacggcaaccagctgagaagcccccaggaggaggccctgcagagactggtgaacctgtacggcctgctgcacggcctgcaggccgccgtggcccagcaggacaccctgatggaggccagattccccgagggccccgagagaagagagaagctgtgcagagccaacagcagagacggcgaggccggcagagccggcgccgcccccgtggcccccgagaagcaggccaccgagctggccctgctgcagagacagcacgccctgctgcaggaggagctgagaagatgcagaagactgggcgaggagagagccaccgaggccggcagcctggaggccagactgagagagagcgagcaggccagagccctgctggagagagaggccgaggaggccagaagacagctggccgccctgggccagaccgagcccctgcccgccgaggccccctgggccagaagacccgtggaccccagaagaagaagcctgcccgccggcgacgccctgtacctgagcttcaaccccccccagcccagcagaggcaccgacagactggacctgcccgtgaccaccagaagcgtgcacagaaacttcgaggacagagagagacaggagctgggcagccccgaggagagactgcaggacagcagcgaccccgacaccggcagcgaggaggagggcagcagcagactgagccccccccacagccccagagacttcaccagaatgcaggacatccccgaggagaccgagagcagagacggcgaggccgtggccagcgagagctag

SEQ ID NO: 97220 - DNA, 2877 bp, Artificial Sequence
  Description of Artificial Sequence: Synthetic coding sequence
atgaaggaggccaaggacgccagatacaccaacggccacctgttcaccaccatcagcgtgagcggcatgaccatgtgctacgcctgcaacaagagcatcaccgccaaggaggccctgatctgccccacctgcaacgtgaccatccacaacagatgcaaggacaccctggccaactgcaccaaggtgaagcagaagcagcagaaggccgccctgctgaagaacaacaccgccctgcagagcgtgagcctgagaagcaagaccaccatcagagagagacccagcagcgccatctaccccagcgacagcttcagacagagcctgctgggcagcagaagaggcagaagcagcctgagcctggccaagagcgtgagcaccaccaacatcgccggccacttcaacgacgagagccccctgggcctgagaagaatcctgagccagagcaccgacagcctgaacatgagaaacagaaccctgagcgtggagagcctgatcgacgaggaggtgatctacagcgagctgatgagcgacttcgagatggacgagaaggacttcgccgccgacagctggagcctggccgtggacagcagcttcctgcagcagcacaagaaggaggtgatgaagcagcaggacgtgatctacgagctgatccagaccgagctgcaccacgtgagaaccctgaagatcatgaccagactgttcagaaccggcatgctggaggagctgcacctggagcccggcgtggtgcagggcctgttcccctgcgtggacgagctgagcgacatccacaccagattcctgagccagctgctggagagaagaagacaggccctgtgccccggcagcaccagaaacttcgtgatccacagactgggcgacctgctgatcagccagttcagcggccccagcgccgagcagatgtgcaagacctacagcgagttctgcagcagacacagcaaggccctgaagctgtacaaggagctgtacgccagagacaagagattccagcagttcatcagaaaggtgaccagacccgccgtgctgaagagacacggcgtgcaggagtgcatcctgctggtgacccagagaatcaccaagtaccccctgctgatcagcagaatcctgcagcacagccacggcatcgaggaggagagacaggacctgaccaccgccctgggcctggtgaaggagctgctgagcaacgtggacgagggcatctaccagctggagaagggcgccagactgcaggagatctacaacagaatggaccccagagcccagacccccgtgcccggcaagggccccttcggcagagaggagctgctgagaagaaagctgatccacgacggctgcctgctgtggaagaccgccaccggcagattcaaggacgtgctggtgctgctgatgaccgacgtgctggtgttcctgcaggagaaggaccagaagtacatcttccccaccctggacaagcccagcgtggtgagcctgcagaacctgatcgtgagagacatcgccaaccaggagaagggcatgttcctgatcagcgccgccccccccgagatgtacgaggtgcacaccgccagcagagacgacagaagcacctggatcagagtgatccagcagagcgtgagaacctgccccagcagagaggacttccccctgatcgagaccgaggacgaggcctacctgagaagaatcaagatggagctgcagcagaaggacagagccctggtggagctgctgagagagaaggtgggcctgttcgccgagatgacccacttccaggccgaggaggacggcggcagcggcatggccctgcccaccctgcccagaggcctgttcagaagcgagagcctggagagccccagaggcgagagactgctgcaggacgccatcagagaggtggagggcctgaaggacctgctggtgggccccggcgtggagctgctgctgacccccagagagcccgccctgcccctggagcccgacagcggcggcaacaccagccccggcgtgaccgccaacggcgaggccagaaccttcaacggcagcatcgagctgtgcagagccgacagcgacagcagccagagagacagaaacggcaaccagctgagaagcccccaggaggaggccctgcagagactggtgaacctgtacggcctgctgcacggcctgcaggccgccgtggcccagcaggacaccctgatggaggccagattccccgagggccccgagagaagagagaagctgtgcagagccaacagcagagacggcgaggccggcagagccggcgccgcccccgtggcccccgagaagcaggccaccgagctggccctgctgcagagacagcacgccctgctgcaggaggagctgagaagatgcagaagactgggcgaggagagagccaccgaggccggcagcctggaggccagactgagagagagcgagcaggccagagccctgctggagagagaggccgaggaggccagaagacagctggccgccctgggccagaccgagcccctgcccgccgaggccccctgggccagaagacccgtggaccccagaagaagaagcctgcccgccggcgacgccctgtacctgagcttcaaccccccccagcccagcagaggcaccgacagactggacctgcccgtgaccaccagaagcgtgcacagaaacttcgaggacagagagagacaggagctgggcagccccgaggagagactgcaggacagcagcgaccccgacaccggcagcgaggaggagggcagcagcagactgagccccccccacagccccagagacttcaccagaatgcaggacatccccgaggagaccgagagcagagacggcgaggccgtggccagcgagagctag

SEQ ID NO: 97221 - DNA, 2961 bp, Artificial Sequence
  Description of Artificial Sequence: Synthetic coding sequence
atgagcagaatcgagagcctgaccagagccagaatcgacagaagcagagagctggccagcaagaccagagagaaggagaagatgaaggaggccaaggacgccagatacaccaacggccacctgttcaccaccatcagcgtgagcggcatgaccatgtgctacgcctgcaacaagagcatcaccgccaaggaggccctgatctgccccacctgcaacgtgaccatccacaacagatgcaaggacaccctggccaactgcaccaaggtgaagcagaagcagcagaaggccgccctgctgaagaacaacaccgccctgcagagcgtgagcctgagaagcaagaccaccatcagagagagacccagcagcgccatctaccccagcgacagcttcagacagagcctgctgggcagcagaagaggcagaagcagcctgagcctggccaagagcgtgagcaccaccaacatcgccggccacttcaacgacgagagccccctgggcctgagaagaatcctgagccagagcaccgacagcctgaacatgagaaacagaaccctgagcgtggagagcctgatcgacgaggccgaggtgatctacagcgagctgatgagcgacttcgagatggacgagaaggacttcgccgccgacagctggagcctggccgtggacagcagcttcctgcagcagcacaagaaggaggtgatgaagcagcaggacgtgatctacgagctgatccagaccgagctgcaccacgtgagaaccctgaagatcatgaccagactgttcagaaccggcatgctggaggagctgcacctggagcccggcgtggtgcagggcctgttcccctgcgtggacgagctgagcgacatccacaccagattcctgagccagctgctggagagaagaagacaggccctgtgccccggcagcaccagaaacttcgtgatccacagactgggcgacctgctgatcagccagttcagcggccccagcgccgagcagatgtgcaagacctacagcgagttctgcagcagacacagcaaggccctgaagctgtacaaggagctgtacgccagagacaagagattccagcagttcatcagaaaggtgaccagacccgccgtgctgaagagacacggcgtgcaggagtgcatcctgctggtgacccagagaatcaccaagtaccccctgctgatcagcagaatcctgcagcacagccacggcatcgaggaggagagacaggacctgaccaccgccctgggcctggtgaaggagctgctgagcaacgtggacgagggcatctaccagctggagaagggcgccagactgcaggagatctacaacagaatggaccccagagcccagacccccgtgcccggcaagggccccttcggcagagaggagctgctgagaagaaagctgatccacgacggctgcctgctgtggaagaccgccaccggcagattcaaggacgtgctggtgctgctgatgaccgacgtgctggtgttcctgcaggagaaggaccagaagtacatcttccccaccctggacaagcccagcgtggtgagcctgcagaacctgatcgtgagagacatcgccaaccaggagaagggcatgttcctgatcagcgccgccccccccgagatgtacgaggtgcacaccgccagcagagacgacagaagcacctggatcagagtgatccagcagagcgtgagaacctgccccagcagagaggacttccccctgatcgagaccgaggacgaggcctacctgagaagaatcaagatggagctgcagcagaaggacagagccctggtggagctgctgagagagaaggtgggcctgttcgccgagatgacccacttccaggccgaggaggacggcggcagcggcatggccctgcccaccctgcccagaggcctgttcagaagcgagagcctggagagccccagaggcgagagactgctgcaggacgccatcagagaggtggagggcctgaaggacctgctggtgggccccggcgtggagctgctgctgacccccagagagcccgccctgcccctggagcccgacagcggcggcaacaccagccccggcgtgaccgccaacggcgaggccagaaccttcaacggcagcatcgagctgtgcagagccgacagcgacagcagccagagagacagaaacggcaaccagctgagaagcccccaggaggaggccctgcagagactggtgaacctgtacggcctgctgcacggcctgcaggccgccgtggcccagcaggacaccctgatggaggccagattccccgagggccccgagagaagagagaagctgtgcagagccaacagcagagacggcgaggccggcagagccggcgccgcccccgtggcccccgagaagcaggccaccgagctggccctgctgcagagacagcacgccctgctgcaggaggagctgagaagatgcagaagactgggcgaggagagagccaccgaggccggcagcctggaggccagactgagagagagcgagcaggccagagccctgctggagagagaggccgaggaggccagaagacagctggccgccctgggccagaccgagcccctgcccgccgaggccccctgggccagaagacccgtggaccccagaagaagaagcctgcccgccggcgacgccctgtacctgagcttcaaccccccccagcccagcagaggcaccgacagactggacctgcccgtgaccaccagaagcgtgcacagaaacttcgaggacagagagagacaggagctgggcagccccgaggagagactgcaggacagcagcgaccccgacaccggcagcgaggaggagggcagcagcagactgagccccccccacagccccagagacttcaccagaatgcaggacatccccgaggagaccgagagcagagacggcgaggccgtggccagcgagagctag

SEQ ID NO: 97222 - DNA, 2964 bp, Artificial Sequence
  Description of Artificial Sequence: Synthetic coding sequence
atgtgctgctgctgcggctgctgccccctgctggcccacctggagcagggcagcctgagagagagaaccagagagaaggagaagatgaaggaggccaaggacgccagatacaccaacggccacctgttcaccaccatcagcgtgagcggcatgaccatgtgctacgcctgcaacaagagcatcaccgccaaggaggccctgatctgccccacctgcaacgtgaccatccacaacagatgcaaggacaccctggccaactgcaccaaggtgaagcagaagcagcagaaggccgccctgctgaagaacaacaccgccctgcagagcgtgagcctgagaagcaagaccaccatcagagagagacccagcagcgccatctaccccagcgacagcttcagacagagcctgctgggcagcagaagaggcagaagcagcctgagcctggccaagagcgtgagcaccaccaacatcgccggccacttcaacgacgagagccccctgggcctgagaagaatcctgagccagagcaccgacagcctgaacatgagaaacagaaccctgagcgtggagagcctgatcgacgaggccgaggtgatctacagcgagctgatgagcgacttcgagatggacgagaaggacttcgccgccgacagctggagcctggccgtggacagcagcttcctgcagcagcacaagaaggaggtgatgaagcagcaggacgtgatctacgagctgatccagaccgagctgcaccacgtgagaaccctgaagatcatgaccagactgttcagaaccggcatgctggaggagctgcacctggagcccggcgtggtgcagggcctgttcccctgcgtggacgagctgagcgacatccacaccagattcctgagccagctgctggagagaagaagacaggccctgtgccccggcagcaccagaaacttcgtgatccacagactgggcgacctgctgatcagccagttcagcggccccagcgccgagcagatgtgcaagacctacagcgagttctgcagcagacacagcaaggccctgaagctgtacaaggagctgtacgccagagacaagagattccagcagttcatcagaaaggtgaccagacccgccgtgctgaagagacacggcgtgcaggagtgcatcctgctggtgacccagagaatcaccaagtaccccctgctgatcagcagaatcctgcagcacagccacggcatcgaggaggagagacaggacctgaccaccgccctgggcctggtgaaggagctgctgagcaacgtggacgagggcatctaccagctggagaagggcgccagactgcaggagatctacaacagaatggaccccagagcccagacccccgtgcccggcaagggccccttcggcagagaggagctgctgagaagaaagctgatccacgacggctgcctgctgtggaagaccgccaccggcagattcaaggacgtgctggtgctgctgatgaccgacgtgctggtgttcctgcaggagaaggaccagaagtacatcttccccaccctggacaagcccagcgtggtgagcctgcagaacctgatcgtgagagacatcgccaaccaggagaagggcatgttcctgatcagcgccgccccccccgagatgtacgaggtgcacaccgccagcagagacgacagaagcacctggatcagagtgatccagcagagcgtgagaacctgccccagcagagaggacttccccctgatcgagaccgaggacgaggcctacctgagaagaatcaagatggagctgcagcagaaggacagagccctggtggagctgctgagagagaaggtgggcctgttcgccgagatgacccacttccaggccgaggaggacggcggcagcggcatggccctgcccaccctgcccagaggcctgttcagaagcgagagcctggagagccccagaggcgagagactgctgcaggacgccatcagagaggtggagggcctgaaggacctgctggtgggccccggcgtggagctgctgctgacccccagagagcccgccctgcccctggagcccgacagcggcggcaacaccagccccggcgtgaccgccaacggcgaggccagaaccttcaacggcagcatcgagctgtgcagagccgacagcgacagcagccagagagacagaaacggcaaccagctgagaagcccccaggaggaggccctgcagagactggtgaacctgtacggcctgctgcacggcctgcaggccgccgtggcccagcaggacaccctgatggaggccagattccccgagggccccgagagaagagagaagctgtgcagagccaacagcagagacggcgaggccggcagagccggcgccgcccccgtggcccccgagaagcaggccaccgagctggccctgctgcagagacagcacgccctgctgcaggaggagctgagaagatgcagaagactgggcgaggagagagccaccgaggccggcagcctggaggccagactgagagagagcgagcaggccagagccctgctggagagagaggccgaggaggccagaagacagctggccgccctgggccagaccgagcccctgcccgccgaggccccctgggccagaagacccgtggaccccagaagaagaagcctgcccgccggcgacgccctgtacctgagcttcaaccccccccagcccagcagaggcaccgacagactggacctgcccgtgaccaccagaagcgtgcacagaaacttcgaggacagagagagacaggagctgggcagccccgaggagagactgcaggacagcagcgaccccgacaccggcagcgaggaggagggcagcagcagactgagccccccccacagccccagagacttcaccagaatgcaggacatccccgaggagaccgagagcagagacggcgaggccgtggccagcgagagctag

SEQ ID NO: 97223 - DNA, 2877 bp, Artificial Sequence; identical to SEQ ID NO: 97220
  Description of Artificial Sequence: Synthetic coding sequence

SEQ ID NO: 97224 - DNA, 1548 bp, Artificial Sequence
  Description of Artificial Sequence: Synthetic coding sequence
atgctgagcaagagcgtgcccgtgagcggcatcaactgcctgctggacagaagcgacaccgacggcaacgtgagccagagcagcgccatcgacctgagaaagagatgcagccagctggagggccacagcggcaccagagtgggcagcagcctgagacagaccttcagcttcctgagcggcatgaccggcaaggccaagaccagagagaaggagaagatgaaggaggccaaggacgccagatacaccaacggccacctgttcaccaccatcagcgtgagcggcatgaccatgtgctacgcctgcaacaagagcatcaccgccaaggaggccctgatctgccccacctgcaacgtgaccatccacaacagatgcaaggacaccctggccaactgcaccaaggtgaagcagaagcagcagaaggccgccctgctgaagaacaacaccgccctgcagagcgtgagcctgagaagcaagaccaccatcagagagagacccagcagcgccatctaccccagcgacagcttcagacagagcctgctgggcagcagaagaggcagaagcagcctgagcctggccaagagcgtgagcaccaccaacatcgccggccacttcaacgacgagagccccctgggcctgagaagaatcctgagccagagcaccgacagcctgaacatgagaaacagaaccctgagcgtggagagcctgatcgacgaggccgaggtgatctacagcgagctgatgagcgacttcgagatggacgagaaggacttcgccgccgacagctggagcctggccgtggacagcagcttcctgcagcagcacaagaaggaggtgatgaagcagcaggacgtgatctacgagctgatccagaccgagctgcaccacgtgagaaccctgaagatcatgaccagactgttcagaaccggcatgctggaggagctgcacctggagcccggcgtggtgcagggcctgttcccctgcgtggacgagctgagcgacatccacaccagattcctgagccagctgctggagagaagaagacaggccctgtgccccggcagcaccagaaacttcgtgatccacagactgggcgacctgctgatcagccagttcagcggccccagcgccgagcagatgtgcaagacctacagcgagttctgcagcagacacagcaaggccctgaagctgtacaaggagctgtacgccagagacaagagattccagcagttcatcagaaaggtgaccagacccgccgtgctgaagagacacggcgtgcaggagtgcatcctgctggtgacccagagaatcaccaagtaccccctgctgatcagcagaatcctgcagcacagccacggcatcgaggaggagagacaggacctgaccaccgccctgggcctggtgaaggagctgctgagcaacgtggacgagggcatctaccagctggagaagggcgccagactgcaggagatctacaacctgctgctgctgttcagcctgagccccagcttcatggaggccctgggcgacaacctggccagctggagctag

SEQ ID NO: 97225 - DNA, 1332 bp, Artificial Sequence
  Description of Artificial Sequence: Synthetic coding sequence
atgaaggaggccaaggacgccagatacaccaacggccacctgttcaccaccatcagcgtgagcggcatgaccatgtgctacgcctgcaacaagagcatcaccgccaaggaggccctgatctgccccacctgcaacgtgaccatccacaacagatgcaaggacaccctggccaactgcaccaaggtgaagcagaagcagcagaaggccgccctgctgaagaacaacaccgccctgcagagcgtgagcctgagaagcaagaccaccatcagagagagacccagcagcgccatctaccccagcgacagcttcagacagagcctgctgggcagcagaagaggcagaagcagcctgagcctggccaagagcgtgagcaccaccaacatcgccggccacttcaacgacgagagccccctgggcctgagaagaatcctgagccagagcaccgacagcctgaacatgagaaacagaaccctgagcgtggagagcctgatcgacgaggccgaggtgatctacagcgagctgatgagcgacttcgagatggacgagaaggacttcgccgccgacagctggagcctggccgtggacagcagcttcctgcagcagcacaagaaggaggtgatgaagcagcaggacgtgatctacgagctgatccagaccgagctgcaccacgtgagaaccctgaagatcatgaccagactgttcagaaccggcatgctggaggagctgcacctggagcccggcgtggtgcagggcctgttcccctgcgtggacgagctgagcgacatccacaccagattcctgagccagctgctggagagaagaagacaggccctgtgccccggcagcaccagaaacttcgtgatccacagactgggcgacctgctgatcagccagttcagcggccccagcgccgagcagatgtgcaagacctacagcgagttctgcagcagacacagcaaggccctgaagctgtacaaggagctgtacgccagagacaagagattccagcagttcatcagaaaggtgaccagacccgccgtgctgaagagacacggcgtgcaggagtgcatcctgctggtgacccagagaatcaccaagtaccccctgctgatcagcagaatcctgcagcacagccacggcatcgaggaggagagacaggacctgaccaccgccctgggcctggtgaaggagctgctgagcaacgtggacgagggcatctaccagctggagaagggcgccagactgcaggagatctacaacctgctgctgctgttcagcctgagccccagcttcatggaggccctgggcgacaacctggccagctggagctag

SEQ ID NO: 97226 - DNA, 4167 bp, Artificial Sequence
  Description of Artificial Sequence: Synthetic coding sequence
atgagcagacccccccccaccggcaagatgcccggcgcccccgagaccgcccccggcgacggcgccggcgccagcagacagagaaagctggaggccctgatcagagaccccagaagccccatcaacgtggagagcctgctggacggcctgaacagcctggtgctggacctggacttccccgccctgagaaagaacaagaacatcgacaacttcctgaacagatacgagaagatcgtgaagaagatcagaggcctgcagatgaaggccgaggactacgacgtggtgaaggtgatcggcagaggcgccttcggcgaggtgcagctggtgagacacaaggccagccagaaggtgtacgccatgaagctgctgagcaagttcgagatgatcaagagaagcgacagcgccttcttctgggaggagagagacatcatggccttcgccaacagcccctgggtggtgcagctgttctacgccttccaggacgacagatacctgtacatggtgatggagtacatgcccggcggcgacctggtgaacctgatgagcaactacgacgtgcccgagaagtgggccaagttctacaccgccgaggtggtgctggccctggacgccatccacagcatgggcctgatccacagagacgtgaagcccgacaacatgctgctggacaagcacggccacctgaagctggccgacttcggcacctgcatgaagatggacgagaccggcatggtgcactgcgacaccgccgtgggcacccccgactacatcagccccgaggtgctgaagagccagggcggcgacggcttctacggcagagagtgcgactggtggagcgtgggcgtgttcctgtacgagatgctggtgggcgacacccccttctacgccgacagcctggtgggcacctacagcaagatcatggaccacaagaacagcctgtgcttccccgaggacgccgagatcagcaagcacgccaagaacctgatctgcgccttcctgaccgacagagaggtgagactgggcagaaacggcgtggaggagatcagacagcaccccttcttcaagaacgaccagtggcactgggacaacatcagagagaccgccgcccccgtggtgcccgagctgagcagcgacatcgacagcagcaacttcgacgacatcgaggacgacaagggcgacgtggagaccttccccatccccaaggccttcgtgggcaaccagctgcccttcatcggcttcacctactacagagagaacctgctgctgagcgacagccccagctgcagagagaccgacagcatccagagcagaaagaacgaggagagccaggagatccagaagaagctgtacaccctggaggagcacctgagcaacgagatgcaggccaaggaggagctggagcagaagtgcaagagcgtgaacaccagactggagaagaccgccaaggagctggaggaggagatcaccctgagaaagagcgtggagagcgccctgagacagctggagagagagaaggccctgctgcagcacaagaacgccgagtaccagagaaaggccgaccacgaggccgacaagaagagaaacctggagaacgacgtgaacagcctgaaggaccagctggaggacctgaagaagagaaaccagaacagccagatcagcaccgagaaggtgaaccagctgcagagacagctggacgagaccaacgccctgctgagaaccgagagcgacaccgccgccagactgagaaagacccaggccgagagcagcaagcagatccagcagctggagagcaacaacagagacctgcaggacaagaactgcctgctggagaccgccaagctgaagctggagaaggagttcatcaacctgcagagcgccctggagagcgagagaagagacagaacccacggcagcgagatcatcaacgacctgcagggcagaatctgcggcctggaggaggacctgaagaacggcaagatcctgctggccaaggtggagctggagaagagacagctgcaggagagattcaccgacctggagaaggagaagagcaacatggagatcgacatgacctaccagctgaaggtgatccagcagagcctggagcaggaggaggccgagcacaaggccaccaaggccagactggccgacaagaacaagatctacgagagcatcgaggaggccaagagcgaggccatgaaggagatggagaagaagctgctggaggagagaaccctgaagcagaaggtggagaacctgctgctggaggccgagaagagatgcagcctgctggactgcgacctgaagcagagccagcagaagatcaacgagctgctgaagcagaaggacgtgctgaacgaggacgtgagaaacctgaccctgaagatcgagcaggagacccagaagagatgcctgacccagaacgacctgaagatgcagacccagcaggtgaacaccctgaagatgagcgagaagcagctgaagcaggagaacaaccacctgatggagatgaagatgaacctggagaagcagaacgccgagctgagaaaggagagacaggacgccgacggccagatgaaggagctgcaggaccagctggaggccgagcagtacttcagcaccctgtacaagacccaggtgagagagctgaaggaggagtgcgaggagaagaccaagctgggcaaggagctgcagcagaagaagcaggagctgcaggacgagagagacagcctggccgcccagctggagatcaccctgaccaaggccgacagcgagcagctggccagaagcatcgccgaggagcagtacagcgacctggagaaggagaagatcatgaaggagctggagatcaaggagatgatggccagacacaagcaggagctgaccgagaaggacgccaccatcgccagcctggaggagaccaacagaaccctgaccagcgacgtggccaacctggccaacgagaaggaggagctgaacaacaagctgaaggacgtgcaggagcagctgagcagactgaaggacgaggagatcagcgccgccgccatcaaggcccagttcgagaagcagctgctgaccgagagaaccctgaagacccaggccgtgaacaagctggccgagatcatgaacagaaaggagcccgtgaagagaggcaacgacaccgacgtgagaagaaaggagaaggagaacagaaagctgcacatggagctgaagagcgagagagagaagctgacccagcagatgatcaagtaccagaaggagctgaacgagatgcaggcccagatcgccgaggagagccagatcagaatcgagctgcagatgaccctggacagcaaggacagcgacatcgagcagctgagaagccagctgcaggccctgcacatcggcctggacagcagcagcatcggcagcggccccggcgacgccgaggccgacgacggcttccccgagagcagactggagggctggctgagcctgcccgtgagaaacaacaccaagaagttcggctgggtgaagaagtacgtgatcgtgagcagcaagaagatcctgttctacgacagcgagcaggacaaggagcagagcaacccctacatggtgctggacatcgacaagctgttccacgtgagacccgtgacccagaccgacgtgtacagagccgacgccaaggagatccccagaatcttccagatcctgtacgccaacgagggcgagagcaagaaggagcaggagttccccgtggagcccgtgggcgagaagagcaactacatctgccacaagggccacgagttcatccccaccctgtaccacttccccaccaactgcgaggcctgcatgaagcccctgtggcacatgttcaagcccccccccgccctggagtgcagaagatgccacatcaagtgccacaaggaccacatggacaagaaggaggagatcatcgccccctgcaaggtgtactacgacatcagcaccgccaagaacctgctgctgctggccaacagcaccgaggagcagcagaagtgggtgagcagactggtgaagaagatccccaagaagccccccgcccccgaccccttcgccagaagcagccccagaaccagcatgaagatccagcagaaccagagcatcagaagacccagcagacagctggcccccaacaagcccagctag

SEQ ID NO: 97227 - DNA, 2241 bp, Artificial Sequence
  Description of Artificial Sequence: Synthetic coding sequence
atgatctacaaggtggagtgcggcctggaggaggacctgaagaacggcaagatcctgctggccaaggtggagctggagaagagacagctgcaggagagattcaccgacctggagaaggagaagagcaacatggagatcgacatgacctaccagctgaaggtgatccagcagagcctggagcaggaggaggccgagcacaaggccaccaaggccagactggccgacaagaacaagatctacgagagcatcgaggaggccaagagcgaggccatgaaggagatggagaagaagctgctggaggagagaaccctgaagcagaaggtggagaacctgctgctggaggccgagaagagatgcagcctgctggactgcgacctgaagcagagccagcagaagatcaacgagctgctgaagcagaaggacgtgctgaacgaggacgtgagaaacctgaccctgaagatcgagcaggagacccagaagagatgcctgacccagaacgacctgaagatgcagacccagcaggtgaacaccctgaagatgagcgagaagcagctgaagcaggagaacaaccacctgatggagatgaagatgaacctggagaagcagaacgccgagctgagaaaggagagacaggacgccgacggccagatgaaggagctgcaggaccagctggaggccgagcagtacttcagcaccctgtacaagacccaggtgagagagctgaaggaggagtgcgaggagaagaccaagctgggcaaggagctgcagcagaagaagcaggagctgcaggacgagagagacagcctggccgcccagctggagatcaccctgaccaaggccgacagcgagcagctggccagaagcatcgccgaggagcagtacagcgacctggagaaggagaagatcatgaaggagctggagatcaaggagatgatggccagacacaagcaggagctgaccgagaaggacgccaccatcgccagcctggaggagaccaacagaaccctgaccagcgacgtggccaacctggccaacgagaaggaggagctgaacaacaagctgaaggacgtgcaggagcagctgagcagactgaaggacgaggagatcagcgccgccgccatcaaggcccagttcgagaagcagctgctgaccgagagaaccctgaagacccaggccgtgaacaagctggccgagatcatgaacagaaaggagcccgtgaagagaggcaacgacaccgacgtgagaagaaaggagaaggagaacagaaagctgcacatggagctgaagagcgagagagagaagctgacccagcagatgatcaagtaccagaaggagctgaacgagatgcaggcccagatcgccgaggagagccagatcagaatcgagctgcagatgaccctggacagcaaggacagcgacatcgagcagctgagaagccagctgcaggccctgcacatcggcctggacagcagcagcatcggcagcggccccggcgacgccgaggccgacgacggcttccccgagagcagactggagggctggctgagcctgcccgtgagaaacaacaccaagaagttcggctgggtgaagaagtacgtgatcgtgagcagcaagaagatcctgttctacgacagcgagcaggacaaggagcagagcaacccctacatggtgctggacatcgacaagctgttccacgtgagacccgtgacccagaccgacgtgtacagagccgacgccaaggagatccccagaatcttccagatcctgtacgccaacgagggcgagagcaagaaggagcaggagttccccgtggagcccgtgggcgagaagagcaactacatctgccacaagggccacgagttcatccccaccctgtaccacttccccaccaactgcgaggcctgcatgaagcccctgtggcacatgttcaagcccccccccgccctggagtgcagaagatgccacatcaagtgccacaaggaccacatggacaagaaggaggagatcatcgccccctgcaaggtgtactacgacatcagcaccgccaagaacctgctgctgctggccaacagcaccgaggagcagcagaagtgggtgagcagactggtgaagaagatccccaagaagccccccgcccccgaccccttcgccagaagcagccccagaaccagcatgaagatccagcagaaccagagcatcagaagacccagcagacagctggcccccaacaagcccagctag

SEQ ID NO: 97228 - DNA, 3438 bp, Artificial Sequence
  Description of Artificial Sequence: Synthetic coding sequence
atggtgcactgcgacaccgccgtgggcacccccgactacatcagccccgaggtgctgaagagccagggcggcgacggcttctacggcagagagtgcgactggtggagcgtgggcgtgttcctgtacgagatgctggtgggcgacacccccttctacgccgacagcctggtgggcacctacagcaagatcatggaccacaagaacagcctgtgcttccccgaggacgccgagatcagcaagcacgccaagaacctgatctgcgccttcctgaccgacagagaggtgagactgggcagaaacggcgtggaggagatcagacagcaccccttcttcaagaacgaccagtggcactgggacaacatcagagagaccgccgcccccgtggtgcccgagctgagcagcgacatcgacagcagcaacttcgacgacatcgaggacgacaagggcgacgtggagaccttccccatccccaaggccttcgtgggcaaccagctgcccttcatcggcttcacctactacagagagaacctgctgctgagcgacagccccagctgcagagagaccgacagcatccagagcagaaagaacgaggagagccaggagatccagaagaagctgtacaccctggaggagcacctgagcaacgagatgcaggccaaggaggagctggagcagaagtgcaagagcgtgaacaccagactggagaagaccgccaaggagctggaggaggagatcaccctgagaaagagcgtggagagcgccctgagacagctggagagagagaaggccctgctgcagcacaagaacgccgagtaccagagaaaggccgaccacgaggccgacaagaagagaaacctggagaacgacgtgaacagcctgaaggaccagctggaggacctgaagaagagaaaccagaacagccagatcagcaccgagaaggtgaaccagctgcagagacagctggacgagaccaacgccctgctgagaaccgagagcgacaccgccgccagactgagaaagacccaggccgagagcagcaagcagatccagcagctggagagcaacaacagagacctgcaggacaagaactgcctgctggagaccgccaagctgaagctggagaaggagttcatcaacctgcagagcgccctggagagcgagagaagagacagaacccacggcagcgagatcatcaacgacctgcagggcagaatctgcggcctggaggaggacctgaagaacggcaagatcctgctggccaaggtggagctggagaagagacagctgcaggagagattcaccgacctggagaaggagaagagcaacatggagatcgacatgacctaccagctgaaggtgatccagcagagcctggagcaggaggaggccgagcacaaggccaccaaggccagactggccgacaagaacaagatctacgagagcatcgaggaggccaagagcgaggccatgaaggagatggagaagaagctgctggaggagagaaccctgaagcagaaggtggagaacctgctgctggaggccgagaagagatgcagcctgctggactgcgacctgaagcagagccagcagaagatcaacgagctgctgaagcagaaggacgtgctgaacgaggacgtgagaaacctgaccctgaagatcgagcaggagacccagaagagatgcctgacccagaacgacctgaagatgcagacccagcaggtgaacaccctgaagatgagcgagaagcagctgaagcaggagaacaaccacctgatggagatgaagatgaacctggagaagcagaacgccgagctgagaaaggagagacaggacgccgacggccagatgaaggagctgcaggaccagctggaggccgagcagtacttcagcaccctgtacaagacccaggtgagagagctgaaggaggagtgcgaggagaagaccaagctgggcaaggagctgcagcagaagaagcaggagctgcaggacgagagagacagcctggccgcccagctggagatcaccctgaccaaggccgacagcgagcagctggccagaagcatcgccgaggagcagtacagcgacctggagaaggagaagatcatgaaggagctggagatcaaggagatgatggccagacacaagcaggagctgaccgagaaggacgccaccatcgccagcctggaggagaccaacagaaccctgaccagcgacgtggccaacctggccaacgagaaggaggagctgaacaacaagctgaaggacgtgcaggagcagctgagcagactgaaggacgaggagatcagcgccgccgccatcaaggcccagttcgagaagcagctgctgaccgagagaaccctgaagacccaggccgtgaacaagctggccgagatcatgaacagaaaggagcccgtgaagagaggcaacgacaccgacgtgagaagaaaggagaaggagaacagaaagctgcacatggagctgaagagcgagagagagaagctgacccagcagatgatcaagtaccagaaggagctgaacgagatgcaggcccagatcgccgaggagagccagatcagaatcgagctgcagatgaccctggacagcaaggacagcgacatcgagcagctgagaagccagctgcaggccctgcacatcggcctggacagcagcagcatcggcagcggccccggcgacgccgaggccgacgacggcttccccgagagcagactggagggctggctgagcctgcccgtgagaaacaacaccaagaagttcggctgggtgaagaagtacgtgatcgtgagcagcaagaagatcctgttctacgacagcgagcaggacaaggagcagagcaacccctacatggtgctggacatcgacaagctgttccacgtgagacccgtgacccagaccgacgtgtacagagccgacgccaaggagatccccagaatcttccagatcctgtacgccaacgagggcgagagcaagaaggagcaggagttccccgtggagcccgtgggcgagaagagcaactacatctgccacaagggccacgagttcatccccaccctgtaccacttccccaccaactgcgaggcctgcatgaagcccctgtggcacatgttcaagcccccccccgccctggagtgcagaagatgccacatcaagtgccacaaggaccacatggacaagaaggaggagatcatcgccccctgcaaggtgtactacgacatcagcaccgccaagaacctgctgctgctggccaacagcaccgaggagcagcagaagtgggtgagcagactggtgaagaagatccccaagaagccccccgcccccgaccccttcgccagaagcagccccagaaccagcatgaagatccagcagaaccagagcatcagaagacccagcagacagctggcccccaacaagcccagctag

SEQ ID NO: 97229 - DNA, 2568 bp, Artificial Sequence
  Description of Artificial Sequence: Synthetic coding sequence
atgagcgaggccagaagagacagcaccagcagcctgcagagaaagaagcccccctggctgaagctggacatccccagcgccgtgcccctgaccgccgaggagcccagcttcctgcagcccctgagaagacaggccttcctgagaagcgtgagcatgcccgccgagaccgcccacatcagcagcccccaccacgagctgagaagacccgtgctgcagagacagaccagcatcacccagaccatcagaagaggcaccgccgactggttcggcgtgagcaaggacagcgacagcacccagaagtggcagagaaagagcatcagacactgcagccagagatacggcaagctgaagccccaggtgctgagagagctggacctgcccagccaggacaacgtgagcctgaccagcaccgagacccccccccccctgtacgtgggcccctgccagctgggcatgcagaagatcatcgaccccctggccagaggcagagccttcagagtggccgacgacaccgccgagggcctgagcgccccccacacccccgtgacccccggcgccgccagcctgtgcagcttcagcagcagcagaagcggcttccacagactgcccagaagaagaaagagagagagcgtggccaagatgagcttcagagccgccgccgccctgatgaagggcagaagcgtgagagacggcaccttcagaagagcccagagaagaagcttcacccccgccagcttcctggaggaggacaccaccgacttccccgacgagctggacaccagcttcttcgccagagagggcatcctgcacgaggagctgagcacctaccccgacgaggtgttcgagagccccagcgaggccgccctgaaggactgggagaaggcccccgagcaggccgacctgaccggcggcgccctggacagaagcgagctggagagaagccacctgatgctgcccctggagagaggctggagaaagcagaaggagggcgccgccgccccccagcccaaggtgagactgagacaggaggtggtgagcaccgccggccccagaagaggccagagaatcgccgtgcccgtgagaaagctgttcgccagagagaagagaccctacggcctgggcatggtgggcagactgaccaacagaacctacagaaagagaatcgacagcttcgtgaagagacagatcgaggacatggacgaccacagacccttcttcacctactggctgaccttcgtgcacagcctggtgaccatcctggccgtgtgcatctacggcatcgcccccgtgggcttcagccagcacgagaccgtggacagcgtgctgagaaacagaggcgtgtacgagaacgtgaagtacgtgcagcaggagaacttctggatcggccccagcagcgaggccctgatccacctgggcgccaagttcagcccctgcatgagacaggacccccaggtgcacagcttcatcagaagcgccagagagagagagaagcacagcgcctgctgcgtgagaaacgacagaagcggctgcgtgcagaccagcgaggaggagtgcagcagcaccctggccgtgtgggtgaagtggcccatccaccccagcgcccccgagctggccggccacaagagacagttcggcagcgtgtgccaccaggaccccagagtgtgcgacgagcccagcagcgaggacccccacgagtggcccgaggacatcaccaagtggcccatctgcaccaagaacagcgccggcaaccacaccaaccacccccacatggactgcgtgatcaccggcagaccctgctgcatcggcaccaagggcagatgcgagatcaccagcagagagtactgcgacttcatgagaggctacttccacgaggaggccaccctgtgcagccaggtgcactgcatggacgacgtgtgcggcctgctgcccttcctgaaccccgaggtgcccgaccagttctacagactgtggctgagcctgttcctgcacgccggcatcctgcactgcctggtgagcatctgcttccagatgaccgtgctgagagacctggagaagctggccggctggcacagaatcgccatcatctacctgctgagcggcgtgaccggcaacctggccagcgccatcttcctgccctacagagccgaggtgggccccgccggcagccagttcggcatcctggcctgcctgttcgtggagctgttccagagctggcagatcctggccagaccctggagagccttcttcaagctgctggccgtggtgctgttcctgttcaccttcggcctgctgccctggatcgacaacttcgcccacatcagcggcttcatcagcggcctgttcctgagcttcgccttcctgccctacatcagcttcggcaagttcgacctgtacagaaagagatgccagatcatcatcttccaggtggtgttcctgggcctgctggccggcctggtggtgctgttctacgtgtaccccgtgagatgcgagtggtgcgagttcctgacctgcatccccttcaccgacaagttctgcgagaagtacgagctggacgcccagctgcactag

SEQ ID NO: 97230 - DNA, 573 bp, Artificial Sequence
  Description of Artificial Sequence: Synthetic coding sequence
atgagcgaggccagaagagacagcaccagcagcctgcagagaaagaagcccccctggctgaagctggacatccccagcgccgtgcccctgaccgccgaggagcccagcttcctgcagcccctgagaagacaggccttcctgagaagcgtgagcatgcccgccgagaccgcccacatcagcagcccccaccacgagctgagaagacccgtgctgcagagacagaccagcatcacccagaccatcagaagcagcagacaggtgagattcggcagagtgcacaccctgcccctgctgggccccagagccgccagaagagccttcccccagagacagagcctgagctggagcctgctgagaggcaccgccgactggttcggcgtgagcaaggacagcgacagcacccagaagtggcagagaaagagcatcagacactgcagccagagatacggcaagctgaagccccaggtgctgagagagctggacctgcccagccaggacaacgtgagcctgaccagcaccgagacccccccccccctgtacgtgggcccctgccagctgggcatgcagaagtag

SEQ ID NO: 97231 - DNA, 699 bp, Artificial Sequence
  Description of Artificial Sequence: Synthetic coding sequence
tgaagaccctgctgcatcggcaccaagggcagatgcgagatcaccagcagagagtactgcgacttcatgagaggctacttccacgaggaggccaccctgtgcagccaggtgcactgcatggacgacgtgtgcggcctgctgcccttcctgaaccccgagatgaccgtgctgagagacctggagaagctggccggctggcacagaatcgccatcatctacctgctgagcggcgtgaccggcaacctggccagcgccatcttcctgccctacagagccgaggtgggccccgccggcagccagttcggcatcctggcctgcctgttcgtggagctgttccagagctggcagatcctggccagaccctggagagccttcttcaagctgctggccgtggtgctgttcctgttcaccttcggcctgctgccctggatcgacaacttcgcccacatcagcggcttcatcagcggcctgttcctgagcttcgccttcctgccctacatcagcttcggcaagttcgacctgtacagaaagagatgccagatcatcatcttccaggtggtgttcctgggcctgctggccggcctggtggtgctgttctacgtgtaccccgtgagatgcgagtggtgcgagttcctgacctgcatccccttcaccgacaagttctgcgagaagtacgagctggacgcccagctgcactag

SEQ ID NO: 97232 - DNA, 492 bp, Artificial Sequence
  Description of Artificial Sequence: Synthetic coding sequence
atgagcgaggccagaagagacagcaccagcagcctgcagagaaagaagcccccctggctgaagctggacatccccagcgccgtgcccctgaccgccgaggagcccagcttcctgcagcccctgagaagacaggccttcctgagaagcgtgagcatgcccgccgagaccgcccacatcagcagcccccaccacgagctgagaagacccgtgctgcagagacagaccagcatcacccagaccatcagaagaggcaccgccgactggttcggcgtgagcaaggacagcgacagcacccagaagtggcagagaaagagcatcagacactgcagccagagatacggcaagctgaagccccaggtgctgagagagctggacctgcccagccaggacaacgtgagcctgaccagcaccgagacccccccccccctgtacgtgggcccctgccagctgggcatgcagaagatcatcgaccccctggccagaggcagatag

SEQ ID NO: 97233 - DNA, 1740 bp, Artificial Sequence
  Description of Artificial Sequence: Synthetic coding sequence
atgagcgaggccagaagagacagcaccagcagcctgcagagaaagaagcccccctggctgaagctggacatccccagcgccgtgcccctgaccgccgaggagcccagcttcctgcagcccctgagaagacaggccttcctgagaagcgtgagcatgcccgccgagaccgcccacatcagcagcccccaccacgagctgagaagacccgtgctgcagagacagaccagcatcacccagaccatcagaagaggcaccgccgactggttcggcgtgagcaaggacagcgacagcacccagaagtggcagagaaagagcatcagacactgcagccagagatacggcaagctgaagccccaggtgctgagagagctggacctgcccagccaggacaacgtgagcctgaccagcaccgagacccccccccccctgtacgtgggcccctgccagctgggcatgcagaagatcatcgaccccctggccagaggcagagccttcagagtggccgacgacaccgccgagggcctgagcgccccccacacccccgtgacccccggcgccgccagcctgtgcagcttcagcagcagcagaagcggcttccacagactgcccagaagaagaaagagagagagcgtggccaagatgagcttcagagccgccgccgccctgatgaagggcagaagcgtgagagacggcaccttcagaagagcccagagaagaagcttcacccccgccagcttcctggaggaggacaccaccgacttccccgacgagctggacaccagcttcttcgccagagagggcatcctgcacgaggagctgagcacctaccccgacgaggtgttcgagagccccagcgaggccgccctgaaggactgggagaaggcccccgagcaggccgacctgaccggcggcgccctggacagaagcgagctggagagaagccacctgatgctgcccctggagagaggctggagaaagcagaaggagggcgccgccgccccccagcccaaggtgagactgagacaggaggtggtgagcaccgccggccccagaagaggccagagaatcgccgtgcccgtgagaaagctgttcgccagagagaagagaccctacggcctgggcatggtgggcagactgaccaacagaacctacagaaagagaatcgacagcttcgtgaagagacagatcgaggacatggacgaccacagacccttcttcacctactggctgaccttcgtgcacagcctggtgaccatcctggccgtgtgcatctacggcatcgcccccgtgggcttcagccagcacgagaccgtggacagcgtgctgagaaacagaggcgtgtacgagaacgtgaagtacgtgcagcaggagaacttctggatcggccccagcagcgtgagaaccggcctgggcgccggccccgccggcgccggccccggcggcgccagaagaggccaggaggcccccgactgcggcagaagcagccccagccccgccggcggcccccacccccccggcagacaggtgttcgccctgcacgcccccggccccgccggcgcccagctgcacagcctgggcgccagagccagagaggccctgagactgctgagagcccagagacaggtgggcctgagagccgacctgggcggcggcgtgctgggcgccttccccagacccggcctgccccccagcagcgccagatgcagcctgttcagaccccagatcgacagcgccgagtag

SEQ ID NO: 97234 - DNA, 2571 bp, Artificial Sequence
  Description of Artificial Sequence: Synthetic coding sequence
atggccagcgccgacaagaacggcggcagcgtgagcagcgtgagcagcagcagactgcagagcagaaagccccccaacctgagcatcaccatccccccccccgagaaggagacccaggcccccggcgagcaggacagcatgctgcccgagggcttccagaacagaagactgaagaagagccagcccagaacctgggccgcccacaccaccgcctgcccccccagcttcctgcccaagagaaagaaccccgcctacctgaagagcgtgagcctgcaggagcccagaagcagatggcaggagagcagcgagaagagacccggcttcagaagacaggccagcctgagccagagcatcagaaagggcgccgcccagtggttcggcgtgagcggcgactgggagggccagagacagcagtggcagagaagaagcctgcaccactgcagcatgagatacggcagactgaaggccagctgccagagagacctggagctgcccagccaggaggcccccagcttccagggcaccgagagccccaagccctgcaagatgcccaagatcgtggaccccctggccagaggcagagccttcagacaccccgaggagatggacagaccccacgccccccacccccccctgacccccggcgtgctgagcctgaccagcttcaccagcgtgagaagcggctacagccacctgcccagaagaaagagaatgagcgtggcccacatgagcctgcaggccgccgccgccctgctgaagggcagaagcgtgctggacgccaccggccagagatgcagagtggtgaagagaagcttcgccttccccagcttcctggaggaggacgtggtggacggcgccgacaccttcgacagcagcttcttcagcaaggaggagatgagcagcatgcccgacgacgtgttcgagagcccccccctgagcgccagctacttcagaggcatcccccacagcgccagccccgtgagccccgacggcgtgcagatccccctgaaggagtacggcagagcccccgtgcccggccccagaagaggcaagagaatcgccagcaaggtgaagcacttcgccttcgacagaaagaagagacactacggcctgggcgtggtgggcaactggctgaacagaagctacagaagaagcatcagcagcaccgtgcagagacagctggagagcttcgacagccacagaccctacttcacctactggctgaccttcgtgcacgtgatcatcaccctgctggtgatctgcacctacggcatcgcccccgtgggcttcgcccagcacgtgaccacccagctggtgctgagaaacaagggcgtgtacgagagcgtgaagtacatccagcaggagaacttctgggtgggccccagcagcatcgacctgatccacctgggcgccaagttcagcccctgcatcagaaaggacggccagatcgagcagctggtgctgagagagagagacctggagagagacagcggctgctgcgtgcagaacgaccacagcggctgcatccagacccagagaaaggactgcagcgagaccctggccaccttcgtgaagtggcaggacgacaccggcccccccatggacaagagcgacctgggccagaagagaaccagcggcgccgtgtgccaccaggaccccagaacctgcgaggagcccgccagcagcggcgcccacatctggcccgacgacatcaccaagtggcccatctgcaccgagcaggccagaagcaaccacaccggcttcctgcacatggactgcgagatcaagggcagaccctgctgcatcggcaccaagggcagctgcgagatcaccaccagagagtactgcgagttcatgcacggctacttccacgaggaggccaccctgtgcagccaggtgcactgcctggacaaggtgtgcggcctgctgcccttcctgaaccccgaggtgcccgaccagttctacagactgtggctgagcctgttcctgcacgccggcgtggtgcactgcctggtgagcgtggtgttccagatgaccatcctgagagacctggagaagctggccggctggcacagaatcgccatcatcttcatcctgagcggcatcaccggcaacctggccagcgccatcttcctgccctacagagccgaggtgggccccgccggcagccagttcggcctgctggcctgcctgttcgtggagctgttccagagctggcccctgctggagagaccctggaaggccttcctgaacctgagcgccatcgtgctgttcctgttcatctgcggcctgctgccctggatcgacaacatcgcccacatcttcggcttcctgagcggcctgctgctggccttcgccttcctgccctacatcaccttcggcaccagcgacaagtacagaaagagagccctgatcctggtgagcctgctggccttcgccggcctgttcgccgccctggtgctgtggctgtacatctaccccatcaactggccctggatcgagcacctgacctgcttccccttcaccagcagattctgcgagaagtacgagctggaccaggtgctgcactag

SEQ ID NO: 97235 - DNA, 2484 bp, Artificial Sequence
  Description of Artificial Sequence: Synthetic coding sequence
atggccagcgccgacaagaacggcggcagcgtgagcagcgtgagcagcagcagactgcagagcagaaagccccccaacctgagcatcaccatccccccccccgagaaggagacccaggcccccggcgagcaggacagcatgctgcccgagagaaagaaccccgcctacctgaagagcgtgagcctgcaggagcccagaagcagatggcaggagagcagcgagaagagacccggcttcagaagacaggccagcctgagccagagcatcagaaagggcgccgcccagtggttcggcgtgagcggcgactgggagggccagagacagcagtggcagagaagaagcctgcaccactgcagcatgagatacggcagactgaaggccagctgccagagagacctggagctgcccagccaggaggcccccagcttccagggcaccgagagccccaagccctgcaagatgcccaagatcgtggaccccctggccagaggcagagccttcagacaccccgaggagatggacagaccccacgccccccacccccccctgacccccggcgtgctgagcctgaccagcttcaccagcgtgagaagcggctacagccacctgcccagaagaaagagaatgagcgtggcccacatgagcctgcaggccgccgccgccctgctgaagggcagaagcgtgctggacgccaccggccagagatgcagagtggtgaagagaagcttcgccttccccagcttcctggaggaggacgtggtggacggcgccgacaccttcgacagcagcttcttcagcaaggaggagatgagcagcatgcccgacgacgtgttcgagagcccccccctgagcgccagctacttcagaggcatcccccacagcgccagccccgtgagccccgacggcgtgcagatccccctgaaggagtacggcagagcccccgtgcccggccccagaagaggcaagagaatcgccagcaaggtgaagcacttcgccttcgacagaaagaagagacactacggcctgggcgtggtgggcaactggctgaacagaagctacagaagaagcatcagcagcaccgtgcagagacagctggagagcttcgacagccacagaccctacttcacctactggctgaccttcgtgcacgtgatcatcaccctgctggtgatctgcacctacggcatcgcccccgtgggcttcgcccagcacgtgaccacccagctggtgctgagaaacaagggcgtgtacgagagcgtgaagtacatccagcaggagaacttctgggtgggccccagcagcatcgacctgatccacctgggcgccaagttcagcccctgcatcagaaaggacggccagatcgagcagctggtgctgagagagagagacctggagagagacagcggctgctgcgtgcagaacgaccacagcggctgcatccagacccagagaaaggactgcagcgagaccctggccaccttcgtgaagtggcaggacgacaccggcccccccatggacaagagcgacctgggccagaagagaaccagcggcgccgtgtgccaccaggaccccagaacctgcgaggagcccgccagcagcggcgcccacatctggcccgacgacatcaccaagtggcccatctgcaccgagcaggccagaagcaaccacaccggcttcctgcacatggactgcgagatcaagggcagaccctgctgcatcggcaccaagggcagctgcgagatcaccaccagagagtactgcgagttcatgcacggctacttccacgaggaggccaccctgtgcagccaggtgcactgcctggacaaggtgtgcggcctgctgcccttcctgaaccccgaggtgcccgaccagttctacagactgtggctgagcctgttcctgcacgccggcgtggtgcactgcctggtgagcgtggtgttccagatgaccatcctgagagacctggagaagctggccggctggcacagaatcgccatcatcttcatcctgagcggcatcaccggcaacctggccagcgccatcttcctgccctacagagccgaggtgggccccgccggcagccagttcggcctgctggcctgcctgttcgtggagctgttccagagctggcccctgctggagagaccctggaaggccttcctgaacctgagcgccatcgtgctgttcctgttcatctgcggcctgctgccctggatcgacaacatcgcccacatcttcggcttcctgagcggcctgctgctggccttcgccttcctgccctacatcaccttcggcaccagcgacaagtacagaaagagagccctgatcctggtgagcctgctggccttcgccggcctgttcgccgccctggtgctgtggctgtacatctaccccatcaactggccctggatcgagcacctgacctgcttccccttcaccagcagattctgcgagaagtacgagctggaccaggtgctgcactag

SEQ ID NO: 97236 - DNA, 2151 bp, Artificial Sequence
  Description of Artificial Sequence: Synthetic coding sequence
cccggcagcagcagaagcagacaccccctgctgctgctgatctggagcctgggcagcagccagggcccccacagacagatcagacccccccccccctgcagacacgccggcacccacgtgcccagccccctgccccacacccaggtgcacagaagaagacaggcctacgcccacctgagcctggtgtgcttcagaagaggcgccgcccagtggttcggcgtgagcggcgactgggagggccagagacagcagtggcagagaagaagcctgcaccactgcagcatgagatacggcagactgaaggccagctgccagagagacctggagctgcccagccaggaggcccccagcttccagggcaccgagagccccaagccctgcaagatgcccaagatcgtggaccccctggccagaggcagagccttcagacaccccgaggagatggacagaccccacgccccccacccccccctgacccccggcgtgctgagcctgaccagcttcaccagcgtgagaagcggctacagccacctgcccagaagaaagagaatgagcgtggcccacatgagcctgcaggccgccgccgccctgctgaagggcagaagcgtgctggacgccaccggccagagatgcagagtggtgaagagaagcttcgccttccccagcttcctggaggaggacgtggtggacggcgccgacaccttcgacagcagcttcttcagcaaggaggagatgagcagcatgcccgacgacgtgttcgagagcccccccctgagcgccagctacttcagaggcatcccccacagcgccagccccgtgagccccgacggcgtgcagatccccctgaaggagtacggcagagcccccgtgcccggccccagaagaggcaagagaatcgccagcaaggtgaagcacttcgccttcgacagaaagaagagacactacggcctgggcgtggtgggcaactggctgaacagaagctacagaagaagcatcagcagcaccgtgcagagacagctggagagcttcgacagccacagaccctacttcacctactggctgaccttcgtgcacgtgatcatcaccctgctggtgatctgcacctacggcatcgcccccgtgggcttcgcccagcacgtgaccacccagctggtgctgagaaacaagggcgtgtacgagagcgtgaagtacatccagcaggagaacttctgggtgggccccagcagcatcgacctgatccacctgggcgccaagttcagcccctgcatcagaaaggacggccagatcgagcagctggtgctgagagagagagacctggagagagacagcggctgctgcgtgcagaacgaccacagcggctgcatccagacccagagaaaggactgcagcgagaccctggccaccttcgtgaagtggcaggacgacaccggcccccccatggacaagagcgacctgggccagaagagaaccagcggcgccgtgtgccaccaggaccccagaacctgcgaggagcccgccagcagcggcgcccacatctggcccgacgacatcaccaagtggcccatctgcaccgagcaggccagaagcaaccacaccggcttcctgcacatggactgcgagatcaagggcagaccctgctgcatcggcaccaagggcagctgcgagatcaccaccagagagtactgcgagttcatgcacggctacttccacgaggaggccaccctgtgcagccaggtgcactgcctggacaaggtgtgcggcctgctgcccttcctgaaccccgaggtgcccgaccagttctacagactgtggctgagcctgttcctgcacgccggcgtggtgcactgcctggtgagcgtggtgttccagatgaccatcctgagagacctggagaagctggccggctggcacagaatcgccatcatcttcatcctgagcggcatcaccggcaacctggccagcgccatcttcctgccctacagagccgaggtgagaatgtggagaatgggccccctgccccacatcggcggccagccctgctgcagctacagcacccacctgggcagcgccagaggcaccagatgccccagctgcaccggcctgcacagcggcggcaccgccaacctgggcgcctactggctggtgagctag

SEQ ID NO: 97237 - DNA, 639 bp, Artificial Sequence
  Description of Artificial Sequence: Synthetic coding sequence
atggcccagaccgacaagcccacctgcatcccccccgagctgcccaagatgctgaaggagttcgccaaggccgccatcagagtgcagccccaggacctgatccagtgggccgccgactacttcgaggccctgagcagaggcgagaccccccccgtgagagagagaagcgagagagtggccctgtgcaacagagccgagctgacccccgagctgctgaagatcctgcacagccaggtggccggcagactgatcatcagagccgaggagctggcccagatgtggaaggtggtgaacctgcccaccgacctgttcaacagcgtgatgaacgtgggcagattcaccgaggagatcgagtggctgaagttcctggccctggcctgcagcgccctgggcgtgaccatcaccaagaccctgaagatcgtgtgcgaggtgctgagctgcgaccacaacggcggcagccccagaatccccttcagcaccttccagttcctgtacacctacatcgccaaggtggacggcgagatcagcgccagccacgtgagcagaatgctgaactacatggagcaggaggtgatcggccccgacggcatcatcaccgtgaacgacttcacccagaaccccagagtgcagctggagtag

SEQ ID NO: 97238 - DNA, 639 bp, Artificial Sequence; identical to SEQ ID NO: 97237
  Description of Artificial Sequence: Synthetic coding sequence

SEQ ID NO: 97239 - DNA, 351 bp, Artificial Sequence
  Description of Artificial Sequence: Synthetic coding sequence
atggcccagaccgacaagcccacctgcatcccccccgagctgcccaagatgctgaaggagttcgccaaggccgccatcagagtgcagccccaggacctgatccagtgggccgccgactacttcgaggccctgagcagaggcgagaccccccccgtgagagagagaagcgagagagtggccctgtgcaacagagccgagctgacccccgagctgctgaagatcctgcacagccaggtggccggcagactgatcatcagagccgaggagctggcccagatgtggaaggtggtgaacctgcccaccgacctgttcaacagcgtgatgaacgtgggcagattcaccgaggagtag

SEQ ID NO: 97240 - DNA, 393 bp, Artificial Sequence
  Description of Artificial Sequence: Synthetic coding sequence
atggcccagaccgacaagcccacctgcatcccccccgagctgcccaagatgctgaaggagttcgccaaggccgccatcagagtgcagccccaggacctgatccagtgggccgccgactacttcgaggccctgagcagaggcgagaccccccccgtgagagagagaagcgagagagtggccctgtgcaacagagccgagctgacccccgagctgctgaagatcctgcacagccaggtggccggcagactgatcatcagagccgaggagctggcccagatgtggaaggtggtgaacctgcccaccgacctgttcaacagcgtgatgaacgtgggcagattcaccgaggagatcgagtggctgaagttcctggccctggcctgcagcgccctgtag

SEQ ID NO: 97241 - DNA, 312 bp, Artificial Sequence
  Description of Artificial Sequence: Synthetic coding sequence
atggcccagaccgacaagcccacctgcatcccccccgagctgcccaagatgctgaaggagttcgccaaggccgccatcagagtgcagccccaggacctgatccagtgggccgccgactacttcgaggccctgagcagaggcgagaccccccccgtgagagagagaagcgagagagtggccctgtgcaacagagccgagctgacccccgagctgctgaagatcctgcacagccaggtggccggcagactgatcatcagagccgaggagctggcccagatgtggaaggtggtgaacctgcccaccgacctgtag

SEQ ID NO: 97242 - DNA, 234 bp, Artificial Sequence
  Description of Artificial Sequence: Synthetic coding sequence
atggcccagaccgacaagcccacctgcatcccccccgagctgcccaagatgctgaaggagttcgccaaggccgccatcagagtgcagccccaggacctgatccagtgggccgccgactacttcgaggccctgagcagaggcgagaccccccccgtgagagagagaagcgagagagtggccctgtgcaacagagccgagctgacccccgagctgctgaagatcctgcacagctag

SEQ ID NO: 97243 - DNA, 693 bp, Artificial Sequence
  Description of Artificial Sequence: Synthetic coding sequence
atgcccctgcccgacaccatgttctgcgcccagcagatccacatcccccccgagctgcccgacatcctgaagcagttcaccaaggccgccatcagaacccagcccgccgacgtgctgagatggagcgccggctacttcagcgccctgagcagaggcgaccccctgcccgtgaaggacagaatggagatgcccaccgccacccagaagaccgacaccggcctgacccagggcctgctgaaggtgctgcacaagcagtgccaccacaagagatacgtggagctgaccgacctggagcagaagtggaagaacctgtgcctgcccaaggagaagttcaaggccctgctgcagctggacccctgcgagaacaagatcaagtggatcaacttcctggccctgggctgcagcatgctgggcggcagcctgaacaccgccctgaagcacctgtgcgagatcctgaccgacgaccccgagggcggccccgccagaatccccttcaagaccttcagctacgtgtacagatacctggccagactggacagcgacgtgagccccctggagaccgagagctacctggccagcctgaaggagaacatcgacgccagaaagaacggcatgatcggcctgagcgacttcttcttccccaagagaaagctgctggagagcatcgagaacagcgaggacgtgggccactag

SEQ ID NO: 97244 - DNA, 693 bp, Artificial Sequence; identical to SEQ ID NO: 97243
  Description of Artificial Sequence: Synthetic coding sequence

SEQ ID NO: 97245 - DNA, 2091 bp, Artificial Sequence
  Description of Artificial Sequence: Synthetic coding sequence
atggacgccgacatggactacgagagacccaacgtggagaccatcaagtgcgtggtggtgggcgacaacgccgtgggcaagaccagactgatctgcgccagagcctgcaacaccaccctgacccagtaccagctgctggccacccacgtgcccaccgtgtgggccatcgaccagtacagagtgtgccaggaggtgctggagagaagcagagacgtggtggacgaggtgagcgtgagcctgagactgtgggacaccttcggcgaccaccacaaggacagaagattcgcctacggcagaagcgacgtggtggtgctgtgcttcagcatcgccaaccccaacagcctgaaccacgtgaagagcatgtggtaccccgagatcaagcacttctgccccagaacccccgtgatcctggtgggctgccagctggacctgagatacgccgacctggaggccgtgaacagagccagaagacccctggccagacccatcaagagaggcgacatcctgccccccgagaagggcagagaggtggccaaggagctgggcctgccctactacgagaccagcgtgttcgaccagttcggcatcaaggacgtgttcgacaacgccatcagagccgccctgatcagcagaagacacctgcagttctggaagagccacctgaagaaggtgcagaagcccctgctgcaggcccccttcctgccccccaaggcccccccccccgtgatcaagatccccgagtgccccagcatgggcaccaacgaggccgcctgcctgctggacaaccccctgtgcgccgacgtgctgttcatcctgcaggaccaggagcacatcttcgcccacagaatctacctggccaccagcagcagcaagttctacgacctgttcctgatggagtgcgaggagagccccaacggcagcgagggcgcctgcgagaaggagaagcagagcagagacttccagggcagaatcctgagcgtggaccccgaggaggagagagaggagggcccccccagaatcccccaggccgaccagtggaagagcagcaacaagagcctggtggaggccctgggcctggaggccgagggcgccgtgcccgagacccagaccctgaccggctggagcaagggcttcatcggcatgcacagagagatgcaggtgaaccccatcagcaagagaatgggccccatgaccgtggtgagaatggacgccagcgtgcagcccggccccttcagaaccctgctgcagttcctgtacaccggccagctggacgagaaggagaaggacctggtgggcctggcccagatcgccgaggtgctggagatgttcgacctgagaatgatggtggagaacatcatgaacaaggaggccttcatgaaccaggagatcaccaaggccttccacgtgagaaaggccaacagaatcaaggagtgcctgagcaagggcaccttcagcgacgtgaccttcaagctggacgacggcgccatcagcgcccacaagcccctgctgatctgcagctgcgagtggatggccgccatgttcggcggcagcttcgtggagagcgccaacagcgaggtgtacctgcccaacatcaacaagatcagcatgcaggccgtgctggactacctgtacaccaagcagctgagccccaacctggacctggaccccctggagctgatcgccctggccaacagattctgcctgccccacctggtggccctggccgagcagcacgccgtgcaggagctgaccaaggccgccaccagcggcgtgggcatcgacggcgaggtgctgagctacctggagctggcccagttccacaacgcccaccagctggccgcctggtgcctgcaccacatctgcaccaactacaacagcgtgtgcagcaagttcagaaaggagatcaagagcaagagcgccgacaaccaggagtacttcgagagacacagatggccccccgtgtggtacctgaaggaggaggaccactaccagagagtgaagagagagagagagaaggaggacatcgccctgaacaagcacagaagcagaagaaagtggtgcttctggaacagcagccccgccgtggcctag

SEQ ID NO: 97246 - DNA, 2091 bp, Artificial Sequence; identical to SEQ ID NO: 97245
  Description of Artificial Sequence: Synthetic coding sequence

SEQ ID NO: 97247 - DNA, 300 bp, Artificial Sequence
  Description of Artificial Sequence: Synthetic coding sequence
atggacgccgacatggactacgagagacccaacgtggagaccatcaagtgcgtggtggtgggcgacaacgccgtgggcaagaccagactgatctgcgccagagcctgcaacaccaccctgacccagtaccagctgctggccacccacgtgcccaccgtgtgggccatcgaccagtacagagtgtgccaggaggtgctggagagaagcagagacgtggtggacgaggtgagcgtgagcctgagactgtgggacaccttcggcgaccaccacaaggacagaagattcgcctacggcagatag

SEQ ID NO: 97248 - DNA, 2184 bp, Artificial Sequence
  Description of Artificial Sequence: Synthetic coding sequence
atggacagcgacatggactacgagagacccaacgtggagaccatcaagtgcgtggtggtgggcgacaacgccgtgggcaagaccagactgatctgcgccagagcctgcaacgccaccctgacccagtaccagctgctggccacccacgtgcccaccgtgtgggccatcgaccagtacagagtgtgccaggaggtgctggagagaagcagagacgtggtggacgacgtgagcgtgagcctgagactgtgggacaccttcggcgaccaccacaaggacagaagattcgcctacggcagaagcgacgtggtggtgctgtgcttcagcatcgccaaccccaacagcctgcaccacgtgaagaccatgtggtaccccgagatcaagcacttctgccccagagcccccgtgatcctggtgggctgccagctggacctgagatacgccgacctggaggccgtgaacagagccagaagacccctggccagacccatcaagcccaacgagatcctgccccccgagaagggcagagaggtggccaaggagctgggcatcccctactacgagaccagcgtggtggcccagttcggcatcaaggacgtgttcgacaacgccatcagagccgccctgatcagcagaagacacctgcagttctggaagagccacctgagaaacgtgcagagacccctgctgcaggcccccttcctgccccccaagccccccccccccatcatcgtggtgcccgacccccccagcagcagcgaggagtgccccgcccacctgctggaggaccccctgtgcgccgacgtgatcctggtgctgcaggagagagtgagaatcttcgcccacaagatctacctgagcaccagcagcagcaagttctacgacctgttcctgatggacctgagcgagggcgagctgggcggccccagcgagcccggcggcacccaccccgaggaccaccagggccacagcgaccagcaccaccaccaccaccaccaccaccacggcagagacttcctgctgagagccgccagcttcgacgtgtgcgagagcgtggacgaggccggcggcagcggccccgccggcctgagagccagcaccagcgacggcatcctgagaggcaacggcaccggctacctgcccggcagaggcagagtgctgagcagctggagcagagccttcgtgagcatccaggaggagatggccgaggaccccctgacctacaagagcagactgatggtggtggtgaagatggacagcagcatccagcccggccccttcagagccgtgctgaagtacctgtacaccggcgagctggacgagaacgagagagacctgatgcacatcgcccacatcgccgagctgctggaggtgttcgacctgagaatgatggtggccaacatcctgaacaacgaggccttcatgaaccaggagatcaccaaggccttccacgtgagaagaaccaacagagtgaaggagtgcctggccaagggcaccttcagcgacgtgaccttcatcctggacgacggcaccatcagcgcccacaagcccctgctgatcagcagctgcgactggatggccgccatgttcggcggccccttcgtggagagcagcaccagagaggtggtgttcccctacaccagcaagagctgcatgagagccgtgctggagtacctgtacaccggcatgttcaccagcagccccgacctggacgacatgaagctgatcatcctggccaacagactgtgcctgccccacctggtggccctgaccgagcagtacaccgtgaccggcctgatggaggccacccagatgatggtggacatcgacggcgacgtgctggtgttcctggagctggcccagttccactgcgcctaccagctggccgactggtgcctgcaccacatctgcaccaactacaacaacgtgtgcagaaagttccccagagacatgaaggccatgagccccgagaaccaggagtacttcgagaagcacagatggccccccgtgtggtacctgaaggaggaggaccactaccagagagccagaaaggagagagagaaggaggactacctgcacctgaagagacagcccaagagaagatggctgttctggaacagccccagcagccccagcagcagcgccgccagcagcagcagccccagcagcagcagcgccgtggtgtag

SEQ ID NO: 97249 - DNA, 2250 bp, Artificial Sequence
  Description of Artificial Sequence: Synthetic coding sequence
atgcaggcctggagaaagggccccgacggcccccagaagaccagcagcgacagcatgagcagactgatggacagcgacatggactacgagagacccaacgtggagaccatcaagtgcgtggtggtgggcgacaacgccgtgggcaagaccagactgatctgcgccagagcctgcaacgccaccctgacccagtaccagctgctggccacccacgtgcccaccgtgtgggccatcgaccagtacagagtgtgccaggaggtgctggagagaagcagagacgtggtggacgacgtgagcgtgagcctgagactgtgggacaccttcggcgaccaccacaaggacagaagattcgcctacggcagaagcgacgtggtggtgctgtgcttcagcatcgccaaccccaacagcctgcaccacgtgaagaccatgtggtaccccgagatcaagcacttctgccccagagcccccgtgatcctggtgggctgccagctggacctgagatacgccgacctggaggccgtgaacagagccagaagacccctggccagacccatcaagcccaacgagatcctgccccccgagaagggcagagaggtggccaaggagctgggcatcccctactacgagaccagcgtggtggcccagttcggcatcaaggacgtgttcgacaacgccatcagagccgccctgatcagcagaagacacctgcagttctggaagagccacctgagaaacgtgcagagacccctgctgcaggcccccttcctgccccccaagccccccccccccatcatcgtggtgcccgacccccccagcagcagcgaggagtgccccgcccacctgctggaggaccccctgtgcgccgacgtgatcctggtgctgcaggagagagtgagaatcttcgcccacaagatctacctgagcaccagcagcagcaagttctacgacctgttcctgatggacctgagcgagggcgagctgggcggccccagcgagcccggcggcacccaccccgaggaccaccagggccacagcgaccagcaccaccaccaccaccaccaccaccacggcagagacttcctgctgagagccgccagcttcgacgtgtgcgagagcgtggacgaggccggcggcagcggccccgccggcctgagagccagcaccagcgacggcatcctgagaggcaacggcaccggctacctgcccggcagaggcagagtgctgagcagctggagcagagccttcgtgagcatccaggaggagatggccgaggaccccctgacctacaagagcagactgatggtggtggtgaagatggacagcagcatccagcccggccccttcagagccgtgctgaagtacctgtacaccggcgagctggacgagaacgagagagacctgatgcacatcgcccacatcgccgagctgctggaggtgttcgacctgagaatgatggtggccaacatcctgaacaacgaggccttcatgaaccaggagatcaccaaggccttccacgtgagaagaaccaacagagtgaaggagtgcctggccaagggcaccttcagcgacgtgaccttcatcctggacgacggcaccatcagcgcccacaagcccctgctgatcagcagctgcgactggatggccgccatgttcggcggccccttcgtggagagcagcaccagagaggtggtgttcccctacaccagcaagagctgcatgagagccgtgctggagtacctgtacaccggcatgttcaccagcagccccgacctggacgacatgaagctgatcatcctggccaacagactgtgcctgccccacctggtggccctgaccgagcagtacaccgtgaccggcctgatggaggccacccagatgatggtggacatcgacggcgacgtgctggtgttcctggagctggcccagttccactgcgcctaccagctggccgactggtgcctgcaccacatctgcaccaactacaacaacgtgtgcagaaagttccccagagacatgaaggccatgagccccgagaaccaggagtacttcgagaagcacagatggccccccgtgtggtacctgaaggaggaggaccactaccagagagccagaaaggagagagagaaggaggactacctgcacctgaagagacagcccaagagaagatggctgttctggaacagccccagcagccccagcagcagcgccgccagcagcagcagccccagcagcagcagcgccgtggtgtag

SEQ ID NO: 97250 - DNA, 2205 bp, Artificial Sequence
  Description of Artificial Sequence: Synthetic coding sequence
atgaaggccagaagcagactgatggacagcgacatggactacgagagacccaacgtggagaccatcaagtgcgtggtggtgggcgacaacgccgtgggcaagaccagactgatctgcgccagagcctgcaacgccaccctgacccagtaccagctgctggccacccacgtgcccaccgtgtgggccatcgaccagtacagagtgtgccaggaggtgctggagagaagcagagacgtggtggacgacgtgagcgtgagcctgagactgtgggacaccttcggcgaccaccacaaggacagaagattcgcctacggcagaagcgacgtggtggtgctgtgcttcagcatcgccaaccccaacagcctgcaccacgtgaagaccatgtggtaccccgagatcaagcacttctgccccagagcccccgtgatcctggtgggctgccagctggacctgagatacgccgacctggaggccgtgaacagagccagaagacccctggccagacccatcaagcccaacgagatcctgccccccgagaagggcagagaggtggccaaggagctgggcatcccctactacgagaccagcgtggtggcccagttcggcatcaaggacgtgttcgacaacgccatcagagccgccctgatcagcagaagacacctgcagttctggaagagccacctgagaaacgtgcagagacccctgctgcaggcccccttcctgccccccaagccccccccccccatcatcgtggtgcccgacccccccagcagcagcgaggagtgccccgcccacctgctggaggaccccctgtgcgccgacgtgatcctggtgctgcaggagagagtgagaatcttcgcccacaagatctacctgagcaccagcagcagcaagttctacgacctgttcctgatggacctgagcgagggcgagctgggcggccccagcgagcccggcggcacccaccccgaggaccaccagggccacagcgaccagcaccaccaccaccaccaccaccaccacggcagagacttcctgctgagagccgccagcttcgacgtgtgcgagagcgtggacgaggccggcggcagcggccccgccggcctgagagccagcaccagcgacggcatcctgagaggcaacggcaccggctacctgcccggcagaggcagagtgctgagcagctggagcagagccttcgtgagcatccaggaggagatggccgaggaccccctgacctacaagagcagactgatggtggtggtgaagatggacagcagcatccagcccggccccttcagagccgtgctgaagtacctgtacaccggcgagctggacgagaacgagagagacctgatgcacatcgcccacatcgccgagctgctggaggtgttcgacctgagaatgatggtggccaacatcctgaacaacgaggccttcatgaaccaggagatcaccaaggccttccacgtgagaagaaccaacagagtgaaggagtgcctggccaagggcaccttcagcgacgtgaccttcatcctggacgacggcaccatcagcgcccacaagcccctgctgatcagcagctgcgactggatggccgccatgttcggcggccccttcgtggagagcagcaccagagaggtggtgttcccctacaccagcaagagctgcatgagagccgtgctggagtacctgtacaccggcatgttcaccagcagccccgacctggacgacatgaagctgatcatcctggccaacagactgtgcctgccccacctggtggccctgaccgagcagtacaccgtgaccggcctgatggaggccacccagatgatggtggacatcgacggcgacgtgctggtgttcctggagctggcccagttccactgcgcctaccagctggccgactggtgcctgcaccacatctgcaccaactacaacaacgtgtgcagaaagttccccagagacatgaaggccatgagccccgagaaccaggagtacttcgagaagcacagatggccccccgtgtggtacctgaaggaggaggaccactaccagagagccagaaaggagagagagaaggaggactacctgcacctgaagagacagcccaagagaagatggctgttctggaacagccccagcagccccagcagcagcgccgccagcagcagcagccccagcagcagcagcgccgtggtgtag

SEQ ID NO: 97251 - DNA, 1836 bp, Artificial Sequence
  Description of Artificial Sequence: Synthetic coding sequence
atgagcatccacatcgtggccctgggcaacgagggcgacaccttccaccaggacaacagacccagcggcctgatcagaacctacctgggcagaagccccctggtgagcggcgacgagagcagcctgctgctgaacgccgccagcaccgtggccagacccgtgttcaccgagtaccaggccagcgccttcggcaacgtgaagctggtggtgcacgactgccccgtgtgggacatcttcgacagcgactggtacaccagcagaaacctgatcggcggcgccgacatcatcgtgatcaagtacaacgtgaacgacaagttcagcttccacgaggtgaaggacaactacatccccgtgatcaagagagccctgaacagcgtgcccgtgatcatcgccgccgtgggcaccagacagaacgaggagctgccctgcacctgccccctgtgcaccagcgacagaggcagctgcgtgagcaccaccgagggcatccagctggccaaggagctgggcgccacctacctggagctgcacagcctggacgacttctacatcggcaagtacttcggcggcgtgctggagtacttcatgatccaggccctgaaccagaagaccagcgagaagatgaagaagagaaagatgagcaacagcttccacggcatcagacccccccagctggagcagcccgagaagatgcccgtgctgaaggccgaggccagccactacaacagcgacctgaacaacctgctgttctgctgccagtgcgtggacgtggtgttctacaaccccaacctgaagaaggtggtggaggcccacaagatcgtgctgtgcgccgtgagccacgtgttcatgctgctgttcaacgtgaagagccccaccgacatccaggacagcagcatcatcagaaccacccaggacctgttcgccatcaacagagacaccgccttccccggcgccagccacgagagcagcggcaacccccccctgagagtgatcgtgaaggacgccctgttctgcagctgcctgagcgacatcctgagattcatctacagcggcgccttccagtgggaggagctggaggaggacatcagaaagaagctgaaggacagcggcgacgtgagcaacgtgatcgagaaggtgaagtgcatcctgaagacccccggcaagatcaactgcctgagaaactgcaagacctaccaggccagaaagcccctgtggttctacaacaccagcctgaagttcttcctgaacaagcccatgctggccgacgtggtgttcgagatccagggcaccaccgtgcccgcccacagagccatcctggtggccagatgcgaggtgatggccgccatgttcaacggcaactacatggaggccaagagcgtgctgatccccgtgtacggcgtgagcaaggagaccttcctgagcttcctggagtacctgtacaccgacagctgctgccccgccggcatcttccaggccatgtgcctgctgatctgcgccgagatgtaccaggtgagcagactgcagcacatctgcgagctgttcatcatcacccagctgcagagcatgcccagcagagagctggccagcatgaacctggacatcgtggacctgctgaagaaggccaagttccaccacagcgactgcctgagcacctggctgctgcacttcatcgccaccaactacctgatcttcagccagaagcccgagttccaggacctgagcgtggaggagagaagcttcgtggagaagcacagatggcccagcaacatgtacctgaagcagctggccgagtacagaaagtacatccacagcagaaagtgcagatgcctggtgatgtag

SEQ ID NO: 97252 - DNA, 354 bp, Artificial Sequence
  Description of Artificial Sequence: Synthetic coding sequence
tgagagatgtaccaggtgagcagactgcagcacatctgcgagctgttcatcatcacccagctgcagagcatgcccagcagagagctggccagcatgaacctggacatcgtggacctgctgaagaaggccaagttccaccacagcgactgcctgagcacctggctgctgcacttcatcgccaccaactacctgatcttcagccagaagcccgagttccaggacctgagcgtggaggagagaagcttcgtggagaagcacagatggcccagcaacatgtacctgaagcagctggccgagtacagaaagtacatccacagcagaaagtgcagatgcctggtgatcaagagacactag

SEQ ID NO: 97253 - DNA, 1692 bp, Artificial Sequence
  Description of Artificial Sequence: Synthetic coding sequence
atgttcagcagaaaccacagaagcagagtgaccgtggccagaggcagcgccctggagatggagttcaagagaggcagattcagactgagcctgttcagcgacctgcccgaggacaccgagctgcagagaaagctggaccacgagatcagaatgagagagggcgcctgcaagctgctggccgcctgcagccagagagagcaggccctggaggccaccaagagcctgctggtgtgcaacagcagaatcctgagctacatgggcgagctgcagagaagaaaggaggcccaggtgctgggcaagaccagcagaagacccagcgacagcggcccccccgccgagagaagcccctgcagaggcagagtgtgcatcagcgacctgagaatccccctgatgtggaaggacaccgagtacttcaagaacaagggcgacctgcacagatgggccgtgttcctgctgctgcagctgggcgagcacatccaggacaccgagatgatcctggtggacagaaccctgaccgacatcagcttccagagcaacgtgctgttcgccgaggccggccccgacttcgagctgagactggagctgtacggcgcctgcgtggaggaggagggcgccctgaccggcggccccaagagactggccaccaagctgagcagcagcctgggcagaagcagcggcagaagagtgagagccagcctggacagcgccggcggcagcggcagcagccccatcctgctgcccacccccgtggtgggcggccccagataccacctgctggcccacaccaccctgaccctggccgccgtgcaggacggcttcagaacccacgacctgaccctggccagccacgaggagaaccccgcctggctgcccctgtacggcagcgtgtgctgcagactggccgcccagcccctgtgcatgacccagcccaccgccagcggcaccctgagagtgcagcaggccggcgagatgcagaactgggcccaggtgcacggcgtgctgaagggcaccaacctgttctgctacagacagcccgaggacgccgacaccggcgaggagcccctgctgaccatcgccgtgaacaaggagaccagagtgagagccggcgagctggaccaggccctgggcagacccttcaccctgagcatcagcaaccagtacggcgacgacgaggtgacccacaccctgcagaccgagagcagagaggccctgcagagctggatggaggccctgtggcagctgttcttcgacatgagccagtggaagcagtgctgcgacgagatcatgaagatcgagacccccgcccccagaaagcccccccaggccctggccaagcagggcagcctgtaccacgagatggccatcgagcccctggacgacatcgccgccgtgaccgacatcctgacccagagagagggcgccagactggagaccccccccccctggctggccatgttcaccgaccagcccgccctgcccaacccctgcagccccgccagcgtggcccccgcccccgactggacccaccccctgccctggggcagacccagaaccttcagcctggacgccgtgccccccgaccacagccccagagccagaagcgtggcccccctgcccccccagagaagccccagaaccagaggcctgtgcagcaagggccagcccagaacctggctgcagagccccgtgtag

SEQ ID NO: 97254 - DNA, 1653 bp, Artificial Sequence
  Description of Artificial Sequence: Synthetic coding sequence
atgcaggacagactgcacatcctggaggacctgaacatgctgtacatcagacagatggccctgagcctggaggacaccgagctgcagagaaagctggaccacgagatcagaatgagagagggcgcctgcaagctgctggccgcctgcagccagagagagcaggccctggaggccaccaagagcctgctggtgtgcaacagcagaatcctgagctacatgggcgagctgcagagaagaaaggaggcccaggtgctgggcaagaccagcagaagacccagcgacagcggcccccccgccgagagaagcccctgcagaggcagagtgtgcatcagcgacctgagaatccccctgatgtggaaggacaccgagtacttcaagaacaagggcgacctgcacagatgggccgtgttcctgctgctgcagctgggcgagcacatccaggacaccgagatgatcctggtggacagaaccctgaccgacatcagcttccagagcaacgtgctgttcgccgaggccggccccgacttcgagctgagactggagctgtacggcgcctgcgtggaggaggagggcgccctgaccggcggccccaagagactggccaccaagctgagcagcagcctgggcagaagcagcggcagaagagtgagagccagcctggacagcgccggcggcagcggcagcagccccatcctgctgcccacccccgtggtgggcggccccagataccacctgctggcccacaccaccctgaccctggccgccgtgcaggacggcttcagaacccacgacctgaccctggccagccacgaggagaaccccgcctggctgcccctgtacggcagcgtgtgctgcagactggccgcccagcccctgtgcatgacccagcccaccgccagcggcaccctgagagtgcagcaggccggcgagatgcagaactgggcccaggtgcacggcgtgctgaagggcaccaacctgttctgctacagacagcccgaggacgccgacaccggcgaggagcccctgctgaccatcgccgtgaacaaggagaccagagtgagagccggcgagctggaccaggccctgggcagacccttcaccctgagcatcagcaaccagtacggcgacgacgaggtgacccacaccctgcagaccgagagcagagaggccctgcagagctggatggaggccctgtggcagctgttcttcgacatgagccagtggaagcagtgctgcgacgagatcatgaagatcgagacccccgcccccagaaagcccccccaggccctggccaagcagggcagcctgtaccacgagatggccatcgagcccctggacgacatcgccgccgtgaccgacatcctgacccagagagagggcgccagactggagaccccccccccctggctggccatgttcaccgaccagcccgccctgcccaacccctgcagccccgccagcgtggcccccgcccccgactggacccaccccctgccctggggcagacccagaaccttcagcctggacgccgtgccccccgaccacagccccagagccagaagcgtggcccccctgcccccccagagaagccccagaaccagaggcctgtgcagcaagggccagcccagaacctggctgcagagccccgtgtag

SEQ ID NO: 97255 - DNA, 4635 bp, Artificial Sequence
  Description of Artificial Sequence: Synthetic coding sequence
atggacagcggccccgtgtaccacggcgacagcagacagctgagcgccagcggcgtgcccgtgaacggcgccagagagcccgccggccccagcctgctgggcaccggcggcccctggagagtggaccagaagcccgactgggaggccgcccccggccccgcccacaccgccagactggaggacgcccacgacctggtggccttcagcgccgtggccgaggccgtgagcagctacggcgccctgagcaccagactgtacgagaccttcaacagagagatgagcagagaggccggcaacaacagcagaggccccagacccggccccgagggctgcagcgccggcagcgaggacctggacaccctgcagaccgccctggccctggccagacacggcatgaagccccccaactgcaactgcgacggccccgagtgccccgactacctggagtggctggagggcaagatcaagagcgtggtgatggagggcggcgaggagagacccagactgcccggccccctgccccccggcgaggccggcctgcccgcccccagcaccagacccctgctgagcagcgaggtgccccagatcagcccccaggagggcctgcccctgagccagagcgccctgagcatcgccaaggagaagaacatcagcctgcagaccgccatcgccatcgaggccctgacccagctgagcagcgccctgccccagcccagccacagcaccccccaggccagctgccccctgcccgaggccctgagcccccccgcccccttcagaagcccccagagctacctgagagcccccagctggcccgtggtgccccccgaggagcacagcagcttcgcccccgacagcagcgccttcccccccgccacccccagaaccgagttccccgaggcctggggcaccgacaccccccccgccacccccagaagcagctggcccatgcccagacccagccccgaccccatggccgagctggagcagctgctgggcagcgccagcgactacatccagagcgtgttcaagagacccgaggccctgcccaccaagcccaaggtgaaggtggaggcccccagcagcagccccgcccccgcccccagccccgtgctgcagagagaggcccccacccccagcagcgagcccgacacccaccagaaggcccagaccgccctgcagcagcacctgcaccacaagagaagcctgttcctggagcaggtgcacgacaccagcttccccgcccccagcgagcccagcgcccccggctggtggcccccccccagcagccccgtgcccagactgcccgacagaccccccaaggagaagaagaagaagctgcccacccccgccggcggccccgtgggcaccgagaaggccgcccccggcatcaagcccagcgtgagaaagcccatccagatcaagaagagcagacccagagaggcccagcccctgttcccccccgtgagacagatcgtgctggagggcctgagaagccccgccagccaggaggtgcaggcccacccccccgcccccctgcccgccagccagggcagcgccgtgcccctgccccccgagcccagcctggccctgttcgcccccagccccagcagagacagcctgctgccccccacccaggagatgagaagccccagccccatgaccgccctgcagcccggcagcaccggccccctgccccccgccgacgacaagctggaggagctgatcagacagttcgaggccgagttcggcgacagcttcggcctgcccggcccccccagcgtgcccatccaggaccccgagaaccagcagacctgcctgcccgcccccgagagccccttcgccaccagaagccccaagcagatcaagatcgagagcagcggcgccgtgaccgtgctgagcaccacctgcttccacagcgaggagggcggccaggaggccacccccaccaaggccgagaaccccctgacccccaccctgagcggcttcctggagagccccctgaagtacctggacacccccaccaagagcctgctggacacccccgccaagagagcccaggccgagttccccacctgcgactgcgtggagcagatcgtggagaaggacgagggcccctactacacccacctgggcagcggccccaccgtggccagcatcagagagctgatggaggagagatacggcgagaagggcaaggccatcagaatcgagaaggtgatctacaccggcaaggagggcaagagcagcagaggctgccccatcgccaagtgggtgatcagaagacacaccctggaggagaagctgctgtgcctggtgagacacagagccggccaccactgccagaacgccgtgatcgtgatcctgatcctggcctgggagggcatccccagaagcctgggcgacaccctgtaccaggagctgaccgacaccctgagaaagtacggcaaccccaccagcagaagatgcggcctgaacgacgacagaacctgcgcctgccagggcaaggaccccaacacctgcggcgccagcttcagcttcggctgcagctggagcatgtacttcaacggctgcaagtacgccagaagcaagacccccagaaagttcagactggccggcgacaaccccaaggaggaggaggtgctgagaaagagcttccaggacctggccaccgaggtggcccccctgtacaagagactggccccccaggcctaccagaaccaggtgaccaacgaggagatcgccatcgactgcagactgggcctgaaggagggcagacccttcgccggcgtgaccgcctgcatggacttctgcgcccacgcccacaaggaccagcacaacctgtacaacggctgcaccgtggtgtgcaccctgaccaaggaggacaacagatgcgtgggcaagatccccgaggacgagcagctgcacgtgctgcccctgtacaagatggccaacaccgacgagttcggcagcgaggagaaccagaacgccaaggtgggcagcggcgccatccaggtgctgaccgccttccccagagaggtgagaagactgcccgagcccgccaagagctgcagacagagacagctggaggccagaaaggccgccgccgagaagaagaagatccagaaggagaagctgagcacccccgagaagatcaagcaggaggccctggagctggccggcatcaccagcgaccccggcctgagcctgaagggcggcctgagccagcagggcctgaagcccagcctgaaggtggagccccagaaccacttcagcagcttcaagtacagcggcaacgccgtggtggagagctacagcgtgctgggcaactgcagacccagcgacccctacagcatgaacagcgtgtacagctaccacagctactacgcccagcccagcctgaccagcgtgaacggcttccacagcaagtacgccctgcccagcttcagctactacggcttccccagcagcaaccccgtgttccccagccagttcctgggccccggcgcctggggccacagcggcagcagcggcagcttcgagaagaagcccgacctgcacgccctgcacaacagcctgagccccgcctacggcggcgccgagttcgccgagctgcccagccaggccgtgcccaccgacgcccaccaccccaccccccaccaccagcagcccgcctaccccggccccaaggagtacctgctgcccaaggcccccctgctgcacagcgtgagcagagaccccagccccttcgcccagagcagcaactgctacaacagaagcatcaagcaggagcccgtggaccccctgacccaggccgagcccgtgcccagagacgccggcaagatgggcaagacccccctgagcgaggtgagccagaacggcggccccagccacctgtggggccagtacagcggcggccccagcatgagccccaagagaaccaacggcgtgggcggcagctggggcgtgttcagcagcggcgagagccccgccatcgtgcccgacaagctgagcagcttcggcgccagctgcctggcccccagccacttcaccgacggccagtggggcctgttccccggcgagggccagcaggccgccagccacagcggcggcagactgagaggcaagccctggagcccctgcaagttcggcaacagcaccagcgccctggccggccccagcctgaccgagaagccctgggccctgggcgccggcgacttcaacagcgccctgaagggcagccccggcttccaggacaagctgtggaaccccatgaagggcgaggagggcagaatccccgccgccggcgccagccagctggtgttctaccagcacaagaacctgaaccagcccaaccacggcctggccctgtgggaggccaagatgaagcagctggccgagagagccagagccagacaggaggaggccgccagactgggcctgggccagcaggaggccaagctgtacggcaagaagagaaagtggggcggcaccgtggtggccgagccccagcagaaggagaagaagggcgtggtgcccaccagacaggccctggccgtgcccaccgacagcgccgtgaccgtgagcagctacgcctacaccaaggtgaccggcccctacagcagatggatctag

SEQ ID NO: 97256 - DNA, 468 bp, Artificial Sequence
  Description of Artificial Sequence: Synthetic coding sequence
atgagacacctgccctacttctgcagaggccaggtggtgagaggcttcggcagaggcagcaagcagctgggcatccccaccgccaacttccccgagcaggtggtggacaacctgcccgccgacatcagcaccggcatctactacggctgggccagcgtgggcagcggcgacgtgcacaagatggtggtgagcatcggctggaacccctactacaagaacaccaagaagagcatggagacccacatcatgcacaccttcaaggaggacttctacggcgagatcctgaacgtggccatcgtgggctacctgagacccgagaagaacttcgacagcctggagagcctgatcagcgccatccagggcgacatcgaggaggccaagaagagactggagctgcccgagcacctgaagatcaaggaggacaacttcttccaggtgagcaagagcaagatcatgaacggccactag

SEQ ID NO: 97257 - DNA, 969 bp, Artificial Sequence
  Description of Artificial Sequence: Synthetic coding sequence
atggccgccagcggcgagccccagagacagtggcaggaggaggtggccgccgtggtggtggtgggcagctgcatgaccgacctggtgagcctgaccagcagactgcccaagaccggcgagaccatccacggccacaagttcttcatcggcttcggcggcaagggcgccaaccagtgcgtgcaggccgccagactgggcgccatgaccagcatggtgtgcaaggtgggcaaggacagcttcggcaacgactacatcgagaacctgaagcagaacgacatcagcaccgagttcacctaccagaccaaggacgccgccaccggcaccgccagcatcatcgtgaacaacgagggccagaacatcatcgtgatcgtggccggcgccaacctgctgctgaacaccgaggacctgagagccgccgccaacgtgatcagcagagccaaggtgatggtgtgccagctggagatcacccccgccaccagcctggaggccctgaccatggccagaagaagcggcgtgaagaccctgttcaaccccgcccccgccatcgccgacctggacccccagttctacaccctgagcgacgtgttctgctgcaacgagagcgaggccgagatcctgaccggcctgaccgtgggcagcgccgccgacgccggcgaggccgccctggtgctgctgaagagaggctgccaggtggtgatcatcaccctgggcgccgagggctgcgtggtgctgagccagaccgagcccgagcccaagcacatccccaccgagaaggtgaaggccgtggacaccaccggcgccggcgacagcttcgtgggcgccctggccttctacctggcctactaccccaacctgagcctggaggacatgctgaacagaagcaacttcatcgccgccgtgagcgtgcaggccgccggcacccagagcagctacccctacaagaaggacctgcccctgaccctgttctag

SEQ ID NO: 97258 - DNA, 861 bp, Artificial Sequence
  Description of Artificial Sequence: Synthetic coding sequence
atggccgccagcggcgagccccagagacagtggcaggaggaggtggccgccgtggtggtggtgggcagctgcatgaccgacctggtgagcctgaccagcagactgcccaagaccggcgagaccatccacggccacaagttcttcatcggcttcggcggcaagggcgccaaccagtgcgtgcaggccgccagactgggcgccatgaccagcatggtgtgcaaggtgggcaaggacagcttcggcaacgactacatcgagaacctgaagcagaacgacatcagcaccgagttcacctaccagaccaaggacgccgccaccggcaccgccagcatcatcgtgaacaacgagggccagaacatcatcgtgatcgtggccggcgccaacctgctgctgaacaccgaggacctgagagccgccgccaacgtgatcagcagagccaaggtgatggtgtgccagctggagatcacccccgccaccagcctggaggccctgaccatggccagaagaagcggcgtgaagaccctgttcaaccccgcccccgccatcgccgacctggacccccagttctacaccctgagcgacgtgttctgctgcaacgagagcgaggccgagatcctgaccggcctgaccgtgggcagcgccgccgacgccggcgaggccgccctggtgctgctgaagagaggctgccaggtggtgatcatcaccctgggcgccgagggctgcgtggtgctgagccagaccgagcccgagcccaagcacatccccaccgagaaggtgaaggccgtggacaccacctgcagacccggcagcagacccaagagcgaggccgccagcgtgaagaagcagaagcactacaagtag

SEQ ID NO: 97259 - DNA, 861 bp, Artificial Sequence
  Description of Artificial Sequence: Synthetic coding sequence
atgagctggctgctgttcctggcccacagagtggccctggccgccctgccctgcagaagaggcagcagaggcttcggcatgttctacgccgtgagaagaggcagaaagaccggcgtgttcctgacctggaacgagtgcagagcccaggtggacagattccccgccgccagattcaagaagttcgccaccgaggacgaggcctgggccttcgtgagaaagagcgccagccccgaggtgagcgagggccacgagaaccagcacggccaggagagcgaggccaaggccagcaagagactgagagagcccctggacggcgacggccacgagagcgccgagccctacgccaagcacatgaagcccagcgtggagcccgccccccccgtgagcagagacaccttcagctacatgggcgacttcgtggtggtgtacaccgacggctgctgcagcagcaacggcagaagaagacccagagccggcatcggcgtgtactggggccccggccaccccctgaacgtgggcatcagactgcccggcagacagaccaaccagagagccgagatccacgccgcctgcaaggccatcgagcaggccaagacccagaacatcaacaagctggtgctgtacaccgacagcatgttcaccatcaacggcatcaccaactgggtgcagggctggaagaagaacggctggaagaccagcgccggcaaggaggtgatcaacaaggaggacttcgtggccctggagagactgacccagggcatggacatccagtggatgcacgtgcccggccacagcggcttcatcggcaacgaggaggccgacagactggccagagagggcgccaagcagagcgaggactag

SEQ ID NO: 97260 - DNA, 1683 bp, Artificial Sequence
  Description of Artificial Sequence: Synthetic coding sequence
atggagttcagacaggaggagttcagaaagctggccggcagagccctgggcaagctgcacagactgctggagaagagacaggagggcgccgagaccctggagctgagcgccgacggcagacccgtgaccacccagaccagagacccccccgtggtggactgcacctgcttcggcctgcccagaagatacatcatcgccatcatgagcggcctgggcttctgcatcagcttcggcatcagatgcaacctgggcgtggccatcgtgagcatggtgaacaacagcaccacccacagaggcggccacgtggtggtgcagaaggcccagttcagctgggaccccgagaccgtgggcctgatccacggcagcttcttctggggctacatcgtgacccagatccccggcggcttcatctgccagaagttcgccgccaacagagtgttcggcttcgccatcgtggccaccagcaccctgaacatgctgatccccagcgccgccagagtgcactacggctgcgtgatcttcgtgagaatcctgcagggcctggtggagggcgtgacctaccccgcctgccacggcatctggagcaagtgggccccccccctggagagaagcagactggccaccaccgccttctgcggcagctacgccggcgccgtggtggccatgcccctggccggcgtgctggtgcagtacagcggctggagcagcgtgttctacgtgtacggcagcttcggcatcttctggtacctgttctggctgctggtgagctacgagagccccgccctgcaccccagcatcagcgaggaggagagaaagtacatcgaggacgccatcggcgagagcgccaagctgatgaaccccctgaccaagttcagcaccccctggagaagattcttcaccagcatgcccgtgtacgccatcatcgtggccaacttctgcagaagctggaccttctacctgctgctgatcagccagcccgcctacttcgaggaggtgttcggcttcgagatcagcaaggtgggcctggtgagcgccctgccccacctggtgatgaccatcatcgtgcccatcggcggccagatcgccgacttcctgagaagcagaagaatcatgagcaccaccaacgtgagaaagctgatgaactgcggcggcttcggcatggaggccaccctgctgctggtggtgggctacagccacagcaagggcgtggccatcagcttcctggtgctggccgtgggcttcagcggcttcgccatcagcggcttcaacgtgaaccacctggacatcgcccccagatacgccagcatcctgatgggcatcagcaacggcgtgggcaccctgagcggcatggtgtgccccatcatcgtgggcgccatgaccaagcacaagaccagagaggagtggcagtacgtgttcctgatcgccagcctggtgcactacggcggcgtgatcttctacggcgtgttcgccagcggcgagaagcagccctgggccgagcccgaggagatgagcgaggagaagtgcggcttcgtgggccacgaccagctggccggcagcgacgacagcgagatggaggacgaggccgagccccccggcgccccccccgcccccccccccagctacggcgccacccacagcaccttccagccccccagaccccccccccccgtgagagactactag

SEQ ID NO: 97261 - DNA, 939 bp, Artificial Sequence
  Description of Artificial Sequence: Synthetic coding sequence
atggccgccggcgtggactgcggcgacggcgtgggcgccagacagcacgtgttcctggtgagcgagtacctgaaggacgccagcaagaagatgaagaacggcctgatgttcgtgaagctggtgaacccctgcagcggcgagggcgccatctacctgttcaacatgtgcctgcagcagctgttcgaggtgaaggtgttcaaggagaagcaccacagctggttcatcaaccagagcgtgcagagcggcggcctgctgcacttcgccacccccgtggaccccctgttcctgctgctgcactacctgatcaaggccgacaaggagggcaagttccagcccctggaccaggtggtggtggacaacgtgttccccaactgcatcctgctgctgaagctgcccggcctggagaagctgctgcaccacgtgaccgaggagaagggcaaccccgagatcgacaacaagaagtactacaagtacagcaaggagaagaccctgaagtggctggagaagaaggtgaaccagaccgtggccgccctgaagaccaacaacgtgaacgtgagcagcagagtgcagagcaccgccttcttcagcggcgaccaggccagcaccgacaaggaggaggactacatcagatacgcccacggcctgatcagcgactacatccccaaggagctgagcgacgacctgagcaagtacctgaagctgcccgagcccagcgccagcctgcccaacccccccagcaagaagatcaagctgagcgacgagcccgtggaggccaaggaggactacaccaagttcaacaccaaggacctgaagaccgagaagaagaacagcaagatgaccgccgcccagaaggccctggccaaggtggacaagagcggcatgaagagcatcgacaccttcttcggcgtgaagaacaagaagaagatcggcaaggtgtag

SEQ ID NO: 97262 - DNA, 774 bp, Artificial Sequence
  Description of Artificial Sequence: Synthetic coding sequence
atggccgccggcgtggactgcggcgacggcgtgggcgccagacagcacgtgttcctggtgagcgagtacctgaaggacgccagcaagaagatgaagaacggcctgatgttcgtgaagctggtgaacccctgcagcggcgagggcgccatctacctgttcaacatgtgcctgcagcagctgttcgaggtgaaggtgttcaaggagaagcaccacagctggttcatcaaccagagcgtgcagagcggcggcctgctgcacttcgccacccccgtggaccccctgttcctgctgctgcactacctgatcaaggccgacaaggagggcaagttccagcccctggaccaggtggtggtggacaacgtgttccccaactgcatcctgctgctgaagctgcccggcctggagaagctgctgcaccacgtgaccgaggagaagggcaaccccgagatcgacaacaagaagtactacaagtacagcaaggagaagaccctgaagtggctggagaagaaggtgaaccagaccgtggccgccctgaagaccaacaacgtgaacgtgagcagcagagtgcagagcaccgccttcttcagcggcgaccaggccagcaccgacaaggaggaggactacatcagatacgcccacggcctgatcagcgactacatccccaaggagctgagcgacgacctgagcaagtacctgaagctgcccgagcccagcgccagcctgcccaacccccccagcaagatggccgcccagagacagaagagaggcaagtag

SEQ ID NO: 97263 - DNA, 996 bp, Artificial Sequence
  Description of Artificial Sequence: Synthetic coding sequence
atggccgccggcgtggactgcggcgacggcgtgggcgccagacagcacgtgttcctggtgagcgagtacctgaaggacgccagcaagaagatgaagaacggcctgatgttcgtgaagctggtgaacccctgcagcggcgagggcgccatctacctgttcaacatgtgcctgcagcagctgttcgaggtgaaggtgttcaaggagaagcaccacagctggttcatcaaccagagcgtgcagagcggcggcctgctgcacttcgccacccccgtggaccccctgttcctgctgctgcactacctgatcaaggccgacaaggagggcaagttccagcccctggaccaggtggtggtggacaacgtgttccccaactgcatcctgctgctgaagctgcccggcctggagaagctgctgcaccacgtgaccgaggagaagggcaaccccgagatcgacaacaagaagtactacaagtacagcaaggagaagaccctgaagtggctggagaagaaggtgaaccagaccgtggccgccctgaagaccaacaacgtgaacgtgagcagcagagtgcagagcaccgccttcttcagcggcgaccaggccagcaccgacaaggaggaggactacatcagatacgcccacggcctgatcagcgactacatccccaaggagctgagcgacgacctgagcaagtacctgaagctgcccgagcccagcgccagcctgcccaacccccccagcaagaagatcaagctgagcgacgagcccgtggaggccaaggaggactacaccaagttcaacaccaaggacctgaagaccgagaagaagaacagcaagatgaccgccgcccagaaggccctggccaaggtggacaagagcggcatgaagagcatcgacaccttcttcggcgtgaagaagaagctggagagattcgagaccctgaagatcaagagcagcaagaacatctgcttcctgcacgtgagcgtgtgccccagctag

SEQ ID NO: 97264 - DNA, 495 bp, Artificial Sequence
  Description of Artificial Sequence: Synthetic coding sequence
atggagagcggcgacgaggccgccatcgagagacacagagtgcacctgagaagcgccaccctgagagacgccgtgcccgccaccctgcacctgctgccctgcgaggtggccgtggacggccccgcccccgtgggcagattcttcacccccgccatcagacagggccccgagggcctggaggtgagcttcagaggcagatgcctgagaggcgaggaggtggccgtgccccccggcctggtgggctacgtgatggtgaccgaggagaagaaggtgagcatgggcaagcccgaccccctgagagacagcggcaccgacgaccaggaggaggagcccctggagagagacttcgacagattcatcggcgccaccgccaacttcagcagattcaccctgtggggcctggagaccatccccggccccgacgccaaggtgagaggcgccctgacctggcccagcctggccgccgccatccacgcccaggtgcccgaggactag

SEQ ID NO: 97265 - DNA, 2226 bp, Artificial Sequence
  Description of Artificial Sequence: Synthetic coding sequence
atggagagcagagaccacaacaacccccaggagggccccaccagcagcagcggcagaagagccgccgtggaggacaaccacctgctgatcaaggccgtgcagaacgaggacgtggacctggtgcagcagctgctggagggcggcgccaacgtgaacttccaggaggaggagggcggctggacccccctgcacaacgccgtgcagatgagcagagaggacatcgtggagctgctgctgagacacggcgccgaccccgtgctgagaaagaagaacggcgccacccccttcatcctggccgccatcgccggcagcgtgaagctgctgaagctgttcctgagcaagggcgccgacgtgaacgagtgcgacttctacggcttcaccgccttcatggaggccgccgtgtacggcaaggtgaaggccctgaagttcctgtacaagagaggcgccaacgtgaacctgagaagaaagaccaaggaggaccaggagagactgagaaagggcggcgccaccgccctgatggacgccgccgagaagggccacgtggaggtgctgaagatcctgctggacgagatgggcgccgacgtgaacgcctgcgacaacatgggcagaaacgccctgatccacgccctgctgagcagcgacgacagcgacgtggaggccatcacccacctgctgctggaccacggcgccgacgtgaacgtgagaggcgagagaggcaagacccccctgatcctggccgtggagaagaagcacctgggcctggtgcagagactgctggagcaggagcacatcgagatcaacgacaccgacagcgacggcaagaccgccctgctgctggccgtggagctgaagctgaagaagatcgccgagctgctgtgcaagagaggcgccagcaccgactgcggcgacctggtgatgaccgccagaagaaactacgaccacagcctggtgaaggtgctgctgagccacggcgccaaggaggacttccacccccccgccgaggactggaagccccagagcagccactggggcgccgccctgaaggacctgcacagaatctacagacccatgatcggcaagctgaagttcttcatcgacgagaagtacaagatcgccgacaccagcgagggcggcatctacctgggcttctacgagaagcaggaggtggccgtgaagaccttctgcgagggcagccccagagcccagagagaggtgagctgcctgcagagcagcagagagaacagccacctggtgaccttctacggcagcgagagccacagaggccacctgttcgtgtgcgtgaccctgtgcgagcagaccctggaggcctgcctggacgtgcacagaggcgaggacgtggagaacgaggaggacgagttcgccagaaacgtgctgagcagcatcttcaaggccgtgcaggagctgcacctgagctgcggctacacccaccaggacctgcagccccagaacatcctgatcgacagcaagaaggccgcccacctggccgacttcgacaagagcatcaagtgggccggcgacccccaggaggtgaagagagacctggaggacctgggcagactggtgctgtacgtggtgaagaagggcagcatcagcttcgaggacctgaaggcccagagcaacgaggaggtggtgcagctgagccccgacgaggagaccaaggacctgatccacagactgttccaccccggcgagcacgtgagagactgcctgagcgacctgctgggccaccccttcttctggacctgggagagcagatacagaaccctgagaaacgtgggcaacgagagcgacatcaagaccagaaagagcgagagcgagatcctgagactgctgcagcccggccccagcgagcacagcaagagcttcgacaagtggaccaccaagatcaacgagtgcgtgatgaagaagatgaacaagttctacgagaagagaggcaacttctaccagaacaccgtgggcgacctgctgaagttcatcagaaacctgggcgagcacatcgacgaggagaagcacaagaagatgaagctgaagatcggcgaccccagcctgtacttccagaagaccttccccgacctggtgatctacgtgtacaccaagctgcagaacaccgagtacagaaagcacttcccccagacccacagccccaacaagccccagtgcgacggcgccggcggcgccagcggcctggccagccccggctgctag

SEQ ID NO: 97266 - DNA, 2226 bp, Artificial Sequence; identical to SEQ ID NO: 97265
  Description of Artificial Sequence: Synthetic coding sequence

SEQ ID NO: 97267 - DNA, 1959 bp, Artificial Sequence
  Description of Artificial Sequence: Synthetic coding sequence
atggagagcagagaccacaacaacccccaggagggccccaccagcagcagcggcagaagagccgccgtggaggacaaccacctgctgatcaaggccgtgcagaacgaggacgtggacctggtgcagcagctgctggagggcggcgccaacgtgaacttccaggaggaggagggcggctggacccccctgcacaacgccgtgcagatgagcagagaggacatcgtggagctgctgctgagacacggcgccgaccccgtgctgagaaagaagaacggcgccacccccttcatcctggccgccatcgccggcagcgtgaagctgctgaagctgttcctgagcaagggcgccgacgtgaacgagtgcgacttctacggcttcaccgccttcatggaggccgccgtgtacggcaaggtgaaggccctgaagttcctgtacaagagaggcgccaacgtgaacctgagaagaaagaccaaggaggaccaggagagactgagaaagggcggcgccaccgccctgatggacgccgccgagaagggccacgtggaggtgctgaagatcctgctggacgagatgggcgccgacgtgaacgcctgcgacaacatgggcagaaacgccctgatccacgccctgctgagcagcgacgacagcgacgtggaggccatcacccacctgctgctggaccacggcgccgacgtgaacgtgagaggcgagagaggcaagacccccctgatcctggccgtggagaagaagcacctgggcctggtgcagagactgctggagcaggagcacatcgagatcaacgacaccgacagcgacggcaagaccgccctgctgctggccgtggagctgaagctgaagaagatcgccgagctgctgtgcaagagaggcgccagcaccgactgcggcgacctggtgatgaccgccagaagaaactacgaccacagcctggtgaaggtgctgctgagccacggcgccaaggaggacttccacccccccgccgaggactggaagccccagagcagccactggggcgccgccctgaaggacctgcacagaatctacagacccatgatcggcaagctgaagttcttcatcgacgagaagtacaagatcgccgacaccagcgagggcggcatctacctgggcttctacgagaagcaggaggtggccgtgaagaccttctgcgagggcagccccagagcccagagagaggtgagctgcctgcagagcagcagagagaacagccacctggtgaccttctacggcagcgagagccacagaggccacctgttcgtgtgcgtgaccctgtgcgagcagaccctggaggcctgcctggacgtgcacagaggcgaggacgtggagaacgaggaggacgagttcgccagaaacgtgctgagcagcatcttcaaggccgtgcaggagctgcacctgagctgcggctacacccaccaggacctgcagccccagaacatcctgatcgacagcaagaaggccgcccacctggccgacttcgacaagagcatcaagtgggccggcgacccccaggaggtgaagagagacctggaggacctgggcagactggtgctgtacgtggtgaagaagggcagcatcagcttcgaggacctgaaggcccagagcaacgaggaggtggtgcagctgagccccgacgaggagaccaaggacctgatccacagactgttccaccccggcgagcacgtgagagactgcctgagcgacctgctgggccaccccttcttctggacctgggagagcagatacagaaccctgagaaacgtgggcaacgagagcgacatcaagaccagaaagagcgagagcgagatcctgagactgctgcagcccggccccagcgagcacagcaagagcttcgacaagtggaccaccaagatgagcaagctgagacacagacagatcatcttccccaccacccagaaccagtag

SEQ ID NO: 97268 - DNA, 465 bp, Artificial Sequence
  Description of Artificial Sequence: Synthetic coding sequence
atgatcggcaagctgaagttcttcatcgacgagaagtacaagatcgccgacaccagcgagggcggcatctacctgggcttctacgagaagcaggaggtggccgtgaagaccttctgcgagggcagccccagagcccagagagaggtgagctgcctgcagagcagcagagagaacagccacctggtgaccttctacggcagcgagagccacagaggccacctgttcgtgtgcgtgaccctgtgcgagcagaccctggaggcctgcctggacgtgcacagaggcgaggacgtggagaacgaggaggacgagttcgccagaaacgtgctgagcagcatcttcaaggccgtgcaggagctgcacctgagctgcggctacacccaccaggacctgcagccccagaacatcctgatcggcccctggaccgccggccccctgtgcggcaaggagggcaagcacctgatctag

SEQ ID NO: 97269 - DNA, 465 bp, Artificial Sequence
  Description of Artificial Sequence: Synthetic coding sequence
atggccggccccgtgaaggacagagaggccttccagagactgaacttcctgtaccaggccgcccactgcgtgctggcccaggaccccgagaaccaggccctggccagattctactgctacaccgagagaaccatcgccaagagactggtgctgagaagagaccccagcgtgaagagaaccctgtgcagaggctgcagcagcctgctggtgcccggcctgacctgcacccagagacagagaagatgcagaggccagagatggaccgtgcagacctgcctgacctgccagagaagccagagattcctgaacgaccccggccacctgctgtggggcgacagacccgaggcccagctgggcagccaggccgacagcaagcccctgcagcccctgcccaacaccgcccacagcatcagcgacagactgcccgaggagaagatgcagacccagggcagcagcaaccagtag

SEQ ID NO: 97270 - DNA, 489 bp, Artificial Sequence
  Description of Artificial Sequence: Synthetic coding sequence
atggccggccccgtgaaggacagagaggccttccagagactgaacttcctgtaccaggccgcccactgcgtgctggcccaggaccccgagaaccaggccctggccagattctactgctacaccgagagaaccatcgccaagagactggtgctgagaagacccctgagcagcagcgcccccagagaccccagcgtgaagagaaccctgtgcagaggctgcagcagcctgctggtgcccggcctgacctgcacccagagacagagaagatgcagaggccagagatggaccgtgcagacctgcctgacctgccagagaagccagagattcctgaacgaccccggccacctgctgtggggcgacagacccgaggcccagctgggcagccaggccgacagcaagcccctgcagcccctgcccaacaccgcccacagcatcagcgacagactgcccgaggagaagatgcagaccaagggcagcagcaaccagtag

SEQ ID NO: 97271 - DNA, 534 bp, Artificial Sequence
  Description of Artificial Sequence: Synthetic coding sequence
atggccggccccgtgaaggacagagaggccttccagagactgaacttcctgtaccaggtgagcctgagacagggcccccacggcgacggcgccagaagacccagagtgaccgcccccctgccccaggccgcccactgcgtgctggcccaggaccccgagaaccaggccctggccagattctactgctacaccgagagaaccatcgccaagagactggtgctgagaagagaccccagcgtgaagagaaccctgtgcagaggctgcagcagcctgctggtgcccggcctgacctgcacccagagacagagaagatgcagaggccagagatggaccgtgcagacctgcctgacctgccagagaagccagagattcctgaacgaccccggccacctgctgtggggcgacagacccgaggcccagctgggcagccaggccgacagcaagcccctgcagcccctgcccaacaccgcccacagcatcagcgacagactgcccgaggagaagatgcagacccagggcagcagcaaccagtag

SEQ ID NO: 97272 - DNA, 489 bp, Artificial Sequence
  Description of Artificial Sequence: Synthetic coding sequence
atggccggccccgtgaaggacagagaggccttccagagactgaacttcctgtaccaggccgcccactgcgtgctggcccaggaccccgagaaccaggccctggccagattctactgctacaccgagagaaccatcgccaagagactggtgctgagaagacccctgagcagcagcgcccccagagaccccagcgtgaagagaaccctgtgcagaggctgcagcagcctgctggtgcccggcctgacctgcacccacagacagagaagatgcagaggccagagatggaccgtgcagacctgcctgacctgccagagaagccagagattcctgaacgaccccggccacctgctgtggggcgacagacccgaggcccagctgggcagccaggccgacagcaagcccctgcagcccctgcccaacaccgcccacagcatcagcgacagactgcccgaggagaagatgcagacccagggcagcagcaaccagtag

SEQ ID NO: 97273 - DNA, 534 bp, Artificial Sequence
  Description of Artificial Sequence: Synthetic coding sequence
atggccggccccgtgaaggacagagaggccttccagagactgaacttcctgtaccaggtgagcctgagacagggcccccacggcgacggcgccagaagacccagagtgaccgcccccctgccccaggccgcccactgcgtgctggcccaggaccccgagaaccaggccctggccagattctactgctacaccgagagaaccatcgccaagagactggtgctgagaagagaccccagcgtgaagagaaccctgtgcagaggctgcagcagcctgctggtgcccggcctgacctgcacccagagacagagaagatgcagaggccagagatggaccgtgcagacctgcctgacctgccagagaagccagagattcctgaacgaccccggccacctgctgtggggcgacagacccgaggcccagctgggcagccaggccgacagcaagcccctgcagcccctgcccaacaccgcccacagcatcagcgacagactgcccgaggagaagatgcagaccaagggcagcagcaaccagtag

SEQ ID NO: 97274 - DNA, 465 bp, Artificial Sequence
  Description of Artificial Sequence: Synthetic coding sequence
atggccggccccgtgaaggacagagaggccttccagagactgaacttcctgtaccaggccgcccactgcgtgctggcccaggaccccgagaaccaggccctggccagattctactgctacaccgagagaaccatcgccaagagactggtgctgagaagagaccccagcgtgaagagaaccctgtgcagaggctgcagcagcctgctggtgcccggcctgacctgcacccacagacagagaagatgcagaggccagagatggaccgtgcagacctgcctgacctgccagagaagccagagattcctgaacgaccccggccacctgctgtggggcgacagacccgaggcccagctgggcagccaggccgacagcaagcccctgcagcccctgcccaacaccgcccacagcatcagcgacagactgcccgaggagaagatgcagacccagggcagcagcaaccagtag

SEQ ID NO: 97275 - DNA, 435 bp, Artificial Sequence
  Description of Artificial Sequence: Synthetic coding sequence
atggccggccccgtgaaggacagagaggccttccagagactgaacttcctgtaccaggccgcccactgcgtgctggcccaggaccccgagaaccaggccctggccagattctactgctacaccgagagaaccatcgccaagagactggtgctgagaagagaccccagcgtgaagagaaccctgtgcagaggctgcagcagcctgctggtgcccggcctgacctgcacccagagacagagaagatgcagaggccagagatggaccgtgcagacctgcctgacctgccagagaagccagagattcctgaacgaccccggccacctgctgtggggcgacagacccgaggcccagctgggcagccaggccggcgagagattccagaccaccaccaccctggccaagcacagccccctgcacttcagaccccccagctag

SEQ ID NO: 97276 - DNA, 465 bp, Artificial Sequence; identical to SEQ ID NO: 97274
  Description of Artificial Sequence: Synthetic coding sequence

SEQ ID NO: 97277 - DNA, 465 bp, Artificial Sequence
  Description of Artificial Sequence: Synthetic coding sequence
atggccggccccgtgaaggacagagaggccttccagagactgaacttcctgtaccaggccgcccactgcgtgctggcccaggaccccgagaaccaggccctggccagattctactgctacaccgagagaaccatcgccaagagactggtgctgagaagagaccccagcgtgaagagaaccctgtgcagaggctgcagcagcctgctggtgcccggcctgacctgcacccagagacagagaagatgcagaggccagagatggaccgtgcagacctgcctgacctgccagagaagccagagattcctgaacgaccccggccacctgctgtggggcgacagacccgaggcccagctgggcagccaggccgacagcaagcccctgcagcccctgcccaacaccgcccacagcatcagcgacagactgcccgaggagaagatgcagaccaagggcagcagcaaccagtag

SEQ ID NO: 97278 - DNA, 534 bp, Artificial Sequence
  Description of Artificial Sequence: Synthetic coding sequence
atggccggccccgtgaaggacagagaggccttccagagactgaacttcctgtaccaggtgagcctgagacagggcccccacggcgacggcgccagaagacccagagtgaccgcccccctgccccaggccgcccactgcgtgctggcccaggaccccgagaaccaggccctggccagattctactgctacaccgagagaaccatcgccaagagactggtgctgagaagagaccccagcgtgaagagaaccctgtgcagaggctgcagcagcctgctggtgcccggcctgacctgcacccacagacagagaagatgcagaggccagagatggaccgtgcagacctgcctgacctgccagagaagccagagattcctgaacgaccccggccacctgctgtggggcgacagacccgaggcccagctgggcagccaggccgacagcaagcccctgcagcccctgcccaacaccgcccacagcatcagcgacagactgcccgaggagaagatgcagacccagggcagcagcaaccagtag

SEQ ID NO: 97279 - DNA, 435 bp, Artificial Sequence
  Description of Artificial Sequence: Synthetic coding sequence
atggccggccccgtgaaggacagagaggccttccagagactgaacttcctgtaccaggccgcccactgcgtgctggcccaggaccccgagaaccaggccctggccagattctactgctacaccgagagaaccatcgccaagagactggtgctgagaagagaccccagcgtgaagagaaccctgtgcagaggctgcagcagcctgctggtgcccggcctgacctgcacccacagacagagaagatgcagaggccagagatggaccgtgcagacctgcctgacctgccagagaagccagagattcctgaacgaccccggccacctgctgtggggcgacagacccgaggcccagctgggcagccaggccggcgagagattccagaccaccaccaccctggccaagcacagccccctgcacttcagaccccccagctag

SEQ ID NO: 97280 - DNA, 465 bp, Artificial Sequence; identical to SEQ ID NO: 97269
  Description of Artificial Sequence: Synthetic coding sequence

SEQ ID NO: 97281 - DNA, 489 bp, Artificial Sequence
  Description of Artificial Sequence: Synthetic coding sequence
atggccggccccgtgaaggacagagaggccttccagagactgaacttcctgtaccaggccgcccactgcgtgctggcccaggaccccgagaaccaggccctggccagattctactgctacaccgagagaaccatcgccaagagactggtgctgagaagacccctgagcagcagcgcccccagagaccccagcgtgaagagaaccctgtgcagaggctgcagcagcctgctggtgcccggcctgacctgcacccagagacagagaagatgcagaggccagagatggaccgtgcagacctgcctgacctgccagagaagccagagattcctgaacgaccccggccacctgctgtggggcgacagacccgaggcccagctgggcagccaggccgacagcaagcccctgcagcccctgcccaacaccgcccacagcatcagcgacagactgcccgaggagaagatgcagacccagggcagcagcaaccagtag

SEQ ID NO: 97282 - DNA, 435 bp, Artificial Sequence; identical to SEQ ID NO: 97279
  Description of Artificial Sequence: Synthetic coding sequence

SEQ ID NO: 97283 - DNA, 534 bp, Artificial Sequence; identical to SEQ ID NO: 97271
  Description of Artificial Sequence: Synthetic coding sequence

SEQ ID NO: 97284 - DNA, 489 bp, Artificial Sequence; identical to SEQ ID NO: 97272
  Description of Artificial Sequence: Synthetic coding sequence

SEQ ID NO: 97285 - DNA, 534 bp, Artificial Sequence; identical to SEQ ID NO: 97271
  Description of Artificial Sequence: Synthetic coding sequence

SEQ ID NO: 97286 - DNA, 489 bp, Artificial Sequence; identical to SEQ ID NO: 97281
  Description of Artificial Sequence: Synthetic coding sequence

SEQ ID NO: 97287 - DNA, 465 bp, Artificial Sequence; identical to SEQ ID NO: 97274
  Description of Artificial Sequence: Synthetic coding sequence

SEQ ID NO: 97288 - DNA, 435 bp, Artificial Sequence; identical to SEQ ID NO: 97275
  Description of Artificial Sequence: Synthetic coding sequence

SEQ ID NO: 97289 - DNA, 435 bp, Artificial Sequence; identical to SEQ ID NO: 97275
  Description of Artificial Sequence: Synthetic coding sequence

SEQ ID NO: 97290 - DNA, 435 bp, Artificial Sequence; identical to SEQ ID NO: 97275
  Description of Artificial Sequence: Synthetic coding sequence

SEQ ID NO: 97291 - DNA, 534 bp, Artificial Sequence; identical to SEQ ID NO: 97278
  Description of Artificial Sequence: Synthetic coding sequence

SEQ ID NO: 97292 - DNA, 435 bp, Artificial Sequence; identical to SEQ ID NO: 97279
  Description of Artificial Sequence: Synthetic coding sequence

SEQ ID NO: 97293 - DNA, 465 bp, Artificial Sequence; identical to SEQ ID NO: 97269
  Description of Artificial Sequence: Synthetic coding sequence

SEQ ID NO: 97294 - DNA, 534 bp, Artificial Sequence; identical to SEQ ID NO: 97278
  Description of Artificial Sequence: Synthetic coding sequence

SEQ ID NO: 97295 - DNA, 489 bp, Artificial Sequence; identical to SEQ ID NO: 97281
  Description of Artificial Sequence: Synthetic coding sequence

SEQ ID NO: 97296 - DNA, 489 bp, Artificial Sequence; identical to SEQ ID NO: 97272
  Description of Artificial Sequence: Synthetic coding sequence

SEQ ID NO: 97297 - DNA, 765 bp, Artificial Sequence
  Description of Artificial Sequence: Synthetic coding sequence
atggccgtgttcgccgacctggacctgagagccggcagcgacctgaaggccctgagaggcctggtggagaccgccgcccacagagagctgcccagactgagagcctggcccaccagctgccaccccgaccacagagccaccctgagaatcggctacagcgtggtggccatcaaccacatcgtggacttcaaggagaagaagcaggagatcgagaagcccgtggccgtgagcgagctgttcaccaccctgcccatcgtgcagggcaagagcagacccatcaagatcctgaccagactgaccatcatcgtgagcgaccccagccactgcaacgtgctgagagccaccagcagcagagccagactgtacgacgtggtggccgtgttccccaagaccgagaagctgttccacatcgcctgcacccacctggacgtggacctggtgtgcatcaccgtgaccgagaagctgcccttctacttcaagagaccccccatcaacgtggccatcgacagaggcctggccttcgagctggtgtacagccccgccatcaaggacagcaccatgagaagatacaccatcagcagcgccctgaacctgatgcagatctgcaagggcaagaacgtgatcatcagcagcgccgccgagagacccctggagatcagaggcccctacgacgtggccaacctgggcctgctgttcggcctgagcgagagcgacgccaaggccgccgtgagcaccaactgcagagccgccctgctgcacggctag

SEQ ID NO: 97298 - DNA, 807 bp, Artificial Sequence
  Description of Artificial Sequence: Synthetic coding sequence
atggccgtgttcgccgacctggacctgagagccggcagcgacctgaaggccctgagaggcctggtggagaccgccgcccacctgggctacagcgtggtggccatcaaccacatcgtggacttcaaggagaagaagcaggagatcgagaagcccgtggccgtgagcgagctgttcaccaccctgcccatcgtgcagggcaagagcagacccatcaagatcctgaccagactgaccatcatcgtgagcgaccccagccactgcaacgtgctgagagccaccagcagcagagccagactgtacgacgtggtggccgtgttccccaagaccgagaagctgttccacatcgcctgcacccacctggacgtggacctggtgtgcatcaccgtgaccgagaagctgcccttctacttcaagagaccccccatcaacgtggccatcgacagaggcctggccttcgagctggtgtacagccccgccatcaaggacagcaccatgagaagatacaccatcagcagcgccctgaacctgatgcagatctgcaagggcaagaacgtgatcatcagcagcgccgccgagagacccctggagatcagaggcccctacgacgtggccaacctgggcctgctgttcggcctgagcgagagcgacgccaaggccgccgtgagcaccaactgcagagccgccctgctgcacggcgagaccagaaagaccgccttcggcatcatcagcaccgtgaagaagcccagacccagcgagggcgacgaggactgcctgcccgccagcaagaaggccaagtgcgagggctag

SEQ ID NO: 97299 - DNA, 768 bp, Artificial Sequence
  Description of Artificial Sequence: Synthetic coding sequence
atggccgtgttcgccgacctggacctgagagccggcagcgacctgaaggccctgagaggcctggtggagaccgccgcccacctgggctacagcgtggtggccatcaaccacatcgtggacttcaaggagaagaagcaggagatcgagaagcccgtggccgtgagcgagctgttcaccaccctgcccatcgtgcagggcaagagcagacccatcaagatcctgaccagactgaccatcatcgtgagcgaccccagccactgcaacgtgctgagagccaccagcagcagagccagactgtacgacgtggtggccgtgttccccaagaccgagaagctgttccacatcgcctgcacccacctggacgtggacctggtgtgcatcaccgtgaccgagaagctgcccttctacttcaagagaccccccatcaacgtggccatcgacagaggcctggccttcgagctggtgtacagccccgccatcaaggacagcaccatgagaagatacaccatcagcagcgccctgaacctgatgcagatctgcaagggcaagcccctggagatcagaggcccctacgacgtggccaacctgggcctgctgttcggcctgagcgagagcgacgccaaggccgccgtgagcaccaactgcagagccgccctgctgcacggcgagaccagaaagaccgccttcggcatcatcagcaccgtgaagaagcccagacccagcgagggcgacgaggactgcctgcccgccagcaagaaggccaagtag

SEQ ID NO: 97300 - DNA, 969 bp, Artificial Sequence
  Description of Artificial Sequence: Synthetic coding sequence
atggccgtgttcgccgacctggacctgagagccggcagcgacctgaaggccctgagaggcctggtggagaccgccgcccacctgggctacagcgtggtggccatcaaccacatcgtggacttcaaggagaagaagcaggagatcgagaagcccgtggccgtgagcgagctgttcaccaccctgcccatcgtgcagggcaagagcagacccatcaagatcctgaccagactgaccatcatcgtgagcgaccccagccactgcaacgtgctgagagccaccagcagcagagccagactgtacgacgtggtggccgtgttccccaagaccgagaagctgttccacatcgcctgcacccacctggacgtggacctggtgtgcatcaccgtgaccgagaagctgcccttctacttcaagagaccccccatcaacgtggccatcgacagaggcctggccttcgagctggtgtacagccccgccatcaaggacagcaccatgagaagatacaccatcagcagcgccctgaacctgatgcagatctgcaagggcaagaacgtgatcatcagcagcgccgccgagagacccctggagatcagaggcccctacgacgtggccaacctgggcctgctgttcggcctgagcgagagcgacgccaaggccgccgtgagcaccaactgcagagccgccctgctgcacggcgagaccagaaagaccgccttcggcatcatcagcaccgtgaagaagcccagacccagcgagggcgacgaggactgcctgcccgccagcaagaaggccaagtggagccacagcgtgacccaggccggcgtgcagtggcacaacctgggcagcctgcagcccctgcccctgggcctgaagcccagcagccacctgagcctgcccagaaccagaatccagcagagacagctgctgatcagccaccagagagaccacacccccaagaacagactgtag

SEQ ID NO: 97301 - DNA, 639 bp, Artificial Sequence
  Description of Artificial Sequence: Synthetic coding sequence
gagatcgagaagcccgtggccgtgagcgagctgttcaccaccctgcccatcgtgcagggcaagagcagacccatcaagatcctgaccagactgaccatcatcgtgagcgaccccagccactgcaacgtgctgagagccaccagcagcagagccagactgtacgacgtggtggccgtgttccccaagaccgagaagctgttccacatcgcctgcacccacctggacgtggacctggtgtgcatcaccgtgaccgagaagctgcccttctacttcaagagaccccccatcaacgtggccatcgacagaggcctggccttcgagctggtgtacagccccgccatcaaggacagcaccatgagaagatacaccatcagcagcgccctgaacctgatgcagatctgcaagggcaagcccctggagatcagaggcccctacgacgtggccaacctgggcctgctgttcggcctgagcgagagcgacgccaaggccgccgtgagcaccaactgcagagccgccctgctgcacggcgagaccagaaagaccgccttcggcatcatcagcaccgtgaagaagcccagacccagcgagggcgacgaggactgcctgcccgccagcaagaaggccaagtgcgagggctag

SEQ ID NO: 97302 - DNA, 852 bp, Artificial Sequence
  Description of Artificial Sequence: Synthetic coding sequence
atggccgccgccccccaggcccccggcagaggcagcctgagaaagaccagacccctggtggtgaagaccagcctgaacaacccctacatcatcagatggagcgccctggagagcgaggacatgcacttcatcctgcagaccctggaggacagactgaaggccatcggcctgcagaagatcgaggacaagaagaagaagaacaagacccccttcctgaagaaggagagcagagagaagtgcagcatcgccgtggacatcagcgagaacctgaaggagaagaagaccgacgccaagcagcaggtgagcggctggacccccgcccacgtgagaaagcagctggccatcggcgtgaacgaggtgaccagagccctggagagaagagagctgctgctggtgctggtgtgcaagagcgtgaagcccgccatgatcaccagccacctgatccagctgagcctgagcagaagcgtgcccgcctgccaggtgcccagactgagcgagagaatcgcccccgtgatcggcctgaagtgcgtgctggccctggccttcaagaagaacaccaccgacttcgtggacgaggtgagagccatcatccccagagtgcccagcctgagcgtgccctggctgcaggacagaatcgaggacagcggcgagaacctggagaccgagcccctggagagccaggacagagagctgctggacaccagcttcgaggacctgagcaagcccaagagaaagctggccgacggcagacaggccagcgtgaccctgcagcccctgaagatcaagaagctgatccccaaccccaacaagatcagaaagccccccaagagcaagaaggccacccccaagtag

SEQ ID NO: 97303 - DNA, 504 bp, Artificial Sequence
  Description of Artificial Sequence: Synthetic coding sequence
atggccgccgccccccaggcccccggcagaggcagcctgagaaagaccagacccctggtggtgaagaccagcctgaacaacccctacatcatcagatggagcgccctggagagcgaggacatgcacttcatcctgcagaccctggaggacagactgaaggccatcggcctgcagaagatcgaggacaagaagaagaagaacaagacccccttcctgaagaaggagagcagagagaagtgcagcatcgccgtggacatcagcgagaacctgaaggagaagaagaccgacgccaagcagcaggtgagcggctggacccccgcccacgtgagaaagcagctggccatcggcgtgaacgaggtgaccagagccctggagagaagagagctgctgctggtgctggtgctgaccctgctgcccagactggagtgcagcggcgtgatccccgcccactgcaaccccgccagctgggtgcaggccatcctgctgccccagccccccgagtag

SEQ ID NO: 97304 - DNA, 852 bp, Artificial Sequence; identical to SEQ ID NO: 97302
  Description of Artificial Sequence: Synthetic coding sequence

SEQ ID NO: 97305 - DNA, 852 bp, Artificial Sequence; identical to SEQ ID NO: 97302
  Description of Artificial Sequence: Synthetic coding sequence

SEQ ID NO: 97306 - DNA, 510 bp, Artificial Sequence
  Description of Artificial Sequence: Synthetic coding sequence
atggccgccgccccccaggcccccggcagaggcagcctgagaaagaccagacccctggtggtgaagaccagcctgaacaacccctacatcatcagatggagcgccctggagagcgaggacatgcacttcatcctgcagaccctggaggacagactgaaggccatcggcctgcagaagatcgaggacaagaagaagaagaacaagacccccttcctgaagaaggagagcagagagaagtgcagcatcgccgtggacatcagcgagaacctgaaggagaagaagaccgacgccaagcagcaggtgagcggctggacccccgcccacgtgagaaagcagctggccatcggcgtgaacgaggtgaccagagccctggagagaagagagctgctgctggtgctggtgtgcaagagcgtgaagcccgccatgatcaccagccacctgatccagctgagcctgagcagaagcgtgcccgcctgccaggtgcccagactgagcgagagaatcgcctag

SEQ ID NO: 97307 - DNA, 1092 bp, Artificial Sequence
  Description of Artificial Sequence: Synthetic coding sequence
atggccaccctgagaagactgagagaggcccccagacacctgctggtgtgcgagaagagcaacttcggcaaccacaagagcagacacagacacctggtgcagacccactactacaactacagagtgagcttcctgatccccgagtgcggcatcctgagcgaggagctgaagaacctggtgatgaacaccggcccctactacttcgtgaagaacctgcccctgcacgagctgatcacccccgagttcatcagcaccttcatcaagaagggcagctgctacgccctgacctacaacacccacatcgacgaggacaacaccgtggccctgctgcccaacggcaagctgatcctgagcctggacaaggacacctacgaggagaccggcctgcagggccaccccagccagttcagcggcagaaagatcatgaagttcatcgtgagcatcgacctgatggagctgagcctgaacctggacagcaagaagtacgagagaatcagctggagcttcaaggagaagaagcccctgaagttcgacttcctgctggcctggcacaagaccggcagcgaggagagcaccatgatgagctacttcagcaagtaccagatccaggagcaccagcccaaggtggccctgagcaccctgagagacctgcagtgccccgtgctgcagagcagcgagctggagggcacccccgaggtgagctgcagagccctggagctgttcgactggctgggcgccgtgttcagcaacgtggacctgaacaacgagcccaacaacttcatcagcacctactgctgccccgagcccagcaccgtggtggccaaggcctacctgtgcaccatcaccggcttcatcctgcccgagaagatctgcctgctgctggagcacctgtgccactacttcgacgagcccaagctggccccctgggtgaccctgagcgtgcagggcttcgccgacagccccgtgagctgggagaagaacgagcacggcttcagaaagggcggcgagcacctgtacaacttcgtgatcttcaacaaccaggactactggctgcagatggccgtgggcgccaacgaccactgccccccctag

SEQ ID NO: 97308 - DNA, 912 bp, Artificial Sequence
  Description of Artificial Sequence: Synthetic coding sequence
atgaacaccggcccctactacttcgtgaagaacctgcccctgcacgagctgatcacccccgagttcatcagcaccttcatcaagaagggcagctgctacgccctgacctacaacacccacatcgacgaggacaacaccgtggccctgctgcccaacggcaagctgatcctgagcctggacaaggacacctacgaggagaccggcctgcagggccaccccagccagttcagcggcagaaagatcatgaagttcatcgtgagcatcgacctgatggagctgagcctgaacctggacagcaagaagtacgagagaatcagctggagcttcaaggagaagaagcccctgaagttcgacttcctgctggcctggcacaagaccggcagcgaggagagcaccatgatgagctacttcagcaagtaccagatccaggagcaccagcccaaggtggccctgagcaccctgagagacctgcagtgccccgtgctgcagagcagcgagctggagggcacccccgaggtgagctgcagagccctggagctgttcgactggctgggcgccgtgttcagcaacgtggacctgaacaacgagcccaacaacttcatcagcacctactgctgccccgagcccagcaccgtggtggccaaggcctacctgtgcaccatcaccggcttcatcctgcccgagaagatctgcctgctgctggagcacctgtgccactacttcgacgagcccaagctggccccctgggtgaccctgagcgtgcagggcttcgccgacagccccgtgagctgggagaagaacgagcacggcttcagaaagggcggcgagcacctgtacaacttcgtgatcttcaacaaccaggactactggctgcagatggccgtgggcgccaacgaccactgccccccctag

SEQ ID NO: 97309 - DNA, 717 bp, Artificial Sequence
  Description of Artificial Sequence: Synthetic coding sequence
atgagacccgccgccctgagaggcgccctgctgggctgcctgtgcctggccctgctgtgcctgggcggcgccgacaagagactgagagacaaccacgagtggaagaagctgatcatggtgcagcactggcccgagaccgtgtgcgagaagatccagaacgactgcagagacccccccgactactggaccatccacggcctgtggcccgacaagagcgagggctgcaacagaagctggcccttcaacctggaggagatcaagaagaactggatggagatcaccgacagcagcctgcccagccccagcatgggccccgccccccccagatggatgagaagcacccccagaagaagcaccctggccgaggcctggaacagcaccggcagctggaccagcaccggcggctgcgccctgccccccgccgccctgcccagcggcgacctgtgctgcagacccagcctgaccgccggcagcagaggcgtgggcgtggacctgaccgccctgcagcagctgctgcacgtgcactacagcgccaccggcatcatccccgaggagtgcagcgagcccaccaagcccttccagatcatcctgcaccacgaccacaccgagtgggtgcagagcatcggcatgcccatctggaccatcagcagcagcgagagcgccatcggcaagaccagaacccagcccgcctgcgccgtgctgagccacgacagctag

SEQ ID NO: 97310 - DNA, 624 bp, Artificial Sequence
  Description of Artificial Sequence: Synthetic coding sequence
atgagacccgccgccctgagaggcgccctgctgggctgcctgtgcctggccctgctgtgcctgggcggcgccgacaagagactgagagacaaccacgagtggaagaagctgatcatggtgcagcactggcccgagaccgtgtgcgagaagatccagaacgactgcagagacccccccgactactggaccatccacggcctgtggcccgacaagagcgagggctgcaacagaagctggcccttcaacctggaggagatcaagaagaactggatggagatcaccgacagcagcctgcccagccccagcaccgacctgctgcccgagatgagagcctactggcccgacgtgatccacagcttccccaacagaagcagattctgcggcacctgcgccgcccaggtggacgccctgaacagccagaagaagtacttcggcagaagcctggagctgtacagagagctggacctgaacagatgggtgagacccagccccggctgcaccagccagtggggcagcctgctgagccccaagcccgacagctggatccagggcagcggctgcagaccccactgcccccccgccgccagcgcctgcgccctgttcggctactgggaccacagctag

SEQ ID NO: 97311 - DNA, 921 bp, Artificial Sequence
  Description of Artificial Sequence: Synthetic coding sequence
atgagacccgccgccctgagaggcgccctgctgggctgcctgtgcctggccctgctgtgcctgggcggcgccgacaagagactgagagacaaccacgagtggaagaagctgatcatggtgcagcactggcccgagaccgtgtgcgagaagatccagaacgactgcagagacccccccgactactggaccatccacggcctgtggcaggtgagccacaccagcagaagaggcctgctgttcctgttcaagaacatcttcagcctgagcagcagaaacttcagcttctacagcctgcagaccagcatgaagaagcccccccagcccagcctgatcttcctgatcttcagcttcaagcccgacaagagcgagggctgcaacagaagctggcccttcaacctggaggagatcaaggacctgctgcccgagatgagagcctactggcccgacgtgatccacagcttccccaacagaagcagattctggaagcacgagtgggagaagcacggcacctgcgccgcccaggtggacgccctgaacagccagaagaagtacttcggcagaagcctggagctgtacagagagctggacctgaacagcgtgctgctgaagctgggcatcaagcccagcatcaactactaccaggtggccgacttcaaggacgccctggccagagtgtacggcgtgatccccaagatccagtgcctgccccccagccaggacgaggaggtgcagaccatcggccagatcgagctgtgcctgaccaagcaggaccagcagctgcagaactgcaccgagcccggcgagcagcccagccccaagcaggaggtgtggctggccaacggcgccgccgagagcagaggcctgagagtgtgcgaggacggccccgtgttctaccccccccccaagaagaccaagcactag

SEQ ID NO: 97312 - DNA, 771 bp, Artificial Sequence
  Description of Artificial Sequence: Synthetic coding sequence
atgagacccgccgccctgagaggcgccctgctgggctgcctgtgcctggccctgctgtgcctgggcggcgccgacaagagactgagagacaaccacgagtggaagaagctgatcatggtgcagcactggcccgagaccgtgtgcgagaagatccagaacgactgcagagacccccccgactactggaccatccacggcctgtggcccgacaagagcgagggctgcaacagaagctggcccttcaacctggaggagatcaaggacctgctgcccgagatgagagcctactggcccgacgtgatccacagcttccccaacagaagcagattctggaagcacgagtgggagaagcacggcacctgcgccgcccaggtggacgccctgaacagccagaagaagtacttcggcagaagcctggagctgtacagagagctggacctgaacagcgtgctgctgaagctgggcatcaagcccagcatcaactactaccaggtggccgacttcaaggacgccctggccagagtgtacggcgtgatccccaagatccagtgcctgccccccagccaggacgaggaggtgcagaccatcggccagatcgagctgtgcctgaccaagcaggaccagcagctgcagaactgcaccgagcccggcgagcagcccagccccaagcaggaggtgtggctggccaacggcgccgccgagagcagaggcctgagagtgtgcgaggacggccccgtgttctaccccccccccaagaagaccaagcactag

SEQ ID NO: 97313 - DNA, 765 bp, Artificial Sequence
  Description of Artificial Sequence: Synthetic coding sequence
atgagacccgccgccctgagaggcgccctgctgggctgcctgtgcctggccctgctgtgcctgggcggcgccgacaagagactgagagacaaccacgagtggaagaagctgatcatggtgcagcactggcccgagaccgtgtgcgagaagatccagaacgactgcagagacccccccgactactggaccatccacggcctgtggcccgacaagagcgagggctgcaacagaagctggcccttcaacctggaggagatcaaggacctgctgcccgagatgagagcctactggcccgacgtgatccacagcttccccaacagaagcagattctggaagcacgagtgggagaagcacggcacctgcgccgcccaggtggacgccctgaacagccagaagaagtacttcggcagaagcctggagctgtacagagagctggacctgaacagcgtgctgctgaagctgggcatcaagcccagcatcaactactaccaggtggccgacttcaaggacgccctggccagagtgtacggcgtgatccccaagatccagtgcctgccccccagccaggacgaggaggtgcagaccatcggccagatcgagctgtgcctgaccaagcaggaccagcagctgcagaactgcaccgagcccggcgagcagcccagccccaagcaggaggtgtggctggccaacggcgccgccgagagcagaggcctgagagtgtgcgaggacggccccgtgttctaccccccccccaagaagacctag

SEQ ID NO: 97314 - DNA, 771 bp, Artificial Sequence; identical to SEQ ID NO: 97312
  Description of Artificial Sequence: Synthetic coding sequence

SEQ ID NO: 97315 - DNA, 471 bp, Artificial Sequence
  Description of Artificial Sequence: Synthetic coding sequence
atggccctggagaagagcctggtgagactgctgctgctggtgctgatcctgctggtgctgggctgggtgcagcccagcctgggcaaggagagcagagccaagaagttccagagacagcacatggacagcgacagcagccccagcagcagcagcacctactgcaaccagatgatgagaagaagaaacatgacccagggcagatgcaagcccgtgaacaccttcgtgcacgagcccctggtggacgtgcagaacgtgtgcttccaggagaaggtgacctgcaagaacggccagggcaactgctacaagagcaacagcagcatgcacatcaccgactgcagactgaccaacggcagcagataccccaactgcgcctacagaaccagccccaaggagagacacatcatcgtggcctgcgagggcagcccctacgtgcccgtgcacttcgacgccagcgtggaggacagcacctag

SEQ ID NO: 97316 - DNA, 471 bp, Artificial Sequence; identical to SEQ ID NO: 97315
  Description of Artificial Sequence: Synthetic coding sequence

SEQ ID NO: 97317 - DNA, 471 bp, Artificial Sequence; identical to SEQ ID NO: 97315
  Description of Artificial Sequence: Synthetic coding sequence

SEQ ID NO: 97318 - DNA, 471 bp, Artificial Sequence; identical to SEQ ID NO: 97315
  Description of Artificial Sequence: Synthetic coding sequence

SEQ ID NO: 97319 - DNA, 486 bp, Artificial Sequence
  Description of Artificial Sequence: Synthetic coding sequence
atggtgcccaagctgttcaccagccagatctgcctgctgctgctgctgggcctgctggccgtggagggcagcctgcacgtgaagcccccccagttcacctgggcccagtggttcgagacccagcacatcaacatgaccagccagcagtgcaccaacgccatgcaggtgatcaacaactaccagagaagatgcaagaaccagaacaccttcctgctgaccaccttcgccaacgtggtgaacgtgtgcggcaaccccaacatgacctgccccagcaacaagaccagaaagaactgccaccacagcggcagccaggtgcccctgatccactgcaacctgaccacccccagcccccagaacatcagcaactgcagatacgcccagacccccgccaacatgttctacatcgtggcctgcgacaacagagaccagagaagagaccccccccagtaccccgtggtgcccgtgcacctggacagaatcatctag

SEQ ID NO: 97320 - DNA, 483 bp, Artificial Sequence
  Description of Artificial Sequence: Synthetic coding sequence
atggtgcccaagctgttcaccagccagatctgcctgctgctgctgctgggcctgatgggcgtggagggcagcctgcacgccagacccccccagttcaccagagcccagtggttcgccatccagcacatcagcctgaacccccccagatgcaccatcgccatgagagccatcaacaactacagatggagatgcaagaaccagaacaccttcctgagaaccaccttcgccaacgtggtgaacgtgtgcggcaaccagagcatcagatgcccccacaacagaaccctgaacaactgccacagaagcagattcagagtgcccctgctgcactgcgacctgatcaaccccggcgcccagaacatcagcaactgcacctacgccgacagacccggcagaagattctacgtggtggcctgcgacaacagagaccccagagacagccccagataccccgtggtgcccgtgcacctggacaccaccatctag

SEQ ID NO: 97321 - DNA, 444 bp, Artificial Sequence
  Description of Artificial Sequence: Synthetic coding sequence
atggccctgcagagaacccacagcctgctgctgctgctgctgctgaccctgctgggcctgggcctggtgcagcccagctacggccaggacggcatgtaccagagattcctgagacagcacgtgcaccccgaggagaccggcggcagcgacagatactgcaacctgatgatgcagagaagaaagatgaccctgtaccactgcaagagattcaacaccttcatccacgaggacatctggaacatcagaagcatctgcagcaccaccaacatccagtgcaagaacggcaagatgaactgccacgagggcgtggtgaaggtgaccgactgcagagacaccggcagcagcagagcccccaactgcagatacagagccatcgccagcaccagaagagtggtgatcgcctgcgagggcaacccccaggtgcccgtgcacttcgacggctag

SEQ ID NO: 97322 - DNA, 444 bp, Artificial Sequence; identical to SEQ ID NO: 97321
  Description of Artificial Sequence: Synthetic coding sequence

SEQ ID NO: 97323 - DNA, 444 bp, Artificial Sequence; identical to SEQ ID NO: 97321
  Description of Artificial Sequence: Synthetic coding sequence

SEQ ID NO: 97324 - DNA, 465 bp, Artificial Sequence
  Description of Artificial Sequence: Synthetic coding sequence
atggcccccgccagagccggctgctgccccctgctgctgctgctgctgggcctgtgggtggccgaggtgctggtgagagccaagcccaaggacatgaccagcagccagtggttcaagacccagcacgtgcagcccagcccccaggcctgcaacagcgccatgagcatcatcaacaagtacaccgagagatgcaaggacctgaacaccttcctgcacgagcccttcagcagcgtggccatcacctgccagacccccaacatcgcctgcaagaacagctgcaagaactgccaccagagccacggccccatgagcctgaccatgggcgagctgaccagcggcaagtaccccaactgcagatacaaggagaagcacctgaacaccccctacatcgtggcctgcgaccccccccagcagggcgaccccggctaccccctggtgcccgtgcacctggacaaggtggtgtag

SEQ ID NO: 97325 - DNA, 453 bp, Artificial Sequence
  Description of Artificial Sequence: Synthetic coding sequence
atggtgctgtgcttccccctgctgctgctgctgctggtgctgtggggccccgtgtgccccctgcacgcctggcccaagagactgaccaaggcccactggttcgagatccagcacatccagcccagccccctgcagtgcaacagagccatgagcggcatcaacaactacacccagcactgcaagcaccagaacaccttcctgcacgacagcttccagaacgtggccgccgtgtgcgacctgctgagcatcgtgtgcaagaacagaagacacaactgccaccagagcagcaagcccgtgaacatgaccgactgcagactgaccagcggcaagtacccccagtgcagatacagcgccgccgcccagtacaagttcttcatcgtggcctgcgaccccccccagaagagcgaccccccctacaagctggtgcccgtgcacctggacagcatcctgtag

SEQ ID NO: 97326 - DNA, 2271 bp, Artificial Sequence
  Description of Artificial Sequence: Synthetic coding sequence
atgcccctgagacccggcagcctggtgcccgagggcgccggcttccccaagatggccgccgacgtgagcgtgacccacagaccccccctgagccccaagagcggcgccgaggtggaggccggcgacgccgccgagagaagagcccccgaggaggagctgccccccctggaccccgaggagatcagaaagagactggagcacaccgagagacagttcagaaacagaagaaagatcctgatcagaggcctgcccggcgacgtgaccaaccaggaggtgcacgacctgctgagcgactacgagctgaagtactgcttcgtggacaagtacaagggcaccgccttcgtgaccctgctgaacggcgagcaggccgaggccgccatcaacgccttccaccagagcagactgagagagagagagctgagcgtgcagctgcagcccaccgacgccctgctgtgcgtggccaacctgccccccagcctgacccagcagcagttcgaggagctggtgagacccttcggcagcctggagagatgcttcctggtgtacagcgagagaaccggccagagcaagggctacggcttcgccgagtacatgaagaaggacagcgccgccagagccaagagcgacctgctgggcaagcccctgggccccagaaccctgtacgtgcactggaccgacgccggccagctgacccccgccctgctgcacagcagatgcctgtgcgtggacagactgccccccggcttcaacgacgtggacgccctgtgcagagccctgagcgccgtgcacagccccaccttctgccagctggcctgcggccaggacggccagctgaagggcttcgccgtgctggagtacgagaccgccgagatggccgaggaggcccagcagcaggccgacggcctgagcctgggcggcagccacctgagagtgagcttctgcgcccccggcccccccggcagaagcatgctggccgccctgatcgccgcccaggccaccgccctgaacagaggcaagggcctgctgcccgagcccaacatcctgcagctgctgaacaacctgggccccagcgccagcctgcagctgctgctgaaccccctgctgcacggcagcgccggcggcaagcagggcctgctgggcgccccccccgccatgcccctgctgaacggccccgccctgagcaccgccctgctgcagctggccctgcagacccagggccagaagaagcccggcatcctgggcgacagccccctgggcgccctgcagcccggcgcccagcccgccaaccccctgctgggcgagctgcccgccggcggcggcctgccccccgagctgccccccagaagaggcaagcccccccccctgctgcccagcgtgctgggccccgccggcggcgacagagaggccctgggcctgggcccccccgccgcccagctgacccccccccccgcccccgtgggcctgagaggcagcggcctgagaggcctgcagaaggacagcggccccctgcccaccccccccggcgtgagcctgctgggcgagccccccaaggactacagaatccccctgaacccctacctgaacctgcacagcctgctgcccgccagcaacctggccggcaaggaggccagaggctggggcggcgccggcagaagcagaagacccgccgagggcccccccaccaacccccccgcccccggcggcggcagcagcagcagcaaggccttccagctgaagagcagactgctgagccccctgagcagcgccagactgccccccgagcccggcctgagcgacagctacagcttcgactaccccagcgacatgggccccagaagactgttcagccaccccagagagcccgccctgggcccccacggccccagcagacacaagatgagccccccccccagcggcttcggcgagagaagcagcggcggcagcggcggcggccccctgagccacttctacagcggcagccccaccagctacttcaccagcggcctgcaggccggcctgaagcagagccacctgagcaaggccatcggcagcagccccctgggcagcggcgagggcctgctgggcctgagccccggccccaacggccacagccacctgctgaagacccccctgggcggccagaagagaagcttcgcccacctgctgcccagccccgagcccagccccgagggcagctacgtgggccagcacagccagggcctgggcggccactacgccgacagctacctgaagagaaagagaatcttctag

SEQ ID NO: 97327 - DNA, 1821 bp, Artificial Sequence
  Description of Artificial Sequence: Synthetic coding sequence
atggccgccgacgtgagcgtgacccacagaccccccctgagccccaagagcggcgccgaggtggaggccggcgacgccgccgagagaagagcccccgaggaggagctgccccccctggaccccgaggagatcagaaagagactggagcacaccgagagacagttcagaaacagaagaaagatcctgatcagaggcctgcccggcgacgtgaccaaccaggaggtgcacgacctgctgagcgactacgagctgaagtactgcttcgtggacaagtacaagggcaccgccttcgtgaccctgctgaacggcgagcaggccgaggccgccatcaacgccttccaccagagcagactgagagagagagagctgagcgtgcagctgcagcccaccgacgccctgctgtgcgtggccaacctgccccccagcctgacccagcagcagttcgaggagctggtgagacccttcggcagcctggagagatgcttcctggtgtacagcgagagaaccggccagagcaagggctacggcttcgccgagtacatgaagaaggacagcgccgccagagccaagagcgacctgctgggcaagcccctgggccccagaaccctgtacgtgcactggaccgacgccggccagctgacccccgccctgctgcacagcagatgcctgtgcgtggacagactgccccccggcttcaacgacgtggacgccctgtgcagagccctgagcgccgtgcacagccccaccttctgccagctggcctgcggccaggacggccagctgaagggcttcgccgtgctggagtacgagaccgccgagatggccgaggaggcccagcagcaggccgacggcctgagcctgggcggcagccacctgagagtgagcttctgcgcccccggcccccccggcagaagcatgctggccgccctgatcgccgcccaggccaccgccctgaacagaggcaagggcctgctgcccgagcccaacatcctgcagctgctgaacaacctgggccccagcgccagcctgcagctgctgctgaaccccctgctgcacggcagcgccggcggcaagcagggcctgctgggcgccccccccgccatgcccctgctgaacggccccgccctgagcaccgccctgctgcagctggccctgcagacccagggccagaagaagcccggcatcctgggcgacagccccctgggcgccctgcagcccggcgcccagcccgccaaccccctgctgggcgagctgcccgccggcggcggcctgccccccgagctgccccccagaagaggcaagcccccccccctgctgcccagcgtgctgggccccgccggcggcgacagagaggccctgggcctgggcccccccgccgcccagctgacccccccccccgcccccgtgggcctgagaggcagcggcctgagaggccccctgagccacttctacagcggcagccccaccagctacttcaccagcggcctgcaggccggcctgaagcagagccacctgagcaaggccatcggcagcagccccctgggcagcggcgagggcctgctgggcctgagccccggccccaacggccacagccacctgctgaaggtgagagccggcggcggcgacatgcagggctgggaggcccccgccccccagagacccctgaccagacccgccctgcccagcgtgagcagaccccactgggccgccagaaacgccgccctgcccacctgctgccccagacccagccccgcccagaaggccgccatgtgggccagcacccccagagccagcgccgccaccaccagaacccccacctag

SEQ ID NO: 97328 - DNA, 2076 bp, Artificial Sequence
  Description of Artificial Sequence: Synthetic coding sequence
atggccgccgccgccggcgacggcggcggcgagggcggcgccggcctgggcagcgccgccggcctgggccccggccccggcctgagaggccagggccccagcgccgaggcccacgagggcgcccccgaccccatgcccgccgccctgcaccccgaggaggtggccgccagactgcagagaatgcagagagagctgagcaacagaagaaagatcctggtgaagaacctgccccaggacagcaactgccaggaggtgcacgacctgctgaaggactacgacctgaagtactgctacgtggacagaaacaagagaaccgccttcgtgaccctgctgaacggcgagcaggcccagaacgccatccagatgttccaccagtacagcttcagaggcaaggacctgatcgtgcagctgcagcccaccgacgccctgctgtgcatcaccaacgtgcccatcagcttcaccagcgaggagttcgaggagctggtgagagcctacggcaacatcgagagatgcttcctggtgtacagcgaggtgaccggccacagcaagggctacggcttcgtggagtacatgaagaaggacttcgccgccaaggccagactggagctgctgggcagacagctgggcgccagcgccctgttcgcccagtggatggacgtgaacctgctggccagcgagctgatccacagcaagtgcctgtgcatcgacaagctgcccagcgactacagagacagcgaggagctgctgcagatcttcagcagcgtgcacaagcccgtgttctgccagctggcccaggacgagggcagctacgtgggcggcttcgccgtggtggagtacagcaccgccgagcaggccgaggaggtgcagcaggccgccgacggcatgaccatcaagggcagcaaggtgcaggtgagcttctgcgcccccggcgcccccggcagaagcaccctggccgccctgatcgccgcccagagagtgatgcacagcaaccagaagggcctgctgcccgagcccaaccccgtgcagatcatgaagagcctgaacaaccccgccatgctgcaggtgctgctgcagccccagctgtgcggcagagccgtgaagcccgccgtgctgggcaccccccacagcctgccccacctgatgaaccccagcatcagccccgccttcctgcacctgaacaaggcccaccagagcagcgtgatgggcaacaccagcaacctgttcctgcagaacctgagccacatccccctggcccagcagcagctgatgaagttcgagaacatccacaccaacaacaagcccggcctgctgggcgagccccccgccgtggtgctgcagaccgccctgggcatcggcagcgtgctgcccctgaagaaggagctgggccaccaccacggcgaggcccacaagaccagcagcctgatccccacccagaccaccatcaccgccggcatgggcatgctgcccttcttccccaaccagcacatcgccggccaggccggccccggccacagcaacacccaggagaagcagcccgccaccgtgggcatggccgagggcaacttcagcggcagccagccctacctgcagagcttccccaacctggccgccggcagcctgctggtgggccaccacaagcagcagcagagccagcccaagggcaccgagatcagcagcggcgccgccagcaagaaccagaccagcctgctgggcgagccccccaaggagatcagactgagcaagaacccctacctgaacctggccagcgtgctgcccagcgtgtgcctgagcagccccgccagcaagaccaccctgcacaagaccggcatcgccagcagcatcctggacgccatcagccagggcagcgagagccagcacgccctggagaagtgcatcgcctacagcccccccttcggcgactacgcccaggtgagcagcctgagaaacgagaagagaggcagcagctacctgatcagcgcccccgagggcggcagcgtggagtgcgtggaccagcacagccagggcaccggcgcctactacatggagacctacctgaagaagaagagagtgtactag

SEQ ID NO: 97329 - DNA, 2037 bp, Artificial Sequence
  Description of Artificial Sequence: Synthetic coding sequence
atggccgccgccgccggcgacggcggcggcgagggcggcgccggcctgggcagcgccgccggcctgggccccggccccggcctgagaggccagggccccagcgccgaggcccacgagggcgcccccgaccccatgcccgccgccctgcaccccgaggaggtggccgccagactgcagagaatgcagagagagctgagcaacagaagaaagatcctggtgaagaacctgccccaggacagcaactgccaggaggtgcacgacctgctgaaggactacgacctgaagtactgctacgtggacagaaacaagagaaccgccttcgtgaccctgctgaacggcgagcaggcccagaacgccatccagatgttccaccagtacagcttcagaggcaaggacctgatcgtgcagctgcagcccaccgacgccctgctgtgcatcaccaacgtgcccatcagcttcaccagcgaggagttcgaggagctggtgagagcctacggcaacatcgagagatgcttcctggtgtacagcgaggtgaccggccacagcaagggctacggcttcgtggagtacatgaagaaggacttcgccgccaaggccagactggagctgctgggcagacagctgggcgccagcgccctgttcgcccagtggatggacgtgaacctgctggccagcgagctgatccacagcaagtgcctgtgcatcgacaagctgcccagcgactacagagacagcgaggagctgctgcagatcttcagcagcgtgcacaagcccgtgttctgccagctggcccaggacgagggcagctacgtgggcggcttcgccgtggtggagtacagcaccgccgagcaggccgaggaggtgcagcaggccgccgacggcatgaccatcaagggcagcaaggtgcaggtgagcttctgcgcccccggcgcccccggcagaagcaccctggccgccctgatcgccgcccagagagtgatgcacagcaaccagaagggcctgctgcccgagcccaaccccgtgcagatcatgaagagcctgaacaaccccgccatgctgcaggtgctgctgcagccccagctgtgcggcagagccgtgaagcccgccgtgctgggcaccccccacagcctgccccacctgatgaaccccagcatcagccccgccttcctgcacctgaacaaggcccaccagaacctgagccacatccccctggcccagcagcagctgatgaagttcgagaacatccacaccaacaacaagcccggcctgctgggcgagccccccgccgtggtgctgcagaccgccctgggcatcggcagcgtgctgcccctgaagaaggagctgggccaccaccacggcgaggcccacaagaccagcagcctgatccccacccagaccaccatcaccgccggcatgggcatgctgcccttcttccccaaccagcacatcgccggccaggccggccccggccacagcaacacccaggagaagcagcccgccaccgtgggcatggccgagggcaacttcagcggcagccagccctacctgcagagcttccccaacctggccgccggcagcctgctggtgggccaccacaagcagcagcagagccagcccaagggcaccgagatcagcagcggcgccgccagcaagaaccagaccagcctgctgggcgagccccccaaggagatcagactgagcaagaacccctacctgaacctggccagcgtgctgcccagcgtgtgcctgagcagccccgccagcaagaccaccctgcacaagaccggcatcgccagcagcatcctggacgccatcagccagggcagcgagagccagcacgccctggagaagtgcatcgcctacagcccccccttcggcgactacgcccaggtgagcagcctgagaaacgagaagagaggcagcagctacctgatcagcgcccccgagggcggcagcgtggagtgcgtggaccagcacagccagggcaccggcgcctactacatggagacctacctgaagaagaagagagtgtactag

SEQ ID NO: 97330 - DNA, 693 bp, Artificial Sequence
  Description of Artificial Sequence: Synthetic coding sequence
atgaccatcaagggcagcaaggtgcaggtgagcttctgcgcccccggcgcccccggcagaagcaccctggccgccctgatcgccgcccagagagtgatgcacagcaaccagaagggcctgctgcccgagcccaaccccgtgcagatcatgaagagcctgaacaaccccgccatgctgcaggtgctgctgcagccccagctgtgcggcagagccgtgaagcccgccgtgctgggcaccccccacagcctgccccacctgatgaaccccagcatcagccccgccttcctgcacctgaacaaggcccaccagaaccagaccagcctgctgggcgagccccccaaggagatcagactgagcaagaacccctacctgaacctggccagcgtgctgcccagcgtgtgcctgagcagccccgccagcaagaccaccctgcacaagaccggcatcgccagcagcatcctggacgccatcagccagggcagcgagagccagcacgccctggagaagtgcatcgcctacagcccccccttcggcgactacgcccaggtgagcagcctgagaaacgagaagagaggcagcagctacctgatcagcgcccccgagggcggcagcgtggagtgcgtggaccagcacagccagggcaccggcgcctactacatggagacctacctgaagaagaagagagtgtactag

SEQ ID NO: 97331 - DNA, 2379 bp, Artificial Sequence
  Description of Artificial Sequence: Synthetic coding sequence
atgcacgtgatcaagagagacggcagacaggagagagtgatgttcgacaagatcaccagcagaatccagaagctgtgctacggcctgaacatggacttcgtggaccccgcccagatcaccatgaaggtgatccagggcctgtacagcggcgtgaccaccgtggagctggacaccctggccgccgagaccgccgccaccctgaccaccaagcaccccgactacgccatcctggccgccagaatcgccgtgagcaacctgcacaaggagaccaagaaggtgttcagcgacgtgatggaggacctgtacaactacatcaacccccacaacggcaagcacagccccatggtggccaagagcaccctggacatcgtgctggccaacaaggacagactgaacagcgccatcatctacgacagagacttcagctacaactacttcggcttcaagaccctggagagaagctacctgctgaagatcaacggcaaggtggccgagagaccccagcacatgctgatgagagtgagcgtgggcatccacaaggaggacatcgacgccgccatcgagacctacaacctgctgagcgagagatggttcacccacgccagccccaccctgttcaacgccggcaccaacagaccccagctgagcagctgcttcctgctgagcatgaaggacgacagcatcgagggcatctacgacaccctgaagcagtgcgccctgatcagcaagagcgccggcggcatcggcgtggccgtgagctgcatcagagccaccggcagctacatcgccggcaccaacggcaacagcaacggcctggtgcccatgctgagagtgtacaacaacaccgccagatacgtggaccagggcggcaacaagagacccggcgccttcgccatctacctggagccctggcacctggacatcttcgagttcctggacctgaagaagaacaccggcaaggaggagcagagagccagagacctgttcttcgccctgtggatccccgacctgttcatgaagagagtggagaccaaccaggactggagcctgatgtgccccaacgagtgccccggcctggacgaggtgtggggcgaggagttcgagaagctgtacgccagctacgagaagcagggcagagtgagaaaggtggtgaaggcccagcagctgtggtacgccatcatcgagagccagaccgagaccggcaccccctacatgctgtacaaggacagctgcaacagaaagagcaaccagcagaacctgggcaccatcaagtgcagcaacctgtgcaccgagatcgtggagtacaccagcaaggacgaggtggccgtgtgcaacctggccagcctggccctgaacatgtacgtgaccagcgagcacacctacgacttcaagaagctggccgaggtgaccaaggtggtggtgagaaacctgaacaagatcatcgacatcaactactaccccgtgcccgaggcctgcctgagcaacaagagacacagacccatcggcatcggcgtgcagggcctggccgacgccttcatcctgatgagataccccttcgagagcgccgaggcccagctgctgaacaagcagatcttcgagaccatctactacggcgccctggaggccagctgcgacctggccaaggagcagggcccctacgagacctacgagggcagccccgtgagcaagggcatcctgcagtacgacatgtggaacgtgacccccaccgacctgtgggactggaaggtgctgaaggagaagatcgccaagtacggcatcagaaacagcctgctgatcgcccccatgcccaccgccagcaccgcccagatcctgggcaacaacgagagcatcgagccctacaccagcaacatctacaccagaagagtgctgagcggcgagttccagatcgtgaacccccacctgctgaaggacctgaccgagagaggcctgtggcacgaggagatgaagaaccagatcatcgcctgcaacggcagcatccagagcatccccgagatccccgacgacctgaagcagctgtacaagaccgtgtgggagatcagccagaagaccgtgctgaagatggccgccgagagaggcgccttcatcgaccagagccagagcctgaacatccacatcgccgagcccaactacggcaagctgaccagcatgcacttctacggctggaagcagggcctgaagaccggcatgtactacctgagaaccagacccgccgccaaccccatccagttcaccctgaacaaggagaagctgaaggacaaggagaaggtgagcaaggaggaggaggagaaggagagaaacaccgccgccatggtgtgcagcctggagaacagagacgagtgcctgatgtgcggcagctag

SEQ ID NO: 97332 - DNA, 2088 bp, Artificial Sequence
  Description of Artificial Sequence: Synthetic coding sequence
atggaggacctgtacaactacatcaacccccacaacggcaagcacagccccatggtggccaagagcaccctggacatcgtgctggccaacaaggacagactgaacagcgccatcatctacgacagagacttcagctacaactacttcggcttcaagaccctggagagaagctacctgctgaagatcaacggcaaggtggccgagagaccccagcacatgctgatgagagtgagcgtgggcatccacaaggaggacatcgacgccgccatcgagacctacaacctgctgagcgagagatggttcacccacgccagccccaccctgttcaacgccggcaccaacagaccccagctgagcagctgcttcctgctgagcatgaaggacgacagcatcgagggcatctacgacaccctgaagcagtgcgccctgatcagcaagagcgccggcggcatcggcgtggccgtgagctgcatcagagccaccggcagctacatcgccggcaccaacggcaacagcaacggcctggtgcccatgctgagagtgtacaacaacaccgccagatacgtggaccagggcggcaacaagagacccggcgccttcgccatctacctggagccctggcacctggacatcttcgagttcctggacctgaagaagaacaccggcaaggaggagcagagagccagagacctgttcttcgccctgtggatccccgacctgttcatgaagagagtggagaccaaccaggactggagcctgatgtgccccaacgagtgccccggcctggacgaggtgtggggcgaggagttcgagaagctgtacgccagctacgagaagcagggcagagtgagaaaggtggtgaaggcccagcagctgtggtacgccatcatcgagagccagaccgagaccggcaccccctacatgctgtacaaggacagctgcaacagaaagagcaaccagcagaacctgggcaccatcaagtgcagcaacctgtgcaccgagatcgtggagtacaccagcaaggacgaggtggccgtgtgcaacctggccagcctggccctgaacatgtacgtgaccagcgagcacacctacgacttcaagaagctggccgaggtgaccaaggtggtggtgagaaacctgaacaagatcatcgacatcaactactaccccgtgcccgaggcctgcctgagcaacaagagacacagacccatcggcatcggcgtgcagggcctggccgacgccttcatcctgatgagataccccttcgagagcgccgaggcccagctgctgaacaagcagatcttcgagaccatctactacggcgccctggaggccagctgcgacctggccaaggagcagggcccctacgagacctacgagggcagccccgtgagcaagggcatcctgcagtacgacatgtggaacgtgacccccaccgacctgtgggactggaaggtgctgaaggagaagatcgccaagtacggcatcagaaacagcctgctgatcgcccccatgcccaccgccagcaccgcccagatcctgggcaacaacgagagcatcgagccctacaccagcaacatctacaccagaagagtgctgagcggcgagttccagatcgtgaacccccacctgctgaaggacctgaccgagagaggcctgtggcacgaggagatgaagaaccagatcatcgcctgcaacggcagcatccagagcatccccgagatccccgacgacctgaagcagctgtacaagaccgtgtgggagatcagccagaagaccgtgctgaagatggccgccgagagaggcgccttcatcgaccagagccagagcctgaacatccacatcgccgagcccaactacggcaagctgaccagcatgcacttctacggctggaagcagggcctgaagaccggcatgtactacctgagaaccagacccgccgccaaccccatccagttcaccctgaacaaggagaagctgaaggacaaggagaaggtgagcaaggaggaggaggagaaggagagaaacaccgccgccatggtgtgcagcctggagaacagagacgagtgcctgatgtgcggcagctag

SEQ ID NO: 97333 - DNA, 2118 bp, Artificial Sequence
  Description of Artificial Sequence: Synthetic coding sequence
gacggcagacaggagagagtgatgttcgacaagatcaccagcagaatccagaagctgtgctacggcctgaacatggacttcgtggaccccgcccagatcaccatgaaggtgatccagggcctgtacagcggcgtgaccaccgtggagctggacaccctggccgccgagaccgccgccaccctgaagaccctggagagaagctacctgctgaagatcaacggcaaggtggccgagagaccccagcacatgctgatgagagtgagcgtgggcatccacaaggaggacatcgacgccgccatcgagacctacaacctgctgagcgagagatggttcacccacgccagccccaccctgttcaacgccggcaccaacagaccccagctgagcagctgcttcctgctgagcatgaaggacgacagcatcgagggcatctacgacaccctgaagcagtgcgccctgatcagcaagagcgccggcggcatcggcgtggccgtgagctgcatcagagccaccggcagctacatcgccggcaccaacggcaacagcaacggcctggtgcccatgctgagagtgtacaacaacaccgccagatacgtggaccagggcggcaacaagagacccggcgccttcgccatctacctggagccctggcacctggacatcttcgagttcctggacctgaagaagaacaccggcaaggaggagcagagagccagagacctgttcttcgccctgtggatccccgacctgttcatgaagagagtggagaccaaccaggactggagcctgatgtgccccaacgagtgccccggcctggacgaggtgtggggcgaggagttcgagaagctgtacgccagctacgagaagcagggcagagtgagaaaggtggtgaaggcccagcagctgtggtacgccatcatcgagagccagaccgagaccggcaccccctacatgctgtacaaggacagctgcaacagaaagagcaaccagcagaacctgggcaccatcaagtgcagcaacctgtgcaccgagatcgtggagtacaccagcaaggacgaggtggccgtgtgcaacctggccagcctggccctgaacatgtacgtgaccagcgagcacacctacgacttcaagaagctggccgaggtgaccaaggtggtggtgagaaacctgaacaagatcatcgacatcaactactaccccgtgcccgaggcctgcctgagcaacaagagacacagacccatcggcatcggcgtgcagggcctggccgacgccttcatcctgatgagataccccttcgagagcgccgaggcccagctgctgaacaagcagatcttcgagaccatctactacggcgccctggaggccagctgcgacctggccaaggagcagggcccctacgagacctacgagggcagccccgtgagcaagggcatcctgcagtacgacatgtggaacgtgacccccaccgacctgtgggactggaaggtgctgaaggagaagatcgccaagtacggcatcagaaacagcctgctgatcgcccccatgcccaccgccagcaccgcccagatcctgggcaacaacgagagcatcgagccctacaccagcaacatctacaccagaagagtgctgagcggcgagttccagatcgtgaacccccacctgctgaaggacctgaccgagagaggcctgtggcacgaggagatgaagaaccagatcatcgcctgcaacggcagcatccagagcatccccgagatccccgacgacctgaagcagctgtacaagaccgtgtgggagatcagccagaagaccgtgctgaagatggccgccgagagaggcgccttcatcgaccagagccagagcctgaacatccacatcgccgagcccaactacggcaagctgaccagcatgcacttctacggctggaagcagggcctgaagaccggcatgtactacctgagaaccagacccgccgccaaccccatccagttcaccctgaacaaggagaagctgaaggacaaggagaaggtgagcaaggaggaggaggagaaggagagaaacaccgccgccatggtgtgcagcctggagaacagagacgagtgcctgatgtgcggcagctag

SEQ ID NO: 97334 - DNA, 1365 bp, Artificial Sequence
  Description of Artificial Sequence: Synthetic coding sequence
atgaagagagtggagaccaaccaggactggagcctgatgtgccccaacgagtgccccggcctggacgaggtgtggggcgaggagttcgagaagctgtacgccagctacgagaagcagggcagagtgagaaaggtggtgaaggcccagcagctgtggtacgccatcatcgagagccagaccgagaccggcaccccctacatgctgtacaaggacagctgcaacagaaagagcaaccagcagaacctgggcaccatcaagtgcagcaacctgtgcaccgagatcgtggagtacaccagcaaggacgaggtggccgtgtgcaacctggccagcctggccctgaacatgtacgtgaccagcgagcacacctacgacttcaagaagctggccgaggtgaccaaggtggtggtgagaaacctgaacaagatcatcgacatcaactactaccccgtgcccgaggcctgcctgagcaacaagagacacagacccatcggcatcggcgtgcagggcctggccgacgccttcatcctgatgagataccccttcgagagcgccgaggcccagctgctgaacaagcagatcttcgagaccatctactacggcgccctggaggccagctgcgacctggccaaggagcagggcccctacgagacctacgagggcagccccgtgagcaagggcatcctgcagtacgacatgtggaacgtgacccccaccgacctgtgggactggaaggtgctgaaggagaagatcgccaagtacggcatcagaaacagcctgctgatcgcccccatgcccaccgccagcaccgcccagatcctgggcaacaacgagagcatcgagccctacaccagcaacatctacaccagaagagtgctgagcggcgagttccagatcgtgaacccccacctgctgaaggacctgaccgagagaggcctgtggcacgaggagatgaagaaccagatcatcgcctgcaacggcagcatccagagcatccccgagatccccgacgacctgaagcagctgtacaagaccgtgtgggagatcagccagaagaccgtgctgaagatggccgccgagagaggcgccttcatcgaccagagccagagcctgaacatccacatcgccgagcccaactacggcaagctgaccagcatgcacttctacggctggaagcagggcctgaagaccggcatgtactacctgagaaccagacccgccgccaaccccatccagttcaccctgaacaaggagaagctgaaggacaaggagaaggtgagcaaggaggaggaggagaaggagagaaacaccgccgccatggtgtgcagcctggagaacagagacgagtgcctgatgtgcggcagctag

SEQ ID NO: 97335 - DNA, 1170 bp, Artificial Sequence
  Description of Artificial Sequence: Synthetic coding sequence
atgctgagcctgagagtgcccctggcccccatcaccgacccccagcagctgcagctgagccccctgaagggcctgagcctggtggacaaggagaacaccccccccgccctgagcggcaccagagtgctggccagcaagaccgccagaagaatcttccaggagcccaccgagcccaagaccaaggccgccgcccccggcgtggaggacgagcccctgctgagagagaaccccagaagattcgtgatcttccccatcgagtaccacgacatctggcagatgtacaagaaggccgaggccagcttctggaccgccgaggaggtggacctgagcaaggacatccagcactgggagagcctgaagcccgaggagagatacttcatcagccacgtgctggccttcttcgccgccagcgacggcatcgtgaacgagaacctggtggagagattcagccaggaggtgcagatcaccgaggccagatgcttctacggcttccagatcgccatggagaacatccacagcgagatgtacagcctgctgatcgacacctacatcaaggaccccaaggagagagagttcctgttcaacgccatcgagaccatgccctgcgtgaagaagaaggccgactgggccctgagatggatcggcgacaaggaggccacctacggcgagagagtggtggccttcgccgccgtggagggcatcttcttcagcggcagcttcgccagcatcttctggctgaagaagagaggcctgatgcccggcctgaccttcagcaacgagctgatcagcagagacgagggcctgcactgcgacttcgcctgcctgatgttcaagcacctggtgcacaagcccagcgaggagagagtgagagagatcatcatcaacgccgtgagaatcgagcaggagttcctgaccgaggccctgcccgtgaagctgatcggcatgaactgcaccctgatgaagcagtacatcgagttcgtggccgacagactgatgctggagctgggcttcagcaaggtgttcagagtggagaaccccttcgacttcatggagaacatcagcctggagggcaagaccaacttcttcgagaagagagtgggcgagtaccagagaatgggcgtgatgagcagccccaccgagaacagcttcaccctggacgccgacttctag

SEQ ID NO: 97336 - DNA, 1350 bp, Artificial Sequence
  Description of Artificial Sequence: Synthetic coding sequence
atgggcagagtgggcggcatggcccagcccatgggcagagccggcgcccccaagcccatgggcagagccggcagcgccagaagaggcagattcaagggctgctggagcgagggcagccccgtgcaccccgtgcccgccgtgctgagctggctgctggccctgctgagatgcgccagcaccatgctgagcctgagagtgcccctggcccccatcaccgacccccagcagctgcagctgagccccctgaagggcctgagcctggtggacaaggagaacaccccccccgccctgagcggcaccagagtgctggccagcaagaccgccagaagaatcttccaggagcccaccgagcccaagaccaaggccgccgcccccggcgtggaggacgagcccctgctgagagagaaccccagaagattcgtgatcttccccatcgagtaccacgacatctggcagatgtacaagaaggccgaggccagcttctggaccgccgaggaggtggacctgagcaaggacatccagcactgggagagcctgaagcccgaggagagatacttcatcagccacgtgctggccttcttcgccgccagcgacggcatcgtgaacgagaacctggtggagagattcagccaggaggtgcagatcaccgaggccagatgcttctacggcttccagatcgccatggagaacatccacagcgagatgtacagcctgctgatcgacacctacatcaaggaccccaaggagagagagttcctgttcaacgccatcgagaccatgccctgcgtgaagaagaaggccgactgggccctgagatggatcggcgacaaggaggccacctacggcgagagagtggtggccttcgccgccgtggagggcatcttcttcagcggcagcttcgccagcatcttctggctgaagaagagaggcctgatgcccggcctgaccttcagcaacgagctgatcagcagagacgagggcctgcactgcgacttcgcctgcctgatgttcaagcacctggtgcacaagcccagcgaggagagagtgagagagatcatcatcaacgccgtgagaatcgagcaggagttcctgaccgaggccctgcccgtgaagctgatcggcatgaactgcaccctgatgaagcagtacatcgagttcgtggccgacagactgatgctggagctgggcttcagcaaggtgttcagagtggagaaccccttcgacttcatggagaacatcagcctggagggcaagaccaacttcttcgagaagagagtgggcgagtaccagagaatgggcgtgatgagcagccccaccgagaacagcttcaccctggacgccgacttctag

SEQ ID NO: 97337 - DNA, 1056 bp, Artificial Sequence
  Description of Artificial Sequence: Synthetic coding sequence
atgggcgaccccgagagacccgaggccgccggcctggaccaggacgagagaagcagcagcgacaccaacgagagcgagatcaagagcaacgaggagcccctgctgagaaagagcagcagaagattcgtgatcttccccatccagtaccccgacatctggaagatgtacaagcaggcccaggccagcttctggaccgccgaggaggtggacctgagcaaggacctgccccactggaacaagctgaaggccgacgagaagtacttcatcagccacatcctggccttcttcgccgccagcgacggcatcgtgaacgagaacctggtggagagattcagccaggaggtgcaggtgcccgaggccagatgcttctacggcttccagatcctgatcgagaacgtgcacagcgagatgtacagcctgctgatcgacacctacatcagagaccccaagaagagagagttcctgttcaacgccatcgagaccatgccctacgtgaagaagaaggccgactgggccctgagatggatcgccgacagaaagagcaccttcggcgagagagtggtggccttcgccgccgtggagggcgtgttcttcagcggcagcttcgccgccatcttctggctgaagaagagaggcctgatgcccggcctgaccttcagcaacgagctgatcagcagagacgagggcctgcactgcgacttcgcctgcctgatgttccagtacctggtgaacaagcccagcgaggagagagtgagagagatcatcgtggacgccgtgaagatcgagcaggagttcctgaccgaggccctgcccgtgggcctgatcggcatgaactgcatcctgatgaagcagtacatcgagttcgtggccgacagactgctggtggagctgggcttcagcaaggtgttccaggccgagaaccccttcgacttcatggagaacatcagcctggagggcaagaccaacttcttcgagaagagagtgagcgagtaccagagattcgccgtgatggccgagaccaccgacaacgtgttcaccctggacgccgacttctag

SEQ ID NO: 97338 - DNA, 900 bp, Artificial Sequence
  Description of Artificial Sequence: Synthetic coding sequence
atgggcgaccccgagagacccgaggccgccggcctggaccaggacgaggtggacctgagcaaggacctgccccactggaacaagctgaaggccgacgagaagtacttcatcagccacatcctggccttcttcgccgccagcgacggcatcgtgaacgagaacctggtggagagattcagccaggaggtgcaggtgcccgaggccagatgcttctacggcttccagatcctgatcgagaacgtgcacagcgagatgtacagcctgctgatcgacacctacatcagagaccccaagaagagagagttcctgttcaacgccatcgagaccatgccctacgtgaagaagaaggccgactgggccctgagatggatcgccgacagaaagagcaccttcggcgagagagtggtggccttcgccgccgtggagggcgtgttcttcagcggcagcttcgccgccatcttctggctgaagaagagaggcctgatgcccggcctgaccttcagcaacgagctgatcagcagagacgagggcctgcactgcgacttcgcctgcctgatgttccagtacctggtgaacaagcccagcgaggagagagtgagagagatcatcgtggacgccgtgaagatcgagcaggagttcctgaccgaggccctgcccgtgggcctgatcggcatgaactgcatcctgatgaagcagtacatcgagttcgtggccgacagactgctggtggagctgggcttcagcaaggtgttccaggccgagaaccccttcgacttcatggagaacatcagcctggagggcaagaccaacttcttcgagaagagagtgagcgagtaccagagattcgccgtgatggccgagaccaccgacaacgtgttcaccctggacgccgacttctag

SEQ ID NO: 97339 - DNA, 420 bp, Artificial Sequence
  Description of Artificial Sequence: Synthetic coding sequence
atgggcgaccccgagagacccgaggccgccggcctggaccaggacgagggcctgcactgcgacttcgcctgcctgatgttccagtacctggtgaacaagcccagcgaggagagagtgagagagatcatcgtggacgccgtgaagatcgagcaggagttcctgaccgaggccctgcccgtgggcctgatcggcatgaactgcatcctgatgaagcagtacatcgagttcgtggccgacagactgctggtggagctgggcttcagcaaggtgttccaggccgagaaccccttcgacttcatggagaacatcagcctggagggcaagaccaacttcttcgagaagagagtgagcgagtaccagagattcgccgtgatggccgagaccaccgacaacgtgttcaccctggacgccgacttctag

SEQ ID NO: 97340 - DNA, 201 bp, Artificial Sequence
  Description of Artificial Sequence: Synthetic coding sequence
atgggcgaccccgagagacccgaggccgccggcctggaccaggacgaggtgttccaggccgagaaccccttcgacttcatggagaacatcagcctggagggcaagaccaacttcttcgagaagagagtgagcgagtaccagagattcgccgtgatggccgagaccaccgacaacgtgttcaccctggacgccgacttctag

SEQ ID NO: 97341 - DNA, 132 bp, Artificial Sequence
  Description of Artificial Sequence: Synthetic coding sequence
atgggcgaccccgagagacccgaggccgccggcctggaccaggacgagagaagcagcagcgacaccaacgagagcgagatcaagagcaacgaggagcccctgctgagaaagagcagcagaagaagcttctag

SEQ ID NO: 97342 - DNA, 894 bp, Artificial Sequence
  Description of Artificial Sequence: Synthetic coding sequence
atgtacaagcaggcccaggccagcttctggaccgccgaggaggtggacctgagcaaggacctgccccactggaacaagctgaaggccgacgagaagtacttcatcagccacatcctggccttcttcgccgccagcgacggcatcgtgaacgagaacctggtggagagattcagccaggaggtgcaggtgcccgaggccagatgcttctacggcttccagatcctgatcgagaacgtgcacagcgagatgtacagcctgctgatcgacacctacatcagagaccccaagaagagagagttcctgttcaacgccatcgagaccatgccctacgtgaagaagaaggccgactgggccctgagatggatcgccgacagaaagagcaccttcggcgagagagtggtggccttcgccgccgtggagggcgtgttcttcagcggcagcttcgccgccatcttctggctgaagaagagaggcctgatgcccggcctgaccttcagcaacgagctgatcagcagagacgagggcctgcactgcgacttcgcctgcctgatgttccagtacctggtgaacaagcccagcgaggagagagtgagagagatcatcgtggacgccgtgaagatcgagcaggagttcctgaccgaggccctgcccgtgggcctgatcggcatgaactgcatcctgatgaagcagtacatcgagttcgtggccgacagactgctggtggagctgggcttcagcaaggtgttccaggccgagaaccccttcgacttcatggagaacatcagcctggagggcaagaccaacttcttcgagaagagagtgagcgagtaccagagattcgccgtgatggccgagaccaccgacaacgtgttcaccctggacgccgacttctag

SEQ ID NO: 97343 - DNA, 1824 bp, Artificial Sequence
  Description of Artificial Sequence: Synthetic coding sequence
atggaggcccccgccgccggcctgttcctgctgctgctgctgggcacctgggcccccgcccccggcagcgccagcagcgaggccccccccctgatcaacgaggacgtgaagagaaccgtggacctgagcagccacctggccaaggtgaccgccgaggtggtgctggcccacctgggcggcggcagcaccagcagagccaccagcttcctgctggccctggagcccgagctggaggccagactggcccacctgggcgtgcaggtgaagggcgaggacgaggaggagaacaacctggaggtgagagagaccaagatcaagggcaagagcggcagattcttcaccgtgaagctgcccgtggccctggaccccggcgccaagatcagcgtgatcgtggagaccgtgtacacccacgtgctgcacccctaccccacccagatcacccagagcgagaagcagttcgtggtgttcgagggcaaccactacttctacagcccctaccccaccaagacccagaccatgagagtgaagctggccagcagaaacgtggagagctacaccaagctgggcaaccccaccagaagcgaggacctgctggactacggccccttcagagacgtgcccgcctacagccaggacaccttcaaggtgcactacgagaacaacagccccttcctgaccatcaccagcatgaccagagtgatcgaggtgagccactggggcaacatcgccgtggaggagaacgtggacctgaagcacaccggcgccgtgctgaagggccccttcagcagatacgactaccagagacagcccgacagcggcatcagcagcatcagaagcttcaagaccatcctgcccgccgccgcccaggacgtgtactacagagacgagatcggcaacgtgagcaccagccacctgctgatcctggacgacagcgtggagatggagatcagacccagattccccctgttcggcggctggaagacccactacatcgtgggctacaacctgcccagctacgagtacctgtacaacctgggcgaccagtacgccctgaagatgagattcgtggaccacgtgttcgacgagcaggtgatcgacagcctgaccgtgaagatcatcctgcccgagggcgccaagaacatcgagatcgacagcccctacgagatcagcagagcccccgacgagctgcactacacctacctggacaccttcggcagacccgtgatcgtggcctacaagaagaacctggtggagcagcacatccaggacatcgtggtgcactacaccttcaacaaggtgctgatgctgcaggagcccctgctggtggtggccgccttctacatcctgttcttcaccgtgatcatctacgtgagactggacttcagcatcaccaaggaccccgccgccgaggccagaatgaaggtggcctgcatcaccgagcaggtgctgaccctggtgaacaagagaatcggcctgtacagacacttcgacgagaccgtgaacagatacaagcagagcagagacatcagcaccctgaacagcggcaagaagagcctggagaccgagcacaaggccctgaccagcgagatcgccctgctgcagagcagactgaagaccgagggcagcgacctgtgcgacagagtgagcgagatgcagaagctggacgcccaggtgaaggagctggtgctgaagagcgccgtggaggccgagagactggtggccggcaagctgaagaaggacacctacatcgagaacgagaagctgatcagcggcaagagacaggagctggtgaccaagatcgaccacatcctggacgccctgtag

SEQ ID NO: 97344 - DNA, 1308 bp, Artificial Sequence
  Description of Artificial Sequence: Synthetic coding sequence
atgagagtgaagctggccagcagaaacgtggagagctacaccaagctgggcaaccccaccagaagcgaggacctgctggactacggccccttcagagacgtgcccgcctacagccaggacaccttcaaggtgcactacgagaacaacagccccttcctgaccatcaccagcatgaccagagtgatcgaggtgagccactggggcaacatcgccgtggaggagaacgtggacctgaagcacaccggcgccgtgctgaagggccccttcagcagatacgactaccagagacagcccgacagcggcatcagcagcatcagaagcttcaagaccatcctgcccgccgccgcccaggacgtgtactacagagacgagatcggcaacgtgagcaccagccacctgctgatcctggacgacagcgtggagatggagatcagacccagattccccctgttcggcggctggaagacccactacatcgtgggctacaacctgcccagctacgagtacctgtacaacctgggcgaccagtacgccctgaagatgagattcgtggaccacgtgttcgacgagcaggtgatcgacagcctgaccgtgaagatcatcctgcccgagggcgccaagaacatcgagatcgacagcccctacgagatcagcagagcccccgacgagctgcactacacctacctggacaccttcggcagacccgtgatcgtggcctacaagaagaacctggtggagcagcacatccaggacatcgtggtgcactacaccttcaacaaggtgctgatgctgcaggagcccctgctggtggtggccgccttctacatcctgttcttcaccgtgatcatctacgtgagactggacttcagcatcaccaaggaccccgccgccgaggccagaatgaaggtggcctgcatcaccgagcaggtgctgaccctggtgaacaagagaatcggcctgtacagacacttcgacgagaccgtgaacagatacaagcagagcagagacatcagcaccctgaacagcggcaagaagagcctggagaccgagcacaaggccctgaccagcgagatcgccctgctgcagagcagactgaagaccgagggcagcgacctgtgcgacagagtgagcgagatgcagaagctggacgcccaggtgaaggagctggtgctgaagagcgccgtggaggccgagagactggtggccggcaagctgaagaaggacacctacatcgagaacgagaagctgatcagcggcaagagacaggagctggtgaccaagatcgaccacatcctggacgccctgtag

SEQ ID NO: 97345 - DNA, 1137 bp, Artificial Sequence
  Description of Artificial Sequence: Synthetic coding sequence
atgaccagagtgatcgaggtgagccactggggcaacatcgccgtggaggagaacgtggacctgaagcacaccggcgccgtgctgaagggccccttcagcagatacgactaccagagacagcccgacagcggcatcagcagcatcagaagcttcaagaccatcctgcccgccgccgcccaggacgtgtactacagagacgagatcggcaacgtgagcaccagccacctgctgatcctggacgacagcgtggagatggagatcagacccagattccccctgttcggcggctggaagacccactacatcgtgggctacaacctgcccagctacgagtacctgtacaacctgggcgaccagtacgccctgaagatgagattcgtggaccacgtgttcgacgagcaggtgatcgacagcctgaccgtgaagatcatcctgcccgagggcgccaagaacatcgagatcgacagcccctacgagatcagcagagcccccgacgagctgcactacacctacctggacaccttcggcagacccgtgatcgtggcctacaagaagaacctggtggagcagcacatccaggacatcgtggtgcactacaccttcaacaaggtgctgatgctgcaggagcccctgctggtggtggccgccttctacatcctgttcttcaccgtgatcatctacgtgagactggacttcagcatcaccaaggaccccgccgccgaggccagaatgaaggtggcctgcatcaccgagcaggtgctgaccctggtgaacaagagaatcggcctgtacagacacttcgacgagaccgtgaacagatacaagcagagcagagacatcagcaccctgaacagcggcaagaagagcctggagaccgagcacaaggccctgaccagcgagatcgccctgctgcagagcagactgaagaccgagggcagcgacctgtgcgacagagtgagcgagatgcagaagctggacgcccaggtgaaggagctggtgctgaagagcgccgtggaggccgagagactggtggccggcaagctgaagaaggacacctacatcgagaacgagaagctgatcagcggcaagagacaggagctggtgaccaagatcgaccacatcctggacgccctgtag

SEQ ID NO: 97346 - DNA, 1746 bp, Artificial Sequence
  Description of Artificial Sequence: Synthetic coding sequence
atggaggcccccgccgccggcctgttcctgctgctgctgctgggcacctgggcccccgcccccggcagcgccagcagcgaggccccccccctgatcaacgaggacgtgaagagaaccgtggacctgagcagccacctggccaaggtgaccgccgaggtggtgctggcccacctgggcgtgcaggtgaagggcgaggacgaggaggagaacaacctggaggtgagagagaccaagatcaagggcaagagcggcagattcttcaccgtgaagctgcccgtggccctggaccccggcgccaagatcagcgtgatcgtggagaccgtgtacacccacgtgctgcacccctaccccacccagatcacccagagcgagaagcagttcgtggtgttcgagggcaaccactacttctacagcccctaccccaccaagacccagaccatgagagtgaagctggccagcagaaacgtggagagctacaccaagctgggcaaccccaccagaagcgaggacctgctggactacggccccttcagagacgtgcccgcctacagccaggacaccttcaaggtgcactacgagaacaacagccccttcctgaccatcaccagcatgaccagagtgatcgaggtgagccactggggcaacatcgccgtggaggagaacgtggacctgaagcacaccggcgccgtgctgaagggccccttcagcagatacgactaccagagacagcccgacagcggcatcagcagcatcagaagcttcaagaccatcctgcccgccgccgcccaggacgtgtactacagagacgagatcggcaacgtgagcaccagccacctgctgatcctggacgacagcgtggagatggagatcagacccagattccccctgttcggcggctggaagacccactacatcgtgggctacaacctgcccagctacgagtacctgtacaacctgggcgaccagtacgccctgaagatgagattcgtggaccacgtgttcgacgagcaggtgatcgacagcctgaccgtgaagatcatcctgcccgagggcgccaagaacatcgagatcgacagcccctacgagatcagcagagcccccgacgagctgcactacacctacctggacaccttcggcagacccgtgatcgtggcctacaagaagaacctggtggagcagcacatccaggacatcgtggtgcactacaccttcaacaaggtgctgatgctgcaggagcccctgctggtggtggccgccttctacatcctgttcttcaccgtgatcatctacgtgagactggacttcagcatcaccaaggaccccgccgccgaggccagaatgaaggtggcctgcatcaccgagcaggtgctgaccctggtgaacaagagaatcggcctgtacagacacttcgacgagaccgtgaacagatacaagcagagcagagacatcagcaccctgaacagcggcaagaagagcctggagaccgagcacaaggccctgaccagcgagatcgccctgctgcagagcagactgaagaccgagggcagcgacctgtgcgacagagtgagcgagatgcagaagctggacgcccaggtgaaggagctggtgctgaagagcgccgtggaggccgagagactggtggccggcaagctgaagaaggacacctacatcgagaacgagaagctgatcagcggcaagagacaggagctggtgaccaagatcgaccacatcctggacgccctgtag

SEQ ID NO: 97347 - DNA, 1896 bp, Artificial Sequence
  Description of Artificial Sequence: Synthetic coding sequence
atggccccccccggcagcagcaccgtgttcctgctggccctgaccatcatcgccagcacctgggccctgacccccacccactacctgaccaagcacgacgtggagagactgaaggccagcctggacagacccttcaccaacctggagagcgccttctacagcatcgtgggcctgagcagcctgggcgcccaggtgcccgacgccaagaaggcctgcacctacatcagaagcaacctggaccccagcaacgtggacagcctgttctacgccgcccaggccagccaggccctgagcggctgcgagatcagcatcagcaacgagaccaaggacctgctgctggccgccgtgagcgaggacagcagcgtgacccagatctaccacgccgtggccgccctgagcggcttcggcctgcccctggccagccaggaggccctgagcgccctgaccgccagactgagcaaggaggagaccgtgctggccaccgtgcaggccctgcagaccgccagccacctgagccagcaggccgacctgagaagcatcgtggaggagatcgaggacctggtggccagactggacgagctgggcggcgtgtacctgcagttcgaggagggcctggagaccaccgccctgttcgtggccgccacctacaagctgatggaccacgtgggcaccgagcccagcatcaaggaggaccaggtgatccagctgatgaacgccatcttcagcaagaagaacttcgagagcctgagcgaggccttcagcgtggccagcgccgccgccgtgctgagccacaacagataccacgtgcccgtggtggtggtgcccgagggcagcgccagcgacacccacgagcaggccatcctgagactgcaggtgaccaacgtgctgagccagcccctgacccaggccaccgtgaagctggagcacgccaagagcgtggccagcagagccaccgtgctgcagaagaccagcttcacccccgtgggcgacgtgttcgagctgaacttcatgaacgtgaagttcagcagcggctactacgacttcctggtggaggtggagggcgacaacagatacatcgccaacaccgtggagctgagagtgaagatcagcaccgaggtgggcatcaccaacgtggacctgagcaccgtggacaaggaccagagcatcgcccccaagaccaccagagtgacctaccccgccaaggccaagggcaccttcatcgccgacagccaccagaacttcgccctgttcttccagctggtggacgtgaacaccggcgccgagctgaccccccaccagaccttcgtgagactgcacaaccagaagaccggccaggaggtggtgttcgtggccgagcccgacaacaagaacgtgtacaagttcgagctggacaccagcgagagaaagatcgagttcgacagcgccagcggcacctacaccctgtacctgatcatcggcgacgccaccctgaagaaccccatcctgtggaacgtggccgacgtggtgatcaagttccccgaggaggaggcccccagcaccgtgctgagccagaacctgttcacccccaagcaggagatccagcacctgttcagagagcccgagaagagaccccccaccgtggtgagcaacaccttcaccgccctgatcctgagccccctgctgctgctgttcgccctgtggatcagaatcggcgccaacgtgagcaacttcaccttcgcccccagcaccatcatcttccacctgggccacgccgccatgctgggcctgatgtacgtgtactggacccagctgaacatgttccagaccctgaagtacctggccatcctgggcagcgtgaccttcctggccggcaacagaatgctggcccagcaggccgtgaagagaaccgcccactag

SEQ ID NO: 97348 - DNA, 1038 bp, Artificial Sequence
  Description of Artificial Sequence: Synthetic coding sequence
gtgagcccccagggcagcagcaccgtgttcctgctggccctgaccatcatcgccagcacctgggccctgacccccacccactacctgaccaagcacgacgtggagagactgaaggccagcctggacagacccttcaccaacctggagagcgccttctacagcatcgtgggcctgagcagcctgggcgcccaggtgcccgacgccaagaaggcctgcacctacatcagaagcaacctggaccccagcaacgtggacagcctgttctacgccgcccaggccagccaggccctgagcggctgcgagatcagcatcagcaacgagaccaaggacctgctgctggccgccgtgagcgaggacagcagcgtgacccagatctaccacgccgtggccgccctgagcggcttcggcctgcccctggccagccaggaggccctgagcgccctgaccgccagactgagcaaggaggagaccgtgctggccagagtgtggagcaccgtgctggagagcagaagcctgttcagcaagagaaccgtgcaggccctgcagaccgccagccacctgagccagcaggccgacctgagaagcatcgtggaggagatcgaggacctggtggccagactggacgagctgggcggcgtgtacctgcagttcgaggagggcctggagaccaccgccctgttcgtggccgccacctacaagctgatggaccacgtgggcaccgagcccagcatcaaggaggaccaggtgatccagctgatgaacgccatcttcagcaagaagaacttcgagagcctgagcgaggccttcagcgtggccagcgccgccgccgtgctgagccacaacagataccacgtgcccgtggtggtggtgcccgagggcagcgccagcgacacccacgagcaggccatcctgagactgcaggtgaccaacgtgctgagccagcccctgacccaggccaccgtgaagctggagcacgccaagagcgtggccagcagagccaccgtgctgcagaagaccagcttcacccccgtgggctag

SEQ ID NO: 97349 - DNA, 1848 bp, Artificial Sequence
  Description of Artificial Sequence: Synthetic coding sequence
atggccccccccggcagcagcaccgtgttcctgctggccctgaccatcatcgccagcacctgggccctgacccccacccactacctgaccaagcacgacgtggagagactgaaggccagcctggacagacccttcaccaacctggagagcgccttctacagcatcgtgggcctgagcagcctgggcgcccaggtgcccgacgccaagatcagcatcagcaacgagaccaaggacctgctgctggccgccgtgagcgaggacagcagcgtgacccagatctaccacgccgtggccgccctgagcggcttcggcctgcccctggccagccaggaggccctgagcgccctgaccgccagactgagcaaggaggagaccgtgctggccaccgtgcaggccctgcagaccgccagccacctgagccagcaggccgacctgagaagcatcgtggaggagatcgaggacctggtggccagactggacgagctgggcggcgtgtacctgcagttcgaggagggcctggagaccaccgccctgttcgtggccgccacctacaagctgatggaccacgtgggcaccgagcccagcatcaaggaggaccaggtgatccagctgatgaacgccatcttcagcaagaagaacttcgagagcctgagcgaggccttcagcgtggccagcgccgccgccgtgctgagccacaacagataccacgtgcccgtggtggtggtgcccgagggcagcgccagcgacacccacgagcaggccatcctgagactgcaggtgaccaacgtgctgagccagcccctgacccaggccaccgtgaagctggagcacgccaagagcgtggccagcagagccaccgtgctgcagaagaccagcttcacccccgtgggcgacgtgttcgagctgaacttcatgaacgtgaagttcagcagcggctactacgacttcctggtggaggtggagggcgacaacagatacatcgccaacaccgtggagctgagagtgaagatcagcaccgaggtgggcatcaccaacgtggacctgagcaccgtggacaaggaccagagcatcgcccccaagaccaccagagtgacctaccccgccaaggccaagggcaccttcatcgccgacagccaccagaacttcgccctgttcttccagctggtggacgtgaacaccggcgccgagctgaccccccaccagaccttcgtgagactgcacaaccagaagaccggccaggaggtggtgttcgtggccgagcccgacaacaagaacgtgtacaagttcgagctggacaccagcgagagaaagatcgagttcgacagcgccagcggcacctacaccctgtacctgatcatcggcgacgccaccctgaagaaccccatcctgtggaacgtggccgacgtggtgatcaagttccccgaggaggaggcccccagcaccgtgctgagccagaacctgttcacccccaagcaggagatccagcacctgttcagagagcccgagaagagaccccccaccgtggtgagcaacaccttcaccgccctgatcctgagccccctgctgctgctgttcgccctgtggatcagaatcggcgccaacgtgagcaacttcaccttcgcccccagcaccatcatcttccacctgggccacgccgccatgctgggcctgatgtacgtgtactggacccagctgaacatgttccagaccctgaagtacctggccatcctgggcagcgtgaccttcctggccggcaacagaatgctggcccagcaggccgtgaagagaatcgccgccgagcagagcagcagactggccaagtacagaaccctgagaaccgcccactag

SEQ ID NO: 97350 - DNA, 441 bp, Artificial Sequence
  Description of Artificial Sequence: Synthetic coding sequence
ggcacctacaccctgtacctgatcatcggcgacgccaccctgaagaaccccatcctgtggaacgtggccgacgtggtgatcaagttccccgaggaggaggcccccagcaccgtgctgagccagaacctgttcacccccaagcaggagatccagcacctgttcagagagcccgagaagagaccccccaccgtggtgagcaacaccttcaccgccctgatcctgagccccctgctgctgctgttcgccctgtggatcagaatcggcgccaacgtgagcaacttcaccttcgcccccagcaccatcatcttccacctgggccacgccgagcagcacatcagcagcagaagaaagatggagatcctgaagaccgagtgccaggagaaggagagcagaaccatccacagcatgagaagaaagatggagaagaagaacttcatctag

SEQ ID NO: 97351 - DNA, 1038 bp, Artificial Sequence
  Description of Artificial Sequence: Synthetic coding sequence
atggccccccccggcagcagcaccgtgttcctgctggccctgaccatcatcgccagcacctgggccctgacccccacccactacctgaccaagcacgacgtggagagactgaaggccagcctggacagacccttcaccaacctggagagcgccttctacagcatcgtgggcctgagcagcctgggcgcccaggtgcccgacgccaagaaggcctgcacctacatcagaagcaacctggaccccagcaacgtggacagcctgttctacgccgcccaggccagccaggccctgagcggctgcgagatcagcatcagcaacgagaccaaggacctgctgctggccgccgtgagcgaggacagcagcgtgacccagatctaccacgccgtggccgccctgagcggcttcggcctgcccctggccagccaggaggccctgagcgccctgaccgccagactgagcaaggaggagaccgtgctggccagagtgtggagcaccgtgctggagagcagaagcctgttcagcaagagaaccgtgcaggccctgcagaccgccagccacctgagccagcaggccgacctgagaagcatcgtggaggagatcgaggacctggtggccagactggacgagctgggcggcgtgtacctgcagttcgaggagggcctggagaccaccgccctgttcgtggccgccacctacaagctgatggaccacgtgggcaccgagcccagcatcaaggaggaccaggtgatccagctgatgaacgccatcttcagcaagaagaacttcgagagcctgagcgaggccttcagcgtggccagcgccgccgccgtgctgagccacaacagataccacgtgcccgtggtggtggtgcccgagggcagcgccagcgacacccacgagcaggccatcctgagactgcaggtgaccaacgtgctgagccagcccctgacccaggccaccgtgaagctggagcacgccaagagcgtggccagcagagccaccgtgctgcagaagaccagcttcacccccgtgggctag

SEQ ID NO: 97352 - DNA, 417 bp, Artificial Sequence
  Description of Artificial Sequence: Synthetic coding sequence
gagctggacaccagcgagagaaagatcgagttcgacagcgccagcggcacctacaccctgtacctgatcatcggcgacgccaccctgaagaaccccatcctgtggaacgtggccgacgtggtgatcaagttccccgaggaggaggcccccagcaccgtgctgagccagaacctgttcacccccaagcaggagatccagtggatcagaatcggcgccaacgtgagcaacttcaccttcgcccccagcaccatcatcttccacctgggccacgccgccatgctgggcctgatgtacgtgtactggacccagctgaacatgttccagaccctgaagtacctggccatcctgggcagcgtgaccttcctggccggcaacagaatgctggcccagcaggccgtgaagagaaccgccgagtag

SEQ ID NO: 97353 - DNA, 417 bp, Artificial Sequence
  Description of Artificial Sequence: Synthetic coding sequence
gagctggacaccagcgagagaaagatcgagttcgacagcgccagcggcacctacaccctgtacctgatcatcggcgacgccaccctgaagaaccccatcctgtggaacgtggccgacgtggtgatcaagttccccgaggaggaggcccccagcaccgtgctgagccagaacctgttcacccccaagcaggagatccagtggatcagaatcggcgccaacgtgagcaacttcaccttcgcccccagcaccatcatcttccacctgggccacgccgccatgctgggcctgatgtacgtgtactggacccagctgaacatgttccagaccctgaagtacctggccatcctgggcagcgtgaccttcctggccggcaacagaatgctggcccagcaggccgtgaagagaaccgcccactag

SEQ ID NO: 97354 - DNA, 504 bp, Artificial Sequence
  Description of Artificial Sequence: Synthetic coding sequence
atgcagagaaccgtgcaggccctgcagaccgccagccacctgagccagcaggccgacctgagaagcatcgtggaggagatcgaggacctggtggccagactggacgagctgggcggcgtgtacctgcagttcgaggagggcctggagaccaccgccctgttcgtggccgccacctacaagctgatggaccacgtgggcaccgagcccagcatcaaggaggaccaggtgatccagctgatgaacgccatcttcagcaagaagaacttcgagagcctgagcgaggccttcagcgtggccagcgccgccgccgtgctgagccacaacagataccacgtgcccgtggtggtggtgcccgagggcagcgccagcgacacccacgagcaggccatcctgagactgcaggtgaccaacgtgctgagccagcccctgacccaggccaccgtgaagctggagcacgccaagagcgtggccagcagagccaccgtgctgcagaagaccagctag

SEQ ID NO: 97355 - DNA, 444 bp, Artificial Sequence
  Description of Artificial Sequence: Synthetic coding sequence
tgaggcacctacaccctgtacctgatcatcggcgacgccaccctgaagaaccccatcctgtggaacgtggccgacgtggtgatcaagttccccgaggaggaggcccccagcaccgtgctgagccagaacctgttcacccccaagcaggagatccagcacctgttcagagagcccgagaagagaccccccaccgtggtgagcaacaccttcaccgccctgatcctgagccccctgctgctgctgttcgccctgtggatcagaatcggcgccaacgtgagcaacttcaccttcgcccccagcaccatcatcttccacctgggccacgccgagcagcacatcagcagcagaagaaagatggagatcctgaagaccgagtgccaggagaaggagagcagaaccatccacagcatgagaagaaagatggagaagaagaacttcatctag

SEQ ID NO: 97356 - DNA, 936 bp, Artificial Sequence
  Description of Artificial Sequence: Synthetic coding sequence
atgcagagacccggccccttcagcaccctgtacggcagagtgctggcccccctgcccggcagagccggcggcgccgccagcggcggcggcggcaacagctgggacctgcccggcagccacgtgagactgcccggcagagcccagagcggcaccagaggcggcgccggcaacaccagcaccagctgcggcgacagcaacagcatctgccccgcccccagcaccatgagcaaggccgaggaggccaagaagctggccggcagagccgccgtggagaaccacgtgagaaacaaccaggtgctgggcatcggcagcggcagcaccatcgtgcacgccgtgcagagaatcgccgagagagtgaagcaggagaacctgaacctggtgtgcatccccaccagcttccaggccagacagctgatcctgcagtacggcctgaccctgagcgacctggacagacaccccgagatcgacctggccatcgacggcgccgacgaggtggacgccgacctgaacctgatcaagggcggcggcggctgcctgacccaggagaagatcgtggccggctacgccagcagattcatcgtgatcgccgacttcagaaaggacagcaagaacctgggcgaccagtggcacaagggcatccccatcgaggtgatccccatggcctacgtgcccgtgagcagagccgtgagccagaagttcggcggcgtggtggagctgagaatggccgtgaacaaggccggccccgtggtgaccgacaacggcaacttcatcctggactggaagttcgacagagtgcacaagtggagcgaggtgaacaccgccatcaagatgatccccggcgtggtggacaccggcctgttcatcaacatggccgagagagtgtacttcggcatgcaggacggcagcgtgaacatgagagagaagcccttctgctag

SEQ ID NO: 97357 - DNA, 534 bp, Artificial Sequence
  Description of Artificial Sequence: Synthetic coding sequence
gccagacagctgatcctgcagtacggcctgaccctgagcgacctggacagacaccccgagatcgacctggccatcgacggcgccgacgaggtggacgccgacctgaacctgatcaagggcggcggcggctgcctgacccaggagaagatcgtggccggctacgccagcagattcatcgtgatcgccgacttcagaaaggacagcaagaacctgggcgaccagtggcacaagggcatccccatcgaggtgatccccatggcctacgtgcccgtgagcagagccgtgagccagaagttcggcggcgtggtggagctgagaatggccgtgaacaaggccggccccgtggtgaccgacaacggcaacttcatcctggactggaagttcgacagagtgcacaagtggagcgaggtgaacaccgccatcaagatgatccccggcgtggtggacaccggcctgttcatcaacatggccgagagagtgtacttcggcatgcaggacggcagcgtgaacatgagagagaagcccttctgctag

SEQ ID NO: 97358 - DNA, 492 bp, Artificial Sequence
  Description of Artificial Sequence: Synthetic coding sequence
atgagaatcgagaagtgctacttctgcagcggccccatctaccccggccacggcatgatgttcgtgagaaacgactgcaaggtgttcagattctgcaagagcaagtgccacaagaacttcaagaagaagagaaaccccagaaaggtgagatggaccaaggccttcagaaaggccgccggcaaggagctgaccgtggacaacagcttcgagttcgagaagagaagaaacgagcccatcaagtaccagagagagctgtggaacaagaccatcgacgccatgaagagagtggaggagatcaagcagaagagacaggccaagttcatcatgaacagactgaagaagaacaaggagctgcagaaggtgcaggacatcaaggaggtgaagcagaacatccacctgatcagagcccccctggccggcaagggcaagcagctggaggagaagatggtgcagcagctgcaggaggacgtggacatggaggacgccccctag

SEQ ID NO: 97359 - DNA, 1161 bp, Artificial Sequence
  Description of Artificial Sequence: Synthetic coding sequence
atgtgcagcagcgtggccgccaagctgtggttcctgaccgacagaagaatcagagaggactacccccagaaggagatcctgagagccctgaaggccaagtgctgcgaggaggagctggacttcagagccgtggtgatggacgaggtggtgctgaccatcgagcagggcaacctgggcctgagaatcaacggcgagctgatcaccgcctacccccaggtggtggtggtgagagtgcccaccccctgggtgcagagcgacagcgacatcaccgtgctgagacacctggagaagatgggctgcagactgatgaacagaccccaggccatcctgaactgcgtgaacaagttctggaccttccaggagctggccggccacggcgtgcccctgcccgacaccttcagctacggcggccacgagaacttcgccaagatgatcgacgaggccgaggtgctggagttccccatggtggtgaagaacaccagaggccacagaggcaaggccgtgttcctggccagagacaagcaccacctggccgacctgagccacctgatcagacacgaggccccctacctgttccagaagtacgtgaaggagagccacggcagagacgtgagagtgatcgtggtgggcggcagagtggtgggcaccatgctgagatgcagcaccgacggcagaatgcagagcaactgcagcctgggcggcgtgggcatgatgtgcagcctgagcgagcagggcaagcagctggccatccaggtgagcaacatcctgggcatggacgtgtgcggcatcgacctgctgatgaaggacgacggcagcttctgcgtgtgcgaggccaacgccaacgtgggcttcatcgccttcgacaaggcctgcaacctggacgtggccggcatcatcgccgactacgccgccagcctgctgcccagcggcagactgaccagaagaatgagcctgctgagcgtggtgagcaccgccagcgagaccagcgagcccgagctgggcccccccgccagcaccgccgtggacaacatgagcgccagcagcagcagcgtggacagcgaccccgagagcaccgagagagagctgctgaccaagctgcccggcggcctgttcaacatgaaccagctgctggccaacgagatcaagctgctggtggactag

SEQ ID NO: 97360 - DNA, 1161 bp, Artificial Sequence; identical to SEQ ID NO: 97359
  Description of Artificial Sequence: Synthetic coding sequence

SEQ ID NO: 97361 - DNA, 1161 bp, Artificial Sequence; identical to SEQ ID NO: 97359
  Description of Artificial Sequence: Synthetic coding sequence

SEQ ID NO: 97362 - DNA, 288 bp, Artificial Sequence
  Description of Artificial Sequence: Synthetic coding sequence
atgtgcagcagcgtggccgccaagctgtggttcctgaccgacagaagaatcagagaggactacccccagaaggagatcctgagagccctgaaggccaagtgctgcgaggaggagctggacttcagagccgtggtgatggacgaggtggtgctgaccatcgagcagggcaacctgggcctgagaatcaacggcgagctgatcaccgcctacccccaggtggtggtggtgagagtgcccaccccctgggtgcagagcgacagcgacatcaccgtgctgagacacctgtag

SEQ ID NO: 97363 - DNA, 345 bp, Artificial Sequence
  Description of Artificial Sequence: Synthetic coding sequence
atgtgcagcagcgtggccgccaagctgtggttcctgaccgacagaagaatcagagaggactacccccagaaggagatcctgagagccctgaaggccaagtgctgcgaggaggagctggacttcagagccgtggtgatggacgaggtggtgctgaccatcgagcagggcaacctgggcctgagaatcaacggcgagctgatcaccgcctacccccaggtggtggtggtgagagtgcccaccccctgggtgcagagcgacagcgacatcaccgtgctgagacacctggagaagatgggctgcagactgatgaacagaccccaggccatcctgaactgcgtgaactag

SEQ ID NO: 97364 - DNA, 645 bp, Artificial Sequence
  Description of Artificial Sequence: Synthetic coding sequence
atgggcagaagacccgccagatgctacagatactgcaagaacaagccctaccccaagagcagattctgcagaggcgtgcccgacgccaagatcagaatcttcgacctgggcagaaagaaggccaaggtggacgagttccccctgtgcggccacatggtgagcgacgagtacgagcagctgagcagcgaggccctggaggccgccagaatctgcgccaacaagtacatggtgaagagctgcggcaaggacggcttccacatcagagtgagactgcaccccttccacgtgatcagaatcaacaagatgctgagctgcgccggcgccgacagactgcagaccggcatgagaggcgccttcggcaagccccagggcaccgtggccagagtgcacatcggccaggtgatcatgagcatcagaaccaagctgcagaacaaggagcacgtgatcgaggccctgagaagagccaagttcaagttccccggcagacagaagatccacatcagcaagaagtggggcttcaccaagttcaacgccgacgagttcgaggacatggtggccgagaagagactgatccccgacggctgcggcgtgaagtacatccccaacagaggccccctggacaagtggagagccctgcacagctag

SEQ ID NO: 97365 - DNA, 645 bp, Artificial Sequence; identical to SEQ ID NO: 97364
  Description of Artificial Sequence: Synthetic coding sequence

SEQ ID NO: 97366 - DNA, 645 bp, Artificial Sequence; identical to SEQ ID NO: 97364
  Description of Artificial Sequence: Synthetic coding sequence

SEQ ID NO: 97367 - DNA, 606 bp, Artificial Sequence
  Description of Artificial Sequence: Synthetic coding sequence
atgggcagaagacccgccagatgctacagatactgcaagaacaagccctaccccaagagcagattctgcagaggcgtgcccgacgccaagatcagaatcttcgacctgggcagaaagaaggccaaggtggacgagttccccctgtgcggccacatggtgagcgacgagtacgagcagctgagcagcgaggccctggaggccgccagaatctgcgccaacaagtacatggtgaagagctgcggcaaggacggcttccacatcagagtgagactgcaccccttccacgtgatcagaatcaacaagatgctgagctgcgccggcgccgacagactgcagaccggcatgagaggcgccttcggcaagccccagggcaccgtggccagagtgcacatcggccaggtgatcatgagcatcagaaccaagctgcagaacaaggagcacgtgatcgaggccctgagaagagccaagttcaagttccccggcagacagaagatccacatcagcaagaagtggggcttcaccaagttcaacgccgacgagttcgaggacatggtggccgagaagagactgatccccgacggctgcggcgtgaagtacatcccctag

SEQ ID NO: 97368 - DNA, 327 bp, Artificial Sequence
  Description of Artificial Sequence: Synthetic coding sequence
cccaagagcagattctgcagaggcgtgcccgacgccaagatcagaatcttcgacctgggcagaaagaaggccaaggtggacgagttccccctgtgcggccacatggtgagcgacgagtacgagcagctgagcagcgaggccctggaggccgccagaatctgcgccaacaagtacatggtgaagagctgcggcaaggacggcttccacatcagagtgagactgcaccccttccacgtgatcagaatcaacaagatgctgagctgcgccggcgccgacagacccaccctgctgtgccagtgctgggagaccagcagaaacaccagctag

SEQ ID NO: 97369 - DNA, 546 bp, Artificial Sequence
  Description of Artificial Sequence: Synthetic coding sequence
atgggcagaagacccgccagatgctacagatactgcaagaacaagccctaccccaagagcagattctgcagaggcgtgcccgacgccaagatcagaatcttcgacctgggcagaaagaaggccaaggtggacgagttccccctgtgcggccacatggtgagcgacgagtacgagcagctgagcagcgaggccctggaggccgccagaatctgcgccaacaagtacatggtgaagagctgcggcaaggacggcttccacatcagagtgagactgcaccccttccacgtgatcagaatcaacaagatgctgagctgcgccggcgccgacagaagcaccagccagagaagcggcgccagccccagcagcatgctgatgaacctgaagacctggtggctgaagagcggcagcagccagatggccgtgggcagcagcaccagccccatcgtggccctgtggaccagcggcggcccctgcacccacgagggcttccagtgcgccgcccccctgctgatcctgaccaacaagttctacttcctgagcacctag

SEQ ID NO: 97370 - DNA, 537 bp, Artificial Sequence
  Description of Artificial Sequence: Synthetic coding sequence
atggcccaggaccagggcgagaaggagaaccccatgagagagctgagaatcagaaagctgtgcctgaacatctgcgtgggcgagagcggcgacagactgaccagagccgccaaggtgctggagcagctgaccggccagacccccgtgttcagcaaggccagatacaccgtgagaagcttcggcatcagaagaaacgagaagatcgccgtgcactgcaccgtgagaggcgccaaggccgaggagatcctggagaagggcctgaaggtgagagagtacgagctgagaaagaacaacttcagcgacaccggcaacttcggcttcggcatccaggagcacatcgacctgggcatcaagtacgaccccagcatcggcatctacggcctggacttctacgtggtgctgggcagacccggcttcagcatcgccgacaagaagagaagaaccggctgcatcggcgccaagcacagaatcagcaaggaggaggccatgagatggttccagcagaagtacgacggcatcatcctgcccggcaagtag

SEQ ID NO: 97371 - DNA, 396 bp, Artificial Sequence
  Description of Artificial Sequence: Synthetic coding sequence
caggaccagggcgagaaggagaaccccatgagagagctgagaatcagaaagctgtgcctgaacatctgcgtgggcgagagcggcgacagactgaccagagccgccaaggtgctggagcagctgaccggccagacccccgtgttcagcaaggccagatacaccgtgagaagcttcggcatcagaagaaacgagaagatcgccgtgcactgcaccgtgagaggcgccaaggccgaggagatcctggagaagggcctgaaggtgagagagtacgagctgagaaagaacaacttcagcgacaccggcaacttcggcttcggcatccaggagcacatcgacctgggcatcaagtacgaccccagcatcggcatctacggcctggacttctacgtggtgtag

SEQ ID NO: 97372 - DNA, 525 bp, Artificial Sequence
  Description of Artificial Sequence: Synthetic coding sequence
caggaccagggcgagaaggagaaccccatgagagagctgagaatcagaaagctgtgcctgaacatctgcgtgggcgagagcggcgacagactgaccagagccgccaaggtgctggagcagctgaccggccagacccccgtgttcagcaaggccagatacaccgtgagaagcttcggcatcagaagaaacgagaagatcgccgtgcactgcaccgtgagaggcgccaaggccgaggagatcctggagaagggcctgaaggtgagagagtacgagctgagaaagaacaacttcagcgacaccggcaacttcggcttcggcatccaggagcacatcgacctgggcatcaagtacgaccccagcatcggcatctacggcctggacttctacgtggtgctgggcagacccggcttcagcatcgccgacaagaagagaagaaccggctgcatcggcgccaagcacagaatcagcaaggaggaggccatgagatggttccagcagaaggtgaagctgatctacctgaagtag

SEQ ID NO: 97373 - DNA, 498 bp, Artificial Sequence
  Description of Artificial Sequence: Synthetic coding sequence
atgccccccaagttcgaccccaacgagatcaaggtggtgtacctgagatgcaccggcggcgaggtgggcgccaccagcgccctggcccccaagatcggccccctgggcctgagccccaagaaggtgggcgacgacatcgccaaggccaccggcgactggaagggcctgagaatcaccgtgaagctgaccatccagaacagacaggcccagatcgaggtggtgcccagcgccagcgccctgatcatcaaggccctgaaggagccccccagagacagaaagaagcagaagaacatcaagcacagcggcaacatcaccttcgacgagatcgtgaacatcgccagacagatgagacacagaagcctggccagagagctgagcggcaccatcaaggagatcctgggcaccgcccagagcgtgggctgcaacgtggacggcagacacccccacgacatcatcgacgacatcaacagcggcgccgtggagtgccccgccagctag

SEQ ID NO: 97374 - DNA, 399 bp, Artificial Sequence
  Description of Artificial Sequence: Synthetic coding sequence
atgccccccaagttcgaccccaacgagatcaaggtggtgtacctgagatgcaccggcggcgaggtgggcgccaccagcgccctggcccccaagatcggccccctgggcctgatcgaggtggtgcccagcgccagcgccctgatcatcaaggccctgaaggagccccccagagacagaaagaagcagaagaacatcaagcacagcggcaacatcaccttcgacgagatcgtgaacatcgccagacagatgagacacagaagcctggccagagagctgagcggcaccatcaaggagatcctgggcaccgcccagagcgtgggctgcaacgtggacggcagacacccccacgacatcatcgacgacatcaacagcggcgccgtggagtgccccgccagctag

SEQ ID NO: 97375 - DNA, 636 bp, Artificial Sequence
  Description of Artificial Sequence: Synthetic coding sequence
atggcccccagcagaaacggcatggtgctgaagccccacttccacaaggactggcagagaagagtggccacctggttcaaccagcccgccagaaagatcagaagaagaaaggccagacaggccaaggccagaagaatcgcccccagacccgccagcggccccatcagacccatcgtgagatgccccaccgtgagataccacaccaaggtgagagccggcagaggcttcagcctggaggagctgagagtggccggcatccacaagaaggtggccagaaccatcggcatcagcgtggaccccagaagaagaaacaagagcaccgagagcctgcaggccaacgtgcagagactgaaggagtacagaagcaagctgatcctgttccccagaaagcccagcgcccccaagaagggcgacagcagcgccgaggagctgaagctggccacccagctgaccggccccgtgatgcccgtgagaaacgtgtacaagaaggagaaggccagagtgatcaccgaggaggagaagaacttcaaggccttcgccagcctgagaatggccagagccaacgccagactgttcggcatcagagccaagagagccaaggaggccgccgagcaggacgtggagaagaagaagtag

SEQ ID NO: 97376 - DNA, 636 bp, Artificial Sequence; identical to SEQ ID NO: 97375
  Description of Artificial Sequence: Synthetic coding sequence

SEQ ID NO: 97377 - DNA, 495 bp, Artificial Sequence
  Description of Artificial Sequence: Synthetic coding sequence
atggcccccagcagaaacggcatggtgctgaagccccacttccacaaggactggcagagaagagtggccacctggttcaaccagcccgccagaaagatcagaagaagaaaggccagacaggccaaggccagaagaatcgcccccagacccgccagcggccccatcagacccatcgtgagatgccccaccgtgagataccacaccaaggtgagagccggcagaggcttcagcctggaggagctgagagtggccggcatccacaagaagggcgacagcagcgccgaggagctgaagctggccacccagctgaccggccccgtgatgcccgtgagaaacgtgtacaagaaggagaaggccagagtgatcaccgaggaggagaagaacttcaaggccttcgccagcctgagaatggccagagccaacgccagactgttcggcatcagagccaagagagccaaggaggccgccgagcaggacgtggagaagaagaagtag

SEQ ID NO: 97378 - DNA, 615 bp, Artificial Sequence
  Description of Artificial Sequence: Synthetic coding sequence
atgggcgcctacaagtacatccaggagctgtggagaaagaagcagagcgacgtgatgagattcctgctgagagtgagatgctggcagtacagacagctgagcgccctgcacagagcccccagacccaccagacccgacaaggccagaagactgggctacaaggccaagcagggctacgtgatctacagaatcagagtgagaagaggcggcagaaagagacccgtgcccaagggcgccacctacggcaagcccgtgcaccacggcgtgaaccagctgaagttcgccagaagcctgcagagcgtggccgaggagagagccggcagacactgcggcgccctgagagtgctgaacagctactgggtgggcgaggacagcacctacaagttcttcgaggtgatcctgatcgaccccttccacaaggccatcagaagaaaccccgacacccagtggatcaccaagcccgtgcacaagcacagagagatgagaggcctgaccagcgccggcagaaagagcagaggcctgggcaagggccacaagttccaccacaccatcggcggcagcagaagagccgcctggagaagaagaaacaccctgcagctgcacagatacagatag

SEQ ID NO: 97379 - DNA, 615 bp, Artificial Sequence; identical to SEQ ID NO: 97378
  Description of Artificial Sequence: Synthetic coding sequence

SEQ ID NO: 97380 - DNA, 528 bp, Artificial Sequence
  Description of Artificial Sequence: Synthetic coding sequence
atgggcgcctacaagtacatccaggagctgtggagaaagaagcagagcgacgtgatgagattcctgctgagagtgagatgctggcagtacagacagctgagcgccctgcacagagcccccagacccaccagacccgacaaggccagaagactgggctacaaggccaagcagggctacgtgatctacagaatcagagtgagaagaggcggcagaaagagacccgtgcccaagggcgccacctacggcaagcccgtgcaccacggcgtgaaccagctgaagttcgccagaagcctgcagagcgtggccgaggtgaacgccggcagacactgcggcgccctgagagtgctgaacagctactgggtgggcgaggacagcacctacaagttcttcgaggtgatcctgatcgaccccttccacaaggccatcagaagaaaccccgacacccagtggatcaccaagcccgtgcacaagcacagagagatgagaggcctgaccagcgccggcagaaagagcagaggcctgggctag

SEQ ID NO: 97381 - DNA, 615 bp, Artificial Sequence; identical to SEQ ID NO: 97378
  Description of Artificial Sequence: Synthetic coding sequence

SEQ ID NO: 97382 - DNA, 615 bp, Artificial Sequence; identical to SEQ ID NO: 97378
  Description of Artificial Sequence: Synthetic coding sequence

SEQ ID NO: 97383 - DNA, 402 bp, Artificial Sequence
  Description of Artificial Sequence: Synthetic coding sequence
atgggcgcctacaagtacatccaggagctgtggagaaagaagcagagcgacgtgatgagattcctgctgagagtgagatgctggcagtacagacagctgagcgccctgcacagagcccccagacccaccagacccgacaaggccagaagactgggctacaaggccaagcagggctacgtgatctacagaatcagagtgagaagaggcggcagaaagagacccgtgcccaagggcgccacctacggcaagcccgtgcaccacggcgtgaaccagctgaagttcgccagaagcctgcagagcgtggccgaggagagagccggcagacactgcggcgccctgagagtgctgaacagctactgggtgggcgaggacagcacctacaagttcttcgaggtgatctag

SEQ ID NO: 97384 - DNA, 525 bp, Artificial Sequence
  Description of Artificial Sequence: Synthetic coding sequence
atgggcgcctacaagtacatccaggagctgtggagaaagaagcagagcgacgtgatgagattcctgctgagagtgagatgctggcagtacagacagctgagcgccctgcacagagcccccagacccaccagacccgacaaggccagaagactgggctacaaggccaagcagggctacgtgatctacagaatcagagtgagaagaggcggcagaaagagacccgtgcccaagggcgccacctacggcaagcccgtgcaccacggcgtgaaccagctgaagttcgccagaagcctgcagagcgtggccgaggagagagccggcagacactgcggcgccctgagagtgctgaacagctactgggtgggcgaggacagcacctacaagttcttcgaggtgatcctgatcgaccccttccacaaggccatcagaagaaaccccgacacccagtggatcaccaagcccgtgcacaagcacagagagatgagaggcctgaccagcgccggcagaaagagcagaggcctgtag

SEQ ID NO: 97385 - DNA, 615 bp, Artificial Sequence; identical to SEQ ID NO: 97378
  Description of Artificial Sequence: Synthetic coding sequence

SEQ ID NO: 97386 - DNA, 180 bp, Artificial Sequence
  Description of Artificial Sequence: Synthetic coding sequence
atgggcgcctacaagtacatccaggagctgtggagaaagaagcagagcgacgtgatgagattcctgctgagagtgagatgctggcagtacagacagctgagcgccctgcacagagcccccagacccaccagacccgacaaggccagaagactgggctacaaggccaagcagggcacctag

SEQ ID NO: 97387 - DNA, 438 bp, Artificial Sequence
  Description of Artificial Sequence: Synthetic coding sequence
atgggcgcctacaagtacatccaggagctgtggagaaagaagcagagcgacgtgatgagattcctgctgagagtgagatgctggcagtacagacagctgagcgccctgcacagagcccccagacccaccagacccgacaaggccagaagactgggctacaaggccaagcagggctacgtgatctacagaatcagagtgagaagaggcggcagaaagagacccgtgcccaagggcgccacctacggcaagcccgtgcaccacggcgtgaaccagctgaagttcgccagaagcctgcagagcgtggccgaggagagagccggcagacactgcggcgccctgagagtgctgaacagctactggatggagagccacagccacagcggcggcagcgccgtgggccagagcagactgaccgccaccagcgtgagcagagtgtag

SEQ ID NO: 97388 - DNA, 495 bp, Artificial Sequence
  Description of Artificial Sequence: Synthetic coding sequence
atgggcgcctacaagtacatccaggagctgtggagaaagaagcagagcgacgtgatgagattcctgctgagagtgagatgctggcagtacagacagctgagcgccctgcacagagcccccagacccaccagacccgacaaggccagaagactgggctacaaggccaagcagggctacgtgatctacagaatcagagtgagaagaggcggcagaaagagacccgtgcccaagggcgccacctacggcaagcccgtgcaccacggcgtgaaccagctgaagttcgccagaagcctgcagagcgtggccgaggagagagccggcagacactgcggcgccctgagagtgcacaagcacagagagatgagaggcctgaccagcgccggcagaaagagcagaggcctgggcaagggccacaagttccaccacaccatcggcggcagcagaagagccgcctggagaagaagaaacaccctgcagctgcacagatacagatag

SEQ ID NO: 97389 - DNA, 441 bp, Artificial Sequence
  Description of Artificial Sequence: Synthetic coding sequence
atgcacatcagaaaggccaccaagtacctgaaggacgtgaccctgcagaagcagtgcgtgcccttcagaagatacaacggcggcgtgggcagatgcgcccaggccaagcagtggggctggacccagggcagatggcccaagaagagcgccgagttcctgctgcacatgctgaagaacgccgagagcaacgccgagctgaagggcctggacgtggacagcctggtgatcgagcacatccaggtgaacaaggcccccaagatgagaagaagaacctacagagcccacggcagaatcaacccctacatgagcagcccctgccacatcgagatgatcctgaccgagaaggagcagatcgtgcccaagcccgaggaggaggtggcccagaagaagaagatcagccagaagaagctgaagaagcagaagctgatggccagagagtag

SEQ ID NO: 97390 - DNA, 555 bp, Artificial Sequence
  Description of Artificial Sequence: Synthetic coding sequence
atggtgagatacagcctggaccccgagaaccccaccaagagctgcaagagcagaggcagcaacctgagagtgcacttcaagaacaccagagagaccgcccaggccatcaagggcatgcacatcagaaaggccaccaagtacctgaaggacgtgaccctgcagaagcagtgcgtgcccttcagaagatacaacggcggcgtgggcagatgcgcccaggccaagcagtggggctggacccagggcagatggcccaagaagagcgccgagttcctgctgcacatgctgaagaacgccgagagcaacgccgagctgaagggcctggacgtggacagcctggtgatcgagcacatccaggtgaacaaggcccccaagatgagaagaagaacctacagagcccacggcagaatcaacccctacatgagcagcccctgccacatcgagatgatcctgaccgagaaggagcagatcgtgcccaagcccgaggaggaggtggcccagaagaagaagatcagccagaagaagctgaagaagcagaagctgatggccagagagtag

SEQ ID NO: 97391 - DNA, 555 bp, Artificial Sequence; identical to SEQ ID NO: 97390
  Description of Artificial Sequence: Synthetic coding sequence

SEQ ID NO: 97392 - DNA, 573 bp, Artificial Sequence
  Description of Artificial Sequence: Synthetic coding sequence
tgaccccagggcgtggacatcagacacaacaaggacagaaaggtgagaagaaaggagcccaagagccaggacatctacctgagactgctggtgaagctgtacagattcctggccagaagaaccaacagcaccttcaaccaggtggtgctgaagagactgttcatgagcagaaccaacagaccccccctgagcctgagcagaatgatcagaaagatgaagctgcccggcagagagaacaagaccgccgtggtggtgggcaccatcaccgacgacgtgagagtgcaggaggtgcccaagctgaaggtgtgcgccctgagagtgaccagcagagccagaagcagaatcctgagagccggcggcaagatcctgaccttcgaccagctggccctggacagccccaagggctgcggcaccgtgctgctgagcggccccagaaagggcagagaggtgtacagacacttcggcaaggcccccggcaccccccacagccacaccaagccctacgtgagaagcaagggcagaaagttcgagagagccagaggcagaagagccagcagaggctacaagaactag

SEQ ID NO: 97393 - DNA, 408 bp, Artificial Sequence
  Description of Artificial Sequence: Synthetic coding sequence
atgggcgtggacatcagacacaacaaggacagaaaggtgagaagaaaggagcccaagagccaggacatctacctgagactgctggtgaagctgtacagattcctggccagaagaaccaacagcaccttcaaccaggtggtgctgaagagactgttcatgagcagaaccaacagaccccccctgagcctgagcagaatgatcagaaagatgaagctgcccggcagagagaacaagaccgccgtggtggtgggcaccatcaccgacgacgtgagagtgcaggaggtgcccaagctgaaggtgagctggagaggcctgggcagacccatcagacccctgctgtactgcgccgtgctgtgctgcgccgtgctgtgctgcctggtgcacccccagagctgccacagatggtag

SEQ ID NO: 97394 - DNA, 567 bp, Artificial Sequence
  Description of Artificial Sequence: Synthetic coding sequence
atgggcgtggacatcagacacaacaaggacagaaaggtgagaagaaaggagcccaagagccaggacatctacctgagactgctggtgaagctgtacagattcctggccagaagaaccaacagcaccttcaaccaggtggtgctgaagagactgttcatgagcagaaccaacagaccccccctgagcctgagcagaatgatcagaaagatgaagctgcccggcagagagaacaagaccgccgtggtggtgggcaccatcaccgacgacgtgagagtgcaggaggtgcccaagctgaaggtgtgcgccctgagagtgaccagcagagccagaagcagaatcctgagagccggcggcaagatcctgaccttcgaccagctggccctggacagccccaagggctgcggcaccgtgctgctgagcggccccagaaagggcagagaggtgtacagacacttcggcaaggcccccggcaccccccacagccacaccaagccctacgtgagaagcaagggcagaaagttcgagagagccagaggcagaagagccagcagaggctacaagaactag

SEQ ID NO: 97395 - DNA, 480 bp, Artificial Sequence
  Description of Artificial Sequence: Synthetic coding sequence
atgctgtacagattcctggccagaagaaccaacagcaccttcaaccaggtggtgctgaagagactgttcatgagcagaaccaacagaccccccctgagcctgagcagaatgatcagaaagatgaagctgcccggcagagagaacaagaccgccgtggtggtgggcaccatcaccgacgacgtgagagtgcaggaggtgcccaagctgaaggtgtgcgccctgagagtgaccagcagagccagaagcagaatcctgagagccggcggcaagatcctgaccttcgaccagctggccctggacagccccaagggctgcggcaccgtgctgctgagcggccccagaaagggcagagaggtgtacagacacttcggcaaggcccccggcaccccccacagccacaccaagccctacgtgagaagcaagggcagaaagttcgagagagccagaggcagaagagccagcagaggctacaagaactag

SEQ ID NO: 97396 - DNA, 795 bp, Artificial Sequence
  Description of Artificial Sequence: Synthetic coding sequence
atgaacatcctgcccaagaagagctggcacgtgagaaacaaggacaacgtggccagagtgagaagagacgaggcccaggccagagaggaggagaaggagagagagagaagagtgctgctggcccagcaggaggccagaaccgagttcctgagaaagaaggccagacaccagaacagcctgcccgagctggaggccgccgaggccggcgcccccggcagcggccccgtggacctgttcagagagctgctggaggagggcaagggcgtgatcagaggcaacaaggagtacgaggaggagaagagacaggagaaggagagacaggagaaggccctgggcatcctgacctacctgggccagagcgccgccgaggcccagacccagcccccctggtaccagctgccccccggcagaggcggccccccccccggccccgcccccgacgagaagatcaagagcagactggaccccctgagagagatgcagaagcacctgggcaagaagagacagcacggcggcgacgagggcagcagaagcagaaaggagaaggagggcagcgagaagcagagacccaaggagccccccagcctggaccagctgagagccgagagactgagaagagaggccgccgagagaagcagagccgaggccctgctggccagagtgcagggcagagccctgcaggagggccagcccgaggaggacgagaccgacgacagaagaagaagatacaacagccagttcaacccccagctggccagaagacccagacagcaggacccccacctgacccactag

SEQ ID NO: 97397 - DNA, 465 bp, Artificial Sequence
  Description of Artificial Sequence: Synthetic coding sequence
atgaaggccagcggcaccctgagagagtacaaggtggtgggcagatgcctgcccacccccaagtgccacaccccccccctgtacagaatgagaatcttcgcccccaaccacgtggtggccaagagcagattctggtacttcgtgagccagctgaagaagatgaagaagagcagcggcgagatcgtgtactgcggccaggtgttcgagaagagccccctgagagtgaagaacttcggcatctggctgagatacgacagcagaagcggcacccacaacatgtacagagagtacagagacctgaccaccgccggcgccgtgacccagtgctacagagacatgggcgccagacacagagccagagcccacagcatccagatcatgaaggtggaggagatcgccgccagcaagtgcagaagacagcacaagcccagattcaccaccaagagacccaacaccttcttctag

SEQ ID NO: 97398 - DNA, 1278 bp, Artificial Sequence
  Description of Artificial Sequence: Synthetic coding sequence
atgggcggcggcgacctgaacctgaagaagagctggcacccccagaccctgagaaacgtggagaaggtgtggaaggccgagcagaagcacgaggccgagagaaagaagatcgaggagctgcagagagagctgagagaggagagagccagagaggagatgcagagatacgccgaggacgtgggcgccgtgaagaagaaggaggagaagctggactggatgtaccagggccccggcggcatggtgaacagagacgagtacctgctgggcagacccatcgacaagtacgtgttcgagaagatggaggagaaggaggccggctgcagcagcgagaccggcctgctgcccggcagcatcttcgcccccagcggcgccaacagcctgctggacatggccagcaagatcagagaggaccccctgttcatcatcagaaagaaggaggaggagaagaagagagaggtgctgaacaaccccgtgaagatgaagaagatcaaggagctgctgcagatgagcctggagaagaaggagaagaagaagaagaaggagaagaagaagaagcacaagaagcacaagcacagaagcagcagcagcgacagaagcagcagcgaggacgagcacagcgccggcagaagccagaagaagatggccaacagcagccccgtgctgagcaaggtgcccggctacggcctgcaggtgagaaacagcgacagaaaccagggcctgcagggccccctgaccgccgagcagaagagaggccacggcatgaagaaccacagcagaagcagaagcagcagccacagcccccccagacacgccagcaagaagagcaccagagaggccggcagcagagacagaagaagcagaagcctgggcagaagaagcagaagccccagacccagcaagctgcacaacagcaaggtgaacagaagagagaccggccagaccagaagccccagccccaagaaggaggtgtaccagagaagacacgcccccggctacaccagaaagctgagcgccgaggagctggagagaaagagacaggagatgatggagaacgccaagtggagagaggaggagagactgaacatcctgaagagacacgccaaggacgaggagagagagcagagactggagaagctggacagcagagacggcaagttcatccacagaatgaagctggagagcgccagcaccagcagcctggaggacagagtgaagagaaacatctacagcctgcagagaaccagcgtggccctggagaagaacttcatgaagagatag

SEQ ID NO: 97399 - DNA, 483 bp, Artificial Sequence
  Description of Artificial Sequence: Synthetic coding sequence
atgaccaacaccaagggcaagagaagaggcaccagatacatgttcagcagacccttcagaaagcacggcgtggtgcccctggccacctacatgagaatctacaagaagggcgacatcgtggacatcaagggcatgggcaccgtgcagaagggcatgccccacaagtgctaccacggcaagaccggcagagtgtacaacgtgacccagcacgccgtgggcatcgtggtgaacaagcaggtgaagggcaagatcctggccaagagaatcaacgtgagaatcgagcacatcaagcacagcaagagcagagacagcttcctgaagagagtgaaggagaacgaccagaagaagaaggaggccaaggagaagggcacctgggtgcagctgaagagacagcccgccccccccagagaggcccacttcgtgagaaccaacggcaaggagcccgagctgctggagcccatcccctacgagttcatggcctag

SEQ ID NO: 97400 - DNA, 483 bp, Artificial Sequence; identical to SEQ ID NO: 97399
  Description of Artificial Sequence: Synthetic coding sequence

SEQ ID NO: 97401 - DNA, 483 bp, Artificial Sequence; identical to SEQ ID NO: 97399
  Description of Artificial Sequence: Synthetic coding sequence

SEQ ID NO: 97402 - DNA, 483 bp, Artificial Sequence; identical to SEQ ID NO: 97399
  Description of Artificial Sequence: Synthetic coding sequence

SEQ ID NO: 97403 - DNA, 972 bp, Artificial Sequence
  Description of Artificial Sequence: Synthetic coding sequence
atggccgcccccaagggcagcctgtgggtgagaacccagctgggcctgccccccctgctgctgctgaccatggccctggccggcggcagcggcaccgccagcgccgaggccttcgacagcgtgctgggcgacaccgccagctgccacagagcctgccagctgacctaccccctgcacacctaccccaaggaggaggagctgtacgcctgccagagaggctgcagactgttcagcatctgccagttcgtggacgacggcatcgacctgaacagaaccaagctggagtgcgagagcgcctgcaccgaggcctacagccagagcgacgagcagtacgcctgccacctgggctgccagaaccagctgcccttcgccgagctgagacaggagcagctgatgagcctgatgcccaagatgcacctgctgttccccctgaccctggtgagaagcttctggagcgacatgatggacagcgcccagagcttcatcaccagcagctggaccttctacctgcaggccgacgacggcaagatcgtgatcttccagagcaagcccgagatccagtacgccccccacctggagcaggagcccaccaacctgagagagagcagcctgagcaagatgagctacctgcagatgagaaacagccaggcccacagaaacttcctggaggacggcgagagcgacggcttcctgagatgcctgagcctgaacagcggctggatcctgaccaccaccctggtgctgagcgtgatggtgctgctgtggatctgctgcgccaccgtggccaccgccgtggagcagtacgtgcccagcgagaagctgagcatctacggcgacctggagttcatgaacgagcagaagctgaacagataccccgccagcagcctggtggtggtgagaagcaagaccgaggaccacgaggaggccggccccctgcccaccaaggtgaacctggcccacagcgagatctag

SEQ ID NO: 97404 - DNA, 276 bp, Artificial Sequence
  Description of Artificial Sequence: Synthetic coding sequence
atggccggcagcagaagagagtgcagaagaggcggcagcagcggcgccaagttcagaatcagcctgggcctgcccgtgggcgccgtgatcaactgcgccgacaacaccggcgccaagaacctgtacatcatcagcgtgaagggcatcaagggcagactgaacagactgcccgccgccggcgtgggcgacatggtgatggccaccgtgaagaagggcaagcccgagctgagaaagaaggtgcaccccgccgtggtgatcagacagagaaagagctag

SEQ ID NO: 97405 - DNA, 423 bp, Artificial Sequence
  Description of Artificial Sequence: Synthetic coding sequence
atgagcaagagaggcagaggcggcagcagcggcgccaagttcagaatcagcctgggcctgcccgtgggcgccgtgatcaactgcgccgacaacaccggcgccaagaacctgtacatcatcagcgtgaagggcatcaagggcagactgaacagactgcccgccgccggcgtgggcgacatggtgatggccaccgtgaagaagggcaagcccgagctgagaaagaaggtgcaccccgccgtggtgatcagacagagaaagagctacagaagaaaggacggcgtgttcctgtacttcgaggacaacgccggcgtgatcgtgaacaacaagggcgagatgaagggcagcgccatcaccggccccgtggccaaggagtgcgccgacctgtggcccagaatcgccagcaacgccggcagcatcgcctag

SEQ ID NO: 97406 - DNA, 345 bp, Artificial Sequence
  Description of Artificial Sequence: Synthetic coding sequence
atgagcaagagaggcagaggcggcagcagcggcgccaagttcagaatcagcctgggcctgcccgtgggcgccgtgatcaactgcgccgacaacaccggcgccaagaacctgtacatcatcagcgtgaagggcatcaagggcagactgaacagactgcccgccgccggcgtgggcgacatggtgatggccaccgtgaagaagggcaagcccgagctgagaaagaaggtgctgctgtgccacaccggctggagcgccgtgacccccctgaagctgaccgtgaccctgaactgctggacctggaacccccccgccgtggccttcaagggcctgcagctgcaggtgtag

SEQ ID NO: 97407 - DNA, 423 bp, Artificial Sequence; identical to SEQ ID NO: 97405
  Description of Artificial Sequence: Synthetic coding sequence

SEQ ID NO: 97408 - DNA, 477 bp, Artificial Sequence
  Description of Artificial Sequence: Synthetic coding sequence
tgactggtgggcgccccctgccccagagccagccccgccccccccaaggccgaggccaaggccaaggccctgaaggccaagaaggccgtgctgaagggcgtgcacagccacaagaagaagaagatcagaaccagccccaccttcagaagacccaagaccctgagactgagaagacagcccaagtaccccagaaagagcgcccccagaagaaacaagctggaccactacgccatcatcaagttccccctgaccaccgagagcgccatgaagaagatcgaggacaacaacaccctggtgttcatcgtggacgtgaaggccaacaagcaccagatcaagcaggccgtgaagaagctgtacgacatcgacgtggccaaggtgaacaccctgatcagacccgacggcgagaagaaggcctacgtgagactggcccccgactacgacgccctggacgtggccaacaagatcggcatcatctag

SEQ ID NO: 97409 - DNA, 477 bp, Artificial Sequence
  Description of Artificial Sequence: Synthetic coding sequence
atgagccccggcctggtggtgctgagatgggcccccgccccccccaaggccgaggccaaggccaaggccctgaaggccaagaaggccgtgctgaagggcgtgcacagccacaagaagaagaagatcagaaccagccccaccttcagaagacccaagaccctgagactgagaagacagcccaagtaccccagaaagagcgcccccagaagaaacaagctggaccactacgccatcatcaagttccccctgaccaccgagagcgccatgaagaagatcgaggacaacaacaccctggtgttcatcgtggacgtgaaggccaacaagcaccagatcaagcaggccgtgaagaagctgtacgacatcgacgtggccaaggtgaacaccctgatcagacccgacggcgagaagaaggcctacgtgagactggcccccgactacgacgccctggacgtggccaacaagatcggcatcatctag

SEQ ID NO: 97410 - DNA, 585 bp, Artificial Sequence
  Description of Artificial Sequence: Synthetic coding sequence
atgcaccccctggtgggcgccccctgccccagagcctgcaaggagctggtgcccagcgccctgaccatcttcctgctggtgcacgtgcagcccggctacatcaccagacccagcctgagaagcgtggtgctgagatgggcccccgccccccccaaggccgaggccaaggccaaggccctgaaggccaagaaggccgtgctgaagggcgtgcacagccacaagaagaagaagatcagaaccagccccaccttcagaagacccaagaccctgagactgagaagacagcccaagtaccccagaaagagcgcccccagaagaaacaagctggaccactacgccatcatcaagttccccctgaccaccgagagcgccatgaagaagatcgaggacaacaacaccctggtgttcatcgtggacgtgaaggccaacaagcaccagatcaagcaggccgtgaagaagctgtacgacatcgacgtggccaaggtgaacaccctgatcagacccgacggcgagaagaaggcctacgtgagactggcccccgactacgacgccctggacgtggccaacaagatcggcatcatctag

SEQ ID NO: 97411 - DNA, 471 bp, Artificial Sequence
  Description of Artificial Sequence: Synthetic coding sequence
atggcccccaaggccaagaaggaggcccccgccccccccaaggccgaggccaaggccaaggccctgaaggccaagaaggccgtgctgaagggcgtgcacagccacaagaagaagaagatcagaaccagccccaccttcagaagacccaagaccctgagactgagaagacagcccaagtaccccagaaagagcgcccccagaagaaacaagctggaccactacgccatcatcaagttccccctgaccaccgagagcgccatgaagaagatcgaggacaacaacaccctggtgttcatcgtggacgtgaaggccaacaagcaccagatcaagcaggccgtgaagaagctgtacgacatcgacgtggccaaggtgaacaccctgatcagacccgacggcgagaagaaggcctacgtgagactggcccccgactacgacgccctggacgtggccaacaagatcggcatcatctag

SEQ ID NO: 97412 - DNA, 474 bp, Artificial Sequence
  Description of Artificial Sequence: Synthetic coding sequence
atgaaggtggagctgtgcagcttcagcggctacaagatctaccccggccacggcagaagatacgccagaaccgacggcaaggtgttccagttcctgaacgccaagtgcgagagcgccttcctgagcaagagaaaccccagacagatcaactggaccgtgctgtacagaagaaagcacaagaagggccagagcgaggagatccagaagaagagaaccagaagagccgtgaagttccagagagccatcaccggcgccagcctggccgacatcatggccaagagaaaccagaagcccgaggtgagaaaggcccagagagagcaggccatcagagccgccaaggaggccaagaaggccaagcaggccagcaagaagaccgccatggccgccgccaaggcccccaccaaggccgcccccaagcagaagatcgtgaagcccgtgaaggtgagcgcccccagagtgggcggcaagagatag

SEQ ID NO: 97413 - DNA, 453 bp, Artificial Sequence
  Description of Artificial Sequence: Synthetic coding sequence
atgaaggtggagctgtgcagcttcagcggctacaagatctaccccggccacggcagaagatacgccagaaccgacggcaaggtgttccagttcctgaacgccaagtgcgagagcgccttcctgagcaagagaaaccccagacagatcaactggaccgtgctgtacagaagaaagcacaagaagggccagagcgaggagatccagaagaagagaaccagaagagccgtgaagttccagagagccatcaccggcgccagcctggccgacatcatggccaagagaaaccagaagcccgaggtgagaaaggcccagagagagcaggccatcagagccgccaaggaggccaagaaggccaagcaggccagcaagaagaccgccatggccgccgccaaggtgatcatgggcttcctgtacttcctggagcagtacaacagaaagatcttcttcttctag

SEQ ID NO: 97414 - DNA, 438 bp, Artificial Sequence
  Description of Artificial Sequence: Synthetic coding sequence
atgaagttcaaccccttcgtgaccagcgacagaagcaagaacagaaagagacacttcaacgcccccagccacatcagaagaaagatcatgagcagccccctgagcaaggagctgagacagaagtacaacgtgagaagcatgcccatcagaaaggacgacgaggtgcaggtggtgagaggccactacaagggccagcagatcggcaaggtggtgcaggtgtacagaaagaagtacgtgatctacatcgagagagtgcagagagagaaggccaacggcaccaccgtgcacgtgggcatccaccccagcaaggtggtgatcaccagactgaagctggacaaggacagaaagaagatcctggagagaaaggccaagagcagacaggtgggcaaggagaagggcaagtacaaggaggagaccatcgagaagatgcaggagtag

SEQ ID NO: 97415 - DNA, 411 bp, Artificial Sequence
  Description of Artificial Sequence: Synthetic coding sequence
atgggcaagttcatgaagcccggcaaggtggtgctggtgctggccggcagatacagcggcagaaaggccgtgatcgtgaagaacatcgacgacggcaccagcgacagaccctacagccacgccctggtggccggcatcgacagataccccagaaaggtgaccgccgccatgggcaagaagaagatcgccaagagaagcaagatcaagagcttcgtgaaggtgtacaactacaaccacctgatgcccaccagatacagcgtggacatccccctggacaagaccgtggtgaacaaggacgtgttcagagaccccgccctgaagagaaaggccagaagagaggccaaggtgaagttcgaggagagatacaagaccggcaagaacaagtggttcttccagaagctgagattctag

SEQ ID NO: 97416 - DNA, 447 bp, Artificial Sequence
  Description of Artificial Sequence: Synthetic coding sequence
atgcccagcagactgagaaagaccagaaagctgagaggccacgtgagccacggccacggcagaatcggcaagcacagaaagcaccccggcggcagaggcaacgccggcggcctgcaccaccacagaatcaacttcgacaagtaccaccccggctacttcggcaaggtgggcatgaagcactaccacctgaagagaaaccagagcttctgccccaccgtgaacctggacaagctgtggaccctggtgagcgagcagaccagagtgaacgccgccaagaacaagaccggcgccgcccccatcatcgacgtggtgagaagcggctactacaaggtgctgggcaagggcaagctgcccaagcagcccgtgatcgtgaaggccaagttcttcagcagaagagccgaggagaagatcaagagcgtgggcggcgcctgcgtgctggtggcctag

SEQ ID NO: 97417 - DNA, 327 bp, Artificial Sequence
  Description of Artificial Sequence: Synthetic coding sequence
atgcccagcagactgagaaagaccagaaagctgagaggccacgtgagccacggccacggcagaatcggcaagcacagaaagcaccccggcggcagaggcaacgccggcggcctgcaccaccacagaatcaacttcgacaagtaccaccccggctacttcggcaaggtgggcatgaagcactaccacctgaagagaaaccagagcttctgccccaccgtgaacctggacaagctgtggaccctggtgagcgagcagaccagagtgaacgccgccaagaacaagaccggcgccgcccccatcatcgacgtggtgagaagcgtgagctag

SEQ ID NO: 97418 - DNA, 414 bp, Artificial Sequence
  Description of Artificial Sequence: Synthetic coding sequence
atgagcgcccacctgcagtggatggtggtgagaaactgcagcagcttcctgatcaagagaaacaagcagacctacagcaccgagcccaacaacctgaaggccagaaacagcttcagatacaacggcctgatccacagaaagaccgtgggcgtggagcccgccgccgacggcaagggcgtggtggtggtgatcaagagaagaagcggccagagaaagcccgccaccagctacgtgagaaccaccatcaacaagaacgccagagccaccctgagcagcatcagacacatgatcagaaagaacaagtacagacccgacctgagaatggccgccatcagaagagccagcgccatcctgagaagccagaagcccgtgatggtgaagagaaagagaaccagacccaccaagagcagctag

SEQ ID NO: 97419 - DNA, 210 bp, Artificial Sequence
  Description of Artificial Sequence: Synthetic coding sequence
atgagcgcccacctgcagtggatggtggtgagaaactgcagcagcttcctgatcaagagaaacaagcagacctacagcaccgagcccaacaacctgaaggccagaaacagcttcagatacaacggcctgatccacagaaagaccgtgggcgtggagcccgccgccgacggcaagggcgtggtggtggtgatcaagagaagaagcgagtag

SEQ ID NO: 97420 - DNA, 264 bp, Artificial Sequence
  Description of Artificial Sequence: Synthetic coding sequence
atgagcgcccacctgcagtggatggtggtgagaaactgcagcagcttcctgatcaagagaaacaagcagacctacagcaccgagcccaacaacctgaaggccagaaacagcttcagatacaacggcctgatccacagaaagaccgtgggcgtggagcccgccgccgacggcaagggcgtggtggtggtgatcaagagaagaagcggcgagttctgcctggtgtgggccagagagagacccctgagcagagtgtgggagctgtag

SEQ ID NO: 97421 - DNA, 510 bp, Artificial Sequence
  Description of Artificial Sequence: Synthetic coding sequence
atgagcgcccacctgcagtggatggtggtgagaaactgcagcagcttcctgatcaagagaaacaagcagacctacagcaccgagcccaacaacctgaaggccagaaacagcttcagatacaacggcctgatccacagaaagaccgtgggcgtggagcccgccgccgacggcaagggcgtggtggtggtgatcaagagaagaagcggccagagaaagcccgccaccagctacgtgagaaccaccatcaacaagaacgccagagccaccctgagcagcatcagacacatgatcagaaagaacaagtacagacccgacctgagaatggacatgctggccagcaccggcagcggcctgtgctgcagcgtggccgtgcagccctgggccagcagcagcaccagcctgtgcctgagaaccctgatctgcaacatgagagtggacagaccctactacagcggcctgatgagaagactgaacgtgcagaacctgctggactgcgcccacaagagctag

SEQ ID NO: 97422 - DNA, 510 bp, Artificial Sequence; identical to SEQ ID NO: 97421
  Description of Artificial Sequence: Synthetic coding sequence

SEQ ID NO: 97423 - DNA, 414 bp, Artificial Sequence; identical to SEQ ID NO: 97418
  Description of Artificial Sequence: Synthetic coding sequence

SEQ ID NO: 97424 - DNA, 492 bp, Artificial Sequence
  Description of Artificial Sequence: Synthetic coding sequence
atgagcgcccacctgcagtggatggtggtgagaaactgcagcagcttcctgatcaagagaaacaagcagacctacagcaccgagcccaacaacctgaaggccagaaacagcttcagatacaacggcctgatccacagaaagaccgtgggcgtggagcccgccgccgacggcaagggcgtggtggtggtgatcaagagaagaagcggccagagaaagcccgccaccagctacgtgagaaccaccatcaacaagaacgccagagccaccctgagcagcatcagacacatgatcagaaagaacaagtacagacccgacctgagaatggtgagctggggcctgggcatcagactgggcgagaccggccagtgctgcggcgagggcccccccaccaccggctgcaacatgggctggagaggcatggacagctgcttccagcccaccccccacacccagcactggcccagaggcagactggtggagtgcatgggctag

SEQ ID NO: 97425 - DNA, 480 bp, Artificial Sequence
  Description of Artificial Sequence: Synthetic coding sequence
atggccaagagcaagaaccacaccacccacaaccagagcagaaagtggcacagaaacggcatcaagaagcccagaagccagagatacgagagcctgaagggcgtggaccccaagttcctgagaaacatgagattcgccaagaagcacaacaagaagggcctgaagaagatgcaggccaacaacgccaaggccatgagcgccagagccgaggccatcaaggccctggtgaagcccaaggaggtgaagcccaagatccccaagggcgtgagcagaaagctggacagactggcctacatcgcccaccccaagctgggcaagagagccagagccagaatcgccaagggcctgagactgtgcagacccaaggccaaggccaaggccaaggccaaggaccagaccaaggcccaggccgccgcccccgccagcgtgcccgcccaggcccccaagagaacccaggcccccaccaaggccagcgagtag

SEQ ID NO: 97426 - DNA, 480 bp, Artificial Sequence; identical to SEQ ID NO: 97425
  Description of Artificial Sequence: Synthetic coding sequence

SEQ ID NO: 97427 - DNA, 480 bp, Artificial Sequence; identical to SEQ ID NO: 97425
  Description of Artificial Sequence: Synthetic coding sequence

SEQ ID NO: 97428 - DNA, 480 bp, Artificial Sequence; identical to SEQ ID NO: 97425
  Description of Artificial Sequence: Synthetic coding sequence

SEQ ID NO: 97429 - DNA, 480 bp, Artificial Sequence; identical to SEQ ID NO: 97425
  Description of Artificial Sequence: Synthetic coding sequence

SEQ ID NO: 97430 - DNA, 480 bp, Artificial Sequence; identical to SEQ ID NO: 97425
  Description of Artificial Sequence: Synthetic coding sequence

SEQ ID NO: 97431 - DNA, 648 bp, Artificial Sequence
  Description of Artificial Sequence: Synthetic coding sequence
atgcccttccaccccgtgaccgccgccctgatgtacagaggcatctacaccgtgcccaacctgctgagcgagcagagacccgtggacatccccgaggacgagctggaggagatcagagaggccttcaaggtgttcgacagagacggcaacggcttcatcagcaagcaggagctgggcaccgccatgagaagcctgggctacatgcccaacgaggtggagctggaggtgatcatccagagactggacatggacggcgacggccaggtggacttcgaggagttcgtgaccctgctgggccccaagctgagcaccagcggcatccccgagaagttccacggcaccgacttcgacaccgtgttctggaagtgcgacatgcagaagctgaccgtggacgagctgaagagactgctgtacgacaccttctgcgagcacctgagcatgaaggacatcgagaacatcatcatgaccgaggaggagagccacctgggcaccgccgaggagtgccccgtggacgtggagacctgcagcaaccagcagatcagacagacctgcgtgagaaagagcctgatctgcgccttcgccatcgccttcatcatcagcgtgatgctgatcgccgccaaccaggtgctgagaagcggcatgaagtag

SEQ ID NO: 97432 - DNA, 1056 bp, Artificial Sequence
  Description of Artificial Sequence: Synthetic coding sequence
atgacccacatcgtgagagaggtggacagacccggcagcaaggtgaacaagaaggaggtggtggaggccgtgaccatcgtggagaccccccccatggtggtggtgggcatcgtgggctacgtggagacccccagaggcctgagaaccttcaagaccgtgttcgccgagcacatcagcgacgagtgcaagagaagattctacaagaactggcacaagagcaagaagaaggccttcaccaagtactgcaagaagtggcaggacgaggacggcaagaagcagctggagaaggacttcagcagcatgaagaagtactgccaggtgatcagagtgatcgcccacacccagatgagactgctgcccctgagacagaagaaggcccacctgatggagatccaggtgaacggcggcaccgtggccgagaagctggactgggccagagagagactggagcagcaggtgcccgtgaaccaggtgttcggccaggacgagatgatcgacgtgatcggcgtgaccaagggcaagggctacaagggcgtgaccagcagatggcacaccaagaagctgcccagaaagacccacagaggcctgagaaaggtggcctgcatcggcgcctggcaccccgccagagtggccttcagcgtggccagagccggccagaagggctaccaccacagaaccgagatcaacaagaagatctacaagatcggccagggctacctgatcaaggacggcaagctgatcaagaacaacgccagcaccgactacgacctgagcgacaagagcatcaaccccctgggcggcttcgtgcactacggcgaggtgaccaacgacttcgtgatgctgaagggctgcgtggtgggcaccaagaagagagtgctgaccctgagaaagagcctgctggtgcagaccaagagaagagccctggagaagatcgacctgaagttcatcgacaccaccagcaagttcggccacggcagattccagaccatggaggagaagaaggccttcatgggccccctgaagaaggacagaatcgccaaggaggagggcgcctag

SEQ ID NO: 97433 - DNA, 348 bp, Artificial Sequence
  Description of Artificial Sequence: Synthetic coding sequence
atggtggccgccaagaagaccaagaagagcctggagagcatcaacagcagactgcagctggtgatgaagagcggcaagtacgtgctgggctacaagcagaccctgaagatgatcagacagggcaaggccaagctggtgatcctggccaacaactgccccgccctgagaaagagcgagatcgagtactacgccatgctggccaagaccggcgtgcaccactacagcggcaacaacatcgagctgggcaccgcctgcggcaagtactacagagtgtgcaccctggccatcatcgaccccggcgacagcgacatcatcagaagcatgcccgagcagaccggcgagaagtag

SEQ ID NO: 97434 - DNA, 348 bp, Artificial Sequence; identical to SEQ ID NO: 97433
  Description of Artificial Sequence: Synthetic coding sequence

SEQ ID NO: 97435 - DNA, 345 bp, Artificial Sequence
  Description of Artificial Sequence: Synthetic coding sequence
atggtggccgccaagaagaccaagaagagcctggagagcatcaacagcagactgcagctggtgatgaagagcggcaagtacgtgctgggctacaagcagaccctgaagatgatcagacagggcaaggccaagctggtgatcctggccaacaactgccccgccctgagaaagagcgagatcgagtactacgccatgctggccaagaccggcgtgcaccactacagcggcaacaacatcgagctgggcaccgcctgcggcaagtactacagagtgtgcaccctggccatcatcgaccccggcgacagcgacatcatcagaagcatgcccgagcagaccggcgagtag

SEQ ID NO: 97436 - DNA, 285 bp, Artificial Sequence
  Description of Artificial Sequence: Synthetic coding sequence
atgagcggcagactgtggagcaaggccatcttcgccggctacaagagaggcctgagaaaccagagagagcacaccgccctgctgaagatcgagggcgtgtacgccagagacgagaccgagttctacctgggcaagagatgcgcctacgtgtacaaggccaagaacaacaccgtgacccccggcggcaagcccaacaagaccagagtgatctggggcaaggtgaccagagcccacggcaacagcggcatggtgagagccaagttcagaagcaacctgcccgcctag

SEQ ID NO: 97437 - DNA, 333 bp, Artificial Sequence
  Description of Artificial Sequence: Synthetic coding sequence
atgagcggcagactgtggagcaaggccatcttcgccggctacaagagaggcctgagaaaccagagagagcacaccgccctgctgaagatcgagggcgtgtacgccagagacgagaccgagttctacctgggcaagagatgcgcctacgtgtacaaggccaagaacaacaccgtgacccccggcggcaagcccaacaagaccagagtgatctggggcaaggtgaccagagcccacggcaacagcggcatggtgagagccaagttcagaagcaacctgcccgccaaggccatcggccacagaatcagagtgatgctgtaccccagcagaatctag

SEQ ID NO: 97438 - DNA, 333 bp, Artificial Sequence; identical to SEQ ID NO: 97437
  Description of Artificial Sequence: Synthetic coding sequence

SEQ ID NO: 97439 - DNA, 396 bp, Artificial Sequence
  Description of Artificial Sequence: Synthetic coding sequence
tgactgcccttcgccagcagattcctgagcttcagagccgacagcgcccacgccagcatggtgaacgtgcccaagaccagaagaaccttctgcaagaagtgcggcaagcaccagccccacaaggtgacccagtacaagaagggcaaggacagcctgtacgcccagggcaagagaagatacgacagaaagcagagcggctacggcggccagaccaagcccatcttcagaaagaaggccaagaccaccaagaagatcgtgctgagactggagtgcgtggagcccaactgcagaagcaagagaatgctggccatcaagagatgcaagcacttcgagctgggcggcgacaagaagagaaaggtgtacaactacggctggaaggtgcagagcttcagctag

SEQ ID NO: 97440 - DNA, 429 bp, Artificial Sequence
  Description of Artificial Sequence: Synthetic coding sequence
atgatcgcccccaccgacagccacgaggaggtgagaagcggcaccagctacatcctgcccttcgccagcagattcctgagcttcagagccgacagcgcccacgccagcatggtgaacgtgcccaagaccagaagaaccttctgcaagaagtgcggcaagcaccagccccacaaggtgacccagtacaagaagggcaaggacagcctgtacgcccagggcaagagaagatacgacagaaagcagagcggctacggcggccagaccaagcccatcttcagaaagaaggccaagaccaccaagaagatcgtgctgagactggagtgcgtggagcccaactgcagaagcaagagaatgctggccatcaagagatgcaagcacttcgagctgggcggcgacaagaagagaaagggccaggtgatccagttctag

SEQ ID NO: 97441 - DNA, 321 bp, Artificial Sequence
  Description of Artificial Sequence: Synthetic coding sequence
atggtgaacgtgcccaagaccagaagaaccttctgcaagaagtgcggcaagcaccagccccacaaggtgacccagtacaagaagggcaaggacagcctgtacgcccagggcaagagaagatacgacagaaagcagagcggctacggcggccagaccaagcccatcttcagaaagaaggccaagaccaccaagaagatcgtgctgagactggagtgcgtggagcccaactgcagaagcaagagaatgctggccatcaagagatgcaagcacttcgagctgggcggcgacaagaagagaaagggccaggtgatccagttctag

SEQ ID NO: 97442 - DNA, 321 bp, Artificial Sequence
  Description of Artificial Sequence: Synthetic coding sequence
atggtgaacgtgcccaagaccagaagaaccttctgcaagaagtgcggcaagcaccagccccacaaggtgacccagtacaagaagggcaaggacagcctgtacgcccagggcagaagaagatacgacagaaagcagagcggctacggcggccagaccaagcccatcttcagaaagaaggccaagaccaccaagaagatcgtgctgagactggagtgcgtggagcccaactgcagaagcaagagaatgctggccatcaagagatgcaagcacttcgagctgggcggcgacaagaagagaaagggccaggtgatccagttctag

SEQ ID NO: 97443 - DNA, 294 bp, Artificial Sequence
  Description of Artificial Sequence: Synthetic coding sequence
atgaccaagggcaccagcagcttcggcaagagaagaaacaagacccacaccctgtgcagaagatgcggcagcaaggcctaccacctgcagaagagcacctgcggcaagtgcggctaccccgccaagagaaagagaaagtacaactggagcgccaaggccaagagaagaaacaccaccggcaccggcagaatgagacacctgaagatcgtgtacagaagattcagacacggcttcagagagggcaccacccccaagcccaagagagccgccgtggccgccagcagcagcagctag

SEQ ID NO: 97444 - DNA, 207 bp, Artificial Sequence
  Description of Artificial Sequence: Synthetic coding sequence
atggtgaagaagatcgagatcagccagcacgccaagtacacctgcagcttctgcggcaagaccaagatgaagagaagagccgtgggcatctggcactgcggcagctgcatgaagaccgtggccggcggcgcctggacctacaacaccaccagcgccgtgaccgtgaagagcgccatcagaagactgaaggagctgaaggaccagtag

SEQ ID NO: 97445 - DNA, 279 bp, Artificial Sequence
  Description of Artificial Sequence: Synthetic coding sequence
atggccaagagaaccaagaaggtgggcatcgtgggcaagtacggcaccagatacggcgccagcctgagaaagatggtgaagaagatcgagatcagccagcacgccaagtacacctgcagcttctgcggcaagaccaagatgaagagaagagccgtgggcatctggcactgcggcagctgcatgaagaccgtggccggcggcgcctggacctacaacaccaccagcgccgtgaccgtgaagagcgccatcagaagactgaaggagctgaaggaccagtag

SEQ ID NO: 97446 - DNA, 213 bp, Artificial Sequence
  Description of Artificial Sequence: Synthetic coding sequence
atgcccagaaagatcgaggagatcaaggacttcctgctgaccgccagaagaaaggacgccaagagcgtgaagatcaagaagaacaaggacaacgtgaagttcaaggtgagatgcagcagatacctgtacaccctggtgatcaccgacaaggagaaggccgagaagctgaagcagagcctgccccccggcctggccgtgaaggagctgaagtag

SEQ ID NO: 97447 - DNA, 213 bp, Artificial Sequence; identical to SEQ ID NO: 97446
  Description of Artificial Sequence: Synthetic coding sequence

SEQ ID NO: 97448 - DNA, 213 bp, Artificial Sequence; identical to SEQ ID NO: 97446
  Description of Artificial Sequence: Synthetic coding sequence

SEQ ID NO: 97449 - DNA, 156 bp, Artificial Sequence
  Description of Artificial Sequence: Synthetic coding sequence
atgagcagccacaagaccttcaccatcaagagattcctggccaagaagcagaagcagaacagacccatcccccagtggatccagatgaagcccggcagcaagatcagatacaacagcaagagaagacactggagaagaaccaagctgggcctgtag

SEQ ID NO: 97450 - DNA, 156 bp, Artificial Sequence; identical to SEQ ID NO: 97449
  Description of Artificial Sequence: Synthetic coding sequence

SEQ ID NO: 97451 - DNA, 156 bp, Artificial Sequence; identical to SEQ ID NO: 97449
  Description of Artificial Sequence: Synthetic coding sequence

SEQ ID NO: 97452 - DNA, 1284 bp, Artificial Sequence
  Description of Artificial Sequence: Synthetic coding sequence
atggcctgcgccagacccctgatcagcgtgtacagcgagaagggcgagagcagcggcaagaacgtgaccctgcccgccgtgttcaaggcccccatcagacccgacatcgtgaacttcgtgcacaccaacctgagaaagaacaacagacagccctacgccgtgagcgagctggccggccaccagaccagcgccgagagctggggcaccggcagagccgtggccagaatccccagagtgagaggcggcggcacccacagaagcggccagggcgccttcggcaacatgtgcagaggcggcagaatgttcgcccccaccaagacctggagaagatggcacagaagagtgaacaccacccagaagagatacgccatctgcagcgccctggccgccagcgccctgcccgccctggtgatgagcaagggccacagaatcgaggaggtgcccgagctgcccctggtggtggaggacaaggtggagggctacaagaagaccaaggaggccgtgctgctgctgaagaagctgaaggcctggaacgacatcaagaaggtgtacgccagccagagaatgagagccggcaagggcaagatgagaaacagaagaagaatccagagaagaggcccctgcatcatctacaacgaggacaacggcatcatcaaggccttcagaaacatccccggcatcaccctgctgaacgtgagcaagctgaacatcctgaagctggcccccggcggccacgtgggcagattctgcatctggaccgagagcgccttcagaaagctggacgagctgtacggcacctggagaaaggccgccagcctgaagagcaactacaacctgcccatgcacaagatgatcaacaccgacctgagcagaatcctgaagagccccgagatccagagagccctgagagcccccagaaagaagatccacagaagagtgctgaagaagaaccccctgaagaacctgagaatcatgctgaagctgaacccctacgccaagaccatgagaagaaacaccatcctgagacaggccagaaaccacaagctgagagtggacaaggccgccgccgccgccgccgccctgcaggccaagagcgacgagaaggccgccgtggccggcaagaagcccgtggtgggcaagaagggcaagaaggccgccgtgggcgtgaagaagcagaagaagcccctggtgggcaagaaggccgccgccaccaagaagcccgcccccgagaagaagcccgccgagaagaagcccaccaccgaggagaagaagcccgccgcctag

SEQ ID NO: 97453 - DNA, 1221 bp, Artificial Sequence
  Description of Artificial Sequence: Synthetic coding sequence
atggcctgcgccagacccctgatcagcgtgtacagcgagaagggcgagagcagcggcaagaacgtgaccctgcccgccgtgttcaaggcccccatcagacccgacatcgtgaacttcgtgcacaccaacctgagaaagaacaacagacagccctacgccgtgagcgagctggccggccaccagaccagcgccgagagctggggcaccggcagagccgtggccagaatccccagagtgagaggcggcggcacccacagaagcggccagggcgccttcggcaacatgtgcagaggcggcagaatgttcgcccccaccaagacctggagaagatggcacagaagagtgaacaccacccagaagagatacgccatctgcagcgccctggccgccagcgccctgcccgccctggtgatgagcaagggccacagaatcgaggaggtgcccgagctgcccctggtggtggaggacaaggtggagggctacaagaagaccaaggaggccgtgctgctgctgaagaagctgaaggcctggaacgacatcaagaaggtgtacgccagccagagaatgagagccggcaagggcaagatgagaaacagaagaagaatccagagaagaggcccctgcatcatctacaacgaggacaacggcatcatcaaggccttcagaaacatccccggcatcaccctgctgaacgtgagcaagctgaacatcctgaagctggcccccggcggccacgtgggcagattctgcatctggaccgagagcgccttcagaaagctggacgagctgtacggcacctggagaaaggccgccagcctgaagagcaactacaacctgcccatgcacaagatgatcaacaccgacctgagcagaatcctgaagagccccgagatccagagagccctgagagcccccagaaagaagatccacagaagagtgctgaagaagaaccccctgaagaacctgagaatcatgctgaagctgaacccctacgccaagaccatgagaagaaacaccatcctgagacaggccagaaaccacaagctgagagtggacaaggccgccgccgccgccgccgccctgcaggccaagagcgacgagaaggccgccgtggccggcaagaagcccgtggtgggcaagaagggcaagaaggccgccgtgggcgagaagaagcccgccgagaagaagcccaccaccgaggagaagaagcccgccgcctag

SEQ ID NO: 97454 - DNA, 456 bp, Artificial Sequence
  Description of Artificial Sequence: Synthetic coding sequence
atggcctgcgccagacccctgatcagcgtgtacagcgagaagggcgagagcagcggcaagaacgtgaccctgcccgccgtgttcaaggcccccatcagacccgacatcgtgaacttcgtgcacaccaacctgagaaagaacaacagacagccctacgccgtgagcgagctggccggccaccagaccagcgccgagagctggggcaccggcagagccgtggccagaatccccagagtgagaggcggcggcacccacagaagcggccagggcgccttcggcaacatgtgcagaggcggcagaatgttcgcccccaccaagacctggagaagatggcacagaagagtgaacaccacccagaagctggagaaccacgtggaggccaagcccatctgcaaggaccacgcccccgagcaccacagcagccccggccaggagagccaggcccccggcggctag

SEQ ID NO: 97455 - DNA, 78 bp, Artificial Sequence
  Description of Artificial Sequence: Synthetic coding sequence
atgagagccaagtggagaaagaagagaatgagaagactgaagagaaagagaagaaagatgagacagagaagcaagtag

SEQ ID NO: 97456 - DNA, 78 bp, Artificial Sequence; identical to SEQ ID NO: 97455
  Description of Artificial Sequence: Synthetic coding sequence

SEQ ID NO: 97457 - DNA, 381 bp, Artificial Sequence
  Description of Artificial Sequence: Synthetic coding sequence
atgatcgtgagagtgaccaacagagacatcatctgccagatcgcctacgccagaatcgagggcgacatgatcgtgtgcgccgcctacgcccacgagctgcccaagtacggcgtgaaggtgggcctgaccaactacgccgccgcctactgcaccggcctgctgctggccagaagactgctgaacagattcggcatggacaagatctacgagggccaggtggaggtgaccggcgacgagtacaacgtggagagcatcgacggccagcccggcgccttcacctgctacctggacgccggcctggccagaaccaccaccggcaacaaggtgttcggcgccctgaagggcgccgtggacggcggcctgagcatcccccacagatag

SEQ ID NO: 97458 - DNA, 894 bp, Artificial Sequence
  Description of Artificial Sequence: Synthetic coding sequence
atgggcttcgtgaaggtggtgaagaacaaggcctacttcaagagataccaggtgaagttcagaagaagaagagagggcaagaccgactactacgccagaaagagactggtgatccaggacaagaacaagtacaacacccccaagtacagaatgatcgtgagagtgaccaacagagacatcatctgccagatcgcctacgccagaatcgagggcgacatgatcgtgtgcgccgcctacgcccacgagctgcccaagtacggcgtgaaggtgggcctgaccaactacgccgccgcctactgcaccggcctgctgctggccagaagactgctgaacagattcggcatggacaagatctacgagggccaggtggaggtgaccggcgacgagtacaacgtggagagcatcgacggccagcccggcgccttcacctgctacctggacgccggcctggccagaaccaccaccggcaacaaggtgttcggcgccctgaagggcgccgtggacggcggcctgagcatcccccacagcaccaagagattccccggctacgacagcgagagcaaggagttcaacgccgaggtgcacagaaagcacatcatgggccagaacgtggccgactacatgagatacctgatggaggaggacgaggacgcctacaagaagcagttcagccagtacatcaagaacagcgtgacccccgacatgatggaggagatgtacaagaaggcccacgccgccatcagagagaaccccgtgtacgagaagaagcccaagaaggaggtgaagaagaagagatggaacagacccaagatgagcctggcccagaagaaggacagagtggcccagaagaaggccagcttcctgagagcccaggagagagccgccgagagctag

SEQ ID NO: 97459 - DNA, 744 bp, Artificial Sequence
  Description of Artificial Sequence: Synthetic coding sequence
atgatcgtgagagtgaccaacagagacatcatctgccagatcgcctacgccagaatcgagggcgacatgatcgtgtgcgccgcctacgcccacgagctgcccaagtacggcgtgaaggtgggcctgaccaactacgccgccgcctactgcaccggcctgctgctggccagaagactgctgaacagattcggcatggacaagatctacgagggccaggtggaggtgaccggcgacgagtacaacgtggagagcatcgacggccagcccggcgccttcacctgctacctggacgccggcctggccagaaccaccaccggcaacaaggtgttcggcgccctgaagggcgccgtggacggcggcctgagcatcccccacagcaccaagagattccccggctacgacagcgagagcaaggagttcaacgccgaggtgcacagaaagcacatcatgggccagaacgtggccgactacatgagatacctgatggaggaggacgaggacgcctacaagaagcagttcagccagtacatcaagaacagcgtgacccccgacatgatggaggagatgtacaagaaggcccacgccgccatcagagagaaccccgtgtacgagaagaagcccaagaaggaggtgaagaagaagagatggaacagacccaagatgagcctggcccagaagaaggacagagtggcccagaagaaggccagcttcctgagagcccaggagagagccgccgagagctag

SEQ ID NO: 97460 - DNA, 867 bp, Artificial Sequence
  Description of Artificial Sequence: Synthetic coding sequence
atggccggcgagaaggtggagaagcccgacaccaaggagaagaagcccgaggccaagaaggtggacgccggcggcaaggtgaagaagggcaacctgaaggccaagaagcccaagaagggcaagccccactgcagcagaaaccccgtgctggtgagaggcatcggcagatacagcagaagcgccatgtacagcagaaaggccatgtacaagagaaagtacagcgccgccaagagcaaggtggagaagaagaagaaggagaaggtgctggccaccgtgaccaagcccgtgggcggcgacaagaacggcggcaccagagtggtgaagctgagaaagatgcccagatactaccccaccgaggacgtgcccagaaagctgctgagccacggcaagaagcccttcagccagcacgtgagaaagctgagagccagcatcacccccggcaccatcctgatcatcctgaccggcagacacagaggcaagagagtggtgttcctgaagcagctggccagcggcctgctgctggtgaccggccccctggtgctgaacagagtgcccctgagaagaacccaccagaagttcgtgatcgccaccagcaccaagatcgacatcagcaacgtgaagatccccaagcacctgaccgacgcctacttcaagaagaagaagctgagaaagcccagacaccaggagggcgagatcttcgacaccgagaaggagaagtacgagatcaccgagcagagaaagatcgaccagaaggccgtggacagccagatcctgcccaagatcaaggccatcccccagctgcagggctacctgagaagcgtgttcgccctgaccaacggcatctacccccacaagctggtgttctag

SEQ ID NO: 97461 - DNA, 867 bp, Artificial Sequence; identical to SEQ ID NO: 97460
  Description of Artificial Sequence: Synthetic coding sequence

SEQ ID NO: 97462 - DNA, 318 bp, Artificial Sequence
  Description of Artificial Sequence: Synthetic coding sequence
atggccggcgagaaggtggagaagcccgacaccaaggagaagaagcccgaggccaagaaggtggacgccggcggcaaggtgaagaagggcaacctgaaggccaagaagcccaagaagggcaagccccactgcagcagaaaccccgtgctggtgagaggcatcggcagatacagcagaagcgccatgtacagcagaaaggccatgtacaagagaaagtacagcgccgccaagagcaaggtggagaagaagaagaaggagaaggtgctggccaccgtgaccaagcccgtgggcggcgacaagaacggcggcaccagatag

SEQ ID NO: 97463 - DNA, 219 bp, Artificial Sequence
  Description of Artificial Sequence: Synthetic coding sequence
atggccggcgagaaggtggagaagcccgacaccaaggagaagaagcccgaggccaagaaggtggacgccggcggcaaggtgaagaagggcaacctgaaggccaagaagcccaagaagggcaagccccactgcagcagaaaccccgtgctggtgagaggcatcggcagatacagcagaagcgccatgtacagcagaaaggccatgtacaagagaaagtag

SEQ ID NO: 97464 - DNA, 480 bp, Artificial Sequence
  Description of Artificial Sequence: Synthetic coding sequence
atggccggcgagaaggtggagaagcccgacaccaaggagaagaagcccgaggccaagaaggtggacgccggcggcaaggtgaagaagggcaacctgaaggccaagaagcccaagaagggcaagccccactgcagcagaaaccccgtgctggtgagaggcatcggcagatacagcagaagcgccatgtacagcagaaaggccatgtacaagagaaagtacagcgccgccaagagcaaggtggagaagaagaagaaggagaaggtgctggccaccgtgaccaagcccgtgggcggcgacaagaacggcggcaccagagtggtgaagctgagaaagatgcccagatactaccccaccgaggacgtgcccagaaagctgctgagccacggcaagaagcccttcagccagcacgtgagaaagctgagagccagcatcacccccggcaccatcctgatcatcctgaccggcagacacagaggctag

SEQ ID NO: 97465 - DNA, 345 bp, Artificial Sequence
  Description of Artificial Sequence: Synthetic coding sequence
atggccggcgagaaggtggagaagcccgacaccaaggagaagaagcccgaggccaagaaggtggacgccggcggcaaggtgaagaagggcaacctgaaggccaagaagcccaagaagggcaagccccactgcagcagaaaccccgtgctggtgagaggcatcggcagatacagcagaagcgccatgtacagcagaaaggccatgtacaagagaaagtacagcgccgccaagagcaaggtggagaagaagaagaaggagaaggtgctggccaccgtgaccaagcccgtgggcggcgacaagaacggcggcaccagagtggtgaagctgagaaagatggtgagatag

SEQ ID NO: 97466 - DNA, 345 bp, Artificial Sequence; identical to SEQ ID NO: 97465
  Description of Artificial Sequence: Synthetic coding sequence

SEQ ID NO: 97467 - DNA, 747 bp, Artificial Sequence
  Description of Artificial Sequence: Synthetic coding sequence
atggagggcgtggaggagaagaagaaggaggtgcccgccgtgcccgagaccctgaagaagaagagaagaaacttcgccgagctgaagatcaagagactgagaaagaagttcgcccagaagatgctgagaaaggccagaagaaagctgatctacgagaaggccaagcactaccacaaggagtacagacagatgtacagaaccgagatcagaatggccagaatggccagaaaggccggcaacttctacgtgcccgccgagcccaagctggccttcgtgatcagaatcagaggcatcaacggcgtgagccccaaggtgagaaaggtgctgcagctgctgagactgagacagatcttcaacggcaccttcgtgaagctgaacaaggccagcatcaacatgctgagaatcgtggagccctacatcgcctggggctaccccaacctgaagagcgtgaacgagctgatctacaagagaggctacggcaagatcaacaagaagagaatcgccctgaccgacaacgccctgatcgccagaagcctgggcaagtacggcatcatctgcatggaggacctgatccacgagatctacaccgtgggcaagagattcaaggaggccaacaacttcctgtggcccttcaagctgagcagccccagaggcggcatgaagaagaagaccacccacttcgtggagggcggcgacgccggcaacagagaggaccagatcaacagactgatcagaagaatgaactag

SEQ ID NO: 97468 - DNA, 456 bp, Artificial Sequence
  Description of Artificial Sequence: Synthetic coding sequence
atggcccccctgtaccaggccgccggcaagggcgacgtgcccaccaagagaccccccgtgctgagagccggcgtgaacaccgtgaccaccctggtggagaacaagaaggcccagctggtggtgatcgcccacgacgtggaccccatcgagctggtggtgttcctgcccgccctgtgcagaaagatgggcgtgccctactgcatcatcaagggcaaggccagactgggcagactggtgcacagaaagacctgcaccaccgtggccttcacccaggtgaacagcgaggacaagggcgccctggccaagctggtggaggccatcagaaccaactacaacgacagatacgacgagatcagaagacactggggcggcaacgtgctgggccccaagagcgtggccagaatcgccaagctggagaaggccaaggccaaggagctggccaccaagctgggctag

SEQ ID NO: 97469 - DNA, 801 bp, Artificial Sequence
  Description of Artificial Sequence: Synthetic coding sequence
atgcccaagggcaagaaggccaagggcaagaaggtggcccccgcccccgccgtggtgaagaagcaggaggccaagaaggtggtgaaccccctgttcgagaagagacccaagaacttcggcatcggccaggacatccagcccaagagagacctgaccagattcgtgaagtggcccagatacatcagactgcagagacagagagccatcctgtacaagagactgaaggtgccccccgccatcaaccagttcacccaggccctggacagacagaccgccacccagctgctgaagctggcccacaagtacagacccgagaccaagcaggagaagaagcagagactgctggccagagccgagaagaaggccgccggcaagggcgacgtgcccaccaagagaccccccgtgctgagagccggcgtgaacaccgtgaccaccctggtggagaacaagaaggcccagctggtggtgatcgcccacgacgtggaccccatcgagctggtggtgttcctgcccgccctgtgcagaaagatgggcgtgccctactgcatcatcaagggcaaggccagactgggcagactggtgcacagaaagacctgcaccaccgtggccttcacccaggtgaacagcgaggacaagggcgccctggccaagctggtggaggccatcagaaccaactacaacgacagatacgacgagatcagaagacactggggcggcaacgtgctgggccccaagagcgtggccagaatcgccaagctggagaaggccaaggccaaggagctggccaccaagctgggctag

SEQ ID NO: 97470 - DNA, 576 bp, Artificial Sequence
  Description of Artificial Sequence: Synthetic coding sequence
atgctggtgagactgaacgtgagatgcagctgcagaggcgtggtgctgggcggctgcagaaagctgctggccagcctggtgcagcccaagggcaagaaggccaagggcaagaaggtggcccccgcccccgccgtggtgaagaagcaggaggccaagaaggtggtgaaccccctgttcgagaagagacccaagaacttcggcatcggccaggacatccagcccaagagagacctgaccagattcgtgaagtggcccagatacatcagactgcagagacagagagccatcctgtacaagagactgaaggtgccccccgccatcaaccagttcacccaggccctggacagacagaccgccacccagctgctgaagctggcccacaagtacagacccgagaccaagcaggagaagaagcagagactgctggccagagccgagaagaaggccgccggcaagggcgacgtgcccaccaagagaccccccgtgctgagagccggcgtgaacaccgtgaccaccctggtggagaacaagaaggcccagctggtggtgatcgcccacgacgtggaccccatctag

SEQ ID NO: 97471 - DNA, 774 bp, Artificial Sequence
  Description of Artificial Sequence: Synthetic coding sequence
atgggcagagtgatcagaggccagagaaagggcgccggcagcgtgttcagagcccacgtgaagcacagaaagggcgccgccagactgagagccgtggacttcgccgagagacacggctacatcaagggcatcgtgaaggacatcatccacgaccccggcagaggcgcccccctggccaaggtggtgttcagagacccctacagattcaagaagagaaccgagctgttcatcgccgccgagggcatccacaccggccagttcgtgtactgcggcaagaaggcccagctgaacatcggcaacgtgctgcccgtgggcaccatgcccgagggcaccatcgtgtgctgcctggaggagaagcccggcgacagaggcaagctggccagagccagcggcaactacgccaccgtgatcagccacaaccccgagaccaagaagaccagagtgaagctgcccagcggcagcaagaaggtgatcagcagcgccaacagagccgtggtgggcgtggtggccggcggcggcagaatcgacaagcccatcctgaaggccggcagagcctaccacaagtacaaggccaagagaaactgctggcccagagtgagaggcgtggccatgaaccccgtggagcaccccttcggcggcggcaaccaccagcacatcggcaagcccagcaccatcagaagagacgcccccgccggcagaaaggtgggcctgatcgccgccagaagaaccggcagactgagaggcaccaagaccgtgcaggagaaggagaactag

SEQ ID NO: 97472 - DNA, 774 bp, Artificial Sequence; identical to SEQ ID NO: 97471
  Description of Artificial Sequence: Synthetic coding sequence

SEQ ID NO: 97473 - DNA, 579 bp, Artificial Sequence
  Description of Artificial Sequence: Synthetic coding sequence
atgaagaccatcctgagcaaccagaccgtggacatccccgagaacgtggacatcaccctgaagggcagaaccgtgatcgtgaagggccccagaggcaccctgagaagagacttcaaccacatcaacgtggagctgagcctgctgggcaagaagaagaagagactgagagtggacaagtggtggggcaacagaaaggagctggccaccgtgagaaccatctgcagccacgtgcagaacatgatcaagggcgtgaccctgggcttcagatacaagatgagaagcgtgtacgcccacttccccatcaacgtggtgatccaggagaacggcagcctggtggagatcagaaacttcctgggcgagaagtacatcagaagagtgagaatgagacccggcgtggcctgcagcgtgagccaggcccagaaggacgagctgatcctggagggcaacgacatcgagctggtgagcaacagcgccgccctgatccagcaggccaccaccgtgaagaacaaggacatcagaaagttcctggacggcatctacgtgagcgagaagggcaccgtgcagcaggccgacgagtag

SEQ ID NO: 97474 - DNA, 444 bp, Artificial Sequence
  Description of Artificial Sequence: Synthetic coding sequence
atgaagaccatcctgagcaaccagaccgtggacatccccgagaacgtggacatcaccctgaagggcagaaccgtgatcgtgaagggccccagaggcaccctgagaagagacttcaaccacatcaacgtggagctgagcctgctgggcaagaagaagaagagactgagagtggacaagtggtggggcaacagaaaggagctggccaccgtgagaaccatctgcagccacgtgcagaacatgatcaagggcgtgaccctgggcttcagatacaagatgagaagcgtgtacgcccacttccccatcaacgtggtgatccaggagaacggcagcctggtggagatcagaaacttcctgggcgagaagtacatcagaagagtgagaatgagacccggcgtggcctgcttcaagttcagcggcttcgacagcgccagccacaacagctag

SEQ ID NO: 97475 - DNA, 579 bp, Artificial Sequence; identical to SEQ ID NO: 97473
  Description of Artificial Sequence: Synthetic coding sequence

SEQ ID NO: 97476 - DNA, 501 bp, Artificial Sequence
  Description of Artificial Sequence: Synthetic coding sequence
atgaagaccatcctgagcaaccagaccgtggacatccccgagaacgtggacatcaccctgaagggcagaaccgtgatcgtgaagggccccagaggcaccctgagaagagacttcaaccacatcaacgtggagctgagcctgctgggcaagaagaagaagagactgagagtggacaagtggtggggcaacagaaaggagctggccaccgtgagaaccatctgcagccacgtgcagaacatgatcaagggcgtgaccctgggcttcagatacaagatgagaagcgtgtacgcccacttccccatcaacgtggtgatccaggagaacggcagcctggtggagatcagaaacttcctgggcgagaagtacatcagaagagtgagaatgagacccggcgtggcctgcagcgtgagccaggcccagaaggacgagctgatcctggagggcaacgacatcgagctggtgagcaacagcgccgccctgatccagcaggccaccacctag

SEQ ID NO: 97477 - DNA, 498 bp, Artificial Sequence
  Description of Artificial Sequence: Synthetic coding sequence
atgctgatgcccaagaagaacagaatcgccatctacgagctgctgttcaaggagggcgtgatggtggccaagaaggacgtgcacatgcccaagcaccccgagctggccgacaagaacgtgcccaacctgcacgtgatgaaggccatgcagagcctgaagagcagaggctacgtgaaggagcagttcgcctggagacacttctactggtacctgaccaacgagggcatccagtacctgagagactacctgcacctgccccccgagatcgtgcccgccaccctgagaagaagcagacccgagaccggcagacccagacccaagggcctggagggcgagagacccgccagactgaccagaggcgaggccgacagagacacctacagaagaagcgccgtgccccccggcgccgacaagaaggccgaggccggcgccggcagcgccaccgagttccagttcagaggcggcttcggcagaggcagaggccagcccccccagtag

SEQ ID NO: 97478 - DNA, 477 bp, Artificial Sequence
  Description of Artificial Sequence: Synthetic coding sequence
atggccgacatccagaccgagagagcctaccagaagcagcccaccatcttccagaacaagaagagagtgctgctgggcgagaccggcaaggagaagctgcccagatactacaagaacatcggcctgggcttcaagacccccaaggaggccatcgagggcacctacatcgacaagaagtgccccttcaccggcaacgtgagcatcagaggcagaatcctgagcggcgtggtgaccaagatgaagatgcagagaaccatcgtgatcagaagagactacctgcactacatcagaaagtacaacagattcgagaagagacacaagaacatgagcgtgcacctgagcccctgcttcagagacgtgcagatcggcgacatcgtgaccgtgggcgagtgcagacccctgagcaagaccgtgagattcaacgtgctgaaggtgaccaaggccgccggcaccaagaagcagttccagaagttctag

SEQ ID NO: 97479 - DNA, 423 bp, Artificial Sequence
  Description of Artificial Sequence: Synthetic coding sequence
atgaccagcatgacccagagcctgagagaggtgatcaaggccatgaccaaggccagaaacttcgagagagtgctgggcaagatcaccctggtgagcgccgcccccggcaaggtgatctgcgagatgaaggtggaggaggagcacaccaacgccatcggcaccctgcacggcggcctgaccgccaccctggtggacaacatcagcaccatggccctgctgtgcaccgagagaggcgcccccggcgtgagcgtggacatgaacatcacctacatgagccccgccaagctgggcgaggacatcgtgatcaccgcccacgtgctgaagcagggcaagaccctggccttcaccagcgtggacctgaccaacaaggccaccggcaagctgatcgcccagggcagacacaccaagcacctgggcaactag

SEQ ID NO: 97480 - DNA, 456 bp, Artificial Sequence
  Description of Artificial Sequence: Synthetic coding sequence
atgggcagaatgcacgcccccggcaagggcctgagccagagcgccctgccctacagaagaagcgtgcccacctggctgaagctgaccagcgacgacgtgaaggagcagatctacaagctggccaagaagggcctgacccccagccagatcggcgtgatcctgagagacagccacggcgtggcccaggtgagattcgtgaccggcaacaagatcctgagaatcctgaagagcaagggcctggcccccgacctgcccgaggacctgtaccacctgatcaagaaggccgtggccgtgagaaagcacctggagagaaacagaaaggacaaggacgccaagttcagactgatcctgatcgagagcagaatccacagactggccagatactacaagaccaagagagtgctgccccccaactggaagtacgagagcagcaccgccagcgccctggtggcctag

SEQ ID NO: 97481 - DNA, 456 bp, Artificial Sequence
  Description of Artificial Sequence: Synthetic coding sequence
atggcccccagaaagggcaaggagaagaaggaggagcaggtgatcagcctgggcccccaggtggccgagggcgagaacgtgttcggcgtgtgccacatcttcgccagcttcaacgacaccttcgtgcacgtgaccgacctgagcggcaaggagaccatctgcagagtgaccggcggcatgaaggtgaaggccgacagagacgagagcagcccctacgccgccatgctggccgcccaggacgtggcccagagatgcaaggagctgggcatcaccgccctgcacatcaagctgagagccaccggcggcaacagaaccaagacccccggccccggcgcccagagcgccctgagagccctggccagaagcggcatgaagatcggcagaatcgaggacgtgacccccatccccagcgacagcaccagaagaaagggcggcagaagaggcagaagactgtag

SEQ ID NO: 97482 - DNA, 456 bp, Artificial Sequence; identical to SEQ ID NO: 97481
  Description of Artificial Sequence: Synthetic coding sequence

SEQ ID NO: 97483 - DNA, 456 bp, Artificial Sequence; identical to SEQ ID NO: 97481
  Description of Artificial Sequence: Synthetic coding sequence

SEQ ID NO: 97484 - DNA, 456 bp, Artificial Sequence; identical to SEQ ID NO: 97481
  Description of Artificial Sequence: Synthetic coding sequence

SEQ ID NO: 97485 - DNA, 6912 bp, Artificial Sequence; identical to SEQ ID NO: 72008
  Description of Artificial Sequence: Synthetic coding sequence

SEQ ID NO: 97486 - DNA, 438 bp, Artificial Sequence
  Description of Artificial Sequence: Synthetic coding sequence
atggccgaggtggagcagaagaagaagagaaccttcagaaagttcacctacagaggcgtggacctggaccagctgctggacatgagctacgagcagctgatgcagctgtacagcgccagacagagaagaagactgaacagaggcctgagaagaaagcagcacagcctgctgaagagactgagaaaggccaagaaggaggccccccccatggagaagcccgaggtggtgaagacccacctgagagacatgatcatcctgcccgagatggtgggcagcatggtgggcgtgtacaacggcaagaccttcaaccaggtggagatcaagcccgagatgatcggccactacctgggcgagttcagcatcacctacaagcccgtgaagcacggcagacccggcatcggcgccacccacagcagcagattcatccccctgaagtag

SEQ ID NO: 97487 - DNA, 393 bp, Artificial Sequence
  Description of Artificial Sequence: Synthetic coding sequence
atggtgagaatgaacgtgctggccgacgccctgaagagcatcaacaacgccgagaagagaggcaagagacaggtgctgatcagaccctgcagcaaggtgatcgtgagattcctgaccgtgatgatgaagcacggctacatcggcgagttcgagatcatcgacgaccacagagccggcaagatcgtggtgaacctgaccggcagactgaacaagtgcggcgtgatcagccccagattcgacgtgcagctgaaggacctggagaagtggcagaacaacctgctgcccagcagacagttcggcttcatcgtgctgaccaccagcgccggcatcatggaccacgaggaggccagaagaaagcacaccggcggcaagatcctgggcttcttcttctag

SEQ ID NO: 97488 - DNA, 393 bp, Artificial Sequence; identical to SEQ ID NO: 97487
  Description of Artificial Sequence: Synthetic coding sequence

SEQ ID NO: 97489 - DNA, 441 bp, Artificial Sequence
  Description of Artificial Sequence: Synthetic coding sequence
atgcccagcaagggccccctgcagagcgtgcaggtgttcggcagaaagaagaccgccaccgccgtggcccactgcaagagaggcaacggcctgatcaaggtgaacggcagacccctggagatgatcgagcccagaaccctgcagtacaagctgctggagcccgtgctgctgctgggcaaggagagattcgccggcgtggacatcagagtgagagtgaagggcggcggccacgtggcccagatctacgccatcagacagagcatcagcaaggccctggtggcctactaccagaagtacgtggacgaggccagcaagaaggagatcaaggacatcctgatccagtacgacagaaccctgctggtggccgaccccagaagatgcgagagcaagaagttcggcggccccggcgccagagccagataccagaagagctacagatag

SEQ ID NO: 97490 - DNA, 459 bp, Artificial Sequence
  Description of Artificial Sequence: Synthetic coding sequence
atgcccagcaagggccccctgcagagcgtgcaggtgttcggcagaaagaagaccgccaccgccgtggcccactgcaagagaggcaacggcctgatcaaggtgaacggcagacccctggagatgatcgagcccagaaccctgcagtacaagctgctggagcccgtgctgctgctgggcaaggagagattcgccggcgtggacatcagagtgagagtgaagggcggcggccacgtggcccagatctacggcgagagccaggagctgggcgcctggagaagatggctgtgggagggcggcctgcacagcgcccccgtgcccttcaactgcgtgagcttcagccagctgagcgtgagccccagccccaagccctggtggcccatcaccagaaacatgtggatgagactgcccagaagaagaagcaagaccagcagcagcagcatgaccggcccctgctggtag

SEQ ID NO: 97491 - DNA, 408 bp, Artificial Sequence
  Description of Artificial Sequence: Synthetic coding sequence
atgggcagagtgagaaccaagaccgtgaagaaggccgccagagtgatcatcgagaagtactacaccagactgggcaacgacttccacaccaacaagagagtgtgcgaggagatcgccatcatccccagcaagaagctgagaaacaagatcgccggctacgtgacccacctgatgaagagaatccagagaggccccgtgagaggcatcagcatcaagctgcaggaggaggagagagagagaagagacaactacgtgcccgaggtgagcgccctggaccaggagatcatcgaggtggaccccgacaccaaggagatgctgaagctgctggacttcggcagcctgagcaacctgcaggtgacccagcccaccgtgggcatgaacttcaagacccccagaggccccgtgtag

SEQ ID NO: 97492 - DNA, 300 bp, Artificial Sequence
  Description of Artificial Sequence: Synthetic coding sequence
atggacctgatcggcttcggctacgccgccctggtgaccttcggcagcatcttcggctacaagagaagaggcggcgtgcccagcctgatcgccggcctgttcgtgggctgcctggccggctacggcgcctacagagtgagcaacgacaagagagacgtgaaggtgagcctgttcaccgccttcttcctggccaccatcatgggcgtgagattcaagagaagcaagaagatcatgcccgccggcctggtggccggcctgagcctgatgatgatcctgagactggtgctgctgctgctgtag

SEQ ID NO: 97493 - DNA, 459 bp, Artificial Sequence; identical to SEQ ID NO: 82265
  Description of Artificial Sequence: Synthetic coding sequence

SEQ ID NO: 97494 - DNA, 459 bp, Artificial Sequence; identical to SEQ ID NO: 82265
  Description of Artificial Sequence: Synthetic coding sequence

SEQ ID NO: 97495 - DNA, 105 bp, Artificial Sequence
  Description of Artificial Sequence: Synthetic coding sequence
atgagcctggtgatccccgagaagttccagcacatcctgagagtgctgaacaccaacatcgacggcagaagaaagatcgccttcgccatcaccgccatcaagtag

SEQ ID NO: 97496 - DNA, 459 bp, Artificial Sequence; identical to SEQ ID NO: 82265
  Description of Artificial Sequence: Synthetic coding sequence

SEQ ID NO: 97497 - DNA, 459 bp, Artificial Sequence; identical to SEQ ID NO: 82265
  Description of Artificial Sequence: Synthetic coding sequence

SEQ ID NO: 97498 - DNA, 249 bp, Artificial Sequence
  Description of Artificial Sequence: Synthetic coding sequence
atgcagaaccccagacagtacaagatccccgactggttcctgaacagacagaaggacgtgaaggacggcaagtacagccaggtgctggccaacggcctggacaacaagctgagagaggacctggagagactgaagaagatcagagcccacagaggcctgagacacttctggggcctgagagtgagaggccagcacaccaagaccaccggcagaagaggcagaaccgtgggcgtgagcaagaagaagtag

SEQ ID NO: 97499 - DNA, 249 bp, Artificial Sequence; identical to SEQ ID NO: 97498
  Description of Artificial Sequence: Synthetic coding sequence

SEQ ID NO: 97500 - DNA, 249 bp, Artificial Sequence; identical to SEQ ID NO: 97498
  Description of Artificial Sequence: Synthetic coding sequence

SEQ ID NO: 97501 - DNA, 249 bp, Artificial Sequence; identical to SEQ ID NO: 97498
  Description of Artificial Sequence: Synthetic coding sequence

SEQ ID NO: 97502 - DNA, 249 bp, Artificial Sequence; identical to SEQ ID NO: 97498
  Description of Artificial Sequence: Synthetic coding sequence

SEQ ID NO: 97503 - DNA, 648 bp, Artificial Sequence
  Description of Artificial Sequence: Synthetic coding sequence
atgtacagcttcatgggcggcggcctgttctgcgcctgggtgggcaccatcctgctggtggtggccatggccaccgaccactggatgcagtacagactgagcggcagcttcgcccaccagggcctgtggagatactgcctgggcaacaagtgctacctgcagaccgacagcatcggcgagccccccggccagggccccggcagagcctggggcaagagcagagccgacctgggcgcccagggccacctgtacagcagatggagaaccctgagactgaaggagggcaagggcgccacccaggcctactggaacgccaccagagccttcatgatcctgagcgccctgtgcgccatcagcggcatcatcatgggcatcatggccttcgcccaccagcccaccttcagcagaatcagcagacccttcagcgccggcatcatgttcttcagcagcaccctgttcgtggtgctggccctggccatctacaccggcgtgaccgtgagcttcctgggcagaagattcggcgactggagattcagctggagctacatcctgggctgggtggccgtgctgatgaccttcttcgccggcatcttctacatgtgcgcctacagagtgcacgagtgcagaagactgagcacccccagatag

SEQ ID NO: 97504 - DNA, 438 bp, Artificial Sequence
  Description of Artificial Sequence: Synthetic coding sequence
atgcccggcgtgaccgtgaaggacgtgaaccagcaggagttcgtgagagccctggccgccttcctgaagaagagcggcaagctgaaggtgcccgagtgggtggacaccgtgaagctggccaagcacaaggagctggccccctacgacgagaactggttctacaccagagccgccagcaccgccagacacctgtacctgagaggcggcgccggcgtgggcagcatgaccaagatctacggcggcagacagagaaacggcgtgatgcccagccacttcagcagaggcagcaagagcgtggccagaagagtgctgcaggccctggagggcctgaagatggtggagaaggaccaggacggcggcagaaagctgaccccccagggccagagagacctggacagaatcgccggccaggtggccgccgccaacaagaagcactag

SEQ ID NO: 97505 - DNA, 411 bp, Artificial Sequence
  Description of Artificial Sequence: Synthetic coding sequence
atgagcgccgccctgctgagaagaggcctggagctgctggccgccagcgaggcccccagagacccccccggccaggccaagcccagaggcgcccccgtgaagagacccagaaagaccaaggccatccaggcccagaagctgagaaacagcgccaagggcaaggtgcccaagagcgccctggacgagtacagaaagagagagtgcagagaccacctgagagtgaacctgaagttcctgaccagaaccagaagcaccgtggccgagagcgtgagccagcagatcctgagacagaacagaggcagaaaggcctgcgacagacccgtggccaagaccaagaagaagaaggccgagggcaccgtgttcaccgaggaggacttccagaagttccagcaggagtacttcggcagctag

SEQ ID NO: 97506 - DNA, 882 bp, Artificial Sequence
  Description of Artificial Sequence: Synthetic coding sequence
atggccgacgacgccggcgccgccggcggccccggcggccccggcggccccggcatgggcaacagaggcggcttcagaggcggcttcggcagcggcatcagaggcagaggcagaggcagaggcagaggcagaggcagaggcagaggcgccagaggcggcaaggccgaggacaaggagtggatgcccgtgaccaagctgggcagactggtgaaggacatgaagatcaagagcctggaggagatctacctgttcagcctgcccatcaaggagagcgagatcatcgacttcttcctgggcgccagcctgaaggacgaggtgctgaagatcatgcccgtgcagaagcagaccagagccggccagagaaccagattcaaggccttcgtggccatcggcgactacaacggccacgtgggcctgggcgtgaagtgcagcaaggaggtggccaccgccatcagaggcgccatcatcctggccaagctgagcatcgtgcccgtgagaagaggctactggggcaacaagatcggcaagccccacaccgtgccctgcaaggtgaccggcagatgcggcagcgtgctggtgagactgatccccgcccccagaggcaccggcatcgtgagcgcccccgtgcccaagaagctgctgatgatggccggcatcgacgactgctacaccagcgccagaggctgcaccgccaccctgggcaacttcgccaaggccaccttcgacgccatcagcaagacctacagctacctgacccccgacctgtggaaggagaccgtgttcaccaagagcccctaccaggagttcaccgaccacctggtgaagacccacaccagagtgagcgtgcagagaacccaggcccccgccgtggccaccacctag

SEQ ID NO: 97507 - DNA, 708 bp, Artificial Sequence
  Description of Artificial Sequence: Synthetic coding sequence
atggccgacgacgccggcgccgccggcggccccggcggccccggcggccccggcatgggcaacagaggcggcttcagaggcggcttcggcagcggcatcagaggcagaggcagaggcagaggcagaggcagaggcagaggcagaggcgccagaggcggcaaggccgaggacaaggagtggatgcccgtgaccaagctgggcagactggtgaaggacatgaagatcaagagcctggaggagatctacctgttcagcctgcccatcaaggagagcgagatcatcgacttcttcctgggcgccagcctgaaggacgaggtgctgaagatcatgcccgtgcagaagcagaccagagccggccagagaaccagattcaaggtgaccggcagatgcggcagcgtgctggtgagactgatccccgcccccagaggcaccggcatcgtgagcgcccccgtgcccaagaagctgctgatgatggccggcatcgacgactgctacaccagcgccagaggctgcaccgccaccctgggcaacttcgccaaggccaccttcgacgccatcagcaagacctacagctacctgacccccgacctgtggaaggagaccgtgttcaccaagagcccctaccaggagttcaccgaccacctggtgaagacccacaccagagtgagcgtgcagagaacccaggcccccgccgtggccaccacctag

SEQ ID NO: 97508 - DNA, 537 bp, Artificial Sequence
  Description of Artificial Sequence: Synthetic coding sequence
atggccgacgacgccggcgccgccggcggccccggcggccccggcggccccggcatgggcaacagaggcggcttcagaggcggcttcggcagcggcatcagaggcagaggcagaggcagaggcagaggcagaggcagaggcagaggcgccagaggcggcaaggccgaggacaaggagtggatgcccgtgaccaagctgggcagactggtgaaggacatgaagatcaagagcctggaggagatctacctgttcagcctgcccatcaaggagagcgagatcatcgacttcttcctgggcgccagcctgaaggacgaggtgctgaagatcatgcccgtgcagaagcagaccagagccggccagagaaccagattcaaggtgcccggctgccccggcggcggctgcgccggcctggccggcaccctgagcgccctgcacagctgcacctggctgcacccctgcgacttcagaaacggcgagagagagaagagaagcccccaggacctgggctgggccctgctgtggcccctgttcccctag

SEQ ID NO: 97509 - DNA, 588 bp, Artificial Sequence
  Description of Artificial Sequence: Synthetic coding sequence
gtgaccaagctgggcagactggtgaaggacatgaagatcaagagcctggaggagatctacctgttcagcctgcccatcaaggccttcgtggccatcggcgactacaacggccacgtgggcctgggcgtgaagtgcagcaaggaggtggccaccgccatcagaggcgccatcatcctggccaagctgagcatcgtgcccgtgagaagaggctactggggcaacaagatcggcaagccccacaccgtgccctgcaaggtgaccggcagatgcggcagcgtgctggtgagactgatccccgcccccagaggcaccggcatcgtgagcgcccccgtgcccaagaagctgctgatgatggccggcatcgacgactgctacaccagcgccagaggctgcaccgccaccctgggcaacttcgccaaggccaccttcgacgccatcagcaagacctacagctacctgacccccgacctgtggaaggagaccgtgttcaccaagagcccctaccaggagttcaccgaccacctggtgaagacccacaccagagtgagcgtgcagagaacccaggcccccgccgtggccaccacctag

SEQ ID NO: 97510 - DNA, 360 bp, Artificial Sequence
  Description of Artificial Sequence: Synthetic coding sequence
atggccttcaaggacaccggcaagacccccgtggagcccgaggtggccatccacagaatcagaatcaccctgaccagcagaaacgtgaagagcctggagaaggtgtgcgccgacctgatcagaggcgccaaggagaagaacctgaaggtgaagggccccgtgagaatgcccaccaagaccctgagaatcaccaccagaaagaccccctgcggcgagggcagcaagacctgggacagattccagatgagaatccacaagagactgatcgacctgcacagccccagcgagatcgtgaagcagatcaccagcatcagcatcgagcccggcgtggaggtggaggtgaccatcgccgacgcctag

SEQ ID NO: 97511 - DNA, 429 bp, Artificial Sequence
  Description of Artificial Sequence: Synthetic coding sequence
atggccttcaaggacaccggcaagacccccgtggagcccgaggtggccatccacagaatcagaatcaccctgaccagcagaaacgtgaagagcctggagaaggtgtgcgccgacctgatcagaggcgccaaggagaagaacctgaaggtgaagggccccgtgagaatgcccaccaagaccctgagaatcaccaccagaaagaccccctgcggcgagggcagcaagacctgggacagattccagatgagaatccacaagagactgatcgacctgcacagccccagcgagatcgtgaagcagatcaccagcatcagcatcgagcccggcgtggagctgatcgagagcaccgacgccgagcccatggacaccgagggccagcagtacaccctgagaagcgtgttcgagagccccggcacctgccccttctag

SEQ ID NO: 97512 - DNA, 360 bp, Artificial Sequence; identical to SEQ ID NO: 97510
  Description of Artificial Sequence: Synthetic coding sequence

SEQ ID NO: 97513 - DNA, 252 bp, Artificial Sequence
  Description of Artificial Sequence: Synthetic coding sequence
atgcagaacgacgccggcgagttcgtggacctgtacgtgcccagaaagtgcagcgccagcaacagaatcatcggcgccaaggaccacgccagcatccagatgaacgtggccgaggtggacaaggtgaccggcagattcaacggccagttcaagacctacgccatctgcggcgccatcagaagaatgggcgagagcgacgacagcatcctgagactggccaaggccgacggcatcgtgagcaagaacttctag

SEQ ID NO: 97514 - DNA, 294 bp, Artificial Sequence
  Description of Artificial Sequence: Synthetic coding sequence
atgcagaacgacgccggcgagttcgtggacctgtacgtgcccagaaagtgcagcgccagcaacagaatcatcggcgccaaggaccacgccagcatccagatgaacgtggccagactgaccagaagccaggccggcctgatggccagcctgaagctgatgctgagcgccggccccttcgtgggctgggtgagccagatgatccccttcagcgactggcccagaagatggcacagactgaaggagctgctgaccggcgagaaccacagatgcggcatcttcgtgatcaacaagtag

SEQ ID NO: 97515 - DNA, 252 bp, Artificial Sequence; identical to SEQ ID NO: 97513
  Description of Artificial Sequence: Synthetic coding sequence

SEQ ID NO: 97516 - DNA, 201 bp, Artificial Sequence
  Description of Artificial Sequence: Synthetic coding sequence
atgcagaacgacgccggcgagttcgtggacctgtacgtgcccagaaagtgcagcgccagcaacagaatcatcggcgccaaggaccacgccagcatccagatgaacgtggccgaggtgagctgggagcccggcagaagagagggctgcgacatctgcgccggcaaggccggctgccccatcgtggaggagcccctgggctag

SEQ ID NO: 97517 - DNA, 273 bp, Artificial Sequence
  Description of Artificial Sequence: Synthetic coding sequence
atgcagaacgacgccggcgagttcgtggacctgtacgtgcccagaaagtgcagcgccagcaacagaatcatcggcgccaaggaccacgccagcatccagatgaacgtggccgaggtggacaaggtgaccggcagattcaacggccagttcaagacctacgccatctgcggcgccatcagaagaatggtgagcgtgagcctgggcttcgcccaccacttcggcaccagctggaccctgccctgcgccctggagtgcgtgatggtgcccgagtag

SEQ ID NO: 97518 - DNA, 246 bp, Artificial Sequence
  Description of Artificial Sequence: Synthetic coding sequence
atgcagaacgacgccggcgagttcgtggacctgtacgtgcccagaaagtgcagcgccagcaacagaatcatcggcgccaaggaccacgccagcatccagatgaacgtggccgaggtggacaaggtgaccggcagattcaacggccagttcaagacctacgccatctgcggcgccatcagaagaatgggcgagagcgacgacagcatcctgagactggccaaggccgacggcatcgtgagcaagtag

SEQ ID NO: 97519 - DNA, 432 bp, Artificial Sequence
  Description of Artificial Sequence: Synthetic coding sequence
atgggcaagtgcagaggcctgagaaccgccagaaagctgagaagccacagaagagaccagaagtggcacgacaagcagtacaagaaggcccacctgggcaccgccctgaaggccaaccccttcggcggcgccagccacgccaagggcatcgtgctggagaaggtgggcgtggaggccaagcagcccaacagcgccatcagaaagtgcgtgagagtgcagctgatcaagaacggcaagaagatcaccgccttcgtgcccaacgacggctgcctgaacttcatcgaggagaacgacgaggtgctggtggccggcttcggcagaaagggccacgccgtgggcgacatccccggcgtgagattcaaggtggtgaaggtggccaacgtgagcctgctggccctgtacaagggcaagaaggagagacccagaagctag

SEQ ID NO: 97520 - DNA, 393 bp, Artificial Sequence
  Description of Artificial Sequence: Synthetic coding sequence
atgaacgacaccgtgaccatcagaaccagaaagttcatgaccaacagactgctgcagagaaagcagatggtgatcgacgtgctgcaccccggcaaggccaccgtgcccaagaccgagatcagagagaagctggccaagatgtacaagaccacccccgacgtgatcttcgtgttcggcttcagaacccacttcggcggcggcaagaccaccggcttcggcatgatctacgacagcctggactacgccaagaagaacgagcccaagcacagactggccagacacggcctgtacgagaagaagaagaccagcagaaagcagagaaaggagagaaagaacagaatgaagaaggtgagaggcaccgccaaggccaacgtgggcgccggcaagaagtag

SEQ ID NO: 97521 - DNA, 402 bp, Artificial Sequence
  Description of Artificial Sequence: Synthetic coding sequence
atgaacgacaccgtgaccatcagaaccagaaagttcatgaccaacagactgctgcagagaaagcagatggtgatcgacgtgctgcaccccggcaaggccaccgtgcccaagaccgagatcagagagaagctggccaagatgtacaagaccacccccgacgtgatcttcgtgttcggcttcagaacccacttcggcggcggcaagaccaccggcttcggcatgatctacgacagcctggactacgccaagaagaacgagcccaagcacagactggccagacacggcctgtacgagaagaagaagaccagcagaaagcagagaaaggagagaaagaacagaatgaagaaggtgagaggcaccgccaaggccaacgtgggcgccggcaagaagcccaaggagtag

SEQ ID NO: 97522 - DNA, 399 bp, Artificial Sequence
  Description of Artificial Sequence: Synthetic coding sequence
atgaacgacaccgtgaccatcagaaccagaaagttcatgaccaacagactgctgcagagaaagcagatggtgatcgacgtgctgcaccccggcaaggccaccgtgcccaagaccgagatcagagagaagctggccaagatgtacaagaccacccccgacgtgatcttcgtgttcggcttcagaacccacttcggcggcggcaagaccaccggcttcggcatgatctacgacagcctggactacgccaagaagaacgagcccaagcacagactggccagacacggcctgtacgagaagaagaagaccagcagaaagcagagaaaggagagaaagaacagaatgaagaaggtgagaggcaccgccaaggccaacgtgggcgccggcaagaagcagaagtag

SEQ ID NO: 97523 - DNA, 396 bp, Artificial Sequence
  Description of Artificial Sequence: Synthetic coding sequence
atgaacgacaccgtgaccatcagaaccagaaagttcatgaccaacagactgctgcagagaaagcagatggtgatcgacgtgctgcaccccggcaaggccaccgtgcccaagaccgagatcagagagaagctggccaagatgtacaagaccacccccgacgtgatcttcgtgttcggcttcagaacccacttcggcggcggcaagaccaccggcttcggcatgatctacgacagcctggactacgccaagaagaacgagcccaagcacagactggccagacacggcctgtacgagaagaagaagaccagcagaaagcagagaaaggagagaaagaacagaatgaagaaggtgagaggcaccgccaaggccaacgtgggcgccggcaagaagcagtag

SEQ ID NO: 97524 - DNA, 870 bp, Artificial Sequence
  Description of Artificial Sequence: Synthetic coding sequence
atgaacgacaccgtgaccatcagaaccagaaagttcatgaccaacagactgctgcagagaaagcagatggtgatcgacgtgctgcaccccggcaaggccaccgtgcccaagaccgagatcagagagaagctggccaagatgtacaagaccacccccgacgtgatcttcgtgttcggcttcagaacccacttcggcggcggcaagaccaccggcttcggcatgatctacgacagcctggactacgccaagaagaacgagcccaagcacagactggccagacacggcctgtacgagaagaagaagaccagcagaaagcagagaaaggagagaaagaacagaatgaagaaggtgagaggcaccgccaaggccaacgtgggcgccggcaagaagatgagagagctgggcctgggcgtgcaggccctgggcagaatcagccaggaggagagatgcaccgacgtgaagaacagcaaggccagagagagcagaggcgtggtgtggcaggtggaggtgcccggcccctggagcgtgtggacctgcggcagactgagaagaggctgcggcaagtacctgcaggtggccgtgacctggagaaagaccgagaacagagagcagtgctgccaggcctgcctgctggagagagccctggtgagaaacggcgccttcatgagccccgccagccccgcccccgccggcagcccccaccccgtggacggcgacctggtgctgcacctgcccgaggccctgagcgccaccctgaccctgagcccccacatccaggccatcaacaagagcttcggccccttcttcgagatccaccaggagagcagctgcttcagcccccccagctgcctgagcggcctgggccactag

SEQ ID NO: 97525 - DNA, 378 bp, Artificial Sequence
  Description of Artificial Sequence: Synthetic coding sequence
atgccccccaaggacgacaagaagaagaaggacgccggcaagagcgccaagaaggacaaggaccccgtgaacaagagcggcggcaaggccaagaagaagaagtggagcaagggcaaggtgagagacaagctgaacaacctggtgctgttcgacaaggccacctacgacaagctgtgcaaggaggtgcccaactacaagctgatcacccccgccgtggtgagcgagagactgaagatcagaggcagcctggccagagccgccctgcaggagctgctgagcaagggcctgatcaagctggtgagcaagcacagagcccaggtgatctacaccagaaacaccaagggcggcgacgcccccgccgccggcgaggacgcctag

SEQ ID NO: 97526 - DNA, 348 bp, Artificial Sequence
  Description of Artificial Sequence: Synthetic coding sequence
atgaccaagaagagaagaaacaacggcagagccaagaagggcagaggccacgtgcagcccatcagatgcaccaactgcgccagatgcgtgcccaaggacaaggccatcaagaagttcgtgatcagaaacatcgtggaggccgccgccgtgagagacatcagcgaggccagcgtgttcgacgcctacgtgctgcccaagctgtacgtgaagctgcactactgcgtgagctgcgccatccacagcaaggtggtgagaaacagaagcagagaggccagaaaggacagaacccccccccccagattcagacccgccggcgccgcccccagacccccccccaagcccatgtag

SEQ ID NO: 97527 - DNA, 348 bp, Artificial Sequence; identical to SEQ ID NO: 97526
  Description of Artificial Sequence: Synthetic coding sequence

SEQ ID NO: 97528 - DNA, 255 bp, Artificial Sequence
  Description of Artificial Sequence: Synthetic coding sequence
atgcccctggccaaggacctgctgcaccccagccccgaggaggagaagagaaagcacaagaagaagagactggtgcagagccccaacagctacttcatggacgtgaagtgccccggctgctacaagatcaccaccgtgttcagccacgcccagaccgtggtgctgtgcgtgggctgcagcaccgtgctgtgccagcccaccggcggcaaggccagactgaccgagggctgcagcttcagaagaaagcagcactag

SEQ ID NO: 97529 - DNA, 201 bp, Artificial Sequence
  Description of Artificial Sequence: Synthetic coding sequence
atgcccctggccaaggacctgctgcaccccagccccgaggaggagaagagaaagcacaagaagaagagactggtgcagagccccaacagctacttcatggacgtgaagtgccccggcgaggagaccgcctgctgcagcggcgagagcaccggcccccagcagctggagaacgtggtggtgctggccgtgagctacccctag

SEQ ID NO: 97530 - DNA, 255 bp, Artificial Sequence
  Description of Artificial Sequence: Synthetic coding sequence
atgcccctggccagagacctgctgcaccccagcctggaggaggagaagaagaagcacaagaagaagagactggtgcagagccccaacagctacttcatggacgtgaagtgccccggctgctacaagatcaccaccgtgttcagccacgcccagaccgtggtgctgtgcgtgggctgcagcaccgtgctgtgccagcccaccggcggcaaggccagactgaccgagggctgcagcttcagaagaaagcagcactag

SEQ ID NO: 97531 - DNA, 159 bp, Artificial Sequence
  Description of Artificial Sequence: Synthetic coding sequence
atggacgtgaagtgccccggctgctacaagatcaccaccgtgttcagccacgcccagaccgtggtgctgtgcgtgggctgcagcaccgtgctgtgccagcccaccggcggcaaggccagactgaccgagggctgcagcttcagaagaaagcagcactag

SEQ ID NO: 97532 - DNA, 159 bp, Artificial Sequence; identical to SEQ ID NO: 97531
  Description of Artificial Sequence: Synthetic coding sequence

SEQ ID NO: 97533 - DNA, 303 bp, Artificial Sequence
  Description of Artificial Sequence: Synthetic coding sequence
atgtgccagagatgcggcctgaagctgatcgtgatcatctgcttcttcgtgcagctggccagagacctgctgcaccccagcctggaggaggagaagaagaagcacaagaagaagagactggtgcagagccccaacagctacttcatggacgtgaagtgccccggctgctacaagatcaccaccgtgttcagccacgcccagaccgtggtgctgtgcgtgggctgcagcaccgtgctgtgccagcccaccggcggcaaggccagactgaccgagggctgcagcttcagaagaaagcagcactag

SEQ ID NO: 97534 - DNA, 210 bp, Artificial Sequence
  Description of Artificial Sequence: Synthetic coding sequence
atggacaccagcagagtgcagcccatcaagctggccagagtgaccaaggtgctgggcagaaccggcagccagggccagtgcacccaggtgagagtggagttcatggacgacaccagcagaagcatcatcagaaacgtgaagggccccgtgagagagggcgacgtgctgaccctgctggagagcgagagagaggccagaagactgagatag

SEQ ID NO: 97535 - DNA, 366 bp, Artificial Sequence
  Description of Artificial Sequence: Synthetic coding sequence
atggtgcccttcaacgacctgtacagcggccccgacaccttcagcgagttcatcagcgccagccacagcgccgtgcccttcagaggcccccccctgctgctgccccccctgagatggggccccgtgggcgccagaggcatccacggcagacacgagcccatccaccacccccagtgcaagagacccagagccagaggcagaagagcccaccccttcggcgtgagagccagaagccccgaggtggccctgagcctggccgccagatgggtgctggacgtgggcttcgaccacctggccgacggcaacggcctgagccagagcgcccccttcttctgccccccccacgtgaccgagatgctgctgtag

SEQ ID NO: 97536 - DNA, 210 bp, Artificial Sequence; identical to SEQ ID NO: 97534
  Description of Artificial Sequence: Synthetic coding sequence

SEQ ID NO: 97537 - DNA, 171 bp, Artificial Sequence
  Description of Artificial Sequence: Synthetic coding sequence
atgggccaccagcagctgtactggagccaccccagaaagttcggccagggcagcagaagctgcagagtgtgcagcaacagacacggcctgatcagaaagtacggcctgaacatgtgcagacagtgcttcagacagtacgccaaggacatcggcttcatcaagctggactag

SEQ ID NO: 97538 - DNA, 204 bp, Artificial Sequence
  Description of Artificial Sequence: Synthetic coding sequence
atgggccaccagcagctgtactggagccaccccagaaagttcggccagggcagcagaagctgcagagtgtgcagcaacagacacggcctgatcagaaagtacggcctgaacatgtgcagacagtgcttcagacagtacgccaaggacatcggcttcatcaagaaggacctgagctgcctgccctggcactgcctgtggagatag

SEQ ID NO: 97539 - DNA, 780 bp, Artificial Sequence
  Description of Artificial Sequence: Synthetic coding sequence
atggccgtgcagatcagcaagaagagaaagttcgtggccgacggcatcttcaaggccgagctgaacgagttcctgaccagagagctggccgaggacggctacagcggcgtggaggtgagagtgacccccaccagaaccgagatcatcatcctggccaccagaacccagaacgtgctgggcgagaagggcagaagaatcagagagctgaccgccgtggtgcagaagagattcggcttccccgagggcagcgtggagctgaagatcatggtgatggtgaccggctaccccctgctgcccctgaagctgtacgccgagaaggtggccaccagaggcctgtgcgccatcgcccaggccgagagcctgagatacaagctgctgggcggcctggccgtgagaagagcctgctacggcgtgctgagattcatcatggagagcggcgccaagggctgcgaggtggtggtgagcggcaagctgagaggccagagagccaagagcatgaagttcgtggacggcctgatgatccacagcggcgaccccgtgaactactacgtggacaccgccgtgagacacgtgctgctgagacagggcgtgctgggcatcaaggtgaagatcatgctgccctgggaccccaccggcaagatcggccccaagaagcccctgcccgaccacgtgagcatcgtggagcccaaggacgagatcctgcccaccacccccatcagcgagcagaagggcggcaagcccgagccccccgccatgccccagcccgtgcccaccgcctag

SEQ ID NO: 97540 - DNA, 732 bp, Artificial Sequence
  Description of Artificial Sequence: Synthetic coding sequence
atggccgtgcagatcagcaagaagagaaagttcgtggccgacggcatcttcaaggccgagctgaacgagttcctgaccagagagctggccgaggacggctacagcggcgtggaggtgagagtgacccccaccagaaccgagatcatcatcctggccaccagaacccagaacgtgctgggcgagaagggcagaagaatcagagagctgaccgccgtggtgcagaagagattcggcttccccgagggcagcgtggagctgtacgccgagaaggtggccaccagaggcctgtgcgccatcgcccaggccgagagcctgagatacaagctgctgggcggcctggccgtgagaagagcctgctacggcgtgctgagattcatcatggagagcggcgccaagggctgcgaggtggtggtgagcggcaagctgagaggccagagagccaagagcatgaagttcgtggacggcctgatgatccacagcggcgaccccgtgaactactacgtggacaccgccgtgagacacgtgctgctgagacagggcgtgctgggcatcaaggtgaagatcatgctgccctgggaccccaccggcaagatcggccccaagaagcccctgcccgaccacgtgagcatcgtggagcccaaggacgagatcctgcccaccacccccatcagcgagcagaagggcggcaagcccgagccccccgccatgccccagcccgtgcccaccgcctag

SEQ ID NO: 97541 - DNA, 732 bp, Artificial Sequence; identical to SEQ ID NO: 97540
  Description of Artificial Sequence: Synthetic coding sequence

SEQ ID NO: 97542 - DNA, 732 bp, Artificial Sequence; identical to SEQ ID NO: 97540
  Description of Artificial Sequence: Synthetic coding sequence

SEQ ID NO: 97543 - DNA, 795 bp, Artificial Sequence
  Description of Artificial Sequence: Synthetic coding sequence
atggccgtgggcaagaacaagagactgaccaagggcggcaagaagggcgccaagaagaaggtggtggaccccttcagcaagaaggactggtacgacgtgaaggcccccgccatgttcaacatcagaaacatcggcaagaccctggtgaccagaacccagggcaccaagatcgccagcgacggcctgaagggcagagtgttcgaggtgagcctggccgacctgcagaacgacgaggtggccttcagaaagttcaagctgatcaccgaggacgtgcagggcaagaactgcctgaccaacttccacggcatggacctgaccagagacaagatgtgcagcatggtgaagaagtggcagaccatgatcgaggcccacgtggacgtgaagaccaccgacggctacctgctgagactgttctgcgtgggcttcaccaagaagagaaacaaccagatcagaaagaccagctacgcccagcaccagcaggtgagacagatcagaaagaagatgatggagatcatgaccagagaggtgcagaccaacgacctgaaggaggtggtgaacaagctgatccccgacagcatcggcaaggacatcgagaaggcctgccagagcatctaccccctgcacgacgtgttcgtgagaaaggtgaagatgctgaagaagcccaagttcgagctgggcaagctgatggagctgcacggcgagggcagcagcagcggcaaggccaccggcgacgagaccggcgccaaggtggagagagccgacggctacgagccccccgtgcaggagagcgtgtag

SEQ ID NO: 97544 - DNA, 528 bp, Artificial Sequence
  Description of Artificial Sequence: Synthetic coding sequence
atggccgtggccaagaagaaggtggtggaccccttcagcaagaaggactggtacgacgtgaaggcccccgccatgttcaacatcagaaacatcggcaagaccctggtgaccagaacccagggcaccaagatcgccagcgacggcctgaagggcagagtgttcgaggtgagcctggccgacctgcagaacgacgaggtggccttcagaaagttcaagctgatcaccgaggacgtgcagggcaagaactgcctgaccaacttccacggcatggacctgaccagagacaagatgtgcagcatggtgaagaagtggcagaccatgatcgaggcccacgtggacgtgaagaccaccgacggctacctgctgagactgttctgcgtgggcttcaccaagaagagaaacaaccagatcagaaagaccagctacgcccagcaccagcaggtgagacagatcagaaagaagatgatggagatcatgaccagagaggtgcagaccaacgacctgaaggaggtggtgaacaagctgtag

SEQ ID NO: 97545 - DNA, 684 bp, Artificial Sequence
  Description of Artificial Sequence: Synthetic coding sequence
atgttcaacatcagaaacatcggcaagaccctggtgaccagaacccagggcaccaagatcgccagcgacggcctgaagggcagagtgttcgaggtgagcctggccgacctgcagaacgacgaggtggccttcagaaagttcaagctgatcaccgaggacgtgcagggcaagaactgcctgaccaacttccacggcatggacctgaccagagacaagatgtgcagcatggtgaagaagtggcagaccatgatcgaggcccacgtggacgtgaagaccaccgacggctacctgctgagactgttctgcgtgggcttcaccaagaagagaaacaaccagatcagaaagaccagctacgcccagcaccagcaggtgagacagatcagaaagaagatgatggagatcatgaccagagaggtgcagaccaacgacctgaaggaggtggtgaacaagctgatccccgacagcatcggcaaggacatcgagaaggcctgccagagcatctaccccctgcacgacgtgttcgtgagaaaggtgaagatgctgaagaagcccaagttcgagctgggcaagctgatggagctgcacggcgagggcagcagcagcggcaaggccaccggcgacgagaccggcgccaaggtggagagagccgacggctacgagccccccgtgcaggagagcgtgtag

SEQ ID NO: 97546 - DNA, 438 bp, Artificial Sequence
  Description of Artificial Sequence: Synthetic coding sequence
atgatcgaggcccacgtggacgtgaagaccaccgacggctacctgctgagactgttctgcgtgggcttcaccaagaagagaaacaaccagatcagaaagaccagctacgcccagcaccagcaggtgagacagatcagaaagaagatgatggagatcatgaccagagaggtgcagaccaacgacctgaaggaggtggtgaacaagctgatccccgacagcatcggcaaggacatcgagaaggcctgccagagcatctaccccctgcacgacgtgttcgtgagaaaggtgaagatgctgaagaagcccaagttcgagctgggcaagctgatggagctgcacggcgagggcagcagcagcggcaaggccaccggcgacgagaccggcgccaaggtggagagagccgacggctacgagccccccgtgcaggagagcgtgtag

SEQ ID NO: 97547 - DNA, 684 bp, Artificial Sequence; identical to SEQ ID NO: 97545
  Description of Artificial Sequence: Synthetic coding sequence

SEQ ID NO: 97548 - DNA, 627 bp, Artificial Sequence
  Description of Artificial Sequence: Synthetic coding sequence
aagagactgaccaagggcggcaagaagggcgccaagaagaaggtggtggaccccttcagcaagaaggactggtacgacgtgaaggcccccgccatgttcaacatcagaaacatcggcaagaccctggtgaccagaacccagggcaccaagatcgccagcgacggcctgaagggcagagtgttcgagaccatgatcgaggcccacgtggacgtgaagaccaccgacggctacctgctgagactgttctgcgtgggcttcaccaagaagagaaacaaccagatcagaaagaccagctacgcccagcaccagcaggtgagacagatcagaaagaagatgatggagatcatgaccagagaggtgcagaccaacgacctgaaggaggtggtgaacaagctgatccccgacagcatcggcaaggacatcgagaaggcctgccagagcatctaccccctgcacgacgtgttcgtgagaaaggtgaagatgctgaagaagcccaagttcgagctgggcaagctgatggagctgcacggcgagggcagcagcagcggcaaggccaccggcgacgagaccggcgccaaggtggagagagccgacggctacgagccccccgtgcaggagagcgtgtag

SEQ ID NO: 97549 - DNA, 792 bp, Artificial Sequence
  Description of Artificial Sequence: Synthetic coding sequence
atggccagaggccccaagaagcacctgaagagagtggccgcccccaagcactggatgctggacaagctgaccggcgtgttcgcccccagacccagcaccggcccccacaagctgagagagtgcctgcccctgatcatcttcctgagaaacagactgaagtacgccctgaccggcgacgaggtgaagaagatctgcatgcagagattcatcaagatcgacggcaaggtgagaaccgacatcacctaccccgccggcttcatggacgtgatcagcatcgacaagaccggcgagaacttcagactgatctacgacaccaagggcagattcgccgtgcacagaatcacccccgaggaggccaagtacaagctgtgcaaggtgagaaagatcttcgtgggcaccaagggcatcccccacctggtgacccacgacgccagaaccatcagataccccgaccccctgatcaaggtgaacgacaccatccagatcgacctggagaccggcaagatcaccgacttcatcaagttcgacaccggcaacctgtgcatggtgaccggcggcgccaacctgggcagaatcggcgtgatcaccaacagagagagacaccccggcagcttcgacgtggtgcacgtgaaggacgccaacggcaacagcttcgccaccagactgagcaacatcttcgtgatcggcaagggcaacaagccctggatcagcctgcccagaggcaagggcatcagactgaccatcgccgaggagagagacaagagactggccgccaagcagagcagcggctag

SEQ ID NO: 97550 - DNA, 369 bp, Artificial Sequence
  Description of Artificial Sequence: Synthetic coding sequence
atggccagaggccccaagaagcacctgaagagagtggccgcccccaagcactggatgctggacaagctgaccggcgtgttcgcccccagacccagcaccggcccccacaagctgagagagtgcctgcccctgatcatcttcctgagaaacagactgaagtacgccctgaccggcgacgaggtgaagaagatctgcatgcagagattcatcaagatcgacggcaaggtgagaaccgacatcacctaccccgccggcttcatggacgtgatcagcatcgacaagaccggcgagaacttcagactgatctacgacaccaagggcagattcgccgtgcacagaatcacccccgaggaggccaagccctgctag

SEQ ID NO: 97551 - DNA, 792 bp, Artificial Sequence
  Description of Artificial Sequence: Synthetic coding sequence
atggccagaggccccaagaagcacctgaagagagtggccgcccccaagcactggatgctggacaagctgaccggcgtgttcgcccccagacccagcaccggcccccacaagctgagagagtgcctgcccctgatcgtgttcctgagaaacagactgaagtacgccctgaccggcgacgaggtgaagaagatctgcatgcagagattcatcaagatcgacggcaaggtgagagtggacgtgacctaccccgccggcttcatggacgtgatcagcatcgagaagaccggcgagcacttcagactggtgtacgacaccaagggcagattcgccgtgcacagaatcaccgtggaggaggccaagtacaagctgtgcaaggtgagaaagatcaccgtgggcgtgaagggcatcccccacctggtgacccacgacgccagaaccatcagataccccgaccccgtgatcaaggtgaacgacaccgtgcagatcgacctgggcaccggcaagatcatcaacttcatcaagttcgacaccggcaacctgtgcatggtgatcggcggcgccaacctgggcagagtgggcgtgatcaccaacagagagagacaccccggcagcttcgacgtggtgcacgtgaaggacgccaacggcaacagcttcgccaccagactgagcaacatcttcgtgatcggcaacggcaacaagccctggatcagcctgcccagaggcaagggcatcagactgaccgtggccgaggagagagacaagagactggccaccaagcagagcagcggctag

SEQ ID NO: 97552 - DNA, 789 bp, Artificial Sequence
  Description of Artificial Sequence: Synthetic coding sequence
atgctgggcagacccgccaagttcagcaaggccagaggccccaagaagcacctgaagagagtggccgcccccaagcactggatgctggacaagctgaccggcgtgttcgcccccagacccagcaccggcccccacaagctgagagagtgcctgcccctgatcgtgttcctgagaaacagactgaagtacgccctgaccggcgacgaggtgaagaagatctgcatgcagagattcatcaagatcgacggcaaggtgagagtggacgtgacctaccccgccggcttcatggacgtgatcagcatcgagaagaccggcgagcacttcagactggtgtacgacaccaagggcagattcgccgtgcacagaatcaccgtggaggaggccaagtacaagctgtgcaaggtgagaaagatcaccgtgggcgtgaagggcatcccccacctggtgacccacgacgccagaaccatcagataccccgaccccgtgatcaaggtgaacgacaccgtgcagatcgacctgggcaccggcaagatcatcaacttcatcaagttcgacaccggcaacctgtgcatggtgatcggcggcgccaacctgggcagagtgggcgtgatcaccaacagagagagacaccccggcagcttcgacgtggtgcacgtgaaggacgccaacggcaacagcttcgccaccagactgagcaacatcttcgtgatcggcaacggcaacaagccctggatcagcctgcccagaggcaagggcatcagactgaccgtggccgaggagagagactag

SEQ ID NO: 97553 - DNA, 792 bp, Artificial Sequence
  Description of Artificial Sequence: Synthetic coding sequence
atggccagaggccccaagaagcacctgaagagagtggccgcccccaagcactggatgctggacaagctgaccggcgtgttcgcccccagacccagcaccggcccccacaagctgagagagtgcctgcccctgatcgtgttcctgagaaacagactgaagtacgccctgaccggcgacgaggtgaagaagatctgcatgcagcacttcctgaagatcgacggcaaggtgagagtggacatcacctaccccgccggcttcatcgacgtgatcagcatcgagaagaccggcgagcacttcagactggtgtacaacaccaagggctgcttcgccgtgcacagaatcaccgtggaggaggccaagtacaagctgtgcaaggtgagaaagatcaccgtgggcaccaagggcatcccccacctggtgacccacgacgccagaaccatcagataccccgaccccctgatcaaggtgaacgacaccgtgcagatcgacctgggcaccggcaagatcaccagcttcatcaagttcgacaccggcaacgtgtgcatggtgatcgccggcgccaacctgggcagagtgggcgtgatcaccaacagagagagacaccccggcagctgcgacgtggtgcacgtgaaggacgccaacggcaacagcttcgccaccagaatcagcaacatcttcgtgatcggcaacggcaacaagccctggatcagcctgcccagaggcaagggcatcagactgaccatcgccgaggagagagacaagagactggccgccaagcagagcagcggctag

SEQ ID NO: 97554 - DNA, 615 bp, Artificial Sequence
  Description of Artificial Sequence: Synthetic coding sequence
atgaccgagtgggagaccgccgcccccgccgtggccgagacccccgacatcaagctgttcggcaagtggagcaccgacgacgtgcagatcaacgacatcagcctgcaggactacatcgccgtgaaggagaagtacgccaagtacctgccccacagcgccggcagatacgccgccaagagattcagaaaggcccagtgccccatcgtggagagactgaccaacagcatgatgatgcacggcagaaacaacggcaagaagctgatgaccgtgagaatcgtgaagcacgccttcgagatcatccacctgctgaccggcgagaaccccctgcaggtgctggtgaacgccatcatcaacagcggccccagagaggacagcaccagaatcggcagagccggcaccgtgagaagacaggccgtggacgtgagccccctgagaagagtgaaccaggccatctggctgctgtgcaccggcgccagagaggccgccttcagaaacatcaagaccatcgccgagtgcctggccgacgagctgatcaacgccgccaagggcagcagcaacagctacgccatcaagaagaaggacgagctggagagagtggccaagagcaacagatag

SEQ ID NO: 97555 - DNA, 615 bp, Artificial Sequence; identical to SEQ ID NO: 97554
  Description of Artificial Sequence: Synthetic coding sequence

SEQ ID NO: 97556 - DNA, 657 bp, Artificial Sequence
  Description of Artificial Sequence: Synthetic coding sequence
atggccaccgaggtggccgccgacgccctgggcgaggagtggaagggctacgtggtgagaatcagcggcggcaacgacaagcagggcttccccatgaagcagggcgtgctgacccacggcagagtgagactgctgctgagcaagggccacagctgctacagacccagaagaaccggcgagagaaagagaaagagcgtgagaggctgcatcgtggacgccaacctgagcgtgctgaacctggtgatcgtgaagaagggcgagaaggacatccccggcctgaccgacaccaccgtgcccagaagactgggccccaagagagccagcagaatcagaaagctgttcaacctgagcaaggaggacgacgtgagacagtacgtggtgagaaagcccctgaacaaggagggcaagaagcccagaaccaaggcccccaagatccagagactggtgacccccagagtgctgcagcacaagagaagaagaatcgccctgaagaagcagagaaccaagaagaacaaggaggaggccgccgagtacgccaagctgctggccaagagaatgaaggaggccaaggagaagagacaggagcagatcgccaagagaagaagactgagcagcctgagagccagcaccagcaagagcgagagcagccagaagtag

SEQ ID NO: 97557 - DNA, 276 bp, Artificial Sequence
  Description of Artificial Sequence: Synthetic coding sequence
atgaagctgaacatcagcttccccgccaccggctgccagaagctgatcgaggtggacgacgagagaaagctgagaaccttctacgagaagagaatggccaccgaggtggccgccgacgccctgggcgaggagtggaaggtgaaggtggacaagctgctgcaggtgttcaagagcgagaccgtgaacgccatcggcaactggtacctggagtggggcagcgacagcggcttctggctgctgaccttcggcaagctgctgcccaacgccaccctgtag

SEQ ID NO: 97558 - DNA, 657 bp, Artificial Sequence; identical to SEQ ID NO: 97556
  Description of Artificial Sequence: Synthetic coding sequence

SEQ ID NO: 97559 - DNA, 750 bp, Artificial Sequence
  Description of Artificial Sequence: Synthetic coding sequence
atgaagctgaacatcagcttccccgccaccggctgccagaagctgatcgaggtggacgacgagagaaagctgagaaccttctacgagaagagaatggccaccgaggtggccgccgacgccctgggcgaggagtggaagggctacgtggtgagaatcagcggcggcaacgacaagcagggcttccccatgaagcagggcgtgctgacccacggcagagtgagactgctgctgagcaagggccacagctgctacagacccagaagaaccggcgagagaaagagaaagagcgtgagaggctgcatcgtggacgccaacctgagcgtgctgaacctggtgatcgtgaagaagggcgagaaggacatccccggcctgaccgacaccaccgtgcccagaagactgggccccaagagagccagcagaatcagaaagctgttcaacctgagcaaggaggacgacgtgagacagtacgtggtgagaaagcccctgaacaaggagggcaagaagcccagaaccaaggcccccaagatccagagactggtgacccccagagtgctgcagcacaagagaagaagaatcgccctgaagaagcagagaaccaagaagaacaaggaggaggccgccgagtacgccaagctgctggccaagagaatgaaggaggccaaggagaagagacaggagcagatcgccaagagaagaagactgagcagcctgagagccagcaccagcaagagcgagagcagccagaagtag

SEQ ID NO: 97560 - DNA, 585 bp, Artificial Sequence
  Description of Artificial Sequence: Synthetic coding sequence
atgttcagcagcagcgccaagatcgtgaagcccaacggcgagaagcccgacgagttcgagagcggcatcagccaggccctgctggagctggagatgaacagcgacctgaaggcccagctgagagagctgaacatcaccgccgccaaggagatcgaggtgggcggcggcagaaaggccatcatcatcttcgtgcccgtgccccagctgaagagcttccagaagatccaggtgagactggtgagagagctggagaagaagttcagcggcaagcacgtggtgttcatcgcccagagaagaatcctgcccaagcccaccagaaagagcagaaccaagaacaagcagaagagacccagaagcagaaccctgaccgccgtgcacgacgccatcctggaggacctggtgttccccagcgagatcgtgggcaagagaatcagagtgaagctggacggcagcagactgatcaaggtgcacctggacaaggcccagcagaacaacgtggagcacaaggtggagaccttcagcggcgtgtacaagaagctgaccggcaaggacgtgaacttcgagttccccgagttccagctgtag

SEQ ID NO: 97561 - DNA, 585 bp, Artificial Sequence; identical to SEQ ID NO: 97560
  Description of Artificial Sequence: Synthetic coding sequence

SEQ ID NO: 97562 - DNA, 585 bp, Artificial Sequence; identical to SEQ ID NO: 97560
  Description of Artificial Sequence: Synthetic coding sequence

SEQ ID NO: 97563 - DNA, 567 bp, Artificial Sequence
  Description of Artificial Sequence: Synthetic coding sequence
atgggcatcagcagagacaactggcacaagagaagaaagaccggcggcaagagaaagccctaccacaagaagagaaagtacgagctgggcagacccgccgccaacaccaagatcggccccagaagaatccacaccgtgagagtgagaggcggctgcaccagaaagaccagaatcatcgacgtggtgtacaacgccagcaacaacgagctggtgagaaccaagaccctggtgaagaactgcatcgtgctgatcgacagcaccccctacagacagtggtacgagagccactacgccctgcccctgggcagaaagaagggcgccaagctgacccccgaggaggaggagatcctgaacaagaagagaagcaagaagatccagaagaagtacgacgagagaaagaagaacgccaagatcagcagcctgctggaggagcagttccagcagggcaagctgctggcctgcatcgccagcagacccggccagtgcggcagagccgacggctacgtgctggagggcaaggagctggagttctacctgagaaagatcaaggccagaaagggcaagtag

SEQ ID NO: 97564 - DNA, 627 bp, Artificial Sequence
  Description of Artificial Sequence: Synthetic coding sequence
atgggcatcagcagagacaactggcacaagagaagaaagaccggcggcaagagaaagccctaccacaagaagagaaagtacgagctgggcagacccgccgccaacaccaagatcggccccagaagaatccacaccgtgagagtgagaggcggcaacaagaagtacagagccctgagactggacgtgggcaacttcagctggggcagcgagtgctgcaccagaaagaccagaatcatcgacgtggtgtacaacgccagcaacaacgagctggtgagaaccaagaccctggtgaagaactgcatcgtgctgatcgacagcaccccctacagacagtggtacgagagccactacgccctgcccctgggcagaaagaagggcgccaagctgacccccgaggaggaggagatcctgaacaagaagagaagcaagaagatccagaagaagtacgacgagagaaagaagaacgccaagatcagcagcctgctggaggagcagttccagcagggcaagctgctggcctgcatcgccagcagacccggccagtgcggcagagccgacggctacgtgctggagggcaaggagctggagttctacctgagaaagatcaaggccagaaagggcaagtag

SEQ ID NO: 97565 - DNA, 585 bp, Artificial Sequence
  Description of Artificial Sequence: Synthetic coding sequence
atgcccgtggccagaagctgggtgtgcagaaagacctacgtgacccccagaagacccttcgagaagagcagactggaccaggagctgaagctgatcggcgagtacggcctgagaaacaagagagaggtgtggagagtgaagttcaccctggccaagatcagaaaggccgccagagagctgctgaccctggacgagaaggaccccagaagactgttcgagggcaacgccctgctgagaagactggtgagaatcggcgtgctggacgagggcaagatgaagctggactacatcctgggcctgaagatcgaggacttcctggagagaagactgcagacccaggtgttcaagctgggcctggccaagagcatccaccacgccagagtgctgatcagacagagacacatcagagtgagaaagcaggtggtgaacatccccagcttcatcgtgagactggacagccagaagcacatcgacttcagcctgagaagcccctacggcggcggcagacccggcagagtgaagagaaagaacgccaagaagggccagggcggcgccggcgccggcgacgacgaggaggaggactag

SEQ ID NO: 97566 - DNA, 585 bp, Artificial Sequence; identical to SEQ ID NO: 97565
  Description of Artificial Sequence: Synthetic coding sequence

SEQ ID NO: 97567 - DNA, 585 bp, Artificial Sequence; identical to SEQ ID NO: 97565
  Description of Artificial Sequence: Synthetic coding sequence

SEQ ID NO: 97568 - DNA, 420 bp, Artificial Sequence
  Description of Artificial Sequence: Synthetic coding sequence
atgcccgtggccagaagctgggtgtgcagaaagacctacgtgacccccagaagacccttcgagaagagcagactggaccaggagctgaagctgatcggcgagtacggcctgagaaacaagagagaggtgtggagagtgaagttcaccctggccaagatcagaaaggccgccagagagctgctgaccctggacgagaaggaccccagaagactgttcgagggcaacgccctgctgagaagactggtgagaatcggcgtgctggacgagggcaagatgaagctggactacatcctgggcctgaagatcgaggacttcctggagagaagactgcagacccaggtgttcaagctgggcctggccaagagcatccaccacgccagagtgctgatcagacagagacacatcagccccagaagatag

SEQ ID NO: 97569 - DNA, 420 bp, Artificial Sequence; identical to SEQ ID NO: 97568
  Description of Artificial Sequence: Synthetic coding sequence

SEQ ID NO: 97570 - DNA, 471 bp, Artificial Sequence
  Description of Artificial Sequence: Synthetic coding sequence
atgcccgtggccagaagctgggtgtgcagaaagacctacgtgacccccagaagacccttcgagaagagcagactggaccaggagctgaagctgatcggcgagtacggcctgagaaacaagagagaggtgtggagagtgaagttcaccctggccaagatcagaaaggccgccagagagctgctgaccctggacgagaaggaccccagaagactgttcgagggcaacgccctgctgagaagactggtgagaatcggcgtgctggacgagggcaagatgaagctggactacatcctgggcctgaagatcgaggacttcctggagagaagactgcagacccaggtgttcaagctgggcctggccaagagcatccaccacgccagagtgctgatcagacagagacacatcagataccacctgggctgggcccccgagagcagcagcacctgccccagcgacggctgcccccactag

SEQ ID NO: 97571 - DNA, 420 bp, Artificial Sequence; identical to SEQ ID NO: 97568
  Description of Artificial Sequence: Synthetic coding sequence

SEQ ID NO: 97572 - DNA, 2844 bp, Artificial Sequence
  Description of Artificial Sequence: Synthetic coding sequence
atggccaccagagtgagaaccgccagcatctgggtgccccccctgcaggagagaaacagcagctgggacagaatcagaaagctgcagggccaggagagcatcctgggccagggcacccccggcctgcagcccctgcccggcacccccagacagaagcagaagagcagaagaatcgagaaggtgctggagtggctgttcatcagccaggagcagcccaagatcaccaagagctggggccccctgagcttcatggacgtgttcgtggacttcacctgggaggagtggcagctgctggaccccgcccagaagtgcctgtacagaagcgtgatgctggagaactacagcaacctggtgagcctgggctaccagcacaccaagcccgacatcatcttcaagctggagcagggcgaggagctgtgcatggtgcaggcccaggtgcccaaccagacctgccccaacaccgtgtggaagatcgacgacctgatggactggcaccaggagaacaaggacaagctgggcagcaccgccaagagcttcgagtgcaccaccttcggcaagctgtgcctgctgagcaccaagtacctgagcagacagaagccccacaagtgcggcacccacggcaagagcctgaagtacatcgacttcaccagcgactacgccagaaacaaccccaacggcttccaggtgcacggcaagagcttcttccacagcaagcacgagcagaccgtgatcggcatcaagtactgcgagagcatcgagagcggcaagaccgtgaacaagaagagccagctgatgtgccagcagatgtacatgggcgagaagcccttcggctgcagctgctgcgagaaggccttcagcagcaagagctacctgctggtgcaccagcagacccacgccgaggagaagccctacggctgcaacgagtgcggcaaggacttcagcagcaagagctacctgatcgtgcaccagagaatccacaccggcgagaagctgcacgagtgcagcgagtgcagaaagaccttcagcttccacagccagctggtgatccaccagagaatccacaccggcgagaacccctacgagtgctgcgagtgcggcaaggtgttcagcagaaaggaccagctggtgagccaccagaagacccacagcggccagaagccctacgtgtgcaacgagtgcggcaaggccttcggcctgaagagccagctgatcatccacgagagaatccacaccggcgagaagccctacgagtgcaacgagtgccagaaggccttcaacaccaagagcaacctgatggtgcaccagagaacccacaccggcgagaagccctacgtgtgcagcgactgcggcaaggccttcaccttcaagagccagctgatcgtgcaccagggcatccacaccggcgtgaagccctacggctgcatccagtgcggcaagggcttcagcctgaagagccagctgatcgtgcaccagagaagccacaccggcatgaagccctacgtgtgcaacgagtgcggcaaggccttcagaagcaagagctacctgatcatccacaccagaacccacaccggcgagaagctgcacgagtgcaacaactgcggcaaggccttcagcttcaagagccagctgatcatccaccagagaatccacaccggcgagaacccctacgagtgccacgagtgcggcaaggccttcagcagaaagtaccagctgatcagccaccagagaacccacgccggcgagaagccctacgagtgcaccgactgcggcaaggccttcggcctgaagagccagctgatcatccaccagagaacccacaccggcgagaagcccttcgagtgcagcgagtgccagaaggccttcaacaccaagagcaacctgatcgtgcaccagagaacccacaccggcgagaagccctacagctgcaacgagtgcggcaaggccttcaccttcaagagccagctgatcgtgcacaagggcgtgcacaccggcgtgaagccctacggctgcagccagtgcgccaagaccttcagcctgaagagccagctgatcgtgcaccagagaagccacaccggcgtgaagccctacggctgcagcgagtgcggcaaggccttcagaagcaagagctacctgatcatccacatgagaacccacaccggcgagaagccccacgagtgcagagagtgcggcaagagcttcagcttcaacagccagctgatcgtgcaccagagaatccacaccggcgagaacccctacgagtgcagcgagtgcggcaaggccttcaacagaaaggaccagctgatcagccaccagagaacccacgccggcgagaagccctacggctgcagcgagtgcggcaaggccttcagcagcaagagctacctgatcatccacatgagaacccacagcggcgagaagccctacgagtgcaacgagtgcggcaaggccttcatctggaagagcctgctgatcgtgcacgagagaacccacgccggcgtgaacccctacaagtgcagccagtgcgagaagagcttcagcggcaagctgagactgctggtgcaccagagaatgcacaccagagagaagccctacgagtgcagcgagtgcggcaaggccttcatcagaaacagccagctgatcgtgcaccagagaacccacagcggcgagaagccctacggctgcaacgagtgcggcaagaccttcagccagaagagcatcctgagcgcccaccagagaacccacaccggcgagaagccctgcaagtgcaccgagtgcggcaaggccttctgctggaagagccagctgatcatgcaccagagaacccacgtggacgacaagcactag

SEQ ID NO: 97573 - DNA, 768 bp, Artificial Sequence
  Description of Artificial Sequence: Synthetic coding sequence
atgcccagagaggacagagccacctggaagagcaactacttcctgaagatcatccagctgctggacgactaccccaagtgcttcatcgtgggcgccgacaacgtgggcagcaagcagatgcagcagatcagaatgagcctgagaggcaaggccgtggtgctgatgggcaagaacaccatgatgagaaaggccatcagaggccacctggagaacaaccccgccctggagaagctgctgccccacatcagaggcaacgtgggcttcgtgttcaccaaggaggacctgaccgagatcagagacatgctgctggccaacaaggtgcccgccgccgccagagccggcgccatcgccccctgcgaggtgaccgtgcccgcccagaacaccggcctgggccccgagaagaccagcttcttccaggccctgggcatcaccaccaagatcagcagaggcaccatcgagatcctgggcgtgagaaacgtggccagcgtgtgcctgcagatcggctaccccaccgtggccagcgtgccccacagcatcatcaacggctacaagagagtgctggccctgagcgtggagaccgactacaccttccccctggccgagaaggtgaaggccttcctggccgaccccagcgccttcgtggccgccgcccccgtggccgccgccaccaccgccgcccccgccgccgccgccgcccccgccaaggtggaggccaaggaggagagcgaggagagcgacgaggacatgggcttcggcctgttcgactag

SEQ ID NO: 97574 - DNA, 954 bp, Artificial Sequence
  Description of Artificial Sequence: Synthetic coding sequence
atgcccagagaggacagagccacctggaagagcaactacttcctgaagatcatccagctgctggacgactaccccaagtgcttcatcgtgggcgccgacaacgtgggcagcaagcagatgcagcagatcagaatgagcctgagaggcaaggccgtggtgctgatgggcaagaacaccatgatgagaaaggccatcagaggccacctggagaacaaccccgccctggagaagctgctgccccacatcagaggcaacgtgggcttcgtgttcaccaaggaggacctgaccgagatcagagacatgctgctggccaacaaggtgcccgccgccgccagagccggcgccatcgccccctgcgaggtgaccgtgcccgcccagaacaccggcctgggccccgagaagaccagcttcttccaggccctgggcatcaccaccaagatcagcagaggcaccatcgagatcctgagcgacgtgcagctgatcaagaccggcgacaaggtgggcgccagcgaggccaccctgctgaacatgctgaacatcagccccttcagcttcggcctggtgatccagcaggtgttcgacaacggcagcatctacaaccccgaggtgctggacatcaccgaggagaccctgcacagcagattcctggagggcgtgagaaacgtggccagcgtgtgcctgcagatcggctaccccaccgtggccagcgtgccccacagcatcatcaacggctacaagagagtgctggccctgagcgtggagaccgactacaccttccccctggccgagaaggtgaaggccttcctggccgaccccagcgccttcgtggccgccgcccccgtggccgccgccaccaccgccgcccccgccgccgccgccgcccccgccaaggtggaggccaaggaggagagcgaggagagcgacgaggacatgggcttcggcctgttcgactag

SEQ ID NO: 97575 - DNA, 954 bp, Artificial Sequence; identical to SEQ ID NO: 97574
  Description of Artificial Sequence: Synthetic coding sequence

SEQ ID NO: 97576 - DNA, 345 bp, Artificial Sequence
  Description of Artificial Sequence: Synthetic coding sequence
atggccagcgtgagcgagctggcctgcatctacagcgccctgatcctgcacgacgacgaggtgaccgtgaccgaggacaagatcaacgccctgatcaaggccgccggcgtgaacgtggagcccttctggcccggcctgttcgccaaggccctggccaacgtgaacatcggcagcctgatctgcaacgtgggcgccggcggccccgcccccgccgccggcgccgcccccgccggcggccccgcccccagcaccgccgccgcccccgccgaggagaagaaggtggaggccaagaaggaggagagcgaggagagcgacgacgacatgggcttcggcctgttcgactag

SEQ ID NO: 97577 - DNA, 270 bp, Artificial Sequence
  Description of Artificial Sequence: Synthetic coding sequence
atggccagcgtgagcgagctggcctgcatctacagcgccctgatcctgcacgacgacgaggtgaccgtgaccgccctggccaacgtgaacatcggcagcctgatctgcaacgtgggcgccggcggccccgcccccgccgccggcgccgcccccgccggcggccccgcccccagcaccgccgccgcccccgccgaggagaagaaggtggaggccaagaaggaggagagcgaggagagcgacgacgacatgggcttcggcctgttcgactag

SEQ ID NO: 97578 - DNA, 2277 bp, Artificial Sequence
  Description of Artificial Sequence: Synthetic coding sequence
atggcccccgccatgcagcccgccgagatccagttcgcccagagactggccagcagcgagaagggcatcagagacagagccgtgaagaagctgagacagtacatcagcgtgaagacccagagagagaccggcggcttcagccaggaggagctgctgaagatctggaagggcctgttctactgcatgtgggtgcaggacgagcccctgctgcaggaggagctggccaacaccatcgcccagctggtgcacgccgtgaacaacagcgccgcccagcacctgttcatccagaccttctggcagaccatgaacagagagtggaagggcatcgacagactgagactggacaagtactacatgctgatcagactggtgctgagacagagcttcgaggtgctgaagagaaacggctgggaggagagcagaatcaaggtgttcctggacgtgctgatgaaggaggtgctgtgccccgagagccagagccccaacggcgtgagattccacttcatcgacatctacctggacgagctgagcaaggtgggcggcaaggagctgctggccgaccagaacctgaagttcatcgaccccttctgcaagatcgccgccaagaccaaggaccacaccctggtgcagaccatcgccagaggcgtgttcgaggccatcgtggaccagagccccttcgtgcccgaggagaccatggaggagcagaagaccaaggtgggcgacggcgacctgagcgccgaggagatccccgagaacgaggtgagcctgagaagagccgtgagcaagaagaagaccgccctgggcaagaaccacagcagaaaggacggcctgagcgacgagagaggcagagacgactgcggcaccttcgaggacaccggccccctgctgcagttcgactacaaggccgtggccgacagactgctggagatgaccagcagaaagaacaccccccacttcaacagaaagagactgagcaagctgatcaagaagttccaggacctgagcgagggcagcagcatcagccagctgagcttcgccgaggacatcagcgccgacgaggacgaccagatcctgagccagggcaagcacaagaagaagggcaacaagctgctggagaagaccaacctggagaaggagaagggcagcagagtgttctgcgtggaggaggaggacagcgagagcagcctgcagaagagaagaagaaagaagaagaagaagcaccacctgcagcccgagaaccccggccccggcggcgccgcccccagcctggagcagaacagaggcagagagcccgaggccagcggcctgaaggccctgaaggccagagtggccgagcccggcgccgaggccaccagcagcaccggcgaggagagcggcagcgagcacccccccgccgtgcccatgcacaacaagagaaagagacccagaaagaagagccccagagcccacagagagatgctggagagcgccgtgctgccccccgaggacatgagccagagcggccccagcggcagccacccccagggccccagaggcagccccaccggcggcgcccagctgctgaagagaaagagaaagctgggcgtggtgcccgtgaacggcagcggcctgagcacccccgcctggccccccctgcagcaggagggcccccccaccggccccgccgagggcgccaacagccacaccaccctgccccagagaagaagactgcagaagaagaaggccggccccggcagcctggagctgtgcggcctgcccagccagaagaccgccagcctgaagaagagaaagaagatgagagtgatgagcaacctggtggagcacaacggcgtgctggagagcgaggccggccagccccaggccctgggcagcagcggcacctgcagcagcctgaagaagcagaagctgagagccgagagcgacttcgtgaagttcgacacccccttcctgcccaagcccctgttcttcagaagagccaagagcagcaccgccacccacccccccggccccgccgtgcagctgaacaagacccccagcagcagcaagaaggtgaccttcggcctgaacagaaacatgaccgccgagttcaagaagaccgacaagagcatcctggtgagccccaccggccccagcagagtggccttcgaccccgagcagaagcccctgcacggcgtgctgaagacccccaccagcagccccgccagcagccccctggtggccaagaagcccctgaccaccacccccagaagaagacccagagccatggacttcttctag

SEQ ID NO: 97579 - DNA, 780 bp, Artificial Sequence
  Description of Artificial Sequence: Synthetic coding sequence
atgcccggcgccaactacagagccggcgccggcgccggcgccggcgccagaagacccagaggcgccagagacagagaggaggacggcggcggcctggagcccgccgccgtggccagagacctgctgagaggcaccagcaacatgagcttcgaggagctgctggagctgcagagccaggtgggcaccaagacctacaagcagctggtggccggcaacagccccaagaagcaggccagcagaccccccatccagaacgcctgcgtggccgacaagcacagacccctggagatgagcgccaagatcagagtgcccttcctgagacaggtggtgcccatcagcaagaaggtggccagagaccccagattcgacgacctgagcggcgagtacaaccccgaggtgttcgacaagacctaccagttcctgaacgacatcagagccaaggagaaggagctggtgaagaagcagctgaagaagcacctgagcggcgaggagcacgagaagctgcagcagctgctgcagagaatggagcagcaggagatggcccagcaggagagaaagcagcagcaggagctgcacctggccctgaagcaggagagaagagcccaggcccagcagggccacagaccctacttcctgaagaagagcgagcagagacagctggccctggccgagaagttcaaggagctgaagagaagcaagaagctggagaacttcctgagcagaaagagaagaagaaacgccggcaaggacagaagacacctgcccctgagcaaggagtag

SEQ ID NO: 97580 - DNA, 4233 bp, Artificial Sequence
  Description of Artificial Sequence: Synthetic coding sequence
atggacatctacgacacccagaccctgggcgtggtggtgttcggcggcttcatggtggtgagcgccatcggcatcttcctggtgagcaccttcagcatgaaggagaccagctacgaggaggccctggccaaccagagaaaggagatggccaagacccaccaccagaaggtggagaagaagaagaaggagaagaccgtggagaagaagggcaagaccaagaagaaggaggagaagcccaacggcaagatccccgaccacgaccccgcccccaacgtgaccgtgctgctgagagagcccgtgagagcccccgccgtggccgtggcccccacccccgtgcagccccccatcatcgtggcccccgtggccaccgtgcccgccatgccccaggagaagctggccagcagccccaaggacaagaagaagaaggagaagaaggtggccaaggtggagcccgccgtgagcagcgtggtgaacagcatccaggtgctgaccagcaaggccgccatcctggagaccgcccccaaggaggtgcccatggtggtggtgccccccgtgggcgccaagggcaacacccccgccaccggcaccacccagggcaagaaggccgagggcacccagaaccagagcaagaaggccgagggcgcccccaaccagggcagaaaggccgagggcacccccaaccagggcaagaagaccgagggcacccccaaccagggcaagaaggccgagggcacccccaaccagggcaagaaggccgagggcacccccaaccagggcaagaaggccgagggcgcccagaaccagggcaagaaggtggacaccacccccaaccagggcaagaaggtggagggcgcccccacccagggcagaaaggccgagggcgcccagaaccaggccaagaaggtggagggcgcccagaaccagggcaagaaggccgagggcgcccagaaccagggcaagaagggcgagggcgcccagaaccagggcaagaaggccgagggcgcccagaaccagggcaagaaggccgagggcgcccagaaccagggcaagaaggccgagggcgcccagaaccagggcaagaaggccgagggcgcccagaaccagggcaagaaggccgagggcgcccagaaccagggcaagaagagcgagggcgcccagaaccagggcaagaaggtggagggcgcccagaaccagggcaagaaggccgagggcgcccagaaccagggcaagaaggccgagggcgcccagaaccagggcaagaaggccgagggcgcccagaaccagggcaagaaggccgagggcgcccagaaccagggcaagaaggccgagggcgcccagaaccagggcaagaaggccgagggcgcccagaaccagggcaagaaggccgagggcgcccagaaccagggcaagaaggtggagggcgcccagaaccagggcaagaaggccgagggcgcccagaaccagggcaagaaggccgagggcgcccagaaccagggcaagaaggccgagggcgcccagaaccagggccagaagggcgagggcgcccagaaccagggcaagaagaccgagggcgcccagggcaagaaggccgagagaagccccaaccagggcaagaagggcgagggcgcccccatccagggcaagaaggccgacagcgtggccaaccagggcaccaaggtggagggcatcaccaaccagggcaagaaggccgagggcagccccagcgagggcaagaaggccgagggcagccccaaccagggcaagaaggccgacgccgccgccaaccagggcaagaagaccgagagcgccagcgtgcagggcagaaacaccgacgtggcccagagccccgaggcccccaagcaggaggcccccgccaagaagaagagcggcagcaagaagaagggcgagcccggcccccccgacgccgacggccccctgtacctgccctacaagaccctggtgagcaccgtgggcagcatggtgttcaacgagggcgaggcccagagactgatcgagatcctgagcgagaaggccggcatcatccaggacacctggcacaaggccacccagaagggcgaccccgtggccatcctgaagagacagctggaggagaaggagaagctgctggccaccgagcaggaggacgccgccgtggccaagagcaagctgagagagctgaacaaggagatggccgccgagaaggccaaggccgccgccggcgaggccaaggtgaagaagcagctggtggccagagagcaggagatcaccgccgtgcaggccagaatgcaggccagctacagagagcacgtgaaggaggtgcagcagctgcagggcaagatcagaaccctgcaggagcagctggagaacggccccaacacccagctggccagactgcagcaggagaacagcatcctgagagacgccctgaaccaggccaccagccaggtggagagcaagcagaacgccgagctggccaagctgagacaggagctgagcaaggtgagcaaggagctggtggagaagagcgaggccgtgagacaggacgagcagcagagaaaggccctggaggccaaggccgccgccttcgagaagcaggtgctgcagctgcaggccagccacagagagagcgaggaggccctgcagaagagactggacgaggtgagcagagagctgtgccacacccagagcagccacgccagcctgagagccgacgccgagaaggcccaggagcagcagcagcagatggccgagctgcacagcaagctgcagagcagcgaggccgaggtgagaagcaagtgcgaggagctgagcggcctgcacggccagctgcaggaggccagagccgagaacagccagctgaccgagagaatcagaagcatcgaggccctgctggaggccggccaggccagagacgcccaggacgtgcaggccagccaggccgaggccgaccagcagcagaccagactgaaggagctggagagccaggtgagcggcctggagaaggaggccatcgagctgagagaggccgtggagcagcagaaggtgaagaacaacgacctgagagagaagaactggaaggccatggaggccctggccaccgccgagcaggcctgcaaggagaagctgctgagcctgacccaggccaaggaggagagcgagaagcagctgtgcctgatcgaggcccagaccatggaggccctgctggccctgctgcccgagctgagcgtgctggcccagcagaactacaccgagtggctgcaggacctgaaggagaagggccccaccctgctgaagcacccccccgcccccgccgagcccagcagcgacctggccagcaagctgagagaggccgaggagacccagagcaccctgcaggccgagtgcgaccagtacagaagcatcctggccgagaccgagggcatgctgagagacctgcagaagagcgtggaggaggaggagcaggtgtggagagccaaggtgggcgccgccgaggaggagctgcagaagagcagagtgaccgtgaagcacctggaggagatcgtggagaagctgaagggcgagctggagagcagcgaccaggtgagagagcacaccagccacctggaggccgagctggagaagcacatggccgccgccagcgccgagtgccagaactacgccaaggaggtggccggcctgagacagctgctgctggagagccagagccagctggacgccgccaagagcgaggcccagaagcagagcgacgagctggccctggtgagacagcagctgagcgagatgaagagccacgtggaggacggcgacatcgccggcgcccccgccagcagccccgaggccccccccgccgagcaggaccccgtgcagctgaagacccagctggagtggaccgaggccatcctggaggacgagcagacccagagacagaagctgaccgccgagttcgaggaggcccagaccagcgcctgcagactgcaggaggagctggagaagctgagaaccgccggccccctggagagcagcgagaccgaggaggccagccagctgaaggagagactggagaaggagaagaagctgaccagcgacctgggcagagccgccaccagactgcaggagctgctgaagaccacccaggagcagctggccagagagaaggacaccgtgaagaagctgcaggagcagctggagaaggccgaggacggcagcagcagcaaggagggcaccagcgtgtag

SEQ ID NO: 97581 - DNA, 2934 bp, Artificial Sequence
  Description of Artificial Sequence: Synthetic coding sequence
atggacatctacgacacccagaccctgggcgtggtggtgttcggcggcttcatggtggtgagcgccatcggcatcttcctggtgagcaccttcagcatgaaggagaccagctacgaggaggccctggccaaccagagaaaggagatggccaagacccaccaccagaaggtggagaagaagaagaaggagaagaccgtggagaagaagggcaagaccaagaagaaggaggagaagcccaacggcaagatccccgaccacgaccccgcccccaacgtgaccgtgctgctgagagagcccgtgagagcccccgccgtggccgtggcccccacccccgtgcagccccccatcatcgtggcccccgtggccaccgtgcccgccatgccccaggagaagctggccagcagccccaaggacaagaagaagaaggagaagaaggtggccaaggtggagcccgccgtgagcagcgtggtgaacagcatccaggtgctgaccagcaaggccgccatcctggagaccgcccccaaggagggcagaaacaccgacgtggcccagagccccgaggcccccaagcaggaggcccccgccaagaagaagagcggcagcaagaagaagggcccccccgacgccgacggccccctgtacctgccctacaagaccctggtgagcaccgtgggcagcatggtgttcaacgagggcgaggcccagagactgatcgagatcctgagcgagaaggccggcatcatccaggacacctggcacaaggccacccagaagggcgaccccgtggccatcctgaagagacagctggaggagaaggagaagctgctggccaccgagcaggaggacgccgccgtggccaagagcaagctgagagagctgaacaaggagatggccgccgagaaggccaaggccgccgccggcgaggccaaggtgaagaagcagctggtggccagagagcaggagatcaccgccgtgcaggccagaatgcaggccagctacagagagcacgtgaaggaggtgcagcagctgcagggcaagatcagaaccctgcaggagcagctggagaacggccccaacacccagctggccagactgcagcaggagaacagcatcctgagagacgccctgaaccaggccaccagccaggtggagagcaagcagaacgccgagctggccaagctgagacaggagctgagcaaggtgagcaaggagctggtggagaagagcgaggccgtgagacaggacgagcagcagagaaaggccctggaggccaaggccgccgccttcgagaagcaggtgctgcagctgcaggccagccacagagagagcgaggaggccctgcagaagagactggacgaggtgagcagagagctgtgccacacccagagcagccacgccagcctgagagccgacgccgagaaggcccaggagcagcagcagcagatggccgagctgcacagcaagctgcagagcagcgaggccgaggtgagaagcaagtgcgaggagctgagcggcctgcacggccagctgcaggaggccagagccgagaacagccagctgaccgagagaatcagaagcatcgaggccctgctggaggccggccaggccagagacgcccaggacgtgcaggccagccaggccgaggccgaccagcagcagaccagactgaaggagctggagagccaggtgagcggcctggagaaggaggccatcgagctgagagaggccgtggagcagcagaaggtgaagaacaacgacctgagagagaagaactggaaggccatggaggccctggccaccgccgagcaggcctgcaaggagaagctgctgagcctgacccaggccaaggaggagagcgagaagcagctgtgcctgatcgaggcccagaccatggaggccctgctggccctgctgcccgagctgagcgtgctggcccagcagaactacaccgagtggctgcaggacctgaaggagaagggccccaccctgctgaagcacccccccgcccccgccgagcccagcagcgacctggccagcaagctgagagaggccgaggagacccagagcaccctgcaggccgagtgcgaccagtacagaagcatcctggccgagaccgagggcatgctgagagacctgcagaagagcgtggaggaggaggagcaggtgtggagagccaaggtgggcgccgccgaggaggagctgcagaagagcagagtgaccgtgaagcacctggaggagatcgtggagaagctgaagggcgagctggagagcagcgaccaggtgagagagcacaccagccacctggaggccgagctggagaagcacatggccgccgccagcgccgagtgccagaactacgccaaggaggtggccggcctgagacagctgctgctggagagccagagccagctggacgccgccaagagcgaggcccagaagcagagcgacgagctggccctggtgagacagcagctgagcgagatgaagagccacgtggaggacggcgacatcgccggcgcccccgccagcagccccgaggccccccccgccgagcaggaccccgtgcagctgaagacccagctggagtggaccgaggccatcctggaggacgagcagacccagagacagaagctgaccgccgagttcgaggaggcccagaccagcgcctgcagactgcaggaggagctggagaagctgagaaccgccggccccctggagagcagcgagaccgaggaggccagccagctgaaggagagactggagaaggagaagaagctgaccagcgacctgggcagagccgccaccagactgcaggagctgctgaagaccacccaggagcagctggccagagagaaggacaccgtgaagaagctgcaggagcagctggagaaggccgaggacggcagcagcagcaaggagggcaccagcgtgtag

SEQ ID NO: 97582 - DNA, 2934 bp, Artificial Sequence; identical to SEQ ID NO: 97581
  Description of Artificial Sequence: Synthetic coding sequence

SEQ ID NO: 97583 - DNA, 4233 bp, Artificial Sequence; identical to SEQ ID NO: 97580
  Description of Artificial Sequence: Synthetic coding sequence

SEQ ID NO: 97584 - DNA, 903 bp, Artificial Sequence
  Description of Artificial Sequence: Synthetic coding sequence
atggacatctacgacacccagaccctgggcgtggtggtgttcggcggcttcatggtggtgagcgccatcggcatcttcctggtgagcaccttcagcatgaaggagaccagctacgaggaggccctggccaaccagagaaaggagatggccaagacccaccaccagaaggtggagaagaagaagaaggagaagaccgtggagaagaagggcaagaccaagaagaaggaggagaagcccaacggcaagatccccgaccacgaccccgcccccaacgtgaccgtgctgctgagagagcccgtgagagcccccgccgtggccgtggcccccacccccgtgcagccccccatcatcgtggcccccgtggccaccgtgcccgccatgccccaggagaagctggccagcagccccaaggacaagaagaagaaggagaagaaggtggccaaggtggagcccgccgtgagcagcgtggtgaacagcatccaggtgctgaccagcaaggccgccatcctggagaccgcccccaaggaggtgcccatggtggtggtgccccccgtgggcgccaagggcaacacccccgccaccggcaccacccagggcaagaaggccgagggcacccagaaccagagcaagaaggccgagggcgcccccaaccagggcagaaaggccgagggcacccccaaccagggcaagaagaccgagggcacccccaaccagggcaagaaggccgagggcacccccaaccagggcaagaaggccgagggcacccccaaccagggcaagaaggccgagggcgcccagaaccagggcaagaaggtggacaccacccccaaccagggcaagaaggtggagggcgcccccacccagggcagaaaggccgagggcgcccagaaccaggccaagtag

SEQ ID NO: 97585 - DNA, 2256 bp, Artificial Sequence
  Description of Artificial Sequence: Synthetic coding sequence
atggtgttcaacgagggcgaggcccagagactgatcgagatcctgagcgagaaggccggcatcatccaggacacctggcacaaggccacccagaagggcgaccccgtggccatcctgaagagacagctggaggagaaggagaagctgctggccaccgagcaggaggacgccgccgtggccaagagcaagctgagagagctgaacaaggagatggccgccgagaaggccaaggccgccgccggcgaggccaaggtgaagaagcagctggtggccagagagcaggagatcaccgccgtgcaggccagaatgcaggccagctacagagagcacgtgaaggaggtgcagcagctgcagggcaagatcagaaccctgcaggagcagctggagaacggccccaacacccagctggccagactgcagcaggagaacagcatcctgagagacgccctgaaccaggccaccagccaggtggagagcaagcagaacgccgagctggccaagctgagacaggagctgagcaaggtgagcaaggagctggtggagaagagcgaggccgtgagacaggacgagcagcagagaaaggccctggaggccaaggccgccgccttcgagaagcaggtgctgcagctgcaggccagccacagagagagcgaggaggccctgcagaagagactggacgaggtgagcagagagctgtgccacacccagagcagccacgccagcctgagagccgacgccgagaaggcccaggagcagcagcagcagatggccgagctgcacagcaagctgcagagcagcgaggccgaggtgagaagcaagtgcgaggagctgagcggcctgcacggccagctgcaggaggccagagccgagaacagccagctgaccgagagaatcagaagcatcgaggccctgctggaggccggccaggccagagacgcccaggacgtgcaggccagccaggccgaggccgaccagcagcagaccagactgaaggagctggagagccaggtgagcggcctggagaaggaggccatcgagctgagagaggccgtggagcagcagaaggtgaagaacaacgacctgagagagaagaactggaaggccatggaggccctggccaccgccgagcaggcctgcaaggagaagctgctgagcctgacccaggccaaggaggagagcgagaagcagctgtgcctgatcgaggcccagaccatggaggccctgctggccctgctgcccgagctgagcgtgctggcccagcagaactacaccgagtggctgcaggacctgaaggagaagggccccaccctgctgaagcacccccccgcccccgccgagcccagcagcgacctggccagcaagctgagagaggccgaggagacccagagcaccctgcaggccgagtgcgaccagtacagaagcatcctggccgagaccgagggcatgctgagagacctgcagaagagcgtggaggaggaggagcaggtgtggagagccaaggtgggcgccgccgaggaggagctgcagaagagcagagtgaccgtgaagcacctggaggagatcgtggagaagctgaagggcgagctggagagcagcgaccaggtgagagagcacaccagccacctggaggccgagctggagaagcacatggccgccgccagcgccgagtgccagaactacgccaaggaggtggccggcctgagacagctgctgctggagagccagagccagctggacgccgccaagagcgaggcccagaagcagagcgacgagctggccctggtgagacagcagctgagcgagatgaagagccacgtggaggacggcgacatcgccggcgcccccgccagcagccccgaggccccccccgccgagcaggaccccgtgcagctgaagacccagctggagtggaccgaggccatcctggaggacgagcagacccagagacagaagctgaccgccgagttcgaggaggcccagaccagcgcctgcagactgcaggaggagctggagaagctgagaaccgccggccccctggagagcagcgagaccgaggaggccagccagctgaaggagagactggagaaggagaagaagctgaccagcgacctgggcagagccgccaccagactgcaggagctgctgaagaccacccaggagcagctggccagagagaaggacaccgtgaagaagctgcaggagcagctggagaaggccgaggacggcagcagcagcaaggagggcaccagcgtgtag

SEQ ID NO: 97586 - DNA, 663 bp, Artificial Sequence
  Description of Artificial Sequence: Synthetic coding sequence
atggccagcggctgcaagatcggccccagcatcctgaacagcgacctggccaacctgggcgccgagtgcctgagaatgctggacagcggcgccgactacctgcacctggacgtgatggacggctacatgcacatgatggtgagcaagcccgagcagtgggtgaagcccatggccgtggccggcgccaaccagtacaccttccacctggaggccaccgagaaccccggcgccctgatcaaggacatcagagagaacggcatgaagagctgcagcgtgacccaggccgaggtgcagtggcacagccagggccccctgcaggtgggcctggccatcaagcccggcaccagcgtggagtacctggccccctgggccaaccagatcgacatggccctggtgatgaccgtggagcccggcttcggcggccagaagttcatggaggacatgatgcccaaggtgcactggctgagaacccagttccccagcctggacatcgaggtggacggcggcgtgggccccgacaccgtgcacaagtgcgccgaggccggcgccaacatgatcgtgagcggcagcgccatcatgagaagcgaggaccccagaagcgtgatcaacctgctgagaaacgtgtgcagcgaggccgcccagaagagaagcctggacagatag

SEQ ID NO: 97587 - DNA, 687 bp, Artificial Sequence
  Description of Artificial Sequence: Synthetic coding sequence
atggccagcggctgcaagatcggccccagcatcctgaacagcgacctggccaacctgggcgccgagtgcctgagaatgctggacagcggcgccgactacctgcacctggacgtgatggacggccacttcgtgcccaacatcaccttcggccaccccgtggtggagagcctgagaaagcagctgggccaggaccccttcttcgacatgcacatgatggtgagcaagcccgagcagtgggtgaagcccatggccgtggccggcgccaaccagtacaccttccacctggaggccaccgagaaccccggcgccctgatcaaggacatcagagagaacggcatgaaggtgggcctggccatcaagcccggcaccagcgtggagtacctggccccctgggccaaccagatcgacatggccctggtgatgaccgtggagcccggcttcggcggccagaagttcatggaggacatgatgcccaaggtgcactggctgagaacccagttccccagcctggacatcgaggtggacggcggcgtgggccccgacaccgtgcacaagtgcgccgaggccggcgccaacatgatcgtgagcggcagcgccatcatgagaagcgaggaccccagaagcgtgatcaacctgctgagaaacgtgtgcagcgaggccgcccagaagagaagcctggacagatag

SEQ ID NO: 97588 - DNA, 537 bp, Artificial Sequence
  Description of Artificial Sequence: Synthetic coding sequence
atgcacatgatggtgagcaagcccgagcagtgggtgaagcccatggccgtggccggcgccaaccagtacaccttccacctggaggccaccgagaaccccggcgccctgatcaaggacatcagagagaacggcatgaagagctgcagcgtgacccaggccgaggtgcagtggcacagccagggccccctgcaggtgggcctggccatcaagcccggcaccagcgtggagtacctggccccctgggccaaccagatcgacatggccctggtgatgaccgtggagcccggcttcggcggccagaagttcatggaggacatgatgcccaaggtgcactggctgagaacccagttccccagcctggacatcgaggtggacggcggcgtgggccccgacaccgtgcacaagtgcgccgaggccggcgccaacatgatcgtgagcggcagcgccatcatgagaagcgaggaccccagaagcgtgatcaacctgctgagaaacgtgtgcagcgaggccgcccagaagagaagcctggacagatag

SEQ ID NO: 97589 - DNA, 537 bp, Artificial Sequence; identical to SEQ ID NO: 97588
  Description of Artificial Sequence: Synthetic coding sequence

SEQ ID NO: 97590 - DNA, 285 bp, Artificial Sequence
  Description of Artificial Sequence: Synthetic coding sequence
atgcacatgatggtgagcaagcccgagcagtgggtgaagcccatggccgtggccggcgccaaccagtacaccttccacctggaggccaccgagaaccccggcgccctgatcaaggacatcagagagaacggcatgaagagctgcagcgtgacccaggccgaggtgcagtggcacagccagggccccctgcaggtgggcctggccatcaagcccggcaccagcgtggagtacctggccccctgggccaaccagatcgacatggccctggtgatgaccgtggagtag

SEQ ID NO: 97591 - DNA, 537 bp, Artificial Sequence; identical to SEQ ID NO: 97588
  Description of Artificial Sequence: Synthetic coding sequence

SEQ ID NO: 97592 - DNA, 600 bp, Artificial Sequence
  Description of Artificial Sequence: Synthetic coding sequence
atggccagcggctgcaagatcggccccagcatcctgaacagcgacctggccaacctgggcgccgagtgcctgagaatgctggacagcggcgccgactacctgcacctggacgtgatggacggccacttcgtgcccaacatcaccttcggccaccccgtggtggagagcctgagaaagcagctgggccaggaccccttcttcgacatgcacatgatggtgagcaagcccgagcagtgggtgaagcccatggccgtggccggcgccaaccagtacaccttccacctggaggccaccgagaaccccggcgccctgatcaaggacatcagagagaacggcatgaaggtgggcctggccatcaagcccggcaccagcgtggagtacctggccccctgggccaaccagatcgacatggccctggtgatgaccgtggagcccggcttcggcggccagaagttcatggaggacatgatgcccaaggccggcgccaacatgatcgtgagcggcagcgccatcatgagaagcgaggaccccagaagcgtgatcaacctgctgagaaacgtgtgcagcgaggccgcccagaagagaagcctggacagatag

SEQ ID NO: 97593 - DNA, 3159 bp, Artificial Sequence
  Description of Artificial Sequence: Synthetic coding sequence
atgagagaggccgccgagagaagacagcagctgcagctggagcacgaccaggccctggccgtgctgagcgccaagcagcaggagatcgacctgctgcagaagagcaaggtgagagagctggaggagaagtgcagaacccagagcgagcagttcaacctgctgagcagagacctggagaagttcagacagcacgccggcaagatcgacctgctgggcggcagcgccgtggcccccctggacatcagcaccgcccccagcaagcccttcccccagttcatgaacggcctggccaccagcctgggcaagggccaggagagcgccatcggcggcagcagcgccatcggcgagtacatcagacccctgccccagcccggcgacagacccgagcccctgagcgccaagcccaccttcctgagcagaagcggcagcgccagatgcagaagcgagagcgacatggagaacgagagaaacagcaacaccagcaagcagagatacagcggcaaggtgcacctgtgcgtggccagatacagctacaaccccttcgacggccccaacgagaaccccgaggccgagctgcccctgaccgccggcaagtacctgtacgtgtacggcgacatggacgaggacggcttctacgagggcgagctgctggacggccagagaggcctggtgcccagcaacttcgtggacttcgtgcaggacaacgagagcagactggccagcaccctgggcaacgagcaggaccagaacttcatcaaccacagcggcatcggcctggagggcgagcacatcctggacctgcacagccccacccacatcgacgccggcatcaccgacaacagcgccggcaccctggacgtgaacatcgacgacatcggcgaggacatcgtgccctaccccagaaagatcaccctgatcaagcagctggccaagagcgtgatcgtgggctgggagccccccgccgtgccccccggctggggcaccgtgagcagctacaacgtgctggtggacaaggagaccagaatgaacctgaccctgggcagcagaaccaaggccctgatcgagaagctgaacatggccgcctgcacctacagaatcagcgtgcagtgcgtgaccagcagaggcagcagcgacgagctgcagtgcaccctgctggtgggcaaggacgtggtggtggcccccagccacctgagagtggacaacatcacccagatcagcgcccagctgagctggctgcccaccaacagcaactacagccacgtgatcttcctgaacgaggaggagttcgacatcgtgaaggccgccagatacaagtaccagttcttcaacctgagacccaacatggcctacaaggtgaaggtgctggccaagccccaccagatgccctggcagctgcccctggagcagagagagaagaaggaggccttcgtggagttcagcaccctgcccgccggcccccccgcccccccccaggacgtgaccgtgcaggccggcgtgacccccgccaccatcagagtgagctggagaccccccgtgctgacccccaccggcctgagcaacggcgccaacgtgaccggctacggcgtgtacgccaagggccagagagtggccgaggtgatcttccccaccgccgacagcaccgccgtggagctggtgagactgagaagcctggaggccaagggcgtgaccgtgagaaccctgagcgcccagggcgagagcgtggacagcgccgtggccgccgtgccccccgagctgctggtgccccccaccccccaccccagacccgccccccagagcaagcccctggccagcagcggcgtgcccgagaccaaggacgagcacctgggcccccacgccagaatggacgaggcctgggagcagagcagagcccccggccccgtgcacggccacatgctggagccccccgtgggccccggcagaagaagccccagccccagcagaatcctgccccagccccagggcacccccgtgagcaccaccgtggccaaggccatggccagagaggccgcccagagagtggccgagagcagcagactggagaagagaagcgtgttcctggagagaagcagcgccggccagtacgccgccagcgacgaggaggacgcctacgacagccccgacttcaagagaagaggcgccagcgtggacgacttcctgaagggcagcgagctgggcaagcagccccactgctgccacggcgacgagtaccacaccgagagcagcagaggcagcgacctgagcgacatcatggaggaggacgaggaggagctgtacagcgagatgcagctggaggacggcggcagaagaagacccagcggcaccagccacaacgccctgaagatcctgggcaaccccgccagcgccggcagagtggaccacatgggcagaagattccccagaggcagcgccggcccccagagaagcagacccgtgaccgtgcccagcatcgacgactacggcagagacagactgagccccgacttctacgaggagagcgagaccgaccccggcgccgaggagctgcccgccagaatcttcgtggccctgttcgactacgaccccctgaccatgagccccaaccccgacgccgccgaggaggagctgcccttcaaggagggccagatcatcaaggtgtacggcgacaaggacgccgacggcttctacagaggcgagacctgcgccagactgggcctgatcccctgcaacatggtgagcgagatccaggccgacgacgaggagatgatggaccagctgctgagacagggcttcctgcccctgaacacccccgtggagaagatcgagagaagcagaagaagcggcagaagacacagcgtgagcaccagaagaatggtggccctgtacgactacgaccccagagagagcagccccaacgtggacgtggaggccgagctgaccttctgcaccggcgacatcatcaccgtgttcggcgagatcgacgaggacggcttctactacggcgagctgaacggccagaagggcctggtgcccagcaacttcctggaggaggtgcccgacgacgtggaggtgtacctgagcgacgcccccagccactacagccaggacacccccatgagaagcaaggccaagagaaagaagagcgtgcacttcaccccctag

SEQ ID NO: 97594 - DNA, 1938 bp, Artificial Sequence
  Description of Artificial Sequence: Synthetic coding sequence
atgaacggcctggccaccagcctgggcaagggccaggagagcgccatcggcggcagcagcgccatcggcgagtacatcagacccctgccccagcccggcgacagacccgagcccctgagcgccaagcccaccttcctgagcagaagcggcagcgccagatgcagaagcgagagcgacatggagaacgagagaaacagcaacaccagcaagcagagatacagcggcaaggtgcacctgtgcgtggccagatacagctacaaccccttcgacggccccaacgagaaccccgaggccgagctgcccctgaccgccggcaagtacctgtacgtgtacggcgacatggacgaggacggcttctacgagggcgagctgctggacggccagagaggcctggtgcccagcaacttcgtggacttcgtgcaggacaacgagagcagactggccagcaccctgggcaacgagcaggaccagaacttcatcaaccacagcggcatcggcctggagggcgagcacatcctggacctgcacagccccacccacatcgacgccggcatcaccgacaacagcgccggcaccctggacgtgaacatcgacgacatcggcgaggacatcgtgccctaccccagaaagatcaccctgatcaagcagctggccaagagcgtgatcgtgggctgggagccccccgccgtgccccccggctggggcaccgtgagcagctacaacgtgctggtggacaaggagaccagaatgaacctgaccctgggcagcagaaccaaggccctgatcgagaagctgaacatggccgcctgcacctacagaatcagcgtgcagtgcgtgaccagcagaggcagcagcgacgagctgcagtgcaccctgctggtgggcaaggacgtggtggtggcccccagccacctgagagtggacaacatcacccagatcagcgcccagctgagctggctgcccaccaacagcaactacagccacgtgatcttcctgaacgaggaggagttcgacatcgtgaaggccgccagatacaagtaccagttcttcaacctgagacccaacatggcctacaaggtgaaggtgctggccaagccccaccagatgccctggcagctgcccctggagcagagagagaagaaggaggccttcgtggagttcagcaccctgcccgccggcccccccgcccccccccaggacgtgaccgtgcaggccggcgtgacccccgccaccatcagagtgagctggagaccccccgtgctgacccccaccggcctgagcaacggcgccaacgtgaccggctacggcgtgtacgccaagggccagagagtggccgaggtgatcttccccaccgccgacagcaccgccgtggagctggtgagactgagaagcctggaggccaagggcgtgaccgtgagaaccctgagcgcccagggcgagagcgtggacagcgccgtggccgccgtgccccccgagctgctggtgccccccaccccccaccccagacccgccccccagagcaagcccctggccagcagcggcgtgcccgagaccaaggacgagcacctgggcccccacgccagaatggacgaggcctgggagcagagcagagcccccggccccgtgcacggccacatgctggagccccccgtgggccccggcagaagaagccccagccccagcagaatcctgccccagccccagggcacccccgtgagcaccaccgtggccaaggccatggccagagaggccgcccagagagtggccgagagcagcagactggagaagagaagcgtgttcctggagagaagcagcgccggccagtacgccgccagcgacgaggaggacgcctacgacagccccgacttcaagagaagaggcgccagcgtggacgacttcctgaagggcagcgagctgggcaagcagatggccagctag

SEQ ID NO: 97595 - DNA, 1938 bp, Artificial Sequence
  Description of Artificial Sequence: Synthetic coding sequence
atgaacggcctggccaccagcctgggcaagggccaggagagcgccatcggcggcagcagcgccatcggcgagtacatcagacccctgccccagcccggcgacagacccgagcccctgagcgccaagcccaccttcctgagcagaagcggcagcgccagatgcagaagcgagagcgacatggagaacgagagaaacagcaacaccagcaagcagagatacagcggcaaggtgcacctgtgcgtggccagatacagctacaaccccttcgacggccccaacgagaaccccgaggccgagctgcccctgaccgccggcaagtacctgtacgtgtacggcgacatggacgaggacggcttctacgagggcgagctgctggacggccagagaggcctggtgcccagcaacttcgtggacttcgtgcaggacaacgagagcagactggccagcaccctgggcaacgagcaggaccagaacttcatcaaccacagcggcatcggcctggagggcgagcacatcctggacctgcacagccccacccacatcgacgccggcatcaccgacaacagcgccggcaccctggacgtgaacatcgacgacatcggcgaggacatcgtgccctaccccagaaagatcaccctgatcaagcagctggccaagagcgtgatcgtgggctgggagccccccgccgtgccccccggctggggcaccgtgagcagctacaacgtgctggtggacaaggagaccagaatgaacctgaccctgggcagcagaaccaaggccctgatcgagaagctgaacatggccgcctgcacctacagaatcagcgtgcagtgcgtgaccagcagaggcagcagcgacgagctgcagtgcaccctgctggtgggcaaggacgtggtggtggcccccagccacctgagagtggacaacatcacccagatcagcgcccagctgagctggctgcccaccaacagcaactacagccacgtgatcttcctgaacgaggaggagttcgacatcgtgaaggccgccagatacaagtaccagttcttcaacctgagacccaacatggcctacaaggtgaaggtgctggccaagccccaccagatgccctggcagctgcccctggagcagagagagaagaaggaggccttcgtggagttcagcaccctgcccgccggcccccccgcccccccccaggacgtgaccgtgcaggccggcgtgacccccgccaccatcagagtgagctggagaccccccgtgctgacccccaccggcctgagcaacggcgccaacgtgaccggctacggcgtgtacgccaagggccagagagtggccgaggtgatcttccccaccgccgacagcaccgccgtggagctggtgagactgagaagcctggaggccaagggcgtgaccgtgagaaccctgagcgcccagggcgagagcgtggacagcgccgtggccgccgtgccccccgagctgctggtgccccccaccccccaccccagacccgccccccagagcaagcccctggccagcagcggcgtgcccgagaccaaggacgagcacctgggcccccacgccagaatggacgaggcctgggagcagagcagagcccccggccccgtgcacggccacatgctggagccccccgtgggccccggcagaagaagccccagccccagcagaatcctgccccagccccagggcacccccgtgagcaccaccgtggccaaggccatggccagagaggccgcccagagagtggccgagagcagcagactggagaagagaagcgtgttcctggagagaagcagcgccggccagtacgccgccagcgacgaggaggacgcctacgacagccccgacttcaagagaagaggcgccagcgtggacgacttcctgaagggcagcgagctgggcaagcagatggtgagctag

SEQ ID NO: 97596 - DNA, 4638 bp, Artificial Sequence
  Description of Artificial Sequence: Synthetic coding sequence
atgcagagagagagagaggccgagatcagacagctgctgagatggaaggaggccgagcagagacagctgcagcagctgctgcacagagagagagacggcgtggtgagacaggccagagagctgcagagacagctggccgaggagctggtgaacagaggccactgcagcagacccggcgccagcgaggtgagcgccgcccagtgcagatgcagactgcaggaggtgctggcccagctgagatggcagaccgacggcgagcaggccgccagaatcagatacctgcaggccgccctggaggtggagagacagctgttcctgaagtacatcctggcccacttcagaggccaccccgccctgagcggcagccccgacccccaggccgtgcacagcctggaggagcccctgccccagaccagcagcggcagctgccacgcccccaagcccgcctgccagctgggcagcctggacagcctgagcgccgaggtgggcgtgagaagcagaagcctgggcctggtgagcagcgcctgcagcagcagccccgacggcctgctgagcacccacgccagcagcctggactgcttcgcccccgcctgcagcagaagcctggacagcaccagaagcctgcccaaggccagcaagagcgaggagagacccagcagccccgacaccagcacccccggcagcagaagactgagccccccccccagccccctgccccccccccccccccccagcgcccacagaaagctgagcaaccccagaggcggcgagggcagcgagagccagccctgcgaggtgctgacccccagcccccccggcctgggccaccacgagctgatcaagctgaactggctgctggccaaggccctgtgggtgctggccagaagatgctacaccctgcaggccgagaacaagcagctgagaagagccggctgcccctaccaggccgacgagaaggtgaagagactgaaggtgaagagagccgagctgaccggcctggccagaagactggccgacagagccagaaagctgcaggagaccaacctgagagccgtgagcgcccccatccccggcgagagctgcgccggcctggagctgtgccaggtgttcgccagacagagagccagagacctgagcgagcaggccagcgcccccctggccaaggacaagcagatcgaggagctgagacaggagtgccacctgctgcaggccagagtggccagcggcccctgcagcgacctgcacaccggcagaggcggcccctgcacccagtggctgaacgtgagagacctggacagactgcagagagagagccagagagaggtgctgagactgcagagacagctgatgctgcagcagggcaacggcggcgcctggcccgaggccggcggccagagcgccacctgcgaggaggtgagaagacagatgctggccctggagagagagctggaccagagaagaagagagtgccaggagctgggcgcccaggccgcccccgccagaagaagaggcgaggaggccgagacccagctgcaggccgccctgctgaagaacgcctggctggccgaggagaacggcagactgcaggccaagaccgactgggtgagaaaggtggaggccgagaacagcgaggtgagaggccacctgggcagagcctgccaggagagagacgccagcggcctgatcgccgagcagctgctgcagcaggccgccagaggccaggacagacagcagcagctgcagagagacccccagaaggccctgtgcgacctgcaccccagctggaaggagatccaggccctgcagtgcagacccggccacccccccgagcagccctgggagaccagccagatgcccgagagccaggtgaagggcagcagaagacccaagttccacgccagacccgaggactacgccgtgagccagcccaacagagacatccaggagaagagagaggccagcctggaggagagccccgtggccctgggcgagagcgccagcgtgccccaggtgagcgagaccgtgcccgccagccagcccctgagcaagaagaccagcagccagagcaacagcagcagcgagggcagcatgtgggccaccgtgcccagcagccccaccctggacagagacaccgccagcgaggtggacgacctggagcccgacagcgtgagcctggccctggagatgggcggcagcgccgcccccgccgcccccaagctgaagatcttcatggcccagtacaactacaaccccttcgagggccccaacgaccaccccgagggcgagctgcccctgaccgccggcgactacatctacatcttcggcgacatggacgaggacggcttctacgagggcgagctggaggacggcagaagaggcctggtgcccagcaacttcgtggagcagatccccgacagctacatccccggctgcctgcccgccaagagccccgacctgggccccagccagctgcccgccggccaggacgaggccctggaggaggacagcctgctgagcggcaaggcccagggcgtggtggacagaggcctgtgccagatggtgagagtgggcagcaagaccgaggtggccaccgagatcctggacaccaagaccgaggcctgccagctgggcctgctgcagagcatgggcaagcagggcctgagcagacccctgctgggcaccaagggcgtgctgagaatggcccccatgcagctgcacctgcagaacgtgaccgccaccagcgccaacatcacctgggtgtacagcagccacagacacccccacgtggtgtacctggacgacagagagcacgccctgacccccgccggcgtgagctgctacaccttccagggcctgtgccccggcacccactacagagccagagtggaggtgagactgcccagagacctgctgcaggtgtactggggcaccatgagcagcaccgtgaccttcgacaccctgctggccggccccccctacccccccctggacgtgctggtggagagacacgccagccccggcgtgctggtggtgagctggctgcccgtgaccatcgacagcgccggcagcagcaacggcgtgcaggtgaccggctacgccgtgtacgccgacggcctgaaggtgtgcgaggtggccgacgccaccgccggcagcaccctgctggagttcagccagctgcaggtgcccctgacctggcagaaggtgagcgtgagaaccatgagcctgtgcggcgagagcctggacagcgtgcccgcccagatccccgaggacttcttcatgtgccacagatggcccgagaccccccccttcagctacacctgcggcgaccccagcacctacagagtgaccttccccgtgtgcccccagaagctgagcctggccccccccagcgccaaggccagcccccacaaccccggcagctgcggcgagccccaggccaagttcctggaggccttcttcgaggagccccccagaagacagagccccgtgagcaacctgggcagcgagggcgagtgccccagcagcggcgccggcagccaggcccaggagctggccgaggcctgggagggctgcagaaaggacctgctgttccagaagagcccccagaaccacagaccccccagcgtgagcgaccagcccggcgagaaggagaactgcagccagcacatgggcaccagcaagagccccgcccccggcttcatccacctgagaaccgagtgcggccccagaaaggagccctgccaggagaaggccgccctggagagagtgctgagacagaagcaggacgcccagggcttcacccccccccagctgggcgccagccagcagtacgccagcgacttccacaacgtgctgaaggaggagcaggaggccctgtgcctggacctgtggggcaccgagagaagagaggagagaagagagcccgagccccacagcagacagggccaggccctgggcgtgaagagaggctgccagctgcacgagcccagcagcgccctgtgccccgcccccagcgccaaggtgatcaagatgcccagaggcggcccccagcagctgggcaccggcgccaacacccccgccagagtgttcgtggccctgagcgactacaaccccctggtgatgagcgccaacctgaaggccgccgaggaggagctggtgttccagaagagacagctgctgagagtgtggggcagccaggacacccacgacttctacctgagcgagtgcaacagacaggtgggcaacatccccggcagactggtggccgagatggaggtgggcaccgagcagaccgacagaagatggagaagccccgcccagggcaacctgcccagcgtggcccacctggaggacttccagggcctgaccatcccccagggcagcagcctggtgctgcagggcaacagcaagagactgcccctgtggacccccaagatcatgatcgccgccctggactacgaccccggcgacggccagatgggcggccagggcaagggcagactggccctgagagccggcgacgtggtgatggtgtacggccccatggacgaccagggcttctactacggcgagctgggcggccacagaggcctggtgcccgcccacctgctggaccacatgagcctgcacggccactag

SEQ ID NO: 97597 - DNA, 4920 bp, Artificial Sequence
  Description of Artificial Sequence: Synthetic coding sequence
atggccaaggacagccccagccccctgggcgccagccccaagaagcccggctgcagcagccccgccgccgccgtgctggagaaccagagaagagagctggagaagctgagagccgagctggaggccgagagagccggctggagagccgagagaagaagattcgccgccagagagagacagctgagagaggaggccgagagagagagaagacagctggccgacagactgagaagcaagtgggaggcccagagaagcagagagctgagacagctgcaggaggagatgcagagagagagagaggccgagatcagacagctgctgagatggaaggaggccgagcagagacagctgcagcagctgctgcacagagagagagacggcgtggtgagacaggccagagagctgcagagacagctggccgaggagctggtgaacagaggccactgcagcagacccggcgccagcgaggtgagcgccgcccagtgcagatgcagactgcaggaggtgctggcccagctgagatggcagaccgacggcgagcaggccgccagaatcagatacctgcaggccgccctggaggtggagagacagctgttcctgaagtacatcctggcccacttcagaggccaccccgccctgagcggcagccccgacccccaggccgtgcacagcctggaggagcccctgccccagaccagcagcggcagctgccacgcccccaagcccgcctgccagctgggcagcctggacagcctgagcgccgaggtgggcgtgagaagcagaagcctgggcctggtgagcagcgcctgcagcagcagccccgacggcctgctgagcacccacgccagcagcctggactgcttcgcccccgcctgcagcagaagcctggacagcaccagaagcctgcccaaggccagcaagagcgaggagagacccagcagccccgacaccagcacccccggcagcagaagactgagccccccccccagccccctgccccccccccccccccccagcgcccacagaaagctgagcaaccccagaggcggcgagggcagcgagagccagccctgcgaggtgctgacccccagcccccccggcctgggccaccacgagctgatcaagctgaactggctgctggccaaggccctgtgggtgctggccagaagatgctacaccctgcaggccgagaacaagcagctgagaagagccggctgcccctaccaggccgacgagaaggtgaagagactgaaggtgaagagagccgagctgaccggcctggccagaagactggccgacagagccagaaagctgcaggagaccaacctgagagccgtgagcgcccccatccccggcgagagctgcgccggcctggagctgtgccaggtgttcgccagacagagagccagagacctgagcgagcaggccagcgcccccctggccaaggacaagcagatcgaggagctgagacaggagtgccacctgctgcaggccagagtggccagcggcccctgcagcgacctgcacaccggcagaggcggcccctgcacccagtggctgaacgtgagagacctggacagactgcagagagagagccagagagaggtgctgagactgcagagacagctgatgctgcagcagggcaacggcggcgcctggcccgaggccggcggccagagcgccacctgcgaggaggtgagaagacagatgctggccctggagagagagctggaccagagaagaagagagtgccaggagctgggcgcccaggccgcccccgccagaagaagaggcgaggaggccgagacccagctgcaggccgccctgctgaagaacgcctggctggccgaggagaacggcagactgcaggccaagaccgactgggtgagaaaggtggaggccgagaacagcgaggtgagaggccacctgggcagagcctgccaggagagagacgccagcggcctgatcgccgagcagctgctgcagcaggccgccagaggccaggacagacagcagcagctgcagagagacccccagaaggccctgtgcgacctgcaccccagctggaaggagatccaggccctgcagtgcagacccggccacccccccgagcagccctgggagaccagccagatgcccgagagccaggtgaagggcagcagaagacccaagttccacgccagacccgaggactacgccgtgagccagcccaacagagacatccaggagaagagagaggccagcctggaggagagccccgtggccctgggcgagagcgccagcgtgccccaggtgagcgagaccgtgcccgccagccagcccctgagcaagaagaccagcagccagagcaacagcagcagcgagggcagcatgtgggccaccgtgcccagcagccccaccctggacagagacaccgccagcgaggtggacgacctggagcccgacagcgtgagcctggccctggagatgggcggcagcgccgcccccgccgcccccaagctgaagatcttcatggcccagtacaactacaaccccttcgagggccccaacgaccaccccgagggcgagctgcccctgaccgccggcgactacatctacatcttcggcgacatggacgaggacggcttctacgagggcgagctggaggacggcagaagaggcctggtgcccagcaacttcgtggagcagatccccgacagctacatccccggctgcctgcccgccaagagccccgacctgggccccagccagctgcccgccggccaggacgaggccctggaggaggacagcctgctgagcggcaaggcccagggcgtggtggacagaggcctgtgccagatggtgagagtgggcagcaagaccgaggtggccaccgagatcctggacaccaagaccgaggcctgccagctgggcctgctgcagagcatgggcaagcagggcctgagcagacccctgctgggcaccaagggcgtgctgagaatggcccccatgcagctgcacctgcagaacgtgaccgccaccagcgccaacatcacctgggtgtacagcagccacagacacccccacgtggtgtacctggacgacagagagcacgccctgacccccgccggcgtgagctgctacaccttccagggcctgtgccccggcacccactacagagccagagtggaggtgagactgcccagagacctgctgcaggtgtactggggcaccatgagcagcaccgtgaccttcgacaccctgctggccggccccccctacccccccctggacgtgctggtggagagacacgccagccccggcgtgctggtggtgagctggctgcccgtgaccatcgacagcgccggcagcagcaacggcgtgcaggtgaccggctacgccgtgtacgccgacggcctgaaggtgtgcgaggtggccgacgccaccgccggcagcaccctgctggagttcagccagctgcaggtgcccctgacctggcagaaggtgagcgtgagaaccatgagcctgtgcggcgagagcctggacagcgtgcccgcccagatccccgaggacttcttcatgtgccacagatggcccgagaccccccccttcagctacacctgcggcgaccccagcacctacagagtgaccttccccgtgtgcccccagaagctgagcctggccccccccagcgccaaggccagcccccacaaccccggcagctgcggcgagccccaggccaagttcctggaggccttcttcgaggagccccccagaagacagagccccgtgagcaacctgggcagcgagggcgagtgccccagcagcggcgccggcagccaggcccaggagctggccgaggcctgggagggctgcagaaaggacctgctgttccagaagagcccccagaaccacagaccccccagcgtgagcgaccagcccggcgagaaggagaactgcagccagcacatgggcaccagcaagagccccgcccccggcttcatccacctgagaaccgagtgcggccccagaaaggagccctgccaggagaaggccgccctggagagagtgctgagacagaagcaggacgcccagggcttcacccccccccagctgggcgccagccagcagtacgccagcgacttccacaacgtgctgaaggaggagcaggaggccctgtgcctggacctgtggggcaccgagagaagagaggagagaagagagcccgagccccacagcagacagggccaggccctgggcgtgaagagaggctgccagctgcacgagcccagcagcgccctgtgccccgcccccagcgccaaggtgatcaagatgcccagaggcggcccccagcagctgggcaccggcgccaacacccccgccagagtgttcgtggccctgagcgactacaaccccctggtgatgagcgccaacctgaaggccgccgaggaggagctggtgttccagaagagacagctgctgagagtgtggggcagccaggacacccacgacttctacctgagcgagtgcaacagacaggtgggcaacatccccggcagactggtggccgagatggaggtgggcaccgagcagaccgacagaagatggagaagccccgcccagggcaacctgcccagcgtggcccacctggaggacttccagggcctgaccatcccccagggcagcagcctggtgctgcagggcaacagcaagagactgcccctgtggacccccaagatcatgatcgccgccctggactacgaccccggcgacggccagatgggcggccagggcaagggcagactggccctgagagccggcgacgtggtgatggtgtacggccccatggacgaccagggcttctactacggcgagctgggcggccacagaggcctggtgcccgcccacctgctggaccacatgagcctgcacggccactag

SEQ ID NO: 97598 - DNA, 4638 bp, Artificial Sequence
  Description of Artificial Sequence: Synthetic coding sequence
atgcagagagagagagaggccgagatcagacagctgctgagatggaaggaggccgagcagagacagctgcagcagctgctgcacagagagagagacggcgtggtgagacaggccagagagctgcagagacagctggccgaggagctggtgaacagaggccactgcagcagacccggcgccagcgaggtgagcgccgcccagtgcagatgcagactgcaggaggtgctggcccagctgagatggcagaccgacggcgagcaggccgccagaatcagatacctgcaggccgccctggaggtggagagacagctgttcctgaagtacatcctggcccacttcagaggccaccccgccctgagcggcagccccgacccccaggccgtgcacagcctggaggagcccctgccccagaccagcagcggcagctgccacgcccccaagcccgcctgccagctgggcagcctggacagcctgagcgccgaggtgggcgtgagaagcagaagcctgggcctggtgagcagcgcctgcagcagcagccccgacggcctgctgagcacccacgccagcagcctggactgcttcgcccccgcctgcagcagaagcctggacagcaccagaagcctgcccaaggccagcaagagcgaggagagacccagcagccccgacaccagcacccccggcagcagaagactgagccccccccccagccccctgccccccccccccccccccagcgcccacagaaagctgagcaaccccagaggcggcgagggcagcgagagccagccctgcgaggtgctgacccccagcccccccggcctgggccaccacgagctgatcaagctgaactggctgctggccaaggccctgtgggtgctggccagaagatgctacaccctgcaggaggagaacaagcagctgagaagagccggctgcccctaccaggccgacgagaaggtgaagagactgaaggtgaagagagccgagctgaccggcctggccagaagactggccgacagagccagagagctgcaggagaccaacctgagagccgtgagcgcccccatccccggcgagagctgcgccggcctggagctgtgccaggtgttcgccagacagagagccagagacctgagcgagcaggccagcgcccccctggccaaggacaagcagatcgaggagctgagacaggagtgccacctgctgcaggccagagtggccagcggcccctgcagcgacctgcacaccggcagaggcggcccctgcacccagtggctgaacgtgagagacctggacagactgcagagagagagccagagagaggtgctgagactgcagagacagctgatgctgcagcagggcaacggcggcgcctggcccgaggccggcggccagagcgccacctgcgaggaggtgagaagacagatgctggccctggagagagagctggaccagagaagaagagagtgccaggagctgggcacccaggccgcccccgccagaagaagaggcgaggaggccgagacccagctgcaggccgccctgctgaagaacgcctggctggccgaggagaacggcagactgcaggccaagaccgactgggtgagaaaggtggaggccgagaacagcgaggtgagaggccacctgggcagagcctgccaggagagagacgccagcggcctgatcgccgagcagctgctgcagcaggccgccagaggccaggacagacagcagcagctgcagagagacccccagaaggccctgtgcgacctgcaccccagctggaaggagatccaggccctgcagtgcagacccggccacccccccgagcagccctgggagaccagccagatgcccgagagccaggtgaagggcagcagaagacccaagttccacgccagacccgaggactacgccgtgagccagcccaacagagacatccaggagaagagagaggccagcctggaggagagccccgtggccctgggcgagagcgccagcgtgccccaggtgagcgagaccgtgcccgccagccagcccctgagcaagaagaccagcagccagagcaacagcagcagcgagggcagcatgtgggccaccgtgcccagcagccccaccctggacagagacaccgccagcgaggtggacgacctggagcccgacagcgtgagcctggccctggagatgggcggcagcgccgcccccgccgcccccaagctgaagatcttcatggcccagtacaactacaaccccttcgagggccccaacgaccaccccgagggcgagctgcccctgaccgccggcgactacatctacatcttcggcgacatggacgaggacggcttctacgagggcgagctggacgacggcagaagaggcctggtgcccagcaacttcgtggagcagatccccgacagctacatccccggctgcctgcccgccaagagccccgacctgggccccagccagctgcccgccggccaggacgaggccctggaggaggacagcctgctgagcggcaaggcccagggcatggtggacagaggcctgtgccagatggtgagagtgggcagcaagaccgaggtggccaccgagatcctggacaccaagaccgaggcctgccagctgggcctgctgcagagcatgggcaagcagggcctgagcagacccctgctgggcaccaagggcgtgctgagaatggcccccatgcagctgcacctgcagaacgtgaccgccaccagcgccaacatcacctgggtgtacagcagccacagacacccccacgtggtgtacctggacgacagagagcacgccctgacccccgccggcgtgagctgctacaccttccagggcctgtgccccggcacccactacagagtgagagtggaggtgagactgccctgggacctgctgcaggtgtactggggcaccatgagcagcaccgtgaccttcgacaccctgctggccggccccccctacccccccctggaggtgctggtggagagacacgccagccccggcgtgctggtggtgagctggctgcccgtgaccatcgacagcgccggcagcagcaacggcgtgcaggtgaccggctacgccgtgtacgccgacggcctgaaggtgtgcgaggtggccgacgccaccgccggcagcaccgtgctggagttcagccagctgcaggtgcccctgacctggcagaaggtgagcgtgagaaccatgagcctgtgcggcgagagcctggacagcgtgcccgcccagatccccgaggacttcttcatgtgccacagatggcccgagaccccccccttcagctacacctgcggcgaccccagcacctacagagtgaccttccccgtgtgcccccagaagctgagcctggccccccccagcgccaaggccagcccccacaaccccggcagctgcggcgagccccaggccaagttcctggaggccttcttcgaggagccccccagaagacagagccccgtgagcaacctgggcagcgagggcgagtgccccagcagcggcgccggcagccaggcccaggagctggccgaggcctgggagggctgcagaaaggacctgctgttccagaagagcccccagaaccacagaccccccagcgtgagcgaccagcccggcgagaaggagaactgctaccagcacatgggcaccagcaagagccccgcccccggcttcatccacctgagaaccgagtgcggccccagaaaggagccctgccaggagaaggccgccctggagagagtgctgagacagaagcaggacgcccagggcttcacccccccccagctgggcgccagccagcagtacgccagcgacttccacaacgtgctgaaggaggagcaggaggccctgtgcctggacctgagaggcaccgagagaagagaggagagaagagagcccgagccccacagcagacagggccaggccctgggcgtgaagagaggctgccagctgcacgagcccagcagcgccctgtgccccgcccccagcgccaaggtgatcaagatgcccagaggcggcccccagcagctgggcaccggcgccaacacccccgccagagtgttcgtggccctgagcgactacaaccccctggtgatgagcgccaacctgaaggccgccgaggaggagctggtgttccagaagagacagctgctgagagtgtggggcagccaggacacccacgacttctacctgagcgagtgcaacagacaggtgggcaacatccccggcagactggtggccgagatggaggtgggcaccgagcagaccgacagaagatggagaagccccgcccagggccacctgcccagcgtggcccacctggaggacttccagggcctgaccatcccccagggcagcagcctggtgctgcagggcaacagcaagagactgcccctgtggacccccaagatcatgatcgccgccctggactacgaccccggcgacggccagatgggcggccagggcaagggcagactggccctgagagccggcgacgtggtgatggtgtacggccccatggacgaccagggcttctactacggcgagctgggcggccacagaggcctggtgcccgcccacctgctggaccacatgagcctgcacggccactag

SEQ ID NO: 97599 - DNA, 4920 bp, Artificial Sequence
  Description of Artificial Sequence: Synthetic coding sequence
atggccaaggacagccccagccccctgggcgccagccccaagaagcccggctgcagcagccccgccgccgccgtgctggagaaccagagaagagagctggagaagctgagagccgagctggaggccgagagagccggctggagagccgagagaagaagattcgccgccagagagagacagctgagagaggaggccgagagagagagaagacagctggccgacagactgagaagcaagtgggaggcccagagaagcagagagctgagacagctgcaggaggagatgcagagagagagagaggccgagatcagacagctgctgagatggaaggaggccgagcagagacagctgcagcagctgctgcacagagagagagacggcgtggtgagacaggccagagagctgcagagacagctggccgaggagctggtgaacagaggccactgcagcagacccggcgccagcgaggtgagcgccgcccagtgcagatgcagactgcaggaggtgctggcccagctgagatggcagaccgacggcgagcaggccgccagaatcagatacctgcaggccgccctggaggtggagagacagctgttcctgaagtacatcctggcccacttcagaggccaccccgccctgagcggcagccccgacccccaggccgtgcacagcctggaggagcccctgccccagaccagcagcggcagctgccacgcccccaagcccgcctgccagctgggcagcctggacagcctgagcgccgaggtgggcgtgagaagcagaagcctgggcctggtgagcagcgcctgcagcagcagccccgacggcctgctgagcacccacgccagcagcctggactgcttcgcccccgcctgcagcagaagcctggacagcaccagaagcctgcccaaggccagcaagagcgaggagagacccagcagccccgacaccagcacccccggcagcagaagactgagccccccccccagccccctgccccccccccccccccccagcgcccacagaaagctgagcaaccccagaggcggcgagggcagcgagagccagccctgcgaggtgctgacccccagcccccccggcctgggccaccacgagctgatcaagctgaactggctgctggccaaggccctgtgggtgctggccagaagatgctacaccctgcaggaggagaacaagcagctgagaagagccggctgcccctaccaggccgacgagaaggtgaagagactgaaggtgaagagagccgagctgaccggcctggccagaagactggccgacagagccagagagctgcaggagaccaacctgagagccgtgagcgcccccatccccggcgagagctgcgccggcctggagctgtgccaggtgttcgccagacagagagccagagacctgagcgagcaggccagcgcccccctggccaaggacaagcagatcgaggagctgagacaggagtgccacctgctgcaggccagagtggccagcggcccctgcagcgacctgcacaccggcagaggcggcccctgcacccagtggctgaacgtgagagacctggacagactgcagagagagagccagagagaggtgctgagactgcagagacagctgatgctgcagcagggcaacggcggcgcctggcccgaggccggcggccagagcgccacctgcgaggaggtgagaagacagatgctggccctggagagagagctggaccagagaagaagagagtgccaggagctgggcacccaggccgcccccgccagaagaagaggcgaggaggccgagacccagctgcaggccgccctgctgaagaacgcctggctggccgaggagaacggcagactgcaggccaagaccgactgggtgagaaaggtggaggccgagaacagcgaggtgagaggccacctgggcagagcctgccaggagagagacgccagcggcctgatcgccgagcagctgctgcagcaggccgccagaggccaggacagacagcagcagctgcagagagacccccagaaggccctgtgcgacctgcaccccagctggaaggagatccaggccctgcagtgcagacccggccacccccccgagcagccctgggagaccagccagatgcccgagagccaggtgaagggcagcagaagacccaagttccacgccagacccgaggactacgccgtgagccagcccaacagagacatccaggagaagagagaggccagcctggaggagagccccgtggccctgggcgagagcgccagcgtgccccaggtgagcgagaccgtgcccgccagccagcccctgagcaagaagaccagcagccagagcaacagcagcagcgagggcagcatgtgggccaccgtgcccagcagccccaccctggacagagacaccgccagcgaggtggacgacctggagcccgacagcgtgagcctggccctggagatgggcggcagcgccgcccccgccgcccccaagctgaagatcttcatggcccagtacaactacaaccccttcgagggccccaacgaccaccccgagggcgagctgcccctgaccgccggcgactacatctacatcttcggcgacatggacgaggacggcttctacgagggcgagctggacgacggcagaagaggcctggtgcccagcaacttcgtggagcagatccccgacagctacatccccggctgcctgcccgccaagagccccgacctgggccccagccagctgcccgccggccaggacgaggccctggaggaggacagcctgctgagcggcaaggcccagggcatggtggacagaggcctgtgccagatggtgagagtgggcagcaagaccgaggtggccaccgagatcctggacaccaagaccgaggcctgccagctgggcctgctgcagagcatgggcaagcagggcctgagcagacccctgctgggcaccaagggcgtgctgagaatggcccccatgcagctgcacctgcagaacgtgaccgccaccagcgccaacatcacctgggtgtacagcagccacagacacccccacgtggtgtacctggacgacagagagcacgccctgacccccgccggcgtgagctgctacaccttccagggcctgtgccccggcacccactacagagtgagagtggaggtgagactgccctgggacctgctgcaggtgtactggggcaccatgagcagcaccgtgaccttcgacaccctgctggccggccccccctacccccccctggaggtgctggtggagagacacgccagccccggcgtgctggtggtgagctggctgcccgtgaccatcgacagcgccggcagcagcaacggcgtgcaggtgaccggctacgccgtgtacgccgacggcctgaaggtgtgcgaggtggccgacgccaccgccggcagcaccgtgctggagttcagccagctgcaggtgcccctgacctggcagaaggtgagcgtgagaaccatgagcctgtgcggcgagagcctggacagcgtgcccgcccagatccccgaggacttcttcatgtgccacagatggcccgagaccccccccttcagctacacctgcggcgaccccagcacctacagagtgaccttccccgtgtgcccccagaagctgagcctggccccccccagcgccaaggccagcccccacaaccccggcagctgcggcgagccccaggccaagttcctggaggccttcttcgaggagccccccagaagacagagccccgtgagcaacctgggcagcgagggcgagtgccccagcagcggcgccggcagccaggcccaggagctggccgaggcctgggagggctgcagaaaggacctgctgttccagaagagcccccagaaccacagaccccccagcgtgagcgaccagcccggcgagaaggagaactgctaccagcacatgggcaccagcaagagccccgcccccggcttcatccacctgagaaccgagtgcggccccagaaaggagccctgccaggagaaggccgccctggagagagtgctgagacagaagcaggacgcccagggcttcacccccccccagctgggcgccagccagcagtacgccagcgacttccacaacgtgctgaaggaggagcaggaggccctgtgcctggacctgagaggcaccgagagaagagaggagagaagagagcccgagccccacagcagacagggccaggccctgggcgtgaagagaggctgccagctgcacgagcccagcagcgccctgtgccccgcccccagcgccaaggtgatcaagatgcccagaggcggcccccagcagctgggcaccggcgccaacacccccgccagagtgttcgtggccctgagcgactacaaccccctggtgatgagcgccaacctgaaggccgccgaggaggagctggtgttccagaagagacagctgctgagagtgtggggcagccaggacacccacgacttctacctgagcgagtgcaacagacaggtgggcaacatccccggcagactggtggccgagatggaggtgggcaccgagcagaccgacagaagatggagaagccccgcccagggccacctgcccagcgtggcccacctggaggacttccagggcctgaccatcccccagggcagcagcctggtgctgcagggcaacagcaagagactgcccctgtggacccccaagatcatgatcgccgccctggactacgaccccggcgacggccagatgggcggccagggcaagggcagactggccctgagagccggcgacgtggtgatggtgtacggccccatggacgaccagggcttctactacggcgagctgggcggccacagaggcctggtgcccgcccacctgctggaccacatgagcctgcacggccactag

SEQ ID NO: 97600 - DNA, 4638 bp, Artificial Sequence
  Description of Artificial Sequence: Synthetic coding sequence
atgcagagagagagagaggccgagatcagacagctgctgagatggaaggaggccgagcagagacagctgcagcagctgctgcacagagagagagacggcgtggtgagacaggccagagagctgcagagacagctggccgaggagctggtgaacagaggccactgcagcagacccggcgccagcgaggtgagcgccgcccagtgcagatgcagactgcaggaggtgctggcccagctgagatggcagaccgacggcgagcaggccgccagaatcagatacctgcaggccgccctggaggtggagagacagctgttcctgaagtacatcctggcccacttcagaggccaccccgccctgagcggcagccccgacccccaggccgtgcacagcctggaggagcccctgccccagaccagcagcggcagctgccacgcccccaagcccgcctgccagctgggcagcctggacagcctgagcgccgaggtgggcgtgagaagcagaagcctgggcctggtgagcagcgcctgcagcagcagccccgacggcctgctgagcacccacgccagcagcctggactgcttcgcccccgcctgcagcagaagcctggacagcaccagaagcctgcccaaggccagcaagagcgaggagagacccagcagccccgacaccagcacccccggcagcagaagactgagccccccccccagccccctgccccccccccccccccccagcgcccacagaaagctgagcaaccccagaggcggcgagggcagcgagagccagccctgcgaggtgctgacccccagcccccccggcctgggccaccacgagctgatcaagctgaactggctgctggccaaggccctgtgggtgctggccagaagatgctacaccctgcaggaggagaacaagcagctgagaagagccggctgcccctaccaggccgacgagaaggtgaagagactgaaggtgaagagagccgagctgaccggcctggccagaagactggccgacagagccagagagctgcaggagaccaacctgagagccgtgagcgcccccatccccggcgagagctgcgccggcctggagctgtgccaggtgttcgccagacagagagccagagacctgagcgagcaggccagcgcccccctggccaaggacaagcagatcgaggagctgagacaggagtgccacctgctgcaggccagagtggccagcggcccctgcagcgacctgcacaccggcagaggcggcccctgcacccagtggctgaacgtgagagacctggacagactgcagagagagagccagagagaggtgctgagactgcagagacagctgatgctgcagcagggcaacggcggcgcctggcccgaggccggcggccagagcgccacctgcgaggaggtgagaagacagatgctggccctggagagagagctggaccagagaagaagagagtgccaggagctgggcacccaggccgcccccgccagaagaagaggcgaggaggccgagacccagctgcaggccgccctgctgaagaacgcctggctggccgaggagaacggcagactgcaggccaagaccgactgggtgagaaaggtggaggccgagaacagcgaggtgagaggccacctgggcagagcctgccaggagagagacgccagcggcctgatcgccgagcagctgctgcagcaggccgccagaggccaggacagacagcagcagctgcagagagacccccagaaggccctgtgcgacctgcaccccagctggaaggagatccaggccctgcagtgcagacccggccacccccccgagcagccctgggagaccagccagatgcccgagagccaggtgaagggcagcagaagacccaagttccacgccagacccgaggactacgccgtgagccagcccaacagagacatccaggagaagagagaggccagcctggaggagagccccgtggccctgggcgagagcgccagcgtgccccaggtgagcgagaccgtgcccgccagccagcccctgagcaagaagaccagcagccagagcaacagcagcagcgagggcagcatgtgggccaccgtgcccagcagccccaccctggacagagacaccgccagcgaggtggacgacctggagcccgacagcgtgagcctggccctggagatgggcggcagcgccgcccccgccgcccccaagctgaagatcttcatggcccagtacaactacaaccccttcgagggccccaacgaccaccccgagggcgagctgcccctgaccgccggcgactacatctacatcttcggcgacatggacgaggacggcttctacgagggcgagctggacgacggcagaagaggcctggtgcccagcaacttcgtggagcagatccccgacagctacatccccggctgcctgcccgccaagagccccgacctgggccccagccagctgcccgccggccaggacgaggccctggaggaggacagcctgctgagcggcaaggcccagggcatggtggacagaggcctgtgccagatggtgagagtgggcagcaagaccgaggtggccaccgagatcctggacaccaagaccgaggcctgccagctgggcctgctgcagagcatgggcaagcagggcctgagcagacccctgctgggcaccaagggcgtgctgagaatggcccccatgcagctgcacctgcagaacgtgaccgccaccagcgccaacatcacctgggtgtacagcagccacagacacccccacgtggtgtacctggacgacagagagcacgccctgacccccgccggcgtgagctgctacaccttccagggcctgtgccccggcacccactacagagtgagagtggaggtgagactgccctgggacctgctgcaggtgtactggggcaccatgagcagcaccgtgaccttcgacaccctgctggccggccccccctacccccccctggacgtgctggtggagagacacgccagccccggcgtgctggtggtgagctggctgcccgtgaccatcgacagcgccggcagcagcaacggcgtgcaggtgaccggctacgccgtgtacgccgacggcctgaaggtgtgcgaggtggccgacgccaccgccggcagcaccgtgctggagttcagccagctgcaggtgcccctgacctggcagaaggtgagcgtgagaaccatgagcctgtgcggcgagagcctggacagcgtgcccgcccagatccccgaggacttcttcatgtgccacagatggcccgagaccccccccttcagctacacctgcggcgaccccagcacctacagagtgaccttccccgtgtgcccccagaagctgagcctggccccccccagcgccaaggccagcccccacaaccccggcagctgcggcgagccccaggccaagttcctggaggccttcttcgaggagccccccagaagacagagccccgtgagcaacctgggcagcgagggcgagtgccccagcagcggcgccggcagccaggcccaggagctggccgaggcctgggagggctgcagaaaggacctgctgttccagaagagcccccagaaccacagaccccccagcgtgagcgaccagcccggcgagaaggagaactgctaccagcacatgggcaccagcaagagccccgcccccggcttcatccacctgagaaccgagtgcggccccagaaaggagccctgccaggagaaggccgccctggagagagtgctgagacagaagcaggacgcccagggcttcacccccccccagctgggcgccagccagcagtacgccagcgacttccacaacgtgctgaaggaggagcaggaggccctgtgcctggacctgagaggcaccgagagaagagaggagagaagagagcccgagccccacagcagacagggccaggccctgggcgtgaagagaggctgccagctgcacgagcccagcagcgccctgtgccccgcccccagcgccaaggtgatcaagatgcccagaggcggcccccagcagctgggcaccggcgccaacacccccgccagagtgttcgtggccctgagcgactacaaccccctggtgatgagcgccaacctgaaggccgccgaggaggagctggtgttccagaagagacagctgctgagagtgtggggcagccaggacacccacgacttctacctgagcgagtgcaacagacaggtgggcaacatccccggcagactggtggccgagatggaggtgggcaccgagcagaccgacagaagatggagaagccccgcccagggccacctgcccagcgtggcccacctggaggacttccagggcctgatcatcccccagggcagcagcctggtgctgcagggcaacagcaagagactgcccctgtggacccccaagatcatgatcgccgccctggactacgaccccggcgacggccagatgggcggccagggcaagggcagactggccctgagagccggcgacgtggtgatggtgtacggccccatggacgaccagggcttctactacggcgagctgggcggccacagaggcctggtgcccgcccacctgctggaccacatgagcctgcacggccactag

SEQ ID NO: 97601 - DNA, 4920 bp, Artificial Sequence
  Description of Artificial Sequence: Synthetic coding sequence
atggccaaggacagccccagccccctgggcgccagccccaagaagcccggctgcagcagccccgccgccgccgtgctggagaaccagagaagagagctggagaagctgagagccgagctggaggccgagagagccggctggagagccgagagaagaagattcgccgccagagagagacagctgagagaggaggccgagagagagagaagacagctggccgacagactgagaagcaagtgggaggcccagagaagcagagagctgagacagctgcaggaggagatgcagagagagagagaggccgagatcagacagctgctgagatggaaggaggccgagcagagacagctgcagcagctgctgcacagagagagagacggcgtggtgagacaggccagagagctgcagagacagctggccgaggagctggtgaacagaggccactgcagcagacccggcgccagcgaggtgagcgccgcccagtgcagatgcagactgcaggaggtgctggcccagctgagatggcagaccgacggcgagcaggccgccagaatcagatacctgcaggccgccctggaggtggagagacagctgttcctgaagtacatcctggcccacttcagaggccaccccgccctgagcggcagccccgacccccaggccgtgcacagcctggaggagcccctgccccagaccagcagcggcagctgccacgcccccaagcccgcctgccagctgggcagcctggacagcctgagcgccgaggtgggcgtgagaagcagaagcctgggcctggtgagcagcgcctgcagcagcagccccgacggcctgctgagcacccacgccagcagcctggactgcttcgcccccgcctgcagcagaagcctggacagcaccagaagcctgcccaaggccagcaagagcgaggagagacccagcagccccgacaccagcacccccggcagcagaagactgagccccccccccagccccctgccccccccccccccccccagcgcccacagaaagctgagcaaccccagaggcggcgagggcagcgagagccagccctgcgaggtgctgacccccagcccccccggcctgggccaccacgagctgatcaagctgaactggctgctggccaaggccctgtgggtgctggccagaagatgctacaccctgcaggaggagaacaagcagctgagaagagccggctgcccctaccaggccgacgagaaggtgaagagactgaaggtgaagagagccgagctgaccggcctggccagaagactggccgacagagccagagagctgcaggagaccaacctgagagccgtgagcgcccccatccccggcgagagctgcgccggcctggagctgtgccaggtgttcgccagacagagagccagagacctgagcgagcaggccagcgcccccctggccaaggacaagcagatcgaggagctgagacaggagtgccacctgctgcaggccagagtggccagcggcccctgcagcgacctgcacaccggcagaggcggcccctgcacccagtggctgaacgtgagagacctggacagactgcagagagagagccagagagaggtgctgagactgcagagacagctgatgctgcagcagggcaacggcggcgcctggcccgaggccggcggccagagcgccacctgcgaggaggtgagaagacagatgctggccctggagagagagctggaccagagaagaagagagtgccaggagctgggcacccaggccgcccccgccagaagaagaggcgaggaggccgagacccagctgcaggccgccctgctgaagaacgcctggctggccgaggagaacggcagactgcaggccaagaccgactgggtgagaaaggtggaggccgagaacagcgaggtgagaggccacctgggcagagcctgccaggagagagacgccagcggcctgatcgccgagcagctgctgcagcaggccgccagaggccaggacagacagcagcagctgcagagagacccccagaaggccctgtgcgacctgcaccccagctggaaggagatccaggccctgcagtgcagacccggccacccccccgagcagccctgggagaccagccagatgcccgagagccaggtgaagggcagcagaagacccaagttccacgccagacccgaggactacgccgtgagccagcccaacagagacatccaggagaagagagaggccagcctggaggagagccccgtggccctgggcgagagcgccagcgtgccccaggtgagcgagaccgtgcccgccagccagcccctgagcaagaagaccagcagccagagcaacagcagcagcgagggcagcatgtgggccaccgtgcccagcagccccaccctggacagagacaccgccagcgaggtggacgacctggagcccgacagcgtgagcctggccctggagatgggcggcagcgccgcccccgccgcccccaagctgaagatcttcatggcccagtacaactacaaccccttcgagggccccaacgaccaccccgagggcgagctgcccctgaccgccggcgactacatctacatcttcggcgacatggacgaggacggcttctacgagggcgagctggacgacggcagaagaggcctggtgcccagcaacttcgtggagcagatccccgacagctacatccccggctgcctgcccgccaagagccccgacctgggccccagccagctgcccgccggccaggacgaggccctggaggaggacagcctgctgagcggcaaggcccagggcatggtggacagaggcctgtgccagatggtgagagtgggcagcaagaccgaggtggccaccgagatcctggacaccaagaccgaggcctgccagctgggcctgctgcagagcatgggcaagcagggcctgagcagacccctgctgggcaccaagggcgtgctgagaatggcccccatgcagctgcacctgcagaacgtgaccgccaccagcgccaacatcacctgggtgtacagcagccacagacacccccacgtggtgtacctggacgacagagagcacgccctgacccccgccggcgtgagctgctacaccttccagggcctgtgccccggcacccactacagagtgagagtggaggtgagactgccctgggacctgctgcaggtgtactggggcaccatgagcagcaccgtgaccttcgacaccctgctggccggccccccctacccccccctggacgtgctggtggagagacacgccagccccggcgtgctggtggtgagctggctgcccgtgaccatcgacagcgccggcagcagcaacggcgtgcaggtgaccggctacgccgtgtacgccgacggcctgaaggtgtgcgaggtggccgacgccaccgccggcagcaccgtgctggagttcagccagctgcaggtgcccctgacctggcagaaggtgagcgtgagaaccatgagcctgtgcggcgagagcctggacagcgtgcccgcccagatccccgaggacttcttcatgtgccacagatggcccgagaccccccccttcagctacacctgcggcgaccccagcacctacagagtgaccttccccgtgtgcccccagaagctgagcctggccccccccagcgccaaggccagcccccacaaccccggcagctgcggcgagccccaggccaagttcctggaggccttcttcgaggagccccccagaagacagagccccgtgagcaacctgggcagcgagggcgagtgccccagcagcggcgccggcagccaggcccaggagctggccgaggcctgggagggctgcagaaaggacctgctgttccagaagagcccccagaaccacagaccccccagcgtgagcgaccagcccggcgagaaggagaactgctaccagcacatgggcaccagcaagagccccgcccccggcttcatccacctgagaaccgagtgcggccccagaaaggagccctgccaggagaaggccgccctggagagagtgctgagacagaagcaggacgcccagggcttcacccccccccagctgggcgccagccagcagtacgccagcgacttccacaacgtgctgaaggaggagcaggaggccctgtgcctggacctgagaggcaccgagagaagagaggagagaagagagcccgagccccacagcagacagggccaggccctgggcgtgaagagaggctgccagctgcacgagcccagcagcgccctgtgccccgcccccagcgccaaggtgatcaagatgcccagaggcggcccccagcagctgggcaccggcgccaacacccccgccagagtgttcgtggccctgagcgactacaaccccctggtgatgagcgccaacctgaaggccgccgaggaggagctggtgttccagaagagacagctgctgagagtgtggggcagccaggacacccacgacttctacctgagcgagtgcaacagacaggtgggcaacatccccggcagactggtggccgagatggaggtgggcaccgagcagaccgacagaagatggagaagccccgcccagggccacctgcccagcgtggcccacctggaggacttccagggcctgatcatcccccagggcagcagcctggtgctgcagggcaacagcaagagactgcccctgtggacccccaagatcatgatcgccgccctggactacgaccccggcgacggccagatgggcggccagggcaagggcagactggccctgagagccggcgacgtggtgatggtgtacggccccatggacgaccagggcttctactacggcgagctgggcggccacagaggcctggtgcccgcccacctgctggaccacatgagcctgcacggccactag

SEQ ID NO: 97602 - DNA, 3402 bp, Artificial Sequence
  Description of Artificial Sequence: Synthetic coding sequence
atgcccgtgcaggccccccagtggaccgacttcctgagctgccccatctgcacccagaccttcgacgagaccatcagaaagcccatcagcctgggctgcggccacaccgtgtgcaagatgtgcctgaacaagctgcacagaaaggcctgccccttcgaccagaccaccatcaacaccgacatcgagctgctgcccgtgaacagcgccctgctgcagctggtgggcgcccaggtgcccgagcagcagcccatcaccctgtgcagcggcgtggaggacaccaagcactacgaggaggccaagaagtgcgtggaggagctggccctgtacctgaagcccctgagcagcgccagaggcgtgggcctgaacagcaccacccagagcgtgctgagcagacccatgcagagaaagctggtgaccctggtgcactgccagctggtggaggaggagggcagaatcagagccatgagagccgccagaagcctgggcgagagaaccgtgaccgagctgatcctgcagcaccagaacccccagcagctgagcagcaacctgtgggccgccgtgagagccagaggctgccagttcctgggccccgccatgcaggaggaggccctgaagctggtgctgctggccctggaggacggcagcgccctgagcagaaaggtgctggtgctgttcgtggtgcagagactggagcccagattcccccaggccagcaagaccagcatcggccacgtggtgcagctgctgtacagagccagctgcttcaaggtgaccaagagagacgaggacagcagcctgatgcagctgaaggaggagttcagaacctacgaggccctgagaagagagcacgacagccagatcgtgcagatcgccatggaggccggcctgagaatcgcccccgaccagtggagcagcctgctgtacggcgaccagagccacaagagccacatgcagagcatcatcgacaagctgcagacccccgccagcttcgcccagagcgtgcaggagctgaccatcgccctgcagagaaccggcgaccccgccaacctgaacagactgagaccccacctggagctgctggccaacatcgaccccagccccgacgcccccccccccacctgggagcagctggagaacggcctggtggccgtgagaaccgtggtgcacggcctggtggactacatccagaaccacagcaagaagggcgccgaccagcagcagcccccccagcacagcaagtacaagacctacatgtgcagagacatgaagcagagaggcggctgccccagaggcgccagctgcaccttcgcccacagccaggaggagctggagaagttcagaaagatgaacaagagactggtgcccagaagacccctgagcgccagcctgggccagctgaacgaggtgggcctgcccagcgccgccatcctgcccgacgagggcgccgtggacctgcccagcagaaagccccccgccctgcccaacggcatcgtgagcaccggcaacaccgtgacccagctgatccccagaggcaccgaccccagctacgacagcagcctgaagcccggcaagatcgaccacctgagcagcagcgcccccggcagcccccccgacctgctggagagcgtgcccaagagcatcagcgccctgcccgtgaacccccacagcatcccccccagaggccccgccgacctgccccccatgcccgtgaccaagcccctgcagatggtgcccagaggcagccagctgtaccccgcccagcagaccgacgtgtactaccaggaccccagaggcgccgccccccccttcgagcccgccccctaccagcagggcatgtactacaccccccccccccagtgcgtgagcagattcgtgagacccccccccagcgcccccgagcccgcccccccctacctggaccactaccccccctacctgcaggagagagtggtgaacagccagtacggcacccagccccagcagtacccccccatctaccccagccactacgacggcagaagagtgtaccccgcccccagctacaccagagaggagatcttcagagagagccccatccccatcgagatcccccccgccgccgtgcccagctacgtgcccgagagcagagagagataccagcagatcgagagctactaccccgtggccccccaccccacccagatcagacccagctacctgagagagcccccctacagcagactgcccccccccccccagccccaccccagcctggacgagctgcacagaagaagaaaggagatcatggcccagctggaggagagaaaggtgatcagccccccccccttcgcccccagccccaccctgccccccaccttccaccccgaggagttcctggacgaggacctgaaggtggccggcaagtacaagggcaacgactacagccagtacagcccctggagctgcgacaccatcggcagctacatcggcaccaaggacgccaagcccaaggacgtggtggccgccggcagcgtggagatgatgaacgtggagagcaagggcatgagagaccagagactggacctgcagagaagagccgccgagaccagcgacgacgacctgatccccttcggcgacagacccaccgtgagcagattcggcgccatcagcagaaccagcaagaccatctaccagggcgccggccccatgcaggccatggccccccagggcgcccccaccaagagcatcaacatcagcgactacagcccctacggcacccacggcggctggggcgccagcccctacagcccccaccagaacatccccagccagggccacttcagcgagagagagagaatcagcatgagcgaggtggccagccacggcaagcccctgcccagcgccgagagagagcagctgagactggagctgcagcagctgaaccaccagatcagccagcagacccagctgagaggcctggaggccgtgagcaacagactggtgctgcagagagaggccaacaccctggccggccagagccagcccccccccccccccccccccaagtggcccggcatgatcagcagcgagcagctgagcctggagctgcaccaggtggagagagagatcggcaagagaaccagagagctgagcatggagaaccagtgcagcctggacatgaagagcaagctgaacaccagcaagcaggccgagaacggccagcccgagccccagaacaaggtgcccgccgaggacctgaccctgaccttcagcgacgtgcccaacggcagcgccctgacccaggagaacatcagcctgctgagcaacaagaccagcagcctgaacctgagcgaggaccccgagggcggcggcgacaacaacgacagccagagaagcggcgtgacccccagcagcgccccctag

SEQ ID NO: 97603 - DNA, 3378 bp, Artificial Sequence
  Description of Artificial Sequence: Synthetic coding sequence
atgcccgtgcaggccccccagtggaccgacttcctgagctgccccatctgcacccagaccttcgacgagaccatcagaaagcccatcagcctgggctgcggccacaccgtgtgcaagatgtgcctgaacaagctgcacagaaaggcctgccccttcgaccagaccaccatcaacaccgacatcgagctgctgcccgtgaacagcgccctgctgcagctggtgggcgcccaggtgcccgagcagcagcccatcaccctgtgcagcggcgtggaggacaccaagcactacgaggaggccaagaagtgcgtggaggagctggccctgtacctgaagcccctgagcagcgccagaggcgtgggcctgaacagcaccacccagagcgtgctgagcagacccatgcagagaaagctggtgaccctggtgcactgccagctggtggaggaggagggcagaatcagagccatgagagccgccagaagcctgggcgagagaaccgtgaccgagctgatcctgcagcaccagaacccccagcagctgagcagcaacctgtgggccgccgtgagagccagaggctgccagttcctgggccccgccatgcaggaggaggccctgaagctggtgctgctggccctggaggacggcagcgccctgagcagaaaggtgctggtgctgttcgtggtgcagagactggagcccagattcccccaggccagcaagaccagcatcggccacgtggtgcagctgctgtacagagccagctgcttcaaggtgaccaagagagacgaggacagcagcctgatgcagctgaaggaggagttcagaacctacgaggccctgagaagagagcacgacagccagatcgtgcagatcgccatggaggccggcctgagaatcgcccccgaccagtggagcagcctgctgtacggcgaccagagccacaagagccacatgcagagcatcatcgacaagctgcagacccccgccagcttcgcccagagcgtgcaggagctgaccatcgccctgcagagaaccggcgaccccgccaacctgaacagactgagaccccacctggagctgctggccaacatcgaccccagccccgacgcccccccccccacctgggagcagctggagaacggcctggtggccgtgagaaccgtggtgcacggcctggtggactacatccagaaccacagcaagaagggcgccgaccagcagcagcccccccagcacagcaagtacaagacctacatgtgcagagacatgaagcagagaggcggctgccccagaggcgccagctgcaccttcgcccacagccaggaggagctggagaagttcagaaagatgaacaagagactggtgcccagaagacccctgagcgccagcctgggccagctgaacgaggtgggcctgcccagcgccgccatcctgcccgacgagggcgccgtggacctgcccagcagaaagccccccgccctgcccaacggcatcgtgagcaccggcaacaccgtgacccagctgatccccagaggcaccgaccccagctacgacagcagcctgaagcccggcaagatcgaccacctgagcagcagcgcccccggcagcccccccgacctgctggagagcgtgcccaagagcatcagcgccctgcccgtgaacccccacagcatcccccccagaggccccgccgacctgccccccatgcccgtgaccaagcccctgcagatggtgcccagaggcagccagctgtaccccgcccagcagaccgacgtgtactaccaggaccccagaggcgccgccccccccttcgagcccgccccctaccagcagggcatgtactacaccccccccccccagtgcgtgagcagattcgtgagacccccccccagcgcccccgagcccgcccccccctacctggaccactaccccccctacctgcaggagagagtggtgaacagccagtacggcacccagccccagcagtacccccccatctaccccagccactacgacggcagaagagtgtaccccgcccccagctacaccagagaggagatcttcagagagagccccatccccatcgagatcccccccgccgccgtgcccagctacgtgcccgagagcagagagagataccagcagatcgagagctactaccccgtggccccccaccccacccagatcagacccagctacctgagagagcccccctacagcagactgcccccccccccccagccccaccccagcctggacgagctgcacagaagaagaaaggagatcatggcccagctggaggagagaaaggtgatcagccccccccccttcgcccccagccccaccctgccccccaccttccaccccgaggagttcctggacgaggacctgaaggtggccggcaagtacaagggcaacgactacagccagtacagcccctggagctgcgacaccatcggcagctacatcggcaccaaggacgccaagcccaaggacgtggtggccgccggcagcgtggagatgatgaacgtggagagcaagggcatgagagaccagagactggacctgcagagaagagccgccgagaccagcgacgacgacctgatccccttcggcgacagacccaccgtgagcagattcggcgccatcagcagaaccagcaagaccatctaccagggcgccggccccatgcaggccatggccccccagggcgcccccaccaagagcatcaacatcagcgactacagcccctacggcacccacggcggctggggcgccagcccctacagcccccaccagaacatccccagccagggccacttcagcgagagagagagaatcagcatgagcgaggtggccagccacggcaagcccctgcccagcgccgagagagagcagctgagactggagctgcagcagctgaaccaccagatcagccagcagacccagctgagaggcctggagagagaggccaacaccctggccggccagagccagcccccccccccccccccccccaagtggcccggcatgatcagcagcgagcagctgagcctggagctgcaccaggtggagagagagatcggcaagagaaccagagagctgagcatggagaaccagtgcagcctggacatgaagagcaagctgaacaccagcaagcaggccgagaacggccagcccgagccccagaacaaggtgcccgccgaggacctgaccctgaccttcagcagcgacgtgcccaacggcagcgccctgacccaggagaacatcagcctgctgagcaacaagaccagcagcctgaacctgagcgaggaccccgagggcggcggcgacaacaacgacagccagagaagcggcgtgacccccagcagcgccccctag

SEQ ID NO: 97604 - DNA, 3402 bp, Artificial Sequence; identical to SEQ ID NO: 97602
  Description of Artificial Sequence: Synthetic coding sequence

SEQ ID NO: 97605 - DNA, 984 bp, Artificial Sequence
  Description of Artificial Sequence: Synthetic coding sequence
atgtgggccacctgctgcaactggttctgcctggacggccagcccgaggaggtgccccccccccagggcgccagaatgcaggcctacagcaaccccggctacagcagcttccccagccccaccggcctggagcccagctgcaagagctgcggcgcccacttcgccaacaccgccagaaagcagacctgcctggactgcaagaagaacttctgcatgacctgcagcagccaggtgggcaacggccccagactgtgcctgctgtgccagagattcagagccaccgccttccagagagaggagctgatgaagatgaaggtgaaggacctgagagactacctgagcctgcacgacatcagcaccgagatgtgcagagagaaggaggagctggtgctgctggtgctgggccagcagcccgtgatcagccaggaggacagaaccagagccagcaccctgagccccgacttccccgagcagcaggccttcctgacccagccccacagcagcatggtgccccccaccagccccaacctgcccagcagcagcgcccaggccaccagcgtgccccccgcccaggtgcaggagaaccagcagagcatcgacagcgaggacagcttcgtgcccggcagaagagccagcctgagcgacctgaccgacctggaggacatcgagggcctgaccgtgagacagctgaaggagatcctggccagaaacttcgtgaactacaagggctgctgcgagaagtgggagctgatggagagagtgaccagactgtacaaggaccagaagggcctgcagcacctgggcggcgccgtgcccagcggcctggaggagaacctgtgcaagatctgcatggacagccccatcgactgcgtgctgctggagtgcggccacatggtgacctgcaccaagtgcggcaagagaatgaacgagtgccccatctgcagacagtacgtgatcagagccgtgcacgtgttcagaagctag

SEQ ID NO: 97606 - DNA, 1092 bp, Artificial Sequence
  Description of Artificial Sequence: Synthetic coding sequence
atgtgggccacctgctgcaactggttctgcctggacggccagcccgaggaggtgccccccccccagggcgccagaatgcaggcctacagcaaccccggctacagcagcttccccagccccaccggcctggagcccagctgcaagagctgcggcgcccacttcgccaacaccgccagaaagcagacctgcctggactgcaagaagaacttctgcatgacctgcagcagccaggtgggcaacggccccagactgtgcctgctgtgccagagattcagagccaccgccttccagagagaggagctgatgaagatgaaggtgaaggacctgagagactacctgagcctgcacgacatcagcaccgagatgtgcagagagaaggaggagctggtgctgctggtgctgggccagcagcccgtgatcagccaggaggacagaaccagagccagcaccctgagccccgacttccccgagcagcaggccttcctgacccagccccacagcagcatggtgccccccaccagccccaacctgcccagcagcagcgcccaggccaccagcgtgccccccgcccaggtgcaggagaaccagcaggccaacggccacgtgagccaggaccaggaggagcccgtgtacctggagagcgtggccagagtgcccgccgaggacgagacccagagcatcgacagcgaggacagcttcgtgcccggcagaagagccagcctgagcgacctgaccgacctggaggacatcgagggcctgaccgtgagacagctgaaggagatcctggccagaaacttcgtgaactacaagggctgctgcgagaagtgggagctgatggagagagtgaccagactgtacaaggaccagaagggcctgcagcacctggtgagcggcgccgaggaccagaacggcggcgccgtgcccagcggcctggaggagaacctgtgcaagatctgcatggacagccccatcgactgcgtgctgctggagtgcggccacatggtgacctgcaccaagtgcggcaagagaatgaacgagtgccccatctgcagacagtacgtgatcagagccgtgcacgtgttcagaagctag

SEQ ID NO: 97607 - DNA, 1068 bp, Artificial Sequence
  Description of Artificial Sequence: Synthetic coding sequence
atgtgggccacctgctgcaactggttctgcctggacggccagcccgaggaggtgccccccccccagggcgccagaatgcaggcctacagcaaccccggctacagcagcttccccagccccaccggcctggagcccagctgcaagagctgcggcgcccacttcgccaacaccgccagaaagcagacctgcctggactgcaagaagaacttctgcatgacctgcagcagccaggtgggcaacggccccagactgtgcctgctgtgccagagattcagagccaccgccttccagagagaggagctgatgaagatgaaggtgaaggacctgagagactacctgagcctgcacgacatcagcaccgagatgtgcagagagaaggaggagctggtgctgctggtgctgggccagcagcccgtgatcagccaggaggacagaaccagagccagcaccctgagccccgacttccccgagcagcaggccttcctgacccagccccacagcagcatggtgccccccaccagccccaacctgcccagcagcagcgcccaggccaccagcgtgccccccgcccaggtgcaggagaaccagcaggccaacggccacgtgagccaggaccaggaggagcccgtgtacctggagagcgtggccagagtgcccgccgaggacgagacccagagcatcgacagcgaggacagcttcgtgcccggcagaagagccagcctgagcgacctgaccgacctggaggacatcgagggcctgaccgtgagacagctgaaggagatcctggccagaaacttcgtgaactacaagggctgctgcgagaagtgggagctgatggagagagtgaccagactgtacaaggaccagaagggcctgcagcacctgggcggcgccgtgcccagcggcctggaggagaacctgtgcaagatctgcatggacagccccatcgactgcgtgctgctggagtgcggccacatggtgacctgcaccaagtgcggcaagagaatgaacgagtgccccatctgcagacagtacgtgatcagagccgtgcacgtgttcagaagctag

SEQ ID NO: 97608 - DNA, 1092 bp, Artificial Sequence; identical to SEQ ID NO: 97606
  Description of Artificial Sequence: Synthetic coding sequence

SEQ ID NO: 97609 - DNA, 816 bp, Artificial Sequence
  Description of Artificial Sequence: Synthetic coding sequence
atgtgggccacctgctgcaactggttctgcctggacggccagcccgaggaggtgccccccccccagggcgccagaatgcaggcctacagcaaccccggctacagcagcttccccagccccaccggcctggagcccagctgcaagagctgcggcgcccacttcgccaacaccgccagaaagcagacctgcctggactgcaagaagaacttctgcatgacctgcagcagccaggtgggcaacggccccagactgtgcctgctgtgccagagattcagagccaccgccttccagagagaggagctgatgaagatgaaggtgaaggacctgagagactacctgagcctgcacgacatcagcaccgagatgtgcagagagaaggaggagctggtgctgctggtgctgggccagcagcccgtgatcagccaggaggacagaaccagagccagcaccctgagccccgacttccccgagcagcaggccttcctgacccagccccacagcagcatggtgccccccaccagccccaacctgcccagcagcagcgcccaggccaccagcgtgccccccgcccaggtgcaggagaaccagcaggccaacggccacgtgagccaggaccaggaggagcccgtgtacctggagagcgtggccagagtgcccgccgaggacgagacccagagcatcgacagcgaggacagcttcgtgcccggcagaagagccagcctgagcgacctgaccgacctggaggacatcgagggcctgaccgtgagacagctgaaggagatcctggccagaaacttcgtgaactacaagggctag

SEQ ID NO: 97610 - DNA, 402 bp, Artificial Sequence
  Description of Artificial Sequence: Synthetic coding sequence
atgtgggccacctgctgcaactggttctgcctggacggccagcccgaggaggtgccccccccccagggcgccagaatgcaggcctacagcaaccccggctacagcagcttccccagccccaccggcctggagcccagctgcaagagctgcggcgcccacttcgccaacaccgccagaaagcagacctgcctggactgcaagaagaacttctgcatgacctgcagcagccaggtgggcaacggccccagactgtgcctgctgtgccagagattcagagccaccgccttccagagagaggagctgatgaagatgaaggtgaaggacctgagagactacctgagcctgcacgacatcagcaccgagatgtgcagagagaaggaggagctggtgctgctggtgtag

SEQ ID NO: 97611 - DNA, 570 bp, Artificial Sequence
  Description of Artificial Sequence: Synthetic coding sequence
atgtgggccacctgctgcaactggttctgcctggacggccagcccgaggaggtgccccccccccagggcgccagaatgcaggcctacagcaaccccggctacagcagcttccccagccccaccggcctggagcccagctgcaagagctgcggcgcccacttcgccaacaccgccagaaagcagacctgcctggactgcaagaagaacttctgcatgacctgcagcagccaggtgggcaacggccccagactgtgcctgctgtgccagagattcagagccaccgccttccagagagaggagctgatgaagatgaaggtgaaggacctgagagactacctgagcctgcacgacatcagcaccgagatgtgcagagagaaggaggagctggtgctgctggtgctgggccagcagcccgtgatcagccaggaggacagaaccagagccagcaccctgagccccgacttccccgagcagcaggccttcctgacccagccccacagcagcatggtgccccccaccagccccaacctgcccagcagcagcgcccaggccaccagcgtgcccccctag

SEQ ID NO: 97612 - DNA, 138 bp, Artificial Sequence
  Description of Artificial Sequence: Synthetic coding sequence
atgtgggccacctgctgcaactggttctgcctggacggccagcccgaggaggtgccccccccccagggcgccagaatgcaggcctacagcaaccccggctacagcagcttccccagccccaccggcctggagccctag

SEQ ID NO: 97613 - DNA, 2124 bp, Artificial Sequence
  Description of Artificial Sequence: Synthetic coding sequence
atgagcggcagcagacaggccggcagcggcagcgccggcaccagccccggcagcagcgccgccagcagcgtgaccagcgccagcagcagcctgagcagcagccccagcccccccagcgtggccgtgagcgccgccgccctggtgagcggcggcgtggcccaggccgccggcagcggcggcctgggcggccccgtgagacccgtgctggtggcccccgccgtgagcggcagcggcggcggcgccgtgagcaccggcctgagcagacacagctgcgccgccagacccagcgccggcgtgggcggcagcagcagcagcctgggcagcggcagcagaaagagacccctgctggcccccctgtgcaacggcctgatcaacagctacgaggacaagagcaacgacttcgtgtgccccatctgcttcgacatgatcgaggaggcctacatgaccaagtgcggccacagcttctgctacaagtgcatccaccagagcctggaggacaacaacagatgccccaagtgcaactacgtggtggacaacatcgaccacctgtaccccaacttcctggtgaacgagctgatcctgaagcagaagcagagattcgaggagaagagattcaagctggaccacagcaacggccacagatggcagatcttccaggactggctgggcaccgaccaggacaacctggacctggccaacgtgaacctgatgctggagctgctggtgcagaagaagaagcagctggaggccgagagccacgccgcccagctgcagatcctgatggagttcctgaaggtggccagaagaaacaagagagaggagatgagcggcctgtacagccccgtgagcgaggacagcaccgtgccccagttcgaggcccccagccccagccacagcagcatcatcgacagcaccgagtacagccagccccccggcttcagcggcagcagccagaccaagaagcagccctggtacaacagcaccctggccagcagaagaaagagactgaccgcccacttcgaggacctggagcagtgctacttcagcaccagaatgagcagaatcagcgacgacagcagaaccgccagccagctggacgagttccaggagtgcctgagcaagttcaccagatacaacagcgtgagacccctggccaccctgagctacgccagcgacctgtacaacggcagcagcatcgtgagcagcatcgagttcgacagagactgcgactacttcgccatcgccggcgtgaccaagaagatcaaggtgtacgagtacgacaccgtgatccaggacgccgtggacatccactaccccgagaacgagatgacctgcaacagcaagatcagctgcatcagctggagcagctaccacaagaacctgctggccagcagcgactacgagggcaccgtgatcctgtgggacggcttcaccggccagagaagcaaggtgtaccaggagcacgagaagagatgctggagcgtggacttcaacctgatggaccccaagctgctggccagcggcagcgacgacgccaaggtgaagctgtggagcaccaacctggacaacagcgtggccagcatcgaggccaaggccaacgtgtgctgcgtgaagttcagccccagcagcagataccacctggccttcggctgcgccgaccactgcgtgcactactacgacctgagaaacaccaagcagcccatcatggtgttcaagggccacagaaaggccgtgagctacgccaagttcgtgagcggcgaggagatcgtgagcgccagcaccgacagccagctgaagctgtggaacgtgggcaagccctactgcctgagaagcttcaagggccacatcaacgagaagaacttcgtgggcctggccagcaacggcgactacatcgcctgcggcagcgagaacaacagcctgtacctgtactacaagggcctgagcaagaccctgctgaccttcaagttcgacaccgtgaagagcgtgctggacaaggacagaaaggaggacgacaccaacgagttcgtgagcgccgtgtgctggagagccctgcccgacggcgagagcaacgtgctgatcgccgccaacagccagggcaccatcaaggtgctggagctggtgtag

SEQ ID NO: 97614 - DNA, 1521 bp, Artificial Sequence
  Description of Artificial Sequence: Synthetic coding sequence
atggagttcctgaaggtggccagaagaaacaagagagagcagctggagcagatccagaaggagctgagcgtgctggaggaggacatcaagagagtggaggagatgagcggcctgtacagccccgtgagcgaggacagcaccgtgccccagttcgaggcccccagccccagccacagcagcatcatcgacagcaccgagtacagccagccccccggcttcagcggcagcagccaggccggcgtgcagtggagatacctgggcagcctgcagccccccccccccagatacaagagattcagctgcctgaccctgcccagcagctgggactacagaagactgcccccccacctgaccaagaagcagccctggtacaacagcaccctggccagcagaagaaagagactgaccgcccacttcgaggacctggagcagtgctacttcagcaccagaatgagcagaatcagcgacgacagcagaaccgccagccagctggacgagttccaggagtgcctgagcaagttcaccagatacaacagcgtgagacccctggccaccctgagctacgccagcgacctgtacaacggcagcagcatcgtgagcagcatcgagttcgacagagactgcgactacttcgccatcgccggcgtgaccaagaagatcaaggtgtacgagtacgacaccgtgatccaggacgccgtggacatccactaccccgagaacgagatgacctgcaacagcaagatcagctgcatcagctggagcagctaccacaagaacctgctggccagcagcgactacgagggcaccgtgatcctgtgggacggcttcaccggccagagaagcaaggtgtaccaggagcacgagaagagatgctggagcgtggacttcaacctgatggaccccaagctgctggccagcggcagcgacgacgccaaggtgaagctgtggagcaccaacctggacaacagcgtggccagcatcgaggccaaggccaacgtgtgctgcgtgaagttcagccccagcagcagataccacctggccttcggctgcgccgaccactgcgtgcactactacgacctgagaaacaccaagcagcccatcatggtgttcaagggccacagaaaggccgtgagctacgccaagttcgtgagcggcgaggagatcgtgagcgccagcaccgacagccagctgaagctgtggaacgtgggcaagccctactgcctgagaagcttcaagggccacatcaacgagaagaacttcgtgggcctggccagcaacggcgactacatcgcctgcggcagcgagaacaacagcctgtacctgtactacaagggcctgagcaagaccctgctgaccttcaagttcgacaccgtgaagagcgtgctggacaaggacagaaaggaggacgacaccaacgagttcgtgagcgccgtgtgctggagagccctgcccgacggcgagagcaacgtgctgatcgccgccaacagccagggcaccatcaaggtgctggccctgctgtag

SEQ ID NO: 97615 - DNA, 2196 bp, Artificial Sequence
  Description of Artificial Sequence: Synthetic coding sequence
atgagcggcagcagacaggccggcagcggcagcgccggcaccagccccggcagcagcgccgccagcagcgtgaccagcgccagcagcagcctgagcagcagccccagcccccccagcgtggccgtgagcgccgccgccctggtgagcggcggcgtggcccaggccgccggcagcggcggcctgggcggccccgtgagacccgtgctggtggcccccgccgtgagcggcagcggcggcggcgccgtgagcaccggcctgagcagacacagctgcgccgccagacccagcgccggcgtgggcggcagcagcagcagcctgggcagcggcagcagaaagagacccctgctggcccccctgtgcaacggcctgatcaacagctacgaggacaagagcaacgacttcgtgtgccccatctgcttcgacatgatcgaggaggcctacatgaccaagtgcggccacagcttctgctacaagtgcatccaccagagcctggaggacaacaacagatgccccaagtgcaactacgtggtggacaacatcgaccacctgtaccccaacttcctggtgaacgagctgatcctgaagcagaagcagagattcgaggagaagagattcaagctggaccacagcgtgagcagcaccaacggccacagatggcagatcttccaggactggctgggcaccgaccaggacaacctggacctggccaacgtgaacctgatgctggagctgctggtgcagaagaagaagcagctggaggccgagagccacgccgcccagctgcagatcctgatggagttcctgaaggtggccagaagaaacaagagagagcagctggagcagatccagaaggagctgagcgtgctggaggaggacatcaagagagtggaggagatgagcggcctgtacagccccgtgagcgaggacagcaccgtgccccagttcgaggcccccagccccagccacagcagcatcatcgacagcaccgagtacagccagccccccggcttcagcggcagcagccagaccaagaagcagccctggtacaacagcaccctggccagcagaagaaagagactgaccgcccacttcgaggacctggagcagtgctacttcagcaccagaatgagcagaatcagcgacgacagcagaaccgccagccagctggacgagttccaggagtgcctgagcaagttcaccagatacaacagcgtgagacccctggccaccctgagctacgccagcgacctgtacaacggcagcagcatcgtgagcagcatcgagttcgacagagactgcgactacttcgccatcgccggcgtgaccaagaagatcaaggtgtacgagtacgacaccgtgatccaggacgccgtggacatccactaccccgagaacgagatgacctgcaacagcaagatcagctgcatcagctggagcagctaccacaagaacctgctggccagcagcgactacgagggcaccgtgatcctgtgggacggcttcaccggccagagaagcaaggtgtaccaggagcacgagaagagatgctggagcgtggacttcaacctgatggaccccaagctgctggccagcggcagcgacgacgccaaggtgaagctgtggagcaccaacctggacaacagcgtggccagcatcgaggccaaggccaacgtgtgctgcgtgaagttcagccccagcagcagataccacctggccttcggctgcgccgaccactgcgtgcactactacgacctgagaaacaccaagcagcccatcatggtgttcaagggccacagaaaggccgtgagctacgccaagttcgtgagcggcgaggagatcgtgagcgccagcaccgacagccagctgaagctgtggaacgtgggcaagccctactgcctgagaagcttcaagggccacatcaacgagaagaacttcgtgggcctggccagcaacggcgactacatcgcctgcggcagcgagaacaacagcctgtacctgtactacaagggcctgagcaagaccctgctgaccttcaagttcgacaccgtgaagagcgtgctggacaaggacagaaaggaggacgacaccaacgagttcgtgagcgccgtgtgctggagagccctgcccgacggcgagagcaacgtgctgatcgccgccaacagccagggcaccatcaaggtgctggagctggtgtag

SEQ ID NO: 97616 - DNA, 774 bp, Artificial Sequence
  Description of Artificial Sequence: Synthetic coding sequence
atgagcggcagcagacaggccggcagcggcagcgccggcaccagccccggcagcagcgccgccagcagcgtgaccagcgccagcagcagcctgagcagcagccccagcccccccagcgtggccgtgagcgccgccgccctggtgagcggcggcgtggcccaggccgccggcagcggcggcctgggcggccccgtgagacccgtgctggtggcccccgccgtgagcggcagcggcggcggcgccgtgagcaccggcctgagcagacacagctgcgccgccagacccagcgccggcgtgggcggcagcagcagcagcctgggcagcggcagcagaaagagacccctgctggcccccctgtgcaacggcctgatcaacagctacgaggacaagagcaacgacttcgtgtgccccatctgcttcgacatgatcgaggaggcctacatgaccaagtgcggccacagcttctgctacaagtgcatccaccagagcctggaggacaacaacagatgccccaagtgcaactacgtggtggacaacatcgaccacctgtaccccaacttcctggtgaacgagctgatcctgaagcagaagcagagattcgaggagaagagattcaagctggaccacagcgtgagcagcaccaacggccacagatggcagatcttccaggactggctgggcaccgaccaggacaacctggacctggccaacgtgaacctgatgctggagctgctggtgcagaagaacaagaagaagaagaagaagaagaagtag

SEQ ID NO: 97617 - DNA, 2325 bp, Artificial Sequence
  Description of Artificial Sequence: Synthetic coding sequence
atggcccacgaggccatggagtacgacgtgcaggtgcagctgaaccacgccgagcagcagcccgcccccgccggcatggccagcagccagggcggccccgccctgctgcagcccgtgcccgccgacgtggtgagcagccagggcgtgcccagcatcctgcagcccgcccccgccgaggtgatcagcagccaggccaccccccccctgctgcagcccgccccccagctgagcgtggacctgaccgaggtggaggtgctgggcgaggacaccgtggagaacatcaaccccagaaccagcgagcagcacagacagggcagcgacggcaaccacaccatccccgccagcagcctgcacagcatgaccaacttcatcagcggcctgcagagactgcacggcatgctggagttcctgagacccagcagcagcaaccacagcgtgggccccatgagaaccagaagaagagtgagcgccagcagaagagccagagccggcggcagccagagaaccgacagcgccagactgagagcccccctggacgcctacttccaggtgagcagaacccagcccgacctgcccgccaccacctacgacagcgagaccagaaaccccgtgagcgaggagctgcaggtgagcagcagcagcgacagcgacagcgacagcagcgccgagtacggcggcgtggtggaccaggccgaggagagcggcgccgtgatcctggaggagcagctggccggcgtgagcgccgagcaggaggtgacctgcatcgacggcggcaagaccctgcccaagcagcccagcccccagaagagcgagcccctgctgcccagcgccagcatggacgaggaggagggcgacacctgcaccatctgcctggagcagtggaccaacgccggcgaccacagactgagcgccctgagatgcggccacctgttcggctacagatgcatcagcacctggctgaagggccaggtgagaaagtgcccccagtgcaacaagaaggccagacacagcgacatcgtggtgctgtacgccagaaccctgagagccctggacaccagcgagcaggagagaatgaagagcagcctgctgaaggagcagatgctgagaaagcaggccgagctggagagcgcccagtgcagactgcagctgcaggtgctgaccgacaagtgcaccagactgcagagaagagtgcaggacctgcagaagctgaccagccaccagagccagaacctgcagcagcccagaggcagccaggcctgggtgctgagctgcagccccagcagccagggccagcacaagcacaagtaccacttccagaagaccttcaccgtgagccaggccggcaactgcagaatcatggcctactgcgacgccctgagctgcctggtgatcagccagcccagcccccaggccagcttcctgcccggcttcggcgtgaagatgctgagcaccgccaacatgaagagcagccagtacatccccatgcacggcaagcagatcagaggcctggccttcagcagctacctgagaggcctgctgctgagcgccagcctggacaacaccatcaagctgaccagcctggagaccaacaccgtggtgcagacctacaacgccggcagacccgtgtggagctgctgctggtgcctggacgaggccaactacatctacgccggcctggccaacggcagcatcctggtgtacgacgtgagaaacaccagcagccacgtgcaggagctggtggcccagaaggccagatgccccctggtgagcctgagctacatgcccagagccgccagcgccgccttcccctacggcggcgtgctggccggcaccctggaggacgccagcttctgggagcagaagatggacttcagccactggccccacgtgctgcccctggagcccggcggctgcatcgacttccagaccgagaacagcagcagacactgcctggtgacctacagacccgacaagaaccacaccaccatcagaagcgtgctgatggagatgagctacagactggacgacaccggcaaccccatctgcagctgccagcccgtgcacaccttcttcggcggccccacctgcaagctgctgaccaagaacgccatcttccagagccccgagaacgacggcaacatcctggtgtgcaccggcgacgaggccgccaacagcgccctgctgtgggacgccgccagcggcagcctgctgcaggacctgcagaccgaccagcccgtgctggacatctgccccttcgaggtgaacagaaacagctacctggccaccctgaccgagaagatggtgcacatctacaagtgggagtag

SEQ ID NO: 97618 - DNA, 792 bp, Artificial Sequence
  Description of Artificial Sequence: Synthetic coding sequence
atggcccacgaggccatggagtacgacgtgcaggtgcagctgaaccacgccgagcagcagcccgcccccgccggcatggccagcagccagggcggccccgccctgctgcagcccgtgcccgccgacgtggtgagcagccagggcgtgcccagcatcctgcagcccgcccccgccgaggtgatcagcagccaggccaccccccccctgctgcagcccgccccccagctgagcgtggacctgaccgaggtggaggtgctgggcgaggacaccgtggagaacatcaaccccagaaccagcgagcagcacagacagggcagcgacggcaaccacaccatccccgccagcagcctgcacagcatgcccctggagcccggcggctgcatcgacttccagaccgagaacagcagcagacactgcctggtgacctacagacccgacaagaaccacaccaccatcagaagcgtgctgatggagatgagctacagactggacgacaccggcaaccccatctgcagctgccagcccgtgcacaccttcttcggcggccccacctgcaagctgctgaccaagaacgccatcttccagagccccgagaacgacggcaacatcctggtgtgcaccggcgacgaggccgccaacagcgccctgctgtgggacgccgccagcggcagcctgctgcaggacctgcagaccgaccagcccgtgctggacatctgccccttcgaggtgaacagaaacagctacctggccaccctgaccgagaagatggtgcacatctacaagtgggagtag

SEQ ID NO: 97619 - DNA, 2058 bp, Artificial Sequence
  Description of Artificial Sequence: Synthetic coding sequence
atgaaccagagcagaagcagaagcgacggcggcagcgaggagaccctgccccaggaccacaaccaccacgagaacgagagaagatggcagcaggagagactgcacagagaggaggcctactaccagttcatcaacgagctgaacgacgaggactacagactgatgagagaccacaacctgctgggcacccccggcgagatcaccagcgaggagctgcagcagagactggacggcgtgaaggagcagctggccagccagcccgacctgagagacggcaccaactacagagacagcgaggtgcccagagagagcagccacgaggacagcctgctggagtggctgaacaccttcagaagaaccggcaacgccaccagaagcggccagaacggcaaccagacctggagagccgtgagcagaaccaaccccaacaacggcgagttcagattcagcctggagatccacgtgaaccacgagaacagaggcttcgagatccacggcgaggactacaccgacatccccctgagcgacagcaacagagaccacaccgccaacagacagcagagaagcaccagccccgtggccagaagaaccagaagccagaccagcgtgaacttcaacggcagcagcagcaacatccccagaaccagactggccagcagaggccagaaccccgccgagggcagcttcagcaccctgggcagactgagaaacggcatcggcggcgccgccggcatccccagagccaacgccagcagaaccaacttcagcagccacaccaaccagagcggcggcagcgagctgagacagagagagggccagagattcggcgccgcccacgtgtgggagaacggcgccagaagcaacgtgaccgtgagaaacaccaaccagagactggagcccatcagactgagaagcaccagcaacagcagaagcagaagccccatccagagacagagcggcaccgtgtaccacaacagccagagagagagcagacccgtgcagcagaccaccagaagaagcgtgagaagaagaggcagaaccagagtgttcctggagcaggacagagagagagagagaagaggcaccgcctacacccccttcagcaacagcagactggtgagcagaatcaccgtggaggagggcgaggagagcagcagaagcagcaccgccgtgagaagacaccccaccatcaccctggacctgcaggtgagaagaatcagacccggcgagaacagagacagagacagcatcgccaacagaaccagaagcagagtgggcctggccgagaacaccgtgaccatcgagagcaacagcggcggcttcagaagaaccatcagcagactggagagaagcggcatcagaacctacgtgagcaccatcaccgtgcccctgagaagaatcagcgagaacgagctggtggagcccagcagcgtggccctgagaagcatcctgagacagatcatgaccggcttcggcgagctgagcagcctgatggaggccgacagcgagagcgagctgcagagaaacggccagcacctgcccgacatgcacagcgagctgagcaacctgggcaccgacaacaacagaagccagcacagagagggcagcagccaggacagacaggcccagggcgacagcaccgagatgcacggcgagaacgagaccacccagccccacaccagaaacagcgacagcagaggcggcagacagctgagaaaccccaacaacctggtggagaccggcaccctgcccatcctgagactggcccacttcttcctgctgaacgagagcgacgacgacgacagaatcagaggcctgaccaaggagcagatcgacaacctgagcaccagacactacgagcacaacagcatcgacagcgagctgggcaagatctgcagcgtgtgcatcagcgactacgtgaccggcaacaagctgagacagctgccctgcatgcacgagttccacatccactgcatcgacagatggctgagcgagaactgcacctgccccatctgcagacagcccgtgctgggcagcaacatcgccaacaacggctag

SEQ ID NO: 97620 - DNA, 2058 bp, Artificial Sequence; identical to SEQ ID NO: 97619
  Description of Artificial Sequence: Synthetic coding sequence

SEQ ID NO: 97621 - DNA, 2058 bp, Artificial Sequence; identical to SEQ ID NO: 97619
  Description of Artificial Sequence: Synthetic coding sequence

SEQ ID NO: 97622 - DNA, 990 bp, Artificial Sequence
  Description of Artificial Sequence: Synthetic coding sequence
atgcagctggaggtggacaagatgggcaccaagctgggcgagctgctggtgagcagaatcaccgtggaggagggcgaggagagcagcagaagcagcaccgccgtgagaagacaccccaccatcaccctggacctgcaggtgagaagaatcagacccggcgagaacagagacagagacagcatcgccaacagaaccagaagcagagtgggcctggccgagaacaccgtgaccatcgagagcaacagcggcggcttcagaagaaccatcagcagactggagagaagcggcatcagaacctacgtgagcaccatcaccgtgcccctgagaagaatcagcgagaacgagctggtggagcccagcagcgtggccctgagaagcatcctgagacagatcatgaccggcttcggcgagctgagcagcctgatggaggccgacagcgagagcgagctgcagagaaacggccagcacctgcccgacatgcacagcgagctgagcaacctgggcaccgacaacaacagaagccagcacagagagggcagcagccaggacagacaggcccagggcgacagcaccgagatgcacggcgagaacgagaccacccagccccacaccagaaacagcgacagcagaggcggcagacagctgagaaaccccaacaacctggtggagaccggcaccctgcccatcctgagactggcccacttcttcctgctgaacgagagcgacgacgacgacagaatcagaggcctgaccaaggagcagatcgacaacctgagcaccagacactacgagcacaacagcatcgacagcgagctgggcaagatctgcagcgtgtgcatcagcgactacgtgaccggcaacaagctgagacagctgccctgcatgcacgagttccacatccactgcatcgacagatggctgagcgagaactgcacctgccccatctgcagacagcccgtgctgggcagcaacatcgccaacaacggctag

SEQ ID NO: 97623 - DNA, 1221 bp, Artificial Sequence
  Description of Artificial Sequence: Synthetic coding sequence
atgaccacccccgccaacgcccagaacgccagcaagacctgggagctgagcctgtacgagctgcacagaaccccccaggaggccatcatggacggcaccgagatcgccgtgagccccagaagcctgcacagcgagctgatgtgccccatctgcctggacatgctgaagaacaccatgaccaccaaggagtgcctgcacagattctgcagcgactgcatcgtgaccgccctgagaagcggcaacaaggagtgccccacctgcagaaagaagctggtgagcaagagaagcctgagacccgaccccaacttcgacgccctgatcagcaagatctaccccagcagagaggagtacgaggcccaccaggacagagtgctgatcagactgagcagactgcacaaccagcaggccctgagcagcagcatcgaggagggcctgagaatgcaggccatgcacagagcccagagagtgagaagacccatccccggcagcgaccagaccaccaccatgagcggcggcgagggcgagcccggcgagggcgagggcgacggcgaggacgtgagcagcgacagcgcccccgacagcgcccccggccccgcccccaagagacccagaggcggcggcgccggcggcagcagcgtgggcaccggcggcggcggcaccggcggcgtgggcggcggcgccggcagcgaggacagcggcgacagaggcggcaccctgggcggcggcaccctgggcccccccagcccccccggcgcccccagcccccccgagcccggcggcgagatcgagctggtgttcagaccccaccccctgctggtggagaagggcgagtactgccagaccagatacgtgaagaccaccggcaacgccaccgtggaccacctgagcaagtacctggccctgagaatcgccctggagagaagacagcagcaggaggccggcgagcccggcggccccggcggcggcgccagcgacaccggcggccccgacggctgcggcggcgagggcggcggcgccggcggcggcgacggccccgaggagcccgccctgcccagcctggagggcgtgagcgagaagcagtacaccatctacatcgcccccggcggcggcgccttcaccaccctgaacggcagcctgaccctggagctggtgaacgagaagttctggaaggtgagcagacccctggagctgtgctacgcccccaccaaggaccccaagtag

SEQ ID NO: 97624 - DNA, 1221 bp, Artificial Sequence; identical to SEQ ID NO: 97623
  Description of Artificial Sequence: Synthetic coding sequence

SEQ ID NO: 97625 - DNA, 1221 bp, Artificial Sequence; identical to SEQ ID NO: 97623
  Description of Artificial Sequence: Synthetic coding sequence

SEQ ID NO: 97626 - DNA, 1221 bp, Artificial Sequence; identical to SEQ ID NO: 97623
  Description of Artificial Sequence: Synthetic coding sequence

SEQ ID NO: 97627 - DNA, 1221 bp, Artificial Sequence; identical to SEQ ID NO: 97623
  Description of Artificial Sequence: Synthetic coding sequence

SEQ ID NO: 97628 - DNA, 1221 bp, Artificial Sequence; identical to SEQ ID NO: 97623
  Description of Artificial Sequence: Synthetic coding sequence

SEQ ID NO: 97629 - DNA, 465 bp, Artificial Sequence
  Description of Artificial Sequence: Synthetic coding sequence
atgggcaactgcctgaagagccccaccagcgacgacatcagcctgctgcacgagagccagagcgacagagccagcttcggcgagggcaccgagcccgaccaggagcccccccccccctaccaggagcaggtgcccgtgcccgtgtaccaccccacccccagccagaccagactggccacccagctgaccgaggaggagcagatcagaatcgcccagagaatcggcctgatccagcacctgcccaagggcgtgtacgaccccggcagagacggcagcgagaagaagatcagagagtgcgtgatctgcatgatggacttcgtgtacggcgaccccatcagattcctgccctgcatgcacatctaccacctggactgcatcgacgactggctgatgagaagcttcacctgccccagctgcatggagcccgtggacgccgccctgctgagcagctacgagaccaactag

SEQ ID NO: 97630 - DNA, 1896 bp, Artificial Sequence
  Description of Artificial Sequence: Synthetic coding sequence
atgcccagacccgccctgagcgtgaccagcttctgccacagactgggcaagagagagagaaagcagagcttcatgggcaacagcggcaacagctggagccacacccccttccccaagctggagctgggcctgggcccccagcccatggcccccagagagctgcccacctgcagcatctgcctggagagactgagagaccccatcagcctggactgcggccacgacttctgcatcagatgcttcagcacccacagactgcccggctgcgagcccccctgctgccccgagtgcagaaagatctgcaagcagaagagaggcctgagaagcctgggcgagaagatgaagctgctgccccagagacccctgccccccgccctgcaggagacctgccccgtgagagccgagcccctgctgctggtgagaatcaacgccagcggcggcctgatcctgagaatgggcgccatcaacagatgcctgaagcaccccctggccagagacacccccgtgtgcctgctggccgtgctgggcgagcagcacagcggcaagagcttcctgctgaaccacctgctgcagggcctgcccggcctggagagcggcgagggcggcagacccagaggcggcgaggccagcctgcagggctgcagatggggcgccaacggcctggccagaggcatctggatgtggagccaccccttcctgctgggcaaggagggcaagaaggtggccgtgttcctggtggacaccggcgacgccatgagccccgagctgagcagagagaccagaatcaagctgtgcgccctgaccaccatgctgagcagctaccagatcctgagcaccagccaggagctgaaggacaccgacctggactacctggagatgttcgtgcacgtggccgaggtgatgggcaagcactacggcatggtgcccatccagcacctggacctgctggtgagagacagcagccaccccaacaaggccggccagggccacgtgggcaacatcttccagagactgagcggcagataccccaaggtgcaggagctgctgcagggcaagagagccagatgctgcctgctgcccgcccccggcagaagaagaatgaaccagggccacgccagccccggcgacaccgacgacgacttcagacacctgctgggcgcctacgtgagcgacgtgctgagcgccgccccccagcacgccaagagcagatgccagggctactggaacgagggcagagccgtggccagaggcgacagaagactgctgaccggccagcagctggcccaggagatcaagaacctgagcggctggatgggcagaaccggccccggcttcaccagccccgacgagatggccgcccagctgcacgacctgagaaaggtggaggccgccaagagagagttcgaggagtacgtgagacagcaggacgtggccaccaagagaatcttcagcgccctgagagtgctgcccgacaccatgagaaacctgctgagcacccagaaggacgccatcctggccagacacggcgtggccctgctgtgcaagggcagagaccagaccctggaggccctggaggccgagctgcaggccaccgccaaggccttcatggacagctacaccatgagattctgcggccacctggccgccgtgggcggcgccgtgggcgccggcctgatgggcctggccggcggcgtggtgggcgccggcatggccgccgccgccctggccgccgaggccggcatggtggccgccggcgccgccgtgggcgccaccggcgccgccgtggtgggcggcggcgtgggcgccggcctggccgccaccgtgggctgcatggagaaggaggaggacgagagactgctggagggcgacagagagcccctgctgcaggaggagtag

SEQ ID NO: 97631 - DNA, 687 bp, Artificial Sequence
  Description of Artificial Sequence: Synthetic coding sequence
atggccgcccagcagagagactgcggcggcgccgcccagctggccggccccgccgccgaggccgaccccctgggcagattcacctgccccgtgtgcctggaggtgtacgagaagcccgtgcaggtgccctgcggccacgtgttctgcagcgcctgcctgcaggagtgcctgaagcccaagaagcccgtgtgcggcgtgtgcagaagcgccctggcccccggcgtgagagccgtggagctggagagacagatcgagagcaccgagaccagctgccacggctgcagaaagaacttcttcctgagcaagatcagaagccacgtggccacctgcagcaagtaccagaactacatcatggagggcgtgaaggccaccatcaaggacgccagcctgcagcccagaaacgtgcccaacagatacaccttcccctgcccctactgccccgagaagaacttcgaccaggagggcctggtggagcactgcaagctgttccacagcaccgacaccaagagcgtggtgtgccccatctgcgccagcatgccctggggcgaccccaactacagaagcgccaacttcagagagcacatccagagaagacacagattcagctacgacaccttcgtggactacgacgtggacgaggaggacatgatgaaccaggtgctgcagagaagcatcatcgaccagtag

SEQ ID NO: 97632 - DNA, 576 bp, Artificial Sequence
  Description of Artificial Sequence: Synthetic coding sequence
atggccgcccagcagagagactgcggcggcgccgcccagctggccggccccgccgccgaggccgaccccctgggcagattcacctgccccgtgtgcctggaggtgtacgagaagcccgtgcaggtgccctgcggccacgtgttctgcagcgcctgcctgcaggagtgcctgaagcccaagaagcccgtgtgcggcgtgtgcagaagcgccctggcccccggcgtgagagccgtggagctggagagacagatcgagagcaccgagaccagctgccacggctgcagaaagaacttcttcctgagcaagatcagaagccacgtggccacctgcagcaagtaccagaactacatcatggagggcgtgaaggccaccatcaaggacgccagcctgcagcccagaaacgtgcccaacagatacaccttcccctgcccctactgccccgagaagaacttcgaccaggagggcctggtggagcactgcaagctgttccacagcaccgacaccaagagcgtgaccagcgagcagagcccctgcctgctgagcgtgagctgctacagagccagcatcacctactag

SEQ ID NO: 97633 - DNA, 1287 bp, Artificial Sequence
  Description of Artificial Sequence: Synthetic coding sequence
atgggccccccccccggcgccggcgtgagctgcagaggcggctgcggcttcagcagactgctggcctggtgcttcctgctggccctgagcccccaggcccccggcagcagaggcgccgaggccgtgtggaccgcctacctgaacgtgagctggagagtgccccacaccggcgtgaacagaaccgtgtgggagctgagcgaggagggcgtgtacggccaggacagccccctggagcccgtggccggcgtgctggtgccccccgacggccccggcgccctgaacgcctgcaacccccacaccaacttcaccgtgcccaccgtgtggggcagcaccgtgcaggtgagctggctggccctgatccagagaggcggcggctgcaccttcgccgacaagatccacctggcctacgagagaggcgccagcggcgccgtgatcttcaacttccccggcaccagaaacgaggtgatccccatgagccaccccggcgccgtggacatcgtggccatcatgatcggcaacctgaagggcaccaagatcctgcagagcatccagagaggcatccaggtgaccatggtgatcgaggtgggcaagaagcacggcccctgggtgaaccactacagcatcttcttcgtgagcgtgagcttcttcatcatcaccgccgccaccgtgggctacttcatcttctacagcgccagaagactgagaaacgccagagcccagagcagaaagcagagacagctgaaggccgacgccaagaaggccatcggcagactgcagctgagaaccctgaagcagggcgacaaggagatcggccccgacggcgacagctgcgccgtgtgcatcgagctgtacaagcccaacgacctggtgagaatcctgacctgcaaccacatcttccacaagacctgcgtggacccctggctgctggagcacagaacctgccccatgtgcaagtgcgacatcctgaaggccctgggcatcgaggtggacgtggaggacggcagcgtgagcctgcaggtgcccgtgagcaacgagatcagcaacagcgccagcagccacgaggaggacaacagaagcgagaccgccagcagcggctacgccagcgtgcagggcaccgacgagccccccctggaggagcacgtgcagagcaccaacgagagcctgcagctggtgaaccacgaggccaacagcgtggccgtggacgtgatcccccacgtggacaaccccaccttcgaggaggacgagacccccaaccaggagaccgccgtgagagagatcaagagctag

SEQ ID NO: 97634 - DNA, 1209 bp, Artificial Sequence
  Description of Artificial Sequence: Synthetic coding sequence
atgaaccaggagaacagaagcagcttcttctggctgctggtgatcttcaccttcctgctgaagatcaccgccagcttcagcatgagcgcctacgtgaccgtgacctactacaacgagaccagcaactacaccgccatcgagacctgcgagtgcggcgtgtacggcctggccagccccgtggccaacgccatgggcgtggtgggcatccccaagaacaacaactaccaggcctgcgaccacaacaccgagttcagcaacaccaagaagccctggatcgccctgatcgagagaggcaactgcaccttcagcgagaagatccagaccgccggcagaagaaacgccgacgccgtggtgatctacaacgcccccgagaccggcaaccagaccatccagatggccaacttcggcgccgtggacatcgtggccatcatgatcggcaacctgaagggcaccaagatcctgcagagcatccagagaggcatccaggtgaccatggtgatcgaggtgggcaagaagcacggcccctgggtgaaccactacagcatcttcttcgtgagcgtgagcttcttcatcatcaccgccgccaccgtgggctacttcatcttctacagcgccagaagactgagaaacgccagagcccagagcagaaagcagagacagctgaaggccgacgccaagaaggccatcggcagactgcagctgagaaccctgaagcagggcgacaaggagatcggccccgacggcgacagctgcgccgtgtgcatcgagctgtacaagcccaacgacctggtgagaatcctgacctgcaaccacatcttccacaagacctgcgtggacccctggctgctggagcacagaacctgccccatgtgcaagtgcgacatcctgaaggccctgggcatcgaggtggacgtggaggacggcagcgtgagcctgcaggtgcccgtgagcaacgagatcagcaacagcgccagcagccacgaggaggacaacagaagcgagaccgccagcagcggctacgccagcgtgcagggcaccgacgagccccccctggaggagcacgtgcagagcaccaacgagagcctgcagctggtgaaccacgaggccaacagcgtggccgtggacgtgatcccccacgtggacaaccccaccttcgaggaggacgagacccccaaccaggagaccgccgtgagagagatcaagagctag

SEQ ID NO: 97635 - DNA, 750 bp, Artificial Sequence
  Description of Artificial Sequence: Synthetic coding sequence
atgagcgcctacgtgaccgtgacctactacaacgagaccagcaactacaccgccatcgagacctgcgagtgcggcgtgtacggcctggccagccccgtggccaacgccatgggcgtggtgggcatccccaagaacaacaactaccaggcctgcgaccacaacaccgagttcagcaacaccaagaagccctggatcgccctgatcgagagaggcaactgcaccttcagcgagaagatccagaccgccggcagaagaaacgccgacgccgtggtgatctacaacgcccccgagaccggcaaccagaccatccagatggccaacttcggcgccgtggacatcgtggccatcatgatcggcaacctgaagggcaccaagatcctgcagagcatccagagaggcatccaggtgaccatggtgatcgaggtgggcaagaagcacggcccctgggtgaaccactacagcatcttcttcgtgagcgtgagcttcttcatcatcaccgccgccaccgtgggctacttcatcttctacagcgccagaagactgagaaacgccagagcccagagcagaaagcagagacagctgaaggccgacgccaagaaggccatcggcagactgcagctgagaaccctgaagcagggcgacaaggagatcggccccgacggcgacagctgcgccgtgtgcatcgagctgtacaagcccaacgacctggtgagaatcctgacctgcaaccacatcttccacaagacctag

SEQ ID NO: 97636 - DNA, 633 bp, Artificial Sequence
  Description of Artificial Sequence: Synthetic coding sequence
atggccggcctgggcctgggcagcgccgtgcccgtgtggctggccgaggacgacctgggctgcatcatctgccagggcctgctggactggcccgccaccctgccctgcggccacagcttctgcagacactgcctggaggccctgtggggcgccagagacgccagaagatgggcctgccccacctgcagacagggcgccgcccagcagccccacctgagaaagaacaccctgctgcaggacctggccgacaagtacagaagagccgccagagagatccaggccggcagcgaccccgcccactgcccctgccccggcagcagcagcctgagcagcgccgccgccagacccagaagaagacccgagctgcagagagtggccgtggagaagagcatcaccgaggtggcccaggagctgaccgagctggtggagcacctggtggacatcgtgagaagcctgcagaaccagagacccctgagcgagagcggccccgacaacgagctgagcatcctgggcaaggagaacagctggaagcccagactgcccccccacgcccactgcctgaccagagccaccctgcacagcggcgagctgctgggcctgctgagcggccccagcatccagcccctgacctag

SEQ ID NO: 97637 - DNA, 1299 bp, Artificial Sequence
  Description of Artificial Sequence: Synthetic coding sequence
atggccggcctgggcctgggcagcgccgtgcccgtgtggctggccgaggacgacctgggctgcatcatctgccagggcctgctggactggcccgccaccctgccctgcggccacagcttctgcagacactgcctggaggccctgtggggcgccagagacgccagaagatgggcctgccccacctgcagacagggcgccgcccagcagccccacctgagaaagaacaccctgctgcaggacctggccgacaagtacagaagagccgccagagagatccaggccggcagcgaccccgcccactgcccctgccccggcagcagcagcctgagcagcgccgccgccagacccagaagaagacccgagctgcagagagtggccgtggagaagagcatcaccgaggtggcccaggagctgaccgagctggtggagcacctggtggacatcgtgagaagcctgcagaaccagagacccctgagcgagagcggccccgacaacgagctgagcatcctgggcaaggccttcagcagcggcgtggacctgagcatggccagccccaagctggtgaccagcgacaccgccgccggcaagatcagagacatcctgcacgacctggaggagatccaggagaagctgcaggagagcgtgacctggaaggaggcccccgaggcccagatgcagggcgagctgctggaggcccccagcagcagcagctgccccctgcccgaccagagccaccccgccctgagaagagccagcagattcgcccagtgggccatccaccccaccttcaacctgaagagcctgagctgcagcctggaggtgagcaaggacagcagaaccgtgaccgtgagccacagaccccagccctacagatggagctgcgagagattcagcaccagccaggtgctgtgcagccaggccctgagcagcggcaagcactactgggaggtggacaccagaaactgcagccactgggccgtgggcgtggccagctgggagatgagcagagaccaggtgctgggcagaaccatggacagctgctgcgtggagtggaagggcaccagccagctgagcgcctggcacatggtgaaggagaccgtgctgggcagcgacagacccggcgtggtgggcatctggctgaacctggaggagggcaagctggccttctacagcgtggacaaccaggagaagctgctgtacgagtgcaccatcagcgccagcagccccctgtaccccgccttctggctgtacggcctgcaccccggcaactacctgatcatcaagcaggtgaaggtgtag

SEQ ID NO: 97638 - DNA, 255 bp, Artificial Sequence
  Description of Artificial Sequence: Synthetic coding sequence
tgaaaggaggcccccgaggcccagatgcagggcagcctgctgcccagactggagtgcagcggcaccatcaccgccgccagcatcagccaggcccaggagaacagctggaagcccagactgcccccccacgcccactgcctgaccagagccaccctgcacagcggcgagctgctgggcctgctgagcgtgccccccagaggcgagctgatcgccaaggccaagcaggtggagaccctggaccccagagccctgtag

SEQ ID NO: 97639 - DNA, 291 bp, Artificial Sequence
  Description of Artificial Sequence: Synthetic coding sequence
gcccagcagccccacctgagaaagaacaccctgctgcaggacctggccgacaagtacagaagagccgccagagagatccaggccggcagcgaccccgcccactgcccctgccccggcagcagcagcctgagcagcgccgccgccagacccagaagaagacccgagctgcagagagagaacagctggaagcccagactgcccccccacgcccactgcctgaccagagccaccctgcacagcggcgagctgctgggcctgctgagcggccccagcatccagcccctgacctag

SEQ ID NO: 97640 - DNA, 861 bp, Artificial Sequence
  Description of Artificial Sequence: Synthetic coding sequence
atggccggcctgggcctgggcagcgccgtgcccgtgtggctggccgaggacgacctgggctgcatcatctgccagggcctgctggactggcccgccaccctgccctgcggccacagcttctgcagacactgcctggaggccctgtggggcgccagagacgccagaagatgggcctgccccacctgcagacagggcgccgcccagcagccccacctgagaaagaacaccctgctgcaggacctggccgacaagtacagaagagccgccagagagatccaggccggcagcgaccccgcccactgcccctgccccggcagcagcagcctgagcagcgccgccgccagacccagaagaagacccgagctgcagagagtggccgtggagaagagcatcaccgaggtggcccaggagctgaccgagctggtggagcacctggtggacatcgtgagaagcctgcagaaccagagacccctgagcgagagcggccccgacaacgagctgagcatcctgggcaaggccttcagcagcggcgtggacctgagcatggccagccccaagctggtgaccagcgacaccgccgccggcaagatcagagacatcctgcacgacctggaggagatccaggagaagctgcaggagagcgtgacctggaaggaggcccccgaggcccagatgcagggcagcctgctgcccagactggagtgcagcggcaccatcaccgccgccagcatcagccaggcccaggagaacagctggaagcccagactgcccccccacgcccactgcctgaccagagccaccctgcacagcggcgagctgctgggcctgctgagcggccccagcatccagcccctgacctag

SEQ ID NO: 97641 - DNA, 756 bp, Artificial Sequence
  Description of Artificial Sequence: Synthetic coding sequence
atggccagccccaagctggtgaccagcgacaccgccgccggcaagatcagagacatcctgcacgacctggaggagatccaggagaagctgcaggagagcgtgacctggaaggaggcccccgaggcccagatgcagggcgagctgctggaggcccccagcagcagcagctgccccctgcccgaccagagccaccccgccctgagaagagccagcagattcgcccagtgggccatccaccccaccttcaacctgaagagcctgagctgcagcctggaggtgagcaaggacagcagaaccgtgaccgtgagccacagaccccagccctacagatggagctgcgagagattcagcaccagccaggtgctgtgcagccaggccctgagcagcggcaagcactactgggaggtggacaccagaaactgcagccactgggccgtgggcgtggccagctgggagatgagcagagaccaggtgctgggcagaaccatggacagctgctgcgtggagtggaagggcaccagccagctgagcgcctggcacatggtgaaggagaccgtgctgggcagcgacagacccggcgtggtgggcatctggctgaacctggaggagggcaagctggccttctacagcgtggacaaccaggagaagctgctgtacgagtgcaccatcagcgccagcagccccctgtaccccgccttctggctgtacggcctgcaccccggcaactacctgatcatcaagcaggtgaaggtgtag

SEQ ID NO: 97642 - DNA, 1995 bp, Artificial Sequence
  Description of Artificial Sequence: Synthetic coding sequence
atggccgccgtgggccccccccagcagcaggtgagaatggcccaccagcaggtgtgggccgccctggaggtggccctgagagtgccctgcctgtacatcatcgacgccatcttcaacagctaccccgacagcagccagagcagattctgcatcgtgctgcagatcttcctgagactgttcggcgtgttcgccagcagcatcgtgctgatcctgagccagagaagcctgttcaagttctacacctacagcagcgccttcctgctggccgccaccagcgtgctggtgaactactacgccagcctgcacatcgacttctacggcgcctacaacaccagcgccttcggcatcgagctgctgcccagaaagggccccagcctgtggatggccctgatcgtgctgcagctgaccttcggcatcggctacgtgaccctgctgcagatccacagcatctacagccagctgatcatcctggacctgctggtgcccgtgatcggcctgatcaccgagctgcccctgcacatcagagagaccctgctgttcaccagcagcctgatcctgaccctgaacaccgtgttcgtgctggccgtgaagctgaagtggttctactacagcaccagatacgtgtacctgctggtgagacacatgtacagaatctacggcctgcagctgctgatggaggacacctggaagagaatcagattccccgacatcctgagagtgttctggctgaccagagtgaccgcccaggccaccgtgctgatgtacatcctgagaatggccaacgagaccgacagcttcttcatcagctgggacgacttctgggacctgatctgcaacctgatcatcagcggctgcgacagcaccctgaccgtgctgggcatgagcgccgtgatcagcagcgtggcccactacctgggcctgggcatcctggccttcatcggcagcaccgaggaggacgacagaagactgggcttcgtggcccccgtgctgttcttcatcctggccctgcagaccggcctgagcggcctgagacccgaggagagactgatcagactgagcagaaacatgtgcctgctgctgaccgccgtgctgcacttcatccacggcatgaccgaccccgtgctgatgagcctgagcgccagccacgtgagcagcttcagaagacacttccccgtgctgttcgtgagcgcctgcctgttcatcctgcccgtgctgctgagctacgtgctgtggcaccactacgccctgaacacctggctgttcgccgtgaccgccttctgcgtggagctgtgcctgaaggtgatcgtgagcctgaccgtgtacaccctgttcatgatcgacggctactacaacgtgctgtgggagaagctggacgactacgtgtactacgtgagaagcaccggcagcatcatcgagttcatcttcggcgtggtgatgttcggcaacggcgcctacaccatgatgttcgagagcggcagcaagatcagagccttcatgatgtgcctgcacgcctacttcaacatctacctgcaggccaagaacggctggaagaccttcatgaacagaagaaccgccgtgaagaagatcaacagcctgcccgagatcaagggcagcagactgcaggagatcaacgacgtgtgcgccatctgctaccacgagttcaccaccagcgccagaatcaccccctgcaaccactacttccacgccctgtgcctgagaaagtggctgtacatccaggacacctgccccatgtgccaccagaaggtgtacatcgaggacgacatcaaggacaacagcaacgtgagcaacaacaacggcttcatcccccccaacgagacccccgaggaggccgtgagagaggccgccgccgagagcgacagagagctgaacgaggacgacagcaccgactgcgacgacgacgtgcagagagagagaaacggcgtgatccagcacaccggcgccgccgccgaggagttcaacgacgacaccgactag

SEQ ID NO: 97643 - DNA, 1425 bp, Artificial Sequence
  Description of Artificial Sequence: Synthetic coding sequence
atgagcagcgaggacagagaggcccaggaggacgagctgctggccctggccagcatctacgacggcgacgagttcagaaaggccgagagcgtgcagggcggcgagaccagaatctacctggacctgccccagaacttcaagatcttcgtgagcggcaacagcaacgagtgcctgcagaacagcggcttcgagtacaccatctgcttcctgccccccctggtgctgaacttcgagctgccccccgactaccccagcagcagcccccccagcttcaccctgagcggcaagtggctgagccccacccagctgagcgccctgtgcaagcacctggacaacctgtgggaggagcacagaggcagcgtggtgctgttcgcctggatgcagttcctgaaggaggagaccctggcctacctgaacatcgtgagccccttcgagctgaagatcggcagccagaagaaggtgcagagaagaaccgcccaggccagccccaacaccgagctggacttcggcggcgccgccggcagcgacgtggaccaggaggagatcgtggacgagagagccgtgcaggacgtggagagcctgagcaacctgatccaggagatcctggacttcgaccaggcccagcagatcaagtgcttcaacagcaagctgttcctgtgcagcatctgcttctgcgagaagctgggcagcgagtgcatgtacttcctggagtgcagacacgtgtactgcaaggcctgcctgaaggactacttcgagatccagatcagagacggccaggtgcagtgcctgaactgccccgagcccaagtgccccagcgtggccacccccggccaggtgaaggagctggtggaggccgagctgttcgccagatacgacagactgctgctgcagagcagcctggacctgatggccgacgtggtgtactgccccagaccctgctgccagctgcccgtgatgcaggagcccggctgcaccatgggcatctgcagcagctgcaacttcgccttctgcaccctgtgcagactgacctaccacggcgtgagcccctgcaaggtgaccgccgagaagctgatggacctgagaaacgagtacctgcaggccgacgaggccaacaagagactgctggaccagagatacggcaagagagtgatccagaaggccctggaggagatggagagcaaggagtggctggagaagaacagcaagagctgcccctgctgcggcacccccatcgagaagctggacggctgcaacaagatgacctgcaccggctgcatgcagtacttctgctggatctgcatgggcagcctgagcagagccaacccctacaagcacttcaacgaccccggcagcccctgcttcaacagactgttctacgccgtggacgtggacgacgacatctgggaggacgaggtggaggactag

SEQ ID NO: 97644 - DNA, 1425 bp, Artificial Sequence; identical to SEQ ID NO: 97643
  Description of Artificial Sequence: Synthetic coding sequence

SEQ ID NO: 97645 - DNA, 1047 bp, Artificial Sequence
  Description of Artificial Sequence: Synthetic coding sequence
atgcagttcctgaaggaggagaccctggcctacctgaacatcgtgagccccttcgagctgaagatcggcagccagaagaaggtgcagagaagaaccgcccaggccagccccaacaccgagctggacttcggcggcgccgccggcagcgacgtggaccaggaggagatcgtggacgagagagccgtgcaggacgtggagagcctgagcaacctgatccaggagatcctggacttcgaccaggcccagcagatcaagtgcttcaacagcaagctgttcctgtgcagcatctgcttctgcgagaagctgggcagcgagtgcatgtacttcctggagtgcagacacgtgtactgcaaggcctgcctgaaggactacttcgagatccagatcagagacggccaggtgcagtgcctgaactgccccgagcccaagtgccccagcgtggccacccccggccaggtgaaggagctggtggaggccgagctgttcgccagatacgacagactgctgctgcagagcagcctggacctgatggccgacgtggtgtactgccccagaccctgctgccagctgcccgtgatgcaggagcccggctgcaccatgggcatctgcagcagctgcaacttcgccttctgcaccctgtgcagactgacctaccacggcgtgagcccctgcaaggtgaccgccgagaagctgatggacctgagaaacgagtacctgcaggccgacgaggccaacaagagactgctggaccagagatacggcaagagagtgatccagaaggccctggaggagatggagagcaaggagtggctggagaagaacagcaagagctgcccctgctgcggcacccccatcgagaagctggacggctgcaacaagatgacctgcaccggctgcatgcagtacttctgctggatctgcatgggcagcctgagcagagccaacccctacaagcacttcaacgaccccggcagcccctgcttcaacagactgttctacgccgtggacgtggacgacgacatctgggaggacgaggtggaggactag

SEQ ID NO: 97646 - DNA, 897 bp, Artificial Sequence
  Description of Artificial Sequence: Synthetic coding sequence
atgagcagcgaggacagagaggcccaggaggacgagctgctggccctggccagcatctacgacggcgacgagttcagaaaggccgagagcgtgcagggcggcgagaccagaatctacctggacctgccccagaacttcaagatcttcgtgagcggcaacagcaacgagtgcctgcagaacagcggcttcgagtacaccatctgcttcctgccccccctggtgctgaacttcgagctgccccccgactaccccagcagcagcccccccagcttcaccctgagcggcaagtggctgagccccacccaggtgaaggagctggtggaggccgagctgttcgccagatacgacagactgctgctgcagagcagcctggacctgatggccgacgtggtgtactgccccagaccctgctgccagctgcccgtgatgcaggagcccggctgcaccatgggcatctgcagcagctgcaacttcgccttctgcaccctgtgcagactgacctaccacggcgtgagcccctgcaaggtgaccgccgagaagctgatggacctgagaaacgagtacctgcaggccgacgaggccaacaagagactgctggaccagagatacggcaagagagtgatccagaaggccctggaggagatggagagcaaggagtggctggagaagaacagcaagagctgcccctgctgcggcacccccatcgagaagctggacggctgcaacaagatgacctgcaccggctgcatgcagtacttctgctggatctgcatgggcagcctgagcagagccaacccctacaagcacttcaacgaccccggcagcccctgcttcaacagactgttctacgccgtggacgtggacgacgacatctgggaggacgaggtggaggactag

SEQ ID NO: 97647 - DNA, 1425 bp, Artificial Sequence; identical to SEQ ID NO: 97643
  Description of Artificial Sequence: Synthetic coding sequence

SEQ ID NO: 97648 - DNA, 1425 bp, Artificial Sequence; identical to SEQ ID NO: 97643
  Description of Artificial Sequence: Synthetic coding sequence

SEQ ID NO: 97649 - DNA, 48 bp, Artificial Sequence
  Description of Artificial Sequence: Synthetic coding sequence
atgagcagcgaggacagagaggcccaggaggacgagctgctggcctag

SEQ ID NO: 97650 - DNA, 399 bp, Artificial Sequence
  Description of Artificial Sequence: Synthetic coding sequence
atgagcagcgaggacagagaggcccaggaggacgagctgctggccctggccagcatctacgacggcgacgagttcagaaaggccgagagcgtgcagggcggcgagaccagaatctacctggacctgccccagaacttcaagatcttcgtgagcggcaacagcaacgagtgcctgcagaacagcggcttcgagtacaccatctgcttcctgccccccctggtgctgaacttcgagctgccccccgactaccccagcagcagcccccccagcttcaccctgagcggcaagtggctgagccccacccagctgagcgccctgtgcaagcacctggacaacctgtgggaggagcacagaggcagcgtggtgctgttcgcctggatgcagttcctgaaggagtag

SEQ ID NO: 97651 - DNA, 516 bp, Artificial Sequence
  Description of Artificial Sequence: Synthetic coding sequence
atgagcagcgaggacagagaggcccaggaggacgagctgctggccctggccagcatctacgacggcgacgagttcagaaaggccgagagcgtgcagggcggcgagaccagaatctacctggacctgccccagaacttcaagatcttcgtgagcggcaacagcaacgagtgcctgcagaacagcggcttcgagtacaccatctgcttcctgccccccctggtgctgaacttcgagctgccccccgactaccccagcagcagcccccccagcttcaccctgagcggcaagtggctgagccccacccagctgagcgccctgtgcaagcacctggacaacctgtgggaggagcacagaggcagcgtggtgctgttcgcctggatgcagttcctgaaggaggagaccctggcctacctgaacatcgtgagccccttcgagctgaagatcggcagccagaagaaggtgcagagaagaaccgcccaggccagccccaacaccgagctggacttcggcggctag

SEQ ID NO: 97652 - DNA, 558 bp, Artificial Sequence
  Description of Artificial Sequence: Synthetic coding sequence
atgagcagcgaggacagagaggcccaggaggacgagctgctggccctggccagcatctacgacggcgacgagttcagaaaggccgagagcgtgcagggcggcgagaccagaatctacctggacctgccccagaacttcaagatcttcgtgagcggcaacagcaacgagtgcctgcagaacagcggcttcgagtacaccatctgcttcctgccccccctggtgctgaacttcgagctgccccccgactaccccagcagcagcccccccagcttcaccctgagcggcaagtggctgagccccacccagctgagcgccctgtgcaagcacctggacaacctgtgggaggagcacagaggcagcgtggtgctgttcgcctggatgcagttcctgaaggaggagaccctggcctacctgaacatcgtgagccccttcgagctgaagatcggcagccagaagaaggtgcagagaagaaccgcccaggccagccccaacaccgagctggacttcggcggcgccgccggcagcgacgtggaccaggaggagatcgtggacgagtag

SEQ ID NO: 97653 - DNA, 186 bp, Artificial Sequence
  Description of Artificial Sequence: Synthetic coding sequence
atgagcagcgaggacagagaggcccaggaggacgagctgctggccctggccagcatctacgacggcgacgagttcagaaaggccgagagcgtgcagggcggcgagaccagaatctacctggacctgccccagaacttcaagatcttcgtgagcggcaacagcaacgagtgcctgcagaacagctag

SEQ ID NO: 97654 - DNA, 837 bp, Artificial Sequence
  Description of Artificial Sequence: Synthetic coding sequence
atgagcagcgaggacagagaggcccaggaggacgagctgctggccctggccagcatctacgacggcgacgagttcagaaaggccgagagcgtgcagggcggcgagaccagaatctacctggacctgccccagaacttcaagatcttcgtgagcggcaacagcaacgagtgcctgcagaacagcggcttcgagtacaccatctgcttcctgccccccctggtgctgaacttcgagctgccccccgactaccccagcagcagcccccccagcttcaccctgagcggcaagtggctgagccccacccagctgagcgccctgtgcaagcacctggacaacctgtgggaggagcacagaggcagcgtggtgctgttcgcctggatgcagttcctgaaggaggagaccctggcctacctgaacatcgtgagccccttcgagctgaagatcggcagccagaagaaggtgcagagaagaaccgcccaggccagccccaacaccgagctggacttcggcggcgccgccggcagcgacgtggaccaggaggagatcgtggacgagagagccgtgcaggacgtggagagcctgagcaacctgatccaggagatcctggacttcgaccaggcccagcagatcaagtgcttcaacagcaagctgttcctgtgcagcatctgcttctgcgagaagctgggcagcgagtgcatgtacttcctggagtgcagacacgtgtactgcaaggcctgcctgaaggactacttcgagatccagatcagagacggccaggtgcagtgcctgaactgccccgagcccaagtgccccagcgtggccacccccggccagtag

SEQ ID NO: 97655 - DNA, 300 bp, Artificial Sequence
  Description of Artificial Sequence: Synthetic coding sequence
atgagcagcgaggacagagaggcccaggaggacgagctgctggccctggccagcatctacgacggcgacgagttcagaaaggccgagagcgtgcagggcggcgagaccagaatctacctggacctgccccagaacttcaagatcttcgtgagcggcaacagcaacgagtgcctgcagaacagcggcttcgagtacaccatctgcttcctgccccccctggtgctgaacttcgagctgccccccgactaccccagcagcagcccccccagcttcaccctgagcggcaagtggctgagctag

SEQ ID NO: 97656 - DNA, 516 bp, Artificial Sequence
  Description of Artificial Sequence: Synthetic coding sequence
atgagcagcgaggacagagaggcccaggaggacgagctgctggccctggccagcatctacgacggcgacgagttcagaaaggccgagagcgtgcagggcggcgagaccagaatctacctggacctgccccagaacttcaagatcttcgtgagcgagaagctgatggacctgagaaacgagtacctgcaggccgacgaggccaacaagagactgctggaccagagatacggcaagagagtgatccagaaggccctggaggagatggagagcaaggagtggctggagaagaacagcaagagctgcccctgctgcggcacccccatcgagaagctggacggctgcaacaagatgacctgcaccggctgcatgcagtacttctgctggatctgcatgggcagcctgagcagagccaacccctacaagcacttcaacgaccccggcagcccctgcttcaacagactgttctacgccgtggacgtggacgacgacatctgggaggacgaggtggaggactag

SEQ ID NO: 97657 - DNA, 1077 bp, Artificial Sequence
  Description of Artificial Sequence: Synthetic coding sequence
atggccggctgcggcgagatcgaccacagcatcaacatgctgcccaccaacagaaaggccaacgagagctgcagcaacaccgcccccagcctgaccgtgcccgagtgcgccatctgcctgcagacctgcgtgcaccccgtgagcctgccctgcaagcacgtgttctgctacctgtgcgtgaagggcgccagctggctgggcaagagatgcgccctgtgcagacaggagatccccgaggacttcctggacaagcccaccctgctgagccccgaggagctgaaggccgccagcagaggcaacggcgagtacgcctggtactacgagggcagaaacggctggtggcagtacgacgagagaaccagcagagagctggaggacgccttcagcaagggcaagaagaacaccgagatgctgatcgccggcttcctgtacgtggccgacctggagaacatggtgcagtacagaagaaacgagcacggcagaagaagaaagatcaagagagacatcatcgacatccccaagaagggcgtggccggcctgagactggactgcgacgccaacaccgtgaacctggccagagagagcagcgccgacggcgccgacagcgtgagcgcccagagcggcgccagcgtgcagcccctggtgagcagcgtgagacccctgaccagcgtggacggccagctgaccagccccgccacccccagccccgacgccagcaccagcctggaggacagcttcgcccacctgcagctgagcggcgacaacaccgccgagagaagccacagaggcgagggcgaggaggaccacgagagccccagcagcggcagagtgcccgcccccgacaccagcatcgaggagaccgagagcgacgccagcagcgacagcgaggacgtgagcgccgtggtggcccagcacagcctgacccagcagagactgctggtgagcaacgccaaccagaccgtgcccgacagaagcgacagaagcggcaccgacagaagcgtggccggcggcggcaccgtgagcgtgagcgtgagaagcagaagacccgacggccagtgcaccgtgaccgaggtgtag

SEQ ID NO: 97658 - DNA, 1077 bp, Artificial Sequence; identical to SEQ ID NO: 97657
  Description of Artificial Sequence: Synthetic coding sequence

SEQ ID NO: 97659 - DNA, 1080 bp, Artificial Sequence
  Description of Artificial Sequence: Synthetic coding sequence
atgatggccggctgcggcgagatcgaccacagcatcaacatgctgcccaccaacagaaaggccaacgagagctgcagcaacaccgcccccagcctgaccgtgcccgagtgcgccatctgcctgcagacctgcgtgcaccccgtgagcctgccctgcaagcacgtgttctgctacctgtgcgtgaagggcgccagctggctgggcaagagatgcgccctgtgcagacaggagatccccgaggacttcctggacaagcccaccctgctgagccccgaggagctgaaggccgccagcagaggcaacggcgagtacgcctggtactacgagggcagaaacggctggtggcagtacgacgagagaaccagcagagagctggaggacgccttcagcaagggcaagaagaacaccgagatgctgatcgccggcttcctgtacgtggccgacctggagaacatggtgcagtacagaagaaacgagcacggcagaagaagaaagatcaagagagacatcatcgacatccccaagaagggcgtggccggcctgagactggactgcgacgccaacaccgtgaacctggccagagagagcagcgccgacggcgccgacagcgtgagcgcccagagcggcgccagcgtgcagcccctggtgagcagcgtgagacccctgaccagcgtggacggccagctgaccagccccgccacccccagccccgacgccagcaccagcctggaggacagcttcgcccacctgcagctgagcggcgacaacaccgccgagagaagccacagaggcgagggcgaggaggaccacgagagccccagcagcggcagagtgcccgcccccgacaccagcatcgaggagaccgagagcgacgccagcagcgacagcgaggacgtgagcgccgtggtggcccagcacagcctgacccagcagagactgctggtgagcaacgccaaccagaccgtgcccgacagaagcgacagaagcggcaccgacagaagcgtggccggcggcggcaccgtgagcgtgagcgtgagaagcagaagacccgacggccagtgcaccgtgaccgaggtgtag

SEQ ID NO: 97660 - DNA, 1716 bp, Artificial Sequence
  Description of Artificial Sequence: Synthetic coding sequence
atggccctgcccaaggacgccatccccagcctgagcgagtgccagtgcggcatctgcatggagatcctggtggagcccgtgaccctgccctgcaaccacaccctgtgcaagccctgcttccagagcaccgtggagaaggccagcctgtgctgccccttctgcagaagaagagtgagcagctggaccagataccacaccagaagaaacagcctggtgaacgtggagctgtggaccatcatccagaagcactaccccagagagtgcaagctgagagccagcggccaggagagcgaggaggtggccgacgactaccagcccgtgagactgctgagcaagcccggcgagctgagaagagagtacgaggaggagatcagcaaggtggccgccgagagaagagccagcgaggaggaggagaacaaggccagcgaggagtacatccagagactgctggccgaggaggaggaggaggagaagagacaggccgagaagagaagaagagccatggaggagcagctgaagagcgacgaggagctggccagaaagctgagcatcgacatcaacaacttctgcgagggcagcatcagcgccagccccctgaacagcagaaagagcgaccccgtgacccccaagagcgagaagaagagcaagaacaagcagagaaacaccggcgacatccagaagtacctgacccccaagagccagttcggcagcgccagccacagcgaggccgtgcaggaggtgagaaaggacagcgtgagcaaggacatcgacagcagcgacagaaagagccccaccggccaggacaccgagatcgaggacatgcccaccctgagcccccagatcagcctgggcgtgggcgagcagggcgccgacagcagcatcgagagccccatgccctggctgtgcgcctgcggcgccgagtggtaccacgagggcaacgtgaagaccagacccagcaaccacggcaaggagctgtgcgtgctgagccacgagagacccaagaccagagtgccctacagcaaggagaccgccgtgatgccctgcggcagaaccgagagcggctgcgcccccaccagcggcgtgacccagaccaacggcaacaacaccggcgagaccgagaacgaggagagctgcctgctgatcagcaaggagatcagcaagagaaagaaccaggagagcagcttcgaggccgtgaaggacccctgcttcagcgccaagagaagaaaggtgagccccgagagcagccccgaccaggaggagaccgagatcaacttcacccagaagctgatcgacctggagcacctgctgttcgagagacacaagcaggaggagcaggacagactgctggccctgcagctgcagaaggaggtggacaaggagcagatggtgcccaacagacagaagggcagccccgacgagtaccacctgagagccaccagcagcccccccgacaaggtgctgaacggccagagaaagaaccccaaggacggcaacttcaagagacagacccacaccaagcaccccacccccgagagaggcagcagagacaagaacagacaggtgagcctgaagatgcagctgaagcagagcgtgaacagaagaaagatgcccaacagcaccagagaccactgcaaggtgagcaagagcgcccacagcctgcagcccagcatcagccagaagagcgtgttccagatgttccagagatgcaccaagtag

SEQ ID NO: 97661 - DNA, 1716 bp, Artificial Sequence; identical to SEQ ID NO: 97660
  Description of Artificial Sequence: Synthetic coding sequence

SEQ ID NO: 97662 - DNA, 4872 bp, Artificial Sequence
  Description of Artificial Sequence: Synthetic coding sequence
atggccgccgaggccagcaagaccggccccagcagaagcagctaccagagaatgggcagaaagagccagccctggggcgccgccgagatccagtgcaccagatgcggcagaagagtgagcagaagcagcggccaccactgcgagctgcagtgcggccacgccttctgcgagctgtgcctgctgatgaccgaggagtgcaccaccatcatctgccccgactgcgaggtggccaccgccgtgaacaccagacagagatactaccccatggccggctacatcaaggaggacagcatcatggagaagctgcagcccaagaccatcaagaactgcagccaggacttcaagaagaccgccgaccagctgaccaccggcctggagagaagcgccagcaccgacaagaccctgctgaacagcagcgccgtgatgctggacaccaacaccgccgaggagatcgacgaggccctgaacaccgcccaccacagcttcgagcagctgagcatcgccggcaaggccctggagcacatgcagaagcagaccatcgaggagagagagagagtgatcgaggtggtggagaagcagttcgaccagctgctggccttcttcgacagcagaaagaagaacctgtgcgaggagttcgccagaaccaccgacgactacctgagcaacctgatcaaggccaagagctacatcgaggagaagaagaacaacctgaacgccgccatgaacatcgccagagccctgcagctgagccccagcctgagaacctactgcgacctgaaccagatcatcagaaccctgcagctgaccagcgacagcgagctggcccaggtgagcagcccccagctgagaaacccccccagactgagcgtgaactgcagcgagatcatctgcatgttcaacaacatgggcaagatcgagttcagagacagcaccaagtgctacccccaggagaacgagatcagacagaacgtgcagaagaagtacaacaacaagaaggagctgagctgctacgacacctacccccccctggagaagaagaaggtggacatgagcgtgctgaccagcgaggccccccccccccccctgcagcccgagaccaacgacgtgcacctggaggccaagaacttccagccccagaaggacgtggccaccgccagccccaagaccatcgccgtgctgccccagatgggcagcagccccgacgtgatcatcgaggagatcatcgaggacaacgtggagagcagcgccgagctggtgttcgtgagccacgtgatcgacccctgccacttctacatcagaaagtacagccagatcaaggacgccaaggtgctggagaagaaggtgaacgagttctgcaacagaagcagccacctggaccccagcgacatcctggagctgggcgccagaatcttcgtgagcagcatcaagaacggcatgtggtgcagaggcaccatcaccgagctgatccccatcgagggcagaaacaccagaaagccctgcagccccaccagactgttcgtgcacgaggtggccctgatccagatcttcatggtggacttcggcaacagcgaggtgctgatcgtgaccggcgtggtggacacccacgtgagacccgagcacagcgccaagcagcacatcgccctgaacgacctgtgcctggtgctgagaaagagcgagccctacaccgagggcctgctgaaggacatccagcccctggcccagccctgcagcctgaaggacatcgtgccccagaacagcaacgagggctgggaggaggaggccaaggtggagttcctgaagatggtgaacaacaaggccgtgagcatgaaggtgttcagagaggaggacggcgtgctgatcgtggacctgcagaagcccccccccaacaagatcagcagcgacatgcccgtgagcctgagagacgccctggtgttcatggagctggccaagttcaagagccagagcctgagaagccacttcgagaagaacaccaccctgcactaccacccccccatcctgcccaaggagatgaccgacgtgagcgtgaccgtgtgccacatcaacagccccggcgacttctacctgcagctgatcgagggcctggacatcctgttcctgctgaagaccatcgaggagttctacaagagcgaggacggcgagaacctggagatcctgtgccccgtgcaggaccaggcctgcgtggccaagttcgaggacggcatctggtacagagccaaggtgatcggcctgcccggccaccaggaggtggaggtgaagtacgtggacttcggcaacaccgccaagatcaccatcaaggacgtgagaaagatcaaggacgagttcctgaacgcccccgagaaggccatcaagtgcaagctggcctacatcgagccctacaagagaaccatgcagtggagcaaggaggccaaggagaagttcgaggagaaggcccaggacaagttcatgacctgcagcgtgatcaagatcctggaggacaacgtgctgctggtggagctgttcgacagcctgggcgcccccgagatgaccaccaccagcatcaacgaccagctggtgaaggagggcctggccagctacgagatcggctacatcctgaaggacaacagccagaagcacatcgaggtgtgggaccccagccccgaggagatcatcagcaacgaggtgcacaacctgaaccccgtgagcgccaagagcctgcccaacgagaacttccagagcctgtacaacaaggagctgcccgtgcacatctgcaacgtgatcagccccgagaagatctacgtgcagtggctgctgaccgagaacctgctgaacagcctggaggagaagatgatcgccgcctacgagaacagcaagtgggagcccgtgaagtgggagaacgacatgcactgcgccgtgaagatccaggacaagaaccagtggagaagaggccagatcatcagaatggtgaccgacaccctggtggaggtgctgctgtacgacgtgggcgtggagctggtggtgaacgtggactgcctgagaaagctggaggagaacctgaagaccatgggcagactgagcctggagtgcagcctggtggacatcagacccgccggcggcagcgacaagtggaccgccaccgcctgcgactgcctgagcctgtacctgaccggcgccgtggccaccatcatcctgcaggtggacagcgaggagaacaacaccacctggcccctgcccgtgaagatcttctgcagagacgagaagggcgagagagtggacgtgagcaagtacctgatcaagaagggcctggccctgagagagagaagaatcaacaacctggacaacagccacagcctgagcgagaagagcctggaggtgcccctggagcaggaggacagcgtggtgaccaactgcatcaagaccaacttcgaccccgacaagaagaccgccgacatcatcagcgagcagaaggtgagcgagttccaggagaagatcctggagcccagaaccaccagaggctacaagccccccgccatccccaacatgaacgtgttcgaggccaccgtgagctgcgtgggcgacgacggcaccatcttcgtggtgcccaagctgagcgagttcgagctgatcaagatgaccaacgagatccagagcaacctgaagtgcctgggcctgctggagccctacttctggaagaagggcgaggcctgcgccgtgagaggcagcgacaccctgtggtacagaggcaaggtgatggaggtggtgggcggcgccgtgagagtgcagtacctggaccacggcttcaccgagaagatcccccagtgccacctgtaccccatcctgctgtaccccgacatcccccagttctgcatcccctgccagctgcacaacaccacccccgtgggcaacgtgtggcagcccgacgccatcgaggtgctgcagcagctgctgagcaagagacaggtggacatccacatcatggagctgcccaagaacccctgggagaagctgagcatccacctgtacttcgacggcatgagcctgagctacttcatggcctactacaagtactgcaccagcgagcacaccgaggagatgctgaaggagaagcccagaagcgaccacgacaagaagtacgaggaggagcagtgggagatcagattcgaggagctgctgagcgccgagaccgacacccccctgctgcccccctacctgagcagcagcctgcccagccccggcgagctgtacgccgtgcaggtgaagcacgtggtgagccccaacgaggtgtacatctgcctggacagcatcgagaccagcaaccagagcaaccagcacagcgacaccgacgacagcggcgtgagcggcgagagcgagagcgagagcctggacgaggccctgcagagagtgaacaagaaggtggaggccctgccccccctgaccgacttcagaaccgagatgccctgcctggccgagtacgacgacggcctgtggtacagagccaagatcgtggccatcaaggagttcaaccccctgagcatcctggtgcagttcgtggactacggcagcaccgccaagctgaccctgaacagactgtgccagatccccagccacctgatgagataccccgccagagccatcaaggtgctgctggccggcttcaagccccccctgagagacctgggcgagaccagaatcccctactgccccaagtggagcatggaggccctgtgggccatgatcgactgcctgcagggcaagcagctgtacgccgtgagcatggcccccgcccccgagcagatcgtgaccctgtacgacgacgagcagcaccccgtgcacatgcccctggtggagatgggcctggccgacaaggacgagtag

SEQ ID NO: 97663 - DNA, 1350 bp, Artificial Sequence
  Description of Artificial Sequence: Synthetic coding sequence
atggccgccgaggccagcaagaccggccccagcagaagcagctaccagagaatgggcagaaagagccagccctggggcgccgccgagatccagtgcaccagatgcggcagaagagtgagcagaagcagcggccaccactgcgagctgcagtgcggccacgccttctgcgagctgtgcctgctgatgaccgaggagtgcaccaccatcatctgccccgactgcgaggtggccaccgccgtgaacaccagacagagatactaccccatggccggctacatcaaggaggacagcatcatggagaagctgcagcccaagaccatcaagaactgcagccaggacttcaagaagaccgccgaccagctgaccaccggcctggagagaagcgccagcaccgacaagaccctgctgaacagcagcgccgtgatgctggacaccaacaccgccgaggagatcgacgaggccctgaacaccgcccaccacagcttcgagcagctgagcatcgccggcaaggccctggagcacatgcagaagcagaccatcgaggagagagagagagtgatcgaggtggtggagaagcagttcgaccagctgctggccttcttcgacagcagaaagaagaacctgtgcgaggagttcgccagaaccaccgacgactacctgagcaacctgatcaaggccaagagctacatcgaggagaagaagaacaacctgaacgccgccatgaacatcgccagagccctgcagctgagccccagcctgagaacctactgcgacctgaaccagatcatcagaaccctgcagctgaccagcgacagcgagctggcccaggtgagcagcccccagctgagaaacccccccagactgagcgtgaactgcagcgagatcatctgcatgttcaacaacatgggcaagatcgagttcagagacagcaccaagtgctacccccaggagaacgagatcagacagaacgtgcagaagaagtacaacaacaagaaggagctgagctgctacgacacctacccccccctggagaagaagaaggtggacatgagcgtgctgaccagcgaggccccccccccccccctgcagcccgagaccaacgacgtgcacctggaggccaagaacttccagccccagaaggacgtggccaccgccagccccaagaccatcgccgtgctgccccagatgggcagcagccccgacgtgatcatcgaggagatcatcgaggacaacgtggagacctgcggcaccgacgacctgggcgagacccccagataccccaagaagcccctgcagaagaacagcagcgtgcccttcggcagcaaggccgacaccgtgaccaccgtgtag

SEQ ID NO: 97664 - DNA, 4746 bp, Artificial Sequence
  Description of Artificial Sequence: Synthetic coding sequence
atggccgccgaggccagcaagaccggccccagcagaagcagctaccagagaatgggcagaaagagccagccctggggcgccgccgagatccagtgcaccagatgcggcagaagagtgagcagaagcagcggccaccactgcgagctgcagtgcggccacgccttctgcgagctgtgcctgctgatgaccgaggagtgcaccaccatcatctgccccgactgcgaggtggccaccgccgtgaacaccagacagagatactaccccatggccggctacatcaaggaggacagcatcatggagaagctgcagcccaagaccatcaagaactgcagccaggacttcaagaagaccgccgaccagctgaccaccggcctggagagaagcgccagcaccgacaagaccctgctgaacagcagcgccgtgatgctggacaccaacaccgccgaggagatcgacgaggccctgaacaccgcccaccacagcttcgagcagctgagcatcgccggcaaggccctggagcacatgcagaagcagaccatcgaggagagagagagagtgatcgaggtggtggagaagcagttcgaccagctgctggccttcttcgacagcagaaagaagaacctgtgcgaggagttcgccagaaccaccgacgactacctgagcaacctgatcaaggccaagagctacatcgaggagaagaagaacaacctgaacgccgccatgaacatcgccagagccctgcagctgagccccagcctgagaacctactgcgacctgaaccagatcatcagaaccctgcagctgaccagcgacagcgagctggcccaggtgagcagcccccagctgagaaacccccccagactgagcgtgaactgcagcgagatcatctgcatgttcaacaacatgggcaagatcgagttcagagacagcaccaagtgctacccccaggagaacgagatcagacagaacgtgcagaagaagtacaacaacaagaaggagctgagctgctacgacacctacccccccctggagaagaagaaggtggacatgagcgtgctgaccagcgaggccccccccccccccctgcagcccgagaccaacgacgtgcacctggaggccaagaacttccagccccagaaggacgtggccaccgccagccccaagaccatcgccgtgctgccccagatgggcagcagccccgacgtgatcatcgaggagatcatcgaggacaacgtggagagcagcgccgagctggtgttcgtgagccacgtgatcgacccctgccacttctacatcagaaagtacagccagatcaaggacgccaaggtgctggagaagaaggtgaacgagttctgcaacagaagcagccacctggaccccagcgacatcctggagctgggcgccagaatcttcgtgagcagcatcaagaacggcatgtggtgcagaggcaccatcaccgagctgatccccatcgagggcagaaacaccagaaagccctgcagccccaccagactgttcgtgcacgaggtggccctgatccagatcttcatggtggacttcggcaacagcgaggtgctgatcgtgaccggcgtggtggacacccacgtgagacccgagcacagcgccaagcagcacatcgccctgaacgacctgtgcctggtgctgagaaagagcgagccctacaccgagggcctgctgaaggacatccagcccctggcccagccctgcagcctgaaggacatcgtgccccagaacagcaacgagggctgggaggaggaggccaaggtggagttcctgaagatggtgaacaacaaggccgtgagcatgaaggtgttcagagaggaggacggcgtgctgatcgtggacctgcagaagcccccccccaacaagatcagcagcgacatgcccgtgagcctgagagacgccctggtgttcatggagctggccaagttcaagagccagagcctgagaagccacttcgagaagaacaccaccctgcactaccacccccccatcctgcccaaggagatgaccgacgtgagcgtgaccgtgtgccacatcaacagccccggcgacttctacctgcagctgatcgagggcctggacatcctgttcctgctgaagaccatcgaggagttctacaagagcgaggacggcgagaacctggagatcctgtgccccgtgcaggaccaggcctgcgtggccaagttcgaggacggcatctggtacagagccaaggtgatcggcctgcccggccaccaggaggtggaggtgaagtacgtggacttcggcaacaccgccaagatcaccatcaaggacgtgagaaagatcaaggacgagttcctgaacgcccccgagaaggccatcaagtgcaagctggcctacatcgagccctacaagagaaccatgcagtggagcaaggaggccaaggagaagttcgaggagaaggcccaggacaagttcatgacctgcagcgtgatcaagatcctggaggacaacgtgctgctggtggagctgttcgacagcctgggcgcccccgagatgaccaccaccagcatcaacgaccagctggtgaaggagggcctggccagctacgagatcggctacatcctgaaggacaacagccagaagcacatcgaggtgtgggaccccagccccgaggagatcatcagcaacgaggtgcacaacctgaaccccgtgagcgccaagagcctgcccaacgagaacttccagagcctgtacaacaaggagctgcccgtgcacatctgcaacgtgatcagccccgagaagatctacgtgcagtggctgctgaccgagaacctgctgaacagcctggaggagaagatgatcgccgcctacgagaacagcaagtgggagcccgtgaagtgggagaacgacatgcactgcgccgtgaagatccaggacaagaaccagtggagaagaggccagatcatcagaatggtgaccgacaccctggtggaggtgctgctgtacgacgtgggcgtggagctggtggtgaacgtggactgcctgagaaagctggaggagaacctgaagaccatgggcagactgagcctggagtgcagcctggtggacatcagacccgccggcggcagcgacaagtggaccgccaccgcctgcgactgcctgagcctgtacctgaccggcgccgtggccaccatcatcctgcaggtggacagcgaggagaacaacaccacctggcccctgcccgtgaagatcttctgcagagacgagaagggcgagagagtggacgtgagcaagtacctgatcaagaagggcctggccctgagagagagaagaatcaacaacctggacaacagccacagcctgagcgagaagagcctggaggtgcccctggagcaggaggacagcgtggtgaccaactgcatcaagaccaacttcgaccccgacaagaagaccgccgacatcatcagcgagcagaaggtgagcgagttccaggagaagatcctggagcccagaaccaccagaggctacaagccccccgccatccccaacatgaacgtgttcgaggccaccgtgagctgcgtgggcgacgacggcaccatcttcgtggtgcccaagctgagcgagttcgagctgatcaagatgaccaacgagatccagagcaacctgaagtgcctgggcctgctggagccctacttctggaagaagggcgaggcctgcgccgtgagaggcagcgacaccctgtggtacagaggcaaggtgatggaggtggtgggcggcgccgtgagagtgcagtacctggaccacggcttcaccgagaagatcccccagtgccacctgtaccccatcctgctgtaccccgacatcccccagttctgcatcccctgccagctgcacaacaccacccccgtgggcaacgtgtggcagcccgacgccatcgaggtgctgcagcagctgctgagcaagagacaggtggacatccacatcatgaagcccagaagcgaccacgacaagaagtacgaggaggagcagtgggagatcagattcgaggagctgctgagcgccgagaccgacacccccctgctgcccccctacctgagcagcagcctgcccagccccggcgagctgtacgccgtgcaggtgaagcacgtggtgagccccaacgaggtgtacatctgcctggacagcatcgagaccagcaaccagagcaaccagcacagcgacaccgacgacagcggcgtgagcggcgagagcgagagcgagagcctggacgaggccctgcagagagtgaacaagaaggtggaggccctgccccccctgaccgacttcagaaccgagatgccctgcctggccgagtacgacgacggcctgtggtacagagccaagatcgtggccatcaaggagttcaaccccctgagcatcctggtgcagttcgtggactacggcagcaccgccaagctgaccctgaacagactgtgccagatccccagccacctgatgagataccccgccagagccatcaaggtgctgctggccggcttcaagccccccctgagagacctgggcgagaccagaatcccctactgccccaagtggagcatggaggccctgtgggccatgatcgactgcctgcagggcaagcagctgtacgccgtgagcatggcccccgcccccgagcagatcgtgaccctgtacgacgacgagcagcaccccgtgcacatgcccctggtggagatgggcctggccgacaaggacgagtag

SEQ ID NO: 97665 - DNA, 3207 bp, Artificial Sequence
  Description of Artificial Sequence: Synthetic coding sequence
atgctggacaccaacaccgccgaggagatcgacgaggccctgaacaccgcccaccacagcttcgagcagctgagcatcgccggcaaggccctggagcacatgcagaagcagaccatcgaggagagagagagagtgatcgaggtggtggagaagcagttcgaccagctgctggccttcttcgacagcagaaagaagaacctgtgcgaggagttcgccagaaccaccgacgactacctgagcaacctgatcaaggccaagagctacatcgaggagaagaagaacaacctgaacgccgccatgaacatcgccagagccctgcagctgagccccagcctgagaacctactgcgacctgaaccagatcatcagaaccctgcagctgaccagcgacagcgagctggcccaggtgagcagcccccagctgagaaacccccccagactgagcgtgaactgcagcgagatcatctgcatgttcaacaacatgggcaagatcgagttcagagacagcaccaagtgctacccccaggagaacgagatcagacagaacgtgcagaagaagtacaacaacaagaaggagctgagctgctacgacacctacccccccctggagaagaagaaggtggacatgagcgtgctgaccagcgaggccccccccccccccctgcagcccgagaccaacgacgtgcacctggaggccaagaacttccagccccagaaggacgtggccaccgccagccccaagaccatcgccgtgctgccccagatgggcagcagccccgacgtgatcatcgaggagatcatcgaggacaacgtggagagcagcgccgagctggtgttcgtgagccacgtgatcgacccctgccacttctacatcagaaagtacagccagatcaaggacgccaaggtgctggagaagaaggtgaacgagttctgcaacagaagcagccacctggaccccagcgacatcctggagctgggcgccagaatcttcgtgagcagcatcaagaacggcatgtggtgcagaggcaccatcaccgagctgatccccatcgagggcagaaacaccagaaagccctgcagccccaccagactgttcgtgcacgaggtggccctgatccagatcttcatggtggacttcggcaacagcgaggtgctgatcgtgaccggcgtggtggacacccacgtgagacccgagcacagcgccaagcagcacatcgccctgaacgacctgtgcctggtgctgagaaagagcgagccctacaccgagggcctgctgaaggacatccagcccctggcccagccctgcagcctgaaggacatcgtgccccagaacagcaacgagggctgggaggaggaggccaaggtggagttcctgaagatggtgaacaacaaggccgtgagcatgaaggtgttcagagaggaggacggcgtgctgatcgtggacctgcagaagcccccccccaacaagatcagcagcgacatgcccgtgagcctgagagacgccctggtgttcatggagctggccaagttcaagagccagagcctgagaagccacttcgagaagaacaccaccctgcactaccacccccccatcctgcccaaggagatgaccgacgtgagcgtgaccgtgtgccacatcaacagccccggcgacttctacctgcagctgatcgagggcctggacatcctgttcctgctgaagaccatcgaggagttctacaagagcgaggacggcgagaacctggagatcctgtgccccgtgcaggaccaggcctgcgtggccaagttcgaggacggcatctggtacagagccaaggtgatcggcctgcccggccaccaggaggtggaggtgaagtacgtggacttcggcaacaccgccaagatcaccatcaaggacgtgagaaagatcaaggacgagttcctgaacgcccccgagaaggccatcaagtgcaagctggcctacatcgagccctacaagagaaccatgcagtggagcaaggaggccaaggagaagttcgaggagaaggcccaggacaagttcatgacctgcagcgtgatcaagatcctggaggacaacgtgctgctggtggagctgttcgacagcctgggcgcccccgagatgaccaccaccagcatcaacgaccagctggtgaaggagggcctggccagctacgagatcggctacatcctgaaggacaacagccagaagcacatcgaggtgtgggaccccagccccgaggagatcatcagcaacgaggtgcacaacctgaaccccgtgagcgccaagagcctgcccaacgagaacttccagagcctgtacaacaaggagctgcccgtgcacatctgcaacgtgatcagccccgagaagatctacgtgcagtggctgctgaccgagaacctgctgaacagcctggaggagaagatgatcgccgcctacgagaacagcaagtgggagcccgtgaagtgggagaacgacatgcactgcgccgtgaagatccaggacaagaaccagtggagaagaggccagatcatcagaatggtgaccgacaccctggtggaggtgctgctgtacgacgtgggcgtggagctggtggtgaacgtggactgcctgagaaagctggaggagaacctgaagaccatgggcagactgagcctggagtgcagcctggtggacatcagacccgccggcggcagcgacaagtggaccgccaccgcctgcgactgcctgagcctgtacctgaccggcgccgtggccaccatcatcctgcaggtggacagcgaggagaacaacaccacctggcccctgcccgtgaagatcttctgcagagacgagaagggcgagagagtggacgtgagcaagtacctgatcaagaagggcctggccctgagagagagaagaatcaacaacctggacaacagccacagcctgagcgagaagagcctggaggtgcccctggagcaggaggacagcgtggtgaccaactgcatcaagaccaacttcgaccccgacaagaagaccgccgacatcatcagcgagcagaaggtgagcgagttccaggagaagatcctggagcccagaaccaccagaggctacaagccccccgccatccccaacatgaacgtgttcgaggccaccgtgagctgcgtgggcgacgacggcaccatcttcgtggtgcccaagctgagcgagttcgagctgatcaagtag

SEQ ID NO: 97666 - DNA, 462 bp, Artificial Sequence
  Description of Artificial Sequence: Synthetic coding sequence
atggccagctacttcgacgagcacgactgcgagcccagcgaccccgagcaggagaccagaaccaacatgctgctggagctggccagaagcctgttcaacagaatggacttcgaggacctgggcctggtggtggactgggaccaccacctgcccccccccgccgccaagaccgtggtggagaacctgcccagaaccgtgatcagaggcagccaggccgagctgaagtgccccgtgtgcctgctggagttcgaggaggaggagaccgccatcgagatgccctgccaccacctgttccacagcagctgcatcctgccctggctgagcaagaccaacagctgccccctgtgcagatacgagctgcccaccgacgacgacacctacgaggagcacagaagagacaaggccagaaagcagcagcagcagcacagactggagaacctgcacggcgccatgtacacctag

SEQ ID NO: 97667 - DNA, 684 bp, Artificial Sequence
  Description of Artificial Sequence: Synthetic coding sequence
atggcctgcaccaagaccctgcagcagagccagcccatcagcgccggcgccaccaccaccaccaccgccgtggcccccgccggcggccacagcggcagcaccgagtgcgacctggagtgcctggtgtgcagagagccctacagctgccccagactgcccaagctgctggcctgccagcacgccttctgcgccatctgcctgaagctgctgctgtgcgtgcaggacaacacctggagcatcacctgccccctgtgcagaaaggtgaccgccgtgcccggcggcctgatctgcagcctgagagaccacgaggccgtggtgggccagctggcccagccctgcaccgaggtgagcctgtgcccccagggcctggtggaccccgccgacctggccgccggccaccccagcctggtgggcgaggacggccaggacgaggtgagcgccaaccacgtggccgccagaagactggccgcccacctgctgctgctggccctgctgatcatcctgatcggccccttcatctaccccggcgtgctgagatgggtgctgaccttcatcatcgccctggccctgctgatgagcaccctgttctgctgcctgcccagcaccagaggcagctgctggcccagcagcagaaccctgttctgcagagagcagaagcacagccacatcagcagcatcgcctag

SEQ ID NO: 97668 - DNA, 795 bp, Artificial Sequence
  Description of Artificial Sequence: Synthetic coding sequence
atgagccaggccgtgcagaccaacggcacccagcccctgagcaagacctgggagctgagcctgtacgagctgcagagaaccccccaggaggccatcaccgacggcctggagatcgtggtgagccccagaagcctgcacagcgagctgatgtgccccatctgcctggacatgctgaagaacaccatgaccaccaaggagtgcctgcacagattctgcgccgactgcatcatcaccgccctgagaagcggcctgcagagaggcaagaagcagcagatcgagaacggcagcggcgccgaggacaacggcgacagcagccactgcagcaacgccagcacccacagcaaccaggaggccggccccagcaacaagagaaccaagaccagcgacgacagcggcctggagctggacaacaacaacgccgccatggccatcgaccccgtgatggacggcgccagcgagatcgagctggtgttcagaccccaccccaccctgatggagaaggacgacagcgcccagaccagatacatcaagaccagcggcaacgccaccgtggaccacctgagcaagtacctggccgtgagactggccctggaggagctgagaagcaagggcgagagcaaccagatgaacctggacaccgccagcgagaagcagtacaccatctacatcgccaccgccagcggccagttcaccgtgctgaacggcagcttcagcctggagctggtgagcgagaagtactggaaggtgaacaagcccatggagctgtactacgcccccaccaaggagcacaagtag

SEQ ID NO: 97669 - DNA, 1011 bp, Artificial Sequence
  Description of Artificial Sequence: Synthetic coding sequence
atgagccaggccgtgcagaccaacggcacccagcccctgagcaagacctgggagctgagcctgtacgagctgcagagaaccccccaggaggccatcaccgacggcctggagatcgtggtgagccccagaagcctgcacagcgagctgatgtgccccatctgcctggacatgctgaagaacaccatgaccaccaaggagtgcctgcacagattctgcgccgactgcatcatcaccgccctgagaagcggcaacaaggagtgccccacctgcagaaagaagctggtgagcaagagaagcctgagacccgaccccaacttcgacgccctgatcagcaagatctaccccagcagagacgagtacgaggcccaccaggagagagtgctggccagaatcaacaagcacaacaaccagcaggccctgagccacagcatcgaggagggcctgaagatccaggccatgaacagactgcagagaggcaagaagcagcagatcgagaacggcagcggcgccgaggacaacggcgacagcagccactgcagcaacgccagcacccacagcaaccaggaggccggccccagcaacaagagaaccaagaccagcgacgacagcggcctggagctggacaacaacaacgccgccatggccatcgaccccgtgatggacggcgccagcgagatcgagctggtgttcagaccccaccccaccctgatggagaaggacgacagcgcccagaccagatacatcaagaccagcggcaacgccaccgtggaccacctgagcaagtacctggccgtgagactggccctggaggagctgagaagcaagggcgagagcaaccagatgaacctggacaccgccagcgagaagcagtacaccatctacatcgccaccgccagcggccagttcaccgtgctgaacggcagcttcagcctggagctggtgagcgagaagtactggaaggtgaacaagcccatggagctgtactacgcccccaccaaggagcacaagtag

SEQ ID NO: 97670 - DNA, 741 bp, Artificial Sequence
  Description of Artificial Sequence: Synthetic coding sequence
atgagccaggccgtgcagaccaacggcacccagcccctgagcaagacctgggagctgagcctgtacgagctgcagagaaccccccaggaggccatcaccgacggcctggagatcgtggtgagccccagaagcctgcacagcgagctgatgtgccccatctgcctggacatgctgaagaacaccatgaccaccaaggagtgcctgcacagattctgcgccgactgcatcatcaccgccctgagaagcggcaacaaggagtgccccacctgcagaaagaagctggtgagcaagagaagcctgagacccgaccccaacttcgacgccctgatcagcaagatctaccccagcagagacgagtacgaggcccaccaggagagagtgctggccagaatcaacaagcacaacaaccagcaggccctgagccacagcatcgaggagggcctgaagatccaggccatgaacagactgcagagaggcaagaagcagcagatcgagaacggcagcggcgccgaggacaacggcgacagcagccactgcagcaacgccagcacccacagcaaccaggaggccggccccagcaacaagagaaccaagaccagcgacgacagcggcctggagctggacaacaacaacgccgccatggccatcgaccccgtgatggacggcgccagcgagatcgagctggtgttcagaccccaccccaccctgatggagaaggacgacagcgcccagaccagatag

SEQ ID NO: 97671 - DNA, 822 bp, Artificial Sequence
  Description of Artificial Sequence: Synthetic coding sequence
atggccaactgggtgttctgcaacagatgcttccagcccccccacagaaccagctgcttcagcctgaccaactgcggccacgtgtactgcgacgcctgcctgggcaagggcaagaagaacgagtgcctgatctgcaaggccccctgcagaaccgtgctgctgagcaagcacaccgacgccgacatccaggccttcttcatgagcatcgacagcctgtgcaagaagtacagcagagagaccagccagtacctgagactgagcagaggctgctgcagactgaagctgtgccccgccaccagcagcaaggaggtgcccagaggcagcacccacggcagccaggccgccgccagagacccccaggagcactgggtgagcaccaccagagcccccagacccggctgcagaagaagccagagccagcccgaggcccagggcaacaccatccaggacgccccccaccccctgaccctgctgcaccccagcagaaccctgatccacaccaagagcccctggggccagaagctgctggagttcatcaagcacgtgtgctaccacagacaccagagccacagaccctgcgcccccggctggttctgccaggtgctgcagagacccggcgccgtgagcggcgagaagacccagcagaccagacccgccccccccgccacctgcctgctgtgcctgagctgcctgagcggcttcagacacggcccctggagaagccaggccctgcccagcgacctggtggcccccctgttcgtgagctacaccgtggaggtgagcatcaccaacgccggctggagcttccccgccgccgtgtag

SEQ ID NO: 97672 - DNA, 699 bp, Artificial Sequence
  Description of Artificial Sequence: Synthetic coding sequence
atggccaactgggtgttctgcaacagatgcttccagcccccccacagaaccagctgcttcagcctgaccaactgcggccacgtgtactgcgacgcctgcctgggcaagggcaagaagaacgagtgcctgatctgcaaggccccctgcagaaccgtgctgctgagcaagcacaccgacgccgacatccaggccttcttcatgagcatcgacagcctgtgcaagaagtacagcagagagaccagccagatcctggagttccaggagaagcacagaaagagactgctggccttctacagagagaagatcagcagactggaggagagcctgagaaagagcgtgctgcagatcgagcagctgcagagcatgagaagcagccagcagaccgccttcagcaccatcaagagcagcgtgagcaccaagccccacggctgcctgctgcccccccacagcagcgcccccgacagactggagagcatggaggtggacctgagccccagccccatcagaaagagcgagatcgccgccggccccgccagaatcagcatgatcagccccccccaggacggcagaatggccccctgcgccagaagagtgtgccacttccagagattcaccatgttcctgcacagaagactgagcagcctggccgccccccccagcgtgcagttctggaaggccagaggcacccaccagctgtag

SEQ ID NO: 97673 - DNA, 894 bp, Artificial Sequence
  Description of Artificial Sequence: Synthetic coding sequence
atggccaactgggtgttctgcaacagatgcttccagcccccccacagaaccagctgcttcagcctgaccaactgcggccacgtgtactgcgacgcctgcctgggcaagggcaagaagaacgagtgcctgatctgcaaggccccctgcagaaccgtgctgctgagcaagcacaccgacgccgacatccaggccttcttcatgagcatcgacagcctgtgcaagaagtacagcagagagaccagccagatcctggagttccaggagaagcacagaaagagactgctggccttctacagagagaagatcagcagactggaggagagcctgagaaagagcgtgctgcagatcgagcagctgcagagcatgagaagcagccagcagaccgccttcagcaccatcaagagcagcgtgagcaccaagccccacggctgcctgctgcccccccacagcagcgcccccgacagactggagagcatggaggtggacctgagccccagccccatcagaaagagcgagatcgccgccggccccgccagaatcagcatgatcagccccccccaggacggcagaatgggcccccacctgaccgccagcttctgcttcatcccctggctgaccctgagcaagccccccgtgcccggcgagtgcgtgatcagcagaggcagcccctgcttctgcatcgacgtgtgcccccactggctgctgctgctggccttcagcagcggcagacacggcgagctgaccaacagcaagaccctgcccatctacgccgaggtgcagagagccgtgctgttccccttccagcaggccgagggcaccctggacaccttcagaacccccgccgtgagcgtggtgttccccctgtgccagttcgagagaaagaagagcttctag

SEQ ID NO: 97674 - DNA, 3192 bp, Artificial Sequence
  Description of Artificial Sequence: Synthetic coding sequence
atggagtgccccagctgccagcacgtgagcaaggaggagacccccaagttctgcagccagtgcggcgagagactgccccccgccgcccccatcgccgacagcgagaacaacaacagcaccatggccagcgccagcgagggcgagatggagtgcggccaggagctgaaggaggagggcggcccctgcctgttccccggcagcgacagctggcaggagaaccccgaggagccctgcagcaaggccagctggaccgtgcaggagagcaagaagaagaagagaaagaagaagaagaagggcaacaagagcgccagcagcgagctggccagcctgcccctgagccccgccagcccctgccacctgaccctgctgagcaacccctggccccaggacaccgccctgccccacagccaggcccagcagagcggccccaccggccagcccagccagccccccggcaccgccaccacccccctggagggcgacggcctgagcgcccccaccgaggtgggcgacagccccctgcaggcccaggccctgggcgaggccggcgtggccaccggcagcgaggcccagagcagcccccagttccaggaccacaccgagggcgaggaccaggacgccagcatccccagcggcggcagaggcctgagccaggagggcaccggcccccccaccagcgccggcgagggccacagcagaaccgaggacgccgcccaggagctgctgctgcccgagagcaagggcggcagcagcgagcccggcaccgagctgcagaccaccgagcagcaggccggcgccagcgccagcatggccgtggacgccgtggccgagcccgccaacgccgtgaagggcgccggcaaggagatgaaggagaagacccagagaatgaagcagccccccgccaccaccccccccttcaagacccactgccaggaggccgagaccaagaccaaggacgagatggccgccgccgaggagaaggtgggcaagaacgagcagggcgagcccgaggacctgaagaagcccgagggcaagaacagaagcgccgccgccgtgaagaacgagaaggagcagaagaaccaggaggccgacgtgcaggaggtgaaggccagcaccctgagccccggcggcggcgtgaccgtgttcttccacgccatcatcagcctgcacttccccttcaaccccgacctgcacaaggtgttcatcagaggcggcgaggagttcggcgagagcaagtgggacagcaacatctgcgagctgcactacaccagagacctgggccacgacagagtgctggtggagggcatcgtgtgcatcagcaagaagcacctggacaagtacatcccctacaagtacgtgatctacaacggcgagagcttcgagtacgagttcatctacaagcaccagcagaagaagggcgagtacgtgaacagatgcctgttcatcaagagcagcctgctgggcagcggcgactggcaccagtactacgacatcgtgtacatgaagccccacggcagactgcagaaggtgatgaaccacatcaccgacggccccagaaaggacctggtgaagggcaagcagatcgccgccgccctgatgctggacagcaccttcagcatcctgcagacctgggacaccatcaacctgaacagcttcttcacccagttcgagcagttctgcttcgtgctgcagcagcccatgatctacgagggccaggcccagctgtggaccgacctgcagtacagagagaaggaggtgaagagatacctgtggcagcacctgaagaagcacgtggtgcccctgcccgacggcaagagcaccgacttcctgcccgtggactgccccgtgagaagcaagctgaagaccggcctgatcgtgctgttcgtggtggagaagatcgagctgctgctggagggcagcctggactggctgtgccacctgctgaccagcgacgccagcagccccgacgagttccacagagacctgagccacatcctgggcatcccccagagctggagactgtacctggtgaacctgtgccagagatgcatggacaccagaacctacacctggctgggcgccctgcccgtgctgcactgctgcatggagctggcccccagacacaaggacgcctggagacagcccgaggacacctgggccgccctggagggcctgagcttcagccccttcagagagcagatgctggacaccagcagcctgctgcagttcatgagagagaagcagcacctgctgagcatcgacgagcccctgttcagaagctggttcagcctgctgcccctgagccacctggtgatgtacatggagaacttcatcgagcacctgggcagattccccgcccacatcctggactgcctgagcggcatctactacagactgcccggcctggagcaggtgctgaacacccaggacgtgcaggacgtgcagaacgtgcagaacatcctggagatgctgctgagactgctggacacctacagagacaagatccccgaggaggccctgagccccagctacctgaccgtgtgcctgaagctgcacgaggccatctgcagcagcaccaagctgctgaagttctacgagctgcccgccctgagcgccgagatcgtgtgcagaatgatcagactgctgagcctggtggacagcgccggccagagagacgagaccggcaacaacagcgtgcagaccgtgttccagggcaccctggccgccaccaagagatggctgagagaggtgttcaccaagaacatgctgaccagcagcggcgccagcttcacctacgtgaaggagatcgaggtgtggagaagactggtggagatccagttccccgccgagcacggctggaaggagagcctgctgggcgacatggagtggagactgaccaaggaggagcccctgagccagatcaccgcctactgcaacagctgctgggacaccaagggcctggaggacagcgtggccaagaccttcgagaagtgcatcatcgaggccgtgagcagcgcctgccaggtgaacaacctgagcagctgggagaccgacagcggcagccagctgtgcagcgccatgacccagctgagagccatgaagcaccccctgggcctgagcagcagcgccaacagcgagatcggcaagtgggcccccagcagcctggccaagggcaacggcgccgagatctag

SEQ ID NO: 97675 - DNA, 9843 bp, Artificial Sequence
  Description of Artificial Sequence: Synthetic coding sequence
atggtgtgcgacggcgactgggagcactgctacctgcccagcgccttcagccagcacaaggtgttcgtgaccccccaggcccccctggaggccatccaggcctacctggccggccactacagagtgcccaagcagaccctgagcgccgccgccgtgttcaacgacagactgtgcgtgggcatcgtggccagcgagagagccggcgtgggcaagagcctgtacgtgaagagactgcacgacaagatgaagatgcagctgaacgtgaagaacgtgcccctgaagaccatcagactgatcgacccccaggtggacgagagcagagtgctgggcgccctgctgcccttcctggacgcccagtaccagaaggtgcccgtgctgttccacctggacgtgaccagcagcgtgcagaccggcatctgggtgttcctgttcaagctgctgatcctgcagtacctgatggacatcaacggcaagatgtggctgagaaacccctgccacctgtacatcgtggagatcctggagagaagaaccagcgtgcccagcagaagcagcagcgccctgagaaccagagtgccccagttcagcttcctggacatcttccccaaggtgacctgcagaccccccaaggaggtgatcgacatggagctgagcgccctgagaagcgacaccgagcccggcatggacctgtgggagttctgcagcgagaccttccagagaccctaccagtacctgagaagattcaaccagaaccaggacctggacaccttccagtaccaggagggcagcgtggagggcacccccgaggagtgcctgcagcacttcctgttccactgcggcgtgatcaaccccagctggagcgagctgagaaacttcgccagattcctgaactaccagctgagagactgcgaggccagcctgttctgcaaccccagcttcatcggcgacaccctgagaggcttcaagaagttcgtggtgaccttcatgatcttcatggccagagacttcgccacccccagcctgcacaccagcgaccagagccccggcaagcacatggtgaccatggacggcgtgagagaggaggacctggcccccttcagcctgagaaagagatgggagagcgagccccacccctacgtgttcttcaacgacgaccacaccaccatgaccttcatcggcttccacctgcagcccaacatcaacggcagcgtggacgccatcagccacctgaccggcaaggtgatcaagagagacgtgatgaccagagacctgtaccagggcctgctgctgcagagagtgcccttcaacgtggacttcgacaagctgcccagacacaagaagctggagagactgtgcctgaccctgggcatcccccaggccaccgaccccgacaagacctacgagctgaccaccgacaacatgctgaagatcctggccatcgagatgagattcagatgcggcatccccgtgatcatcatgggcgagaccggctgcggcaagaccagactgatcaagttcctgagcgacctgagaagaggcggcaccaacgccgacaccatcaagctggtgaaggtgcacggcggcaccaccgccgacatgatctacagcagagtgagagaggccgagaacgtggccttcgccaacaaggaccagcaccagctggacaccatcctgttcttcgacgaggccaacaccaccgaggccatcagctgcatcaaggaggtgctgtgcgaccacatggtggacggccagcccctggccgaggacagcggcctgcacatcatcgccgcctgcaacccctacagaaagcacagcgaggagatgatctgcagactggagagcgccggcctgggctacagagtgagcatggaggagaccgccgacagactgggcagcatccccctgagacagctggtgtacagagtgcacgccctgccccccagcctgatccccctggtgtgggacttcggccagctgagcgacgtggccgagaagctgtacatccagcagatcgtgcagagactggtggagagcatcagcctggacgagaacggcaccagagtgatcaccgaggtgctgtgcgccagccagggcttcatgagaaagaccgaggacgagtgcagcttcgtgagcctgagagacgtggagagatgcgtgaaggtgttcagatggttccacgagcacagcgccatgctgctggcccagctgaacgccttcctgagcaagagcagcgtgagcaagaaccacaccgagagagaccccgtgctgtggagcctgatgctggccatcggcgtgtgctaccacgccagcctggagaagaaggacagctacagaaaggccatcgccagattcttccccaagccctacgacgacagcagactgctgctggacgagatcaccagagcccaggacctgttcctggacggcgtgcccctgagaaagaccatcgccaagaacctggccctgaaggagaacgtgttcatgatggtggtgtgcatcgagctgaagatccccctgttcctggtgggcaagcccggcagcagcaagagcctggccaagaccatcgtggccgacgccatgcagggccccgccgcctacagcgacctgttcagaagcctgaagcaggtgcacctggtgagcttccagtgcagcccccacagcaccccccagggcatcatcagcaccttcagacagtgcgccagattccagcagggcaaggacctgcagcagtacgtgagcgtggtggtgctggacgaggtgggcctggccgaggacagccccaagatgcccctgaagaccctgcaccccctgctggaggacggctgcatcgaggacgaccccgccccccacaagaaggtgggcttcgtgggcatcagcaactgggccctggaccccgccaagatgaacagaggcatcttcgtgagcagaggcagccccaacgagaccgagctgatcgagagcgccaagggcatctgcagcagcgacatcctggtgcaggacagagtgcagggctacttcgccagcttcgccaaggcctacgagaccgtgtgcaagagacaggacaaggagttcttcggcctgagagactactacagcctgatcaagatggtgttcgccgccgccaaggccagcaacagaaagcccagcccccaggacatcgcccaggccgtgctgagaaacttcagcggcaaggacgacatccaggccctggacatcttcctggccaacctgcccgaggccaagtgcagcgaggaggtgagccccatgcagctgatcaagcagaacatcttcggccccagccagaaggtgcccggcggcgagcaggaggacgccgagagcagatacctgctggtgctgaccaagaactacgtggccctgcagatcctgcagcagaccttcttcgagggcgaccagcagcccgagatcatcttcggcagcggcttccccaaggaccaggagtacacccagctgtgcagaaacatcaacagagtgaagatctgcatggagaccggcaagatggtgctgctgctgaacctgcagaacctgtacgagagcctgtacgacgccctgaaccagtactacgtgcacctgggcggccagaagtacgtggacctgggcctgggcacccacagagtgaagtgcagagtgcaccccaacttcagactgatcgtgatcgaggagaaggacgtggtgtacaagcacttccccatccccctgatcaacagactggagaagcactacctggacatcaacaccgtgctggagaagtggcagaagagcatcgtggaggagctgtgcgcctgggtggagaagttcatcaacgtgaaggcccaccacttccagaagagacacaagtacagccccagcgacgtgttcatcggctaccacagcgacgcctgcgccagcgtggtgctgcaggtgatcgagagacagggccccagagccctgaccgaggagctgcaccagaaggtgagcgaggaggccaagagcatcctgctgaactgcgccacccccgacgccgtggtgagactgagcgcctacagcctgggcggcttcgccgccgagtggctgagccaggagtacttccacagacagagacacaacagcttcgccgacttcctgcaggcccacctgcacaccgccgacctggagagacacgccatcttcaccgagatcaccaccttcagcagactgctgaccagccacgactgcgagatcctggagagcgaggtgaccggcagagcccccaagcccaccctgctgtggctgcagcagttcgacaccgagtacagcttcctgaaggaggtgagaaactgcctgaccaacaccgccaagtgcaagatcctgatcttccagaccgacttcgaggacggcatcagaagcgcccagctgatcgccagcgccaagtacagcgtgatcaacgagatcaacaagatcagagagaacgaggacagaatcttcgtgtacttcatcaccaagctgagcagagtgggcagaggcaccgcctacgtgggcttccacggcggcctgtggcagagcgtgcacatcgacgacctgagaagaagcaccctgatggtgagcgacgtgaccagactgcagcacgtgaccatcagccagctgttcgcccccggcgacctgcccgagctgggcctggagcacagagccgaggacggccacgaggaggccatggagaccgaggccagcaccagcggcgaggtggccgaggtggccgaggaggccatggagaccgagagcagcgagaaggtgggcaaggagaccagcgagctgggcggcagcgacgtgagcatcctggacaccaccagactgctgagaagctgcgtgcagagcgccgtgggcatgctgagagaccagaacgagagctgcaccagaaacatgagaagagtggtgctgctgctgggcctgctgaacgaggacgacgcctgccacgccagcttcctgagagtgagcaagatgagactgagcgtgttcctgaagaagcaggaggagagccagttccaccccctggagtggctggccagagaggcctgcaaccaggacgccctgcaggaggccggcaccttcagacacaccctgtggaagagagtgcagggcgccgtgacccccctgctggccagcatgatcagcttcatcgacagagacggcaacctggagctgctgaccagacccgacacccccccctgggccagagacctgtggatgttcatcttcagcgacaccatgctgctgaacatccccctggtgatgaacaacgagagacacaagggcgagatggcctacatcgtggtgcagaaccacatgaacctgagcgagaacgccagcaacaacgtgcccttcagctggaagatcaaggactacctggaggagctgtgggtgcaggcccagtacatcaccgacgccgagggcctgcccaagaagttcgtggacatcttccagcagacccccctgggcagattcctggcccagctgcacggcgagccccagcaggagctgctgcagtgctacctgaaggacttcatcctgctgaccatgagagtgagcaccgaggaggagctgaagttcctgcagatggccctgtggagctgcaccagaaagctgaaggccgccagcgaggcccccgaggaggaggtgagcctgccctgggtgcacctggcctaccagagattcagaagcagactgcagaacttcagcagaatcctgaccatctacccccaggtgctgcacagcctgatggaggccagatggaaccacgagctggccggctgcgagatgaccctggacgccttcgccgccatggcctgcaccgagatgctgaccagaaacaccctgaagcccagcccccaggcctggctgcagctggtgaagaacctgagcatgcccctggagctgatctgcagcgacgagcacatgcagggcagcggcagcctggcccaggccgtgatcagagaggtgagagcccagtggagcagaatcttcagcaccgccctgttcgtggagcacgtgctgctgggcaccgagagcagagtgcccgagctgcagggcctggtgaccgagcacgtgttcctgctggacaagtgcctgagagagaacagcgacgtgaagacccacggccccttcgaggccgtgatgagaaccctgtgcgagtgcaaggagaccgccagcaagaccctgagcagattcggcatccagccctgcagcatctgcctgggcgacgccaaggaccccgtgtgcctgccctgcgaccacgtgcactgcctgagatgcctgagagcctggttcgccagcgagcagatgatctgcccctactgcctgaccgccctgcccgacgagttcagccccgccgtgagccaggcccacagagaggccatcgagaagcacgccagattcagacagatgtgcaacagcttcttcgtggacctggtgagcaccatctgcttcaaggacaacgccccccccgagaaggaggtgatcgagagcctgctgagcctgctgttcgtgcagaagggcagactgagagacgccgcccagagacactgcgagcacaccaagagcctgagccccttcaacgacgtggtggacaagacccccgtgatcagaagcgtgatcctgaagctgctgctgaagtacagcttccacgacgtgaaggactacatccaggagtacctgaccctgctgaagaagaaggccttcatcaccgaggacaagaccgagctgtacatgctgttcatcaactgcctggaggacagcatcctggagaagaccagcgcctacagcagaaacgacgagctgaaccacctggaggaggagggcagattcctgaaggcctacagccccgccagcagaggcagagagcccgccaacgaggccagcgtggagtacctgcaggaggtggccagaatcagactgtgcctggacagagccgccgacttcctgagcgagcccgagggcggccccgagatggccaaggagaagcagtgctacctgcagcaggtgaagcagttctgcatcagagtggagaacgactggcacagagtgtacctggtgagaaagctgagcagccagagaggcatggagttcgtgcagggcctgagcaagcccggcagaccccaccagtgggtgttccccaaggacgtggtgaagcagcagggcctgagacaggaccaccccggccagatggacagatacctggtgtacggcgacgagtacaaggccctgagagacgccgtggccaaggccgtgctggagtgcaagcccctgggcatcaagaccgccctgaaggcctgcaagaccccccagagccagcagagcgcctacttcctgctgaccctgttcagagaggtggccatcctgtacagaagccacaacgccagcctgcaccccacccccgagcagtgcgaggccgtgagcaagttcatcggcgagtgcaagatcctgagcccccccgacatcagcagattcgccaccagcctggtggacaacagcgtgcccctgctgagagccggccccagcgacagcaacctggacggcaccgtgaccgagatggccatccacgccgccgccgtgctgctgtgcggccagaacgagctgctggagcccctgaagaacctggccttcagccccgccaccatggcccacgccttcctgcccaccatgcccgaggacctgctggcccaggccagaagatggaagggcctggagagagtgcactggtacacctgccccaacggccacccctgcagcgtgggcgagtgcggcagacccatggagcagagcatctgcatcgactgccacgcccccatcggcggcatcgaccacaagcccagagacggcttccacctggtgaaggacaaggccgacagaacccagaccggccacgtgctgggcaacccccagagaagagacgtggtgacctgcgacagaggcctgccccccgtggtgttcctgctgatcagactgctgacccacctggccctgctgctgggcgccagccagagcagccaggccctgatcaacatcatcaagccccccgtgagagaccccaagggcttcctgcagcagcacatcctgaaggacctggagcagctggccaagatgctgggccacagcgccgacgagaccatcggcgtggtgcacctggtgctgagaagactgctgcaggagcagcaccagctgagcagcagaagactgctgaacttcgacaccgagctgagcaccaaggagatgagaaacaactgggagaaggagatcgccgccgtgatcagccccgagctggagcacctggacaagaccctgcccaccatgaacaacctgatcagccaggacaagagaatcagcagcaaccccgtggccaagatcatctacggcgaccccgtgaccttcctgccccacctgcccagaaagagcgtggtgcactgcagcaagatctggagctgcagaaagagaatcaccgtggagtacctgcagcacatcgtggagcagaagaacggcaaggagagagtgcccatcctgtggcacttcctgcagaaggaggccgagctgagactggtgaagttcctgcccgagatcctggccctgcagagagacctggtgaagcagttccagaacgtgcagcaggtggagtacagcagcatcagaggcttcctgagcaagcacagcagcgacggcctgagacagctgctgcacaacagaatcaccgtgttcctgagcacctggaacaagctgagaagaagcctggagaccaacggcgagatcaacctgcccaaggactactgcagcaccgacctggacctggacaccgagttcgagatcctgctgcccagaagaagaggcctgggcctgtgcgccaccgccctggtgagctacctgatcagactgcacaacgagatcgtgtacgccgtggagaagctgagcaaggagaacaacagctacagcgtggacgccgccgaggtgaccgagctgcacgtgatcagctacgaggtggagagagacctgacccccctgatcctgagcaactgccagtaccaggtggaggagggcagagagaccgtgcaggagttcgacctggagaagatccagagacagatcgtgagcagattcctgcagggcaagcccagactgagcctgaagggcatccccaccctggtgtacagacacgactggaactacgagcacctgttcatggacatcaagaacaagatggcccaggacagcctgcccagcagcgtgatcagcgccatcagcggccagctgcagagctacagcgacgcctgcgaggtgctgagcgtggtggaggtgaccctgggcttcctgagcaccgccggcggcgaccccaacatgcagctgaacgtgtacacccaggacatcctgcagatgggcgaccagaccatccacgtgctgaaggccctgaacagatgccagctgaagcacaccatcgccctgtggcagttcctgagcgcccacaagagcgagcagctgctgagactgcacaaggagcccttcggcgagatcagcagcagatacaaggccgacctgagccccgagaacgccaagctgctgagcaccttcctgaaccagaccggcctggacgccttcctgctggagctgcacgagatgatcatcctgaagctgaagaacccccagacccagaccgaggagagattcagaccccagtggagcctgagagacaccctggtgagctacatgcagaccaaggagagcgagatcctgcccgagatggccagccagttccccgaggagatcctgctggccagctgcgtgagcgtgtggaagaccgccgccgtgctgaagtggaacagagagatgagatag

SEQ ID NO: 97676 - DNA, 4653 bp, Artificial Sequence
  Description of Artificial Sequence: Synthetic coding sequence
atggagtgccccagctgccagcacgtgagcaaggaggagacccccaagttctgcagccagtgcggcgagagactgccccccgccgcccccatcgccgacagcgagaacaacaacagcaccatggccagcgccagcgagggcgagatggagtgcggccaggagctgaaggaggagggcggcccctgcctgttccccggcagcgacagctggcaggagaaccccgaggagccctgcagcaaggccagctggaccgtgcaggagagcaagaagaagaagagaaagaagaagaagaagggcaacaagagcgccagcagcgagctggccagcctgcccctgagccccgccagcccctgccacctgaccctgctgagcaacccctggccccaggacaccgccctgccccacagccaggcccagcagagcggccccaccggccagcccagccagccccccggcaccgccaccacccccctggagggcgacggcctgagcgcccccaccgaggtgggcgacagccccctgcaggcccaggccctgggcgaggccggcgtggccaccggcagcgaggcccagagcagcccccagttccaggaccacaccgagggcgaggaccaggacgccagcatccccagcggcggcagaggcctgagccaggagggcaccggcccccccaccagcgccggcgagggccacagcagaaccgaggacgccgcccaggagctgctgctgcccgagagcaagggcggcagcagcgagcccggcaccgagctgcagaccaccgagcagcaggccggcgccagcgccagcatggccgtggacgccgtggccgagcccgccaacgccgtgaagggcgccggcaaggagatgaaggagaagacccagagaatgaagcagccccccgccaccaccccccccttcaagacccactgccaggaggccgagaccaagaccaaggacgagatggccgccgccgaggagaaggtgggcaagaacgagcagggcgagcccgaggacctgaagaagcccgagggcaagaacagaagcgccgccgccgtgaagaacgagaaggagcagaagaaccaggaggccgacgtgcaggaggtgaaggccagcaccctgagccccggcggcggcgtgaccgtgttcttccacgccatcatcagcctgcacttccccttcaaccccgacctgcacaaggtgttcatcagaggcggcgaggagttcggcgagagcaagtgggacagcaacatctgcgagctgcactacaccagagacctgggccacgacagagtgctggtggagggcatcgtgtgcatcagcaagaagcacctggacaagtacatcccctacaagtacgtgatctacaacggcgagagcttcgagtacgagttcatctacaagcaccagcagaagaagggcgagtacgtgaacagatgcctgttcatcaagagcagcctgctgggcagcggcgactggcaccagtactacgacatcgtgtacatgaagccccacggcagactgcagaaggtgatgaaccacatcaccgacggccccagaaaggacctggtgaagggcaagcagatcgccgccgccctgatgctggacagcaccttcagcatcctgcagacctgggacaccatcaacctgaacagcttcttcacccagttcgagcagttctgcttcgtgctgcagcagcccatgatctacgagggccaggcccagctgtggaccgacctgcagtacagagagaaggaggtgaagagatacctgtggcagcacctgaagaagcacgtggtgcccctgcccgacggcaagagcaccgacttcctgcccgtggactgccccgtgagaagcaagctgaagaccggcctgatcgtgctgttcgtggtggagaagatcgagctgctgctggagggcagcctggactggctgtgccacctgctgaccagcgacgccagcagccccgacgagttccacagagacctgagccacatcctgggcatcccccagagctggagactgtacctggtgaacctgtgccagagatgcatggacaccagaacctacacctggctgggcgccctgcccgtgctgcactgctgcatggagctggcccccagacacaaggacgcctggagacagcccgaggacacctgggccgccctggagggcctgagcttcagccccttcagagagcagatgctggacaccagcagcctgctgcagttcatgagagagaagcagcacctgctgagcatcgacgagcccctgttcagaagctggttcagcctgctgcccctgagccacctggtgatgtacatggagaacttcatcgagcacctgggcagattccccgcccacatcctggactgcctgagcggcatctactacagactgcccggcctggagcaggtgctgaacacccaggacgtgcaggacgtgcagaacgtgcagaacatcctggagatgctgctgagactgctggacacctacagagacaagatccccgaggaggccctgagccccagctacctgaccgtgtgcctgaagctgcacgaggccatctgcagcagcaccaagctgctgaagttctacgagctgcccgccctgagcgccgagatcgtgtgcagaatgatcagactgctgagcctggtggacagcgccggccagagagacgagaccggcaacaacagcgtgcagaccgtgttccagggcaccctggccgccaccaagagatggctgagagaggtgttcaccaagaacatgctgaccagcagcggcgccagcttcacctacgtgaaggagatcgaggtgtggagaagactggtggagatccagttccccgccgagcacggctggaaggagagcctgctgggcgacatggagtggagactgaccaaggaggagcccctgagccagatcaccgcctactgcaacagctgctgggacaccaagggcctggaggacagcgtggccaagaccttcgagaagtgcatcatcgaggccgtgagcagcgcctgccagagccagaccagcatcctgcagggcttcagctacagcgacctgagaaagttcggcatcgtgctgagcgccgtgatcaccaagagctggcccagaaccgccgacaacttcaacgacatcctgaagcacctgctgaccctggccgacgtgaagcacgtgttcagactgtgcggcaccgacgagaagatcctggccaacgtgaccgaggacgccaagagactgatcgccgtggccgacagcgtgctgaccaaggtggtgggcgacctgctgagcggcaccatcctggtgggccagctggagctgatcatcaagcacaagaaccagttcctggacatctggcagctgagagagaagagcctgagcccccaggacgagcagtgcgccgtggaggaggccctggactggagaagagaggagctgctgctgctgaagaaggagaagagatgcgtggacagcctgctgaagatgtgcggcaacgtgaagcacctgatccaggtggacttcggcgtgctggccgtgagacacagccaggacctgagcagcaagagactgaacgacaccgtgaccgtgagactgagcaccagcagcaacagccagagagccacccactaccacctgagcagccaggtgcaggagatggccggcaagatcgacctgctgagagacagccacatcttccagctgttctggagagaggccgccgagcccctgagcgagcccaaggaggaccaggaggccgccgagctgctgagcgagcccgaggaggagagcgagagacacatcctggagctggaggaggtgtacgactacctgtaccagcccagctacagaaagttcatcaagctgcaccaggacctgaagagcggcgaggtgaccctggccgagatcgacgtgatcttcaaggacttcgtgaacaagtacaccgacctggacagcgagctgaagatcatgtgcaccgtggaccaccaggaccagagagactggatcaaggacagagtggagcagatcaaggagtaccaccacctgcaccaggccgtgcacgccgccaaggtgatcctgcaggtgaaggagagcctgggcctgaacggcgacttcagcgtgctgaacaccctgctgaacttcaccgacaacttcgacgacttcagaagagagaccctggaccagatcaaccaggagctgatccaggccaagaagctgctgcaggacatcagcgaggccagatgcaagggcctgcaggccctgagcctgagaaaggagttcatctgctgggtgagagaggccctgggcggcatcaacgagctgaaggtgttcgtggacctggccagcatcagcgccggcgagaacgacatcgacgtggacagagtggcctgcttccacgacgccgtgcagggctacgccagcctgctgttcaagctggaccccagcgtggacttcagcgccttcatgaagcacctgaagaagctgtggaaggccctggacaaggaccagtacctgcccagaaagctggtgagcctgatcctgagcctgatgcagatcctgctgaacagagccctgctgagcaacgtgagagccgtgaccgtggagatggtggcccacctgtgcggcagattcgtgcacagcagattccagtag

SEQ ID NO: 97677 - DNA, 15771 bp, Artificial Sequence
  Description of Artificial Sequence: Synthetic coding sequence
atggagtgccccagctgccagcacgtgagcaaggaggagacccccaagttctgcagccagtgcggcgagagactgccccccgccgcccccatcgccgacagcgagaacaacaacagcaccatggccagcgccagcgagggcgagatggagtgcggccaggagctgaaggaggagggcggcccctgcctgttccccggcagcgacagctggcaggagaaccccgaggagccctgcagcaaggccagctggaccgtgcaggagggcgccaccagcgaggtgctggtggacgccgccgtggacctgatcagcgacgagtgggaggccgccaacgccatccccagcaagagaagaaagcaggacgccgcccccctggaggccgccagcgtgcccagcgccgactgcgagcagagcaagaagaagaagagaaagaagaagaagaagggcaacaagagcgccagcagcgagctggccagcctgcccctgagccccgccagcccctgccacctgaccctgctgagcaacccctggccccaggacaccgccctgccccacagccaggcccagcagagcggccccaccggccagcccagccagccccccggcaccgccaccacccccctggagggcgacggcctgagcgcccccaccgaggtgggcgacagccccctgcaggcccaggccctgggcgaggccggcgtggccaccggcagcgaggcccagagcagcccccagttccaggaccacaccgagggcgaggaccaggacgccagcatccccagcggcggcagaggcctgagccaggagggcaccggcccccccaccagcgccggcgagggccacagcagaaccgaggacgccgcccaggagctgctgctgcccgagagcaagggcggcagcagcgagcccggcaccgagctgcagaccaccgagcagcaggccggcgccagcgccagcatggccgtggacgccgtggccgagcccgccaacgccgtgaagggcgccggcaaggagatgaaggagaagacccagagaatgaagcagccccccgccaccaccccccccttcaagacccactgccaggaggccgagaccaagaccaaggacgagatggccgccgccgaggagaaggtgggcaagaacgagcagggcgagcccgaggacctgaagaagcccgagggcaagaacagaagcgccgccgccgtgaagaacgagaaggagcagaagaaccaggaggccgacgtgcaggaggtgaaggccagcaccctgagccccggcggcggcgtgaccgtgttcttccacgccatcatcagcctgcacttccccttcaaccccgacctgcacaaggtgttcatcagaggcggcgaggagttcggcgagagcaagtgggacagcaacatctgcgagctgcactacaccagagacctgggccacgacagagtgctggtggagggcatcgtgtgcatcagcaagaagcacctggacaagtacatcccctacaagtacgtgatctacaacggcgagagcttcgagtacgagttcatctacaagcaccagcagaagaagggcgagtacgtgaacagatgcctgttcatcaagagcagcctgctgggcagcggcgactggcaccagtactacgacatcgtgtacatgaagccccacggcagactgcagaaggtgatgaaccacatcaccgacggccccagaaaggacctggtgaagggcaagcagatcgccgccgccctgatgctggacagcaccttcagcatcctgcagacctgggacaccatcaacctgaacagcttcttcacccagttcgagcagttctgcttcgtgctgcagcagcccatgatctacgagggccaggcccagctgtggaccgacctgcagtacagagagaaggaggtgaagagatacctgtggcagcacctgaagaagcacgtggtgcccctgcccgacggcaagagcaccgacttcctgcccgtggactgccccgtgagaagcaagctgaagaccggcctgatcgtgctgttcgtggtggagaagatcgagctgctgctggagggcagcctggactggctgtgccacctgctgaccagcgacgccagcagccccgacgagttccacagagacctgagccacatcctgggcatcccccagagctggagactgtacctggtgaacctgtgccagagatgcatggacaccagaacctacacctggctgggcgccctgcccgtgctgcactgctgcatggagctggcccccagacacaaggacgcctggagacagcccgaggacacctgggccgccctggagggcctgagcttcagccccttcagagagcagatgctggacaccagcagcctgctgcagttcatgagagagaagcagcacctgctgagcatcgacgagcccctgttcagaagctggttcagcctgctgcccctgagccacctggtgatgtacatggagaacttcatcgagcacctgggcagattccccgcccacatcctggactgcctgagcggcatctactacagactgcccggcctggagcaggtgctgaacacccaggacgtgcaggacgtgcagaacgtgcagaacatcctggagatgctgctgagactgctggacacctacagagacaagatccccgaggaggccctgagccccagctacctgaccgtgtgcctgaagctgcacgaggccatctgcagcagcaccaagctgctgaagttctacgagctgcccgccctgagcgccgagatcgtgtgcagaatgatcagactgctgagcctggtggacagcgccggccagagagacgagaccggcaacaacagcgtgcagaccgtgttccagggcaccctggccgccaccaagagatggctgagagaggtgttcaccaagaacatgctgaccagcagcggcgccagcttcacctacgtgaaggagatcgaggtgtggagaagactggtggagatccagttccccgccgagcacggctggaaggagagcctgctgggcgacatggagtggagactgaccaaggaggagcccctgagccagatcaccgcctactgcaacagctgctgggacaccaagggcctggaggacagcgtggccaagaccttcgagaagtgcatcatcgaggccgtgagcagcgcctgccagagccagaccagcatcctgcagggcttcagctacagcgacctgagaaagttcggcatcgtgctgagcgccgtgatcaccaagagctggcccagaaccgccgacaacttcaacgacatcctgaagcacctgctgaccctggccgacgtgaagcacgtgttcagactgtgcggcaccgacgagaagatcctggccaacgtgaccgaggacgccaagagactgatcgccgtggccgacagcgtgctgaccaaggtggtgggcgacctgctgagcggcaccatcctggtgggccagctggagctgatcatcaagcacaagaaccagttcctggacatctggcagctgagagagaagagcctgagcccccaggacgagcagtgcgccgtggaggaggccctggactggagaagagaggagctgctgctgctgaagaaggagaagagatgcgtggacagcctgctgaagatgtgcggcaacgtgaagcacctgatccaggtggacttcggcgtgctggccgtgagacacagccaggacctgagcagcaagagactgaacgacaccgtgaccgtgagactgagcaccagcagcaacagccagagagccacccactaccacctgagcagccaggtgcaggagatggccggcaagatcgacctgctgagagacagccacatcttccagctgttctggagagaggccgccgagcccctgagcgagcccaaggaggaccaggaggccgccgagctgctgagcgagcccgaggaggagagcgagagacacatcctggagctggaggaggtgtacgactacctgtaccagcccagctacagaaagttcatcaagctgcaccaggacctgaagagcggcgaggtgaccctggccgagatcgacgtgatcttcaaggacttcgtgaacaagtacaccgacctggacagcgagctgaagatcatgtgcaccgtggaccaccaggaccagagagactggatcaaggacagagtggagcagatcaaggagtaccaccacctgcaccaggccgtgcacgccgccaaggtgatcctgcaggtgaaggagagcctgggcctgaacggcgacttcagcgtgctgaacaccctgctgaacttcaccgacaacttcgacgacttcagaagagagaccctggaccagatcaaccaggagctgatccaggccaagaagctgctgcaggacatcagcgaggccagatgcaagggcctgcaggccctgagcctgagaaaggagttcatctgctgggtgagagaggccctgggcggcatcaacgagctgaaggtgttcgtggacctggccagcatcagcgccggcgagaacgacatcgacgtggacagagtggcctgcttccacgacgccgtgcagggctacgccagcctgctgttcaagctggaccccagcgtggacttcagcgccttcatgaagcacctgaagaagctgtggaaggccctggacaaggaccagtacctgcccagaaagctgtgcgacagcgccagaaacctggagtggctgaagaccgtgaacgagagccacggcagcgtggagagaagcagcctgaccctggccaccgccatcaaccagagaggcatctacgtgatccaggcccccaagggcggccagaagatcagccccgacaccgtgctgcacctgatcctgcccgagagccccggcagccacgaggagagcagagagtacagcctggaggaggtgaaggagctgctgaacaagctgatgctgatgagcggcaagaaggacagaaacaacaccgaggtggagagattcagcgaggtgttctgcagcgtgcagagactgagccaggccttcatcgacctgcacagcgccggcaacatgctgttcagaacctggatcgccatggcctactgcagccccaagcagggcgtgagcctgcagatggacttcggcctggacctggtgaccgagctgaaggagggcggcgacgtgaccgagctgctggccgccctgtgcagacagatggagcacttcctggacagctggaagagattcgtgacccagaagagaatggagcacttctacctgaacttctacaccgccgagcagctggtgtacctgagcaccgagctgagaaagcagccccccagcgacgccgccctgaccatgctgagcttcatcaagagcaactgcaccctgagagacgtgctgagagccagcgtgggctgcggcagcgaggccgccagatacagaatgagaagagtgatggaggagctgcccctgatgctgctgagcgagttcagcctggtggacaagctgagaatcatcatggagcagagcatgagatgcctgcccgccttcctgcccgactgcctggacctggagaccctgggccactgcctggcccacctggccggcatgggcggcagccccgtggagagatgcctgcccagaggcctgcaggtgggccagcccaacctggtggtgtgcggccacagcgaggtgctgcccgccgccctggccgtgtacatgcagacccccagccagcccctgcccacctacgacgaggtgctgctgtgcacccccgccaccaccttcgaggaggtggccctgctgctgagaagatgcctgaccctgggcagcctgggccacaaggtgtacagcctgctgttcgccgaccagctgagctacgaggtggccagacaggccgaggagctgttccacaacctgtgcacccagcagcacagagaggactaccagctggtgatggtgtgcgacggcgactgggagcactgctacctgcccagcgccttcagccagcacaaggtgttcgtgaccccccaggcccccctggaggccatccaggcctacctggccggccactacagagtgcccaagcagaccctgagcgccgccgccgtgttcaacgacagactgtgcgtgggcatcgtggccagcgagagagccggcgtgggcaagagcctgtacgtgaagagactgcacgacaagatgaagatgcagctgaacgtgaagaacgtgcccctgaagaccatcagactgatcgacccccaggtggacgagagcagagtgctgggcgccctgctgcccttcctggacgcccagtaccagaaggtgcccgtgctgttccacctggacgtgaccagcagcgtgcagaccggcatctgggtgttcctgttcaagctgctgatcctgcagtacctgatggacatcaacggcaagatgtggctgagaaacccctgccacctgtacatcgtggagatcctggagagaagaaccagcgtgcccagcagaagcagcagcgccctgagaaccagagtgccccagttcagcttcctggacatcttccccaaggtgacctgcagaccccccaaggaggtgatcgacatggagctgagcgccctgagaagcgacaccgagcccggcatggacctgtgggagttctgcagcgagaccttccagagaccctaccagtacctgagaagattcaaccagaaccaggacctggacaccttccagtaccaggagggcagcgtggagggcacccccgaggagtgcctgcagcacttcctgttccactgcggcgtgatcaaccccagctggagcgagctgagaaacttcgccagattcctgaactaccagctgagagactgcgaggccagcctgttctgcaaccccagcttcatcggcgacaccctgagaggcttcaagaagttcgtggtgaccttcatgatcttcatggccagagacttcgccacccccagcctgcacaccagcgaccagagccccggcaagcacatggtgaccatggacggcgtgagagaggaggacctggcccccttcagcctgagaaagagatgggagagcgagccccacccctacgtgttcttcaacgacgaccacaccaccatgaccttcatcggcttccacctgcagcccaacatcaacggcagcgtggacgccatcagccacctgaccggcaaggtgatcaagagagacgtgatgaccagagacctgtaccagggcctgctgctgcagagagtgcccttcaacgtggacttcgacaagctgcccagacacaagaagctggagagactgtgcctgaccctgggcatcccccaggccaccgaccccgacaagacctacgagctgaccaccgacaacatgctgaagatcctggccatcgagatgagattcagatgcggcatccccgtgatcatcatgggcgagaccggctgcggcaagaccagactgatcaagttcctgagcgacctgagaagaggcggcaccaacgccgacaccatcaagctggtgaaggtgcacggcggcaccaccgccgacatgatctacagcagagtgagagaggccgagaacgtggccttcgccaacaaggaccagcaccagctggacaccatcctgttcttcgacgaggccaacaccaccgaggccatcagctgcatcaaggaggtgctgtgcgaccacatggtggacggccagcccctggccgaggacagcggcctgcacatcatcgccgcctgcaacccctacagaaagcacagcgaggagatgatctgcagactggagagcgccggcctgggctacagagtgagcatggaggagaccgccgacagactgggcagcatccccctgagacagctggtgtacagagtgcacgccctgccccccagcctgatccccctggtgtgggacttcggccagctgagcgacgtggccgagaagctgtacatccagcagatcgtgcagagactggtggagagcatcagcctggacgagaacggcaccagagtgatcaccgaggtgctgtgcgccagccagggcttcatgagaaagaccgaggacgagtgcagcttcgtgagcctgagagacgtggagagatgcgtgaaggtgttcagatggttccacgagcacagcgccatgctgctggcccagctgaacgccttcctgagcaagagcagcgtgagcaagaaccacaccgagagagaccccgtgctgtggagcctgatgctggccatcggcgtgtgctaccacgccagcctggagaagaaggacagctacagaaaggccatcgccagattcttccccaagccctacgacgacagcagactgctgctggacgagatcaccagagcccaggacctgttcctggacggcgtgcccctgagaaagaccatcgccaagaacctggccctgaaggagaacgtgttcatgatggtggtgtgcatcgagctgaagatccccctgttcctggtgggcaagcccggcagcagcaagagcctggccaagaccatcgtggccgacgccatgcagggccccgccgcctacagcgacctgttcagaagcctgaagcaggtgcacctggtgagcttccagtgcagcccccacagcaccccccagggcatcatcagcaccttcagacagtgcgccagattccagcagggcaaggacctgcagcagtacgtgagcgtggtggtgctggacgaggtgggcctggccgaggacagccccaagatgcccctgaagaccctgcaccccctgctggaggacggctgcatcgaggacgaccccgccccccacaagaaggtgggcttcgtgggcatcagcaactgggccctggaccccgccaagatgaacagaggcatcttcgtgagcagaggcagccccaacgagaccgagctgatcgagagcgccaagggcatctgcagcagcgacatcctggtgcaggacagagtgcagggctacttcgccagcttcgccaaggcctacgagaccgtgtgcaagagacaggacaaggagttcttcggcctgagagactactacagcctgatcaagatggtgttcgccgccgccaaggccagcaacagaaagcccagcccccaggacatcgcccaggccgtgctgagaaacttcagcggcaaggacgacatccaggccctggacatcttcctggccaacctgcccgaggccaagtgcagcgaggaggtgagccccatgcagctgatcaagcagaacatcttcggccccagccagaaggtgcccggcggcgagcaggaggacgccgagagcagatacctgctggtgctgaccaagaactacgtggccctgcagatcctgcagcagaccttcttcgagggcgaccagcagcccgagatcatcttcggcagcggcttccccaaggaccaggagtacacccagctgtgcagaaacatcaacagagtgaagatctgcatggagaccggcaagatggtgctgctgctgaacctgcagaacctgtacgagagcctgtacgacgccctgaaccagtactacgtgcacctgggcggccagaagtacgtggacctgggcctgggcacccacagagtgaagtgcagagtgcaccccaacttcagactgatcgtgatcgaggagaaggacgtggtgtacaagcacttccccatccccctgatcaacagactggagaagcactacctggacatcaacaccgtgctggagaagtggcagaagagcatcgtggaggagctgtgcgcctgggtggagaagttcatcaacgtgaaggcccaccacttccagaagagacacaagtacagccccagcgacgtgttcatcggctaccacagcgacgcctgcgccagcgtggtgctgcaggtgatcgagagacagggccccagagccctgaccgaggagctgcaccagaaggtgagcgaggaggccaagagcatcctgctgaactgcgccacccccgacgccgtggtgagactgagcgcctacagcctgggcggcttcgccgccgagtggctgagccaggagtacttccacagacagagacacaacagcttcgccgacttcctgcaggcccacctgcacaccgccgacctggagagacacgccatcttcaccgagatcaccaccttcagcagactgctgaccagccacgactgcgagatcctggagagcgaggtgaccggcagagcccccaagcccaccctgctgtggctgcagcagttcgacaccgagtacagcttcctgaaggaggtgagaaactgcctgaccaacaccgccaagtgcaagatcctgatcttccagaccgacttcgaggacggcatcagaagcgcccagctgatcgccagcgccaagtacagcgtgatcaacgagatcaacaagatcagagagaacgaggacagaatcttcgtgtacttcatcaccaagctgagcagagtgggcagaggcaccgcctacgtgggcttccacggcggcctgtggcagagcgtgcacatcgacgacctgagaagaagcaccctgatggtgagcgacgtgaccagactgcagcacgtgaccatcagccagctgttcgcccccggcgacctgcccgagctgggcctggagcacagagccgaggacggccacgaggaggccatggagaccgaggccagcaccagcggcgaggtggccgaggtggccgaggaggccatggagaccgagagcagcgagaaggtgggcaaggagaccagcgagctgggcggcagcgacgtgagcatcctggacaccaccagactgctgagaagctgcgtgcagagcgccgtgggcatgctgagagaccagaacgagagctgcaccagaaacatgagaagagtggtgctgctgctgggcctgctgaacgaggacgacgcctgccacgccagcttcctgagagtgagcaagatgagactgagcgtgttcctgaagaagcaggaggagagccagttccaccccctggagtggctggccagagaggcctgcaaccaggacgccctgcaggaggccggcaccttcagacacaccctgtggaagagagtgcagggcgccgtgacccccctgctggccagcatgatcagcttcatcgacagagacggcaacctggagctgctgaccagacccgacacccccccctgggccagagacctgtggatgttcatcttcagcgacaccatgctgctgaacatccccctggtgatgaacaacgagagacacaagggcgagatggcctacatcgtggtgcagaaccacatgaacctgagcgagaacgccagcaacaacgtgcccttcagctggaagatcaaggactacctggaggagctgtgggtgcaggcccagtacatcaccgacgccgagggcctgcccaagaagttcgtggacatcttccagcagacccccctgggcagattcctggcccagctgcacggcgagccccagcaggagctgctgcagtgctacctgaaggacttcatcctgctgaccatgagagtgagcaccgaggaggagctgaagttcctgcagatggccctgtggagctgcaccagaaagctgaaggccgccagcgaggcccccgaggaggaggtgagcctgccctgggtgcacctggcctaccagagattcagaagcagactgcagaacttcagcagaatcctgaccatctacccccaggtgctgcacagcctgatggaggccagatggaaccacgagctggccggctgcgagatgaccctggacgccttcgccgccatggcctgcaccgagatgctgaccagaaacaccctgaagcccagcccccaggcctggctgcagctggtgaagaacctgagcatgcccctggagctgatctgcagcgacgagcacatgcagggcagcggcagcctggcccaggccgtgatcagagaggtgagagcccagtggagcagaatcttcagcaccgccctgttcgtggagcacgtgctgctgggcaccgagagcagagtgcccgagctgcagggcctggtgaccgagcacgtgttcctgctggacaagtgcctgagagagaacagcgacgtgaagacccacggccccttcgaggccgtgatgagaaccctgtgcgagtgcaaggagaccgccagcaagaccctgagcagattcggcatccagccctgcagcatctgcctgggcgacgccaaggaccccgtgtgcctgccctgcgaccacgtgcactgcctgagatgcctgagagcctggttcgccagcgagcagatgatctgcccctactgcctgaccgccctgcccgacgagttcagccccgccgtgagccaggcccacagagaggccatcgagaagcacgccagattcagacagatgtgcaacagcttcttcgtggacctggtgagcaccatctgcttcaaggacaacgccccccccgagaaggaggtgatcgagagcctgctgagcctgctgttcgtgcagaagggcagactgagagacgccgcccagagacactgcgagcacaccaagagcctgagccccttcaacgacgtggtggacaagacccccgtgatcagaagcgtgatcctgaagctgctgctgaagtacagcttccacgacgtgaaggactacatccaggagtacctgaccctgctgaagaagaaggccttcatcaccgaggacaagaccgagctgtacatgctgttcatcaactgcctggaggacagcatcctggagaagaccagcgcctacagcagaaacgacgagctgaaccacctggaggaggagggcagattcctgaaggcctacagccccgccagcagaggcagagagcccgccaacgaggccagcgtggagtacctgcaggaggtggccagaatcagactgtgcctggacagagccgccgacttcctgagcgagcccgagggcggccccgagatggccaaggagaagcagtgctacctgcagcaggtgaagcagttctgcatcagagtggagaacgactggcacagagtgtacctggtgagaaagctgagcagccagagaggcatggagttcgtgcagggcctgagcaagcccggcagaccccaccagtgggtgttccccaaggacgtggtgaagcagcagggcctgagacaggaccaccccggccagatggacagatacctggtgtacggcgacgagtacaaggccctgagagacgccgtggccaaggccgtgctggagtgcaagcccctgggcatcaagaccgccctgaaggcctgcaagaccccccagagccagcagagcgcctacttcctgctgaccctgttcagagaggtggccatcctgtacagaagccacaacgccagcctgcaccccacccccgagcagtgcgaggccgtgagcaagttcatcggcgagtgcaagatcctgagcccccccgacatcagcagattcgccaccagcctggtggacaacagcgtgcccctgctgagagccggccccagcgacagcaacctggacggcaccgtgaccgagatggccatccacgccgccgccgtgctgctgtgcggccagaacgagctgctggagcccctgaagaacctggccttcagccccgccaccatggcccacgccttcctgcccaccatgcccgaggacctgctggcccaggccagaagatggaagggcctggagagagtgcactggtacacctgccccaacggccacccctgcagcgtgggcgagtgcggcagacccatggagcagagcatctgcatcgactgccacgcccccatcggcggcatcgaccacaagcccagagacggcttccacctggtgaaggacaaggccgacagaacccagaccggccacgtgctgggcaacccccagagaagagacgtggtgacctgcgacagaggcctgccccccgtggtgttcctgctgatcagactgctgacccacctggccctgctgctgggcgccagccagagcagccaggccctgatcaacatcatcaagccccccgtgagagaccccaagggcttcctgcagcagcacatcctgaaggacctggagcagctggccaagatgctgggccacagcgccgacgagaccatcggcgtggtgcacctggtgctgagaagactgctgcaggagcagcaccagctgagcagcagaagactgctgaacttcgacaccgagctgagcaccaaggagatgagaaacaactgggagaaggagatcgccgccgtgatcagccccgagctggagcacctggacaagaccctgcccaccatgaacaacctgatcagccaggacaagagaatcagcagcaaccccgtggccaagatcatctacggcgaccccgtgaccttcctgccccacctgcccagaaagagcgtggtgcactgcagcaagatctggagctgcagaaagagaatcaccgtggagtacctgcagcacatcgtggagcagaagaacggcaaggagagagtgcccatcctgtggcacttcctgcagaaggaggccgagctgagactggtgaagttcctgcccgagatcctggccctgcagagagacctggtgaagcagttccagaacgtgcagcaggtggagtacagcagcatcagaggcttcctgagcaagcacagcagcgacggcctgagacagctgctgcacaacagaatcaccgtgttcctgagcacctggaacaagctgagaagaagcctggagaccaacggcgagatcaacctgcccaaggactactgcagcaccgacctggacctggacaccgagttcgagatcctgctgcccagaagaagaggcctgggcctgtgcgccaccgccctggtgagctacctgatcagactgcacaacgagatcgtgtacgccgtggagaagctgagcaaggagaacaacagctacagcgtggacgccgccgaggtgaccgagctgcacgtgatcagctacgaggtggagagagacctgacccccctgatcctgagcaactgccagtaccaggtggaggagggcagagagaccgtgcaggagttcgacctggagaagatccagagacagatcgtgagcagattcctgcagggcaagcccagactgagcctgaagggcatccccaccctggtgtacagacacgactggaactacgagcacctgttcatggacatcaagaacaagatggcccaggacagcctgcccagcagcgtgatcagcgccatcagcggccagctgcagagctacagcgacgcctgcgaggtgctgagcgtggtggaggtgaccctgggcttcctgagcaccgccggcggcgaccccaacatgcagctgaacgtgtacacccaggacatcctgcagatgggcgaccagaccatccacgtgctgaaggccctgaacagatgccagctgaagcacaccatcgccctgtggcagttcctgagcgcccacaagagcgagcagctgctgagactgcacaaggagcccttcggcgagatcagcagcagatacaaggccgacctgagccccgagaacgccaagctgctgagcaccttcctgaaccagaccggcctggacgccttcctgctggagctgcacgagatgatcatcctgaagctgaagaacccccagacccagaccgaggagagattcagaccccagtggagcctgagagacaccctggtgagctacatgcagaccaaggagagcgagatcctgcccgagatggccagccagttccccgaggagatcctgctggccagctgcgtgagcgtgtggaagaccgccgccgtgctgaagtggaacagagagatgagatag

SEQ ID NO: 97678 - DNA, 15624 bp, Artificial Sequence
  Description of Artificial Sequence: Synthetic coding sequence
atggagtgccccagctgccagcacgtgagcaaggaggagacccccaagttctgcagccagtgcggcgagagactgccccccgccgcccccatcgccgacagcgagaacaacaacagcaccatggccagcgccagcgagggcgagatggagtgcggccaggagctgaaggaggagggcggcccctgcctgttccccggcagcgacagctggcaggagaaccccgaggagccctgcagcaaggccagctggaccgtgcaggagagcaagaagaagaagagaaagaagaagaagaagggcaacaagagcgccagcagcgagctggccagcctgcccctgagccccgccagcccctgccacctgaccctgctgagcaacccctggccccaggacaccgccctgccccacagccaggcccagcagagcggccccaccggccagcccagccagccccccggcaccgccaccacccccctggagggcgacggcctgagcgcccccaccgaggtgggcgacagccccctgcaggcccaggccctgggcgaggccggcgtggccaccggcagcgaggcccagagcagcccccagttccaggaccacaccgagggcgaggaccaggacgccagcatccccagcggcggcagaggcctgagccaggagggcaccggcccccccaccagcgccggcgagggccacagcagaaccgaggacgccgcccaggagctgctgctgcccgagagcaagggcggcagcagcgagcccggcaccgagctgcagaccaccgagcagcaggccggcgccagcgccagcatggccgtggacgccgtggccgagcccgccaacgccgtgaagggcgccggcaaggagatgaaggagaagacccagagaatgaagcagccccccgccaccaccccccccttcaagacccactgccaggaggccgagaccaagaccaaggacgagatggccgccgccgaggagaaggtgggcaagaacgagcagggcgagcccgaggacctgaagaagcccgagggcaagaacagaagcgccgccgccgtgaagaacgagaaggagcagaagaaccaggaggccgacgtgcaggaggtgaaggccagcaccctgagccccggcggcggcgtgaccgtgttcttccacgccatcatcagcctgcacttccccttcaaccccgacctgcacaaggtgttcatcagaggcggcgaggagttcggcgagagcaagtgggacagcaacatctgcgagctgcactacaccagagacctgggccacgacagagtgctggtggagggcatcgtgtgcatcagcaagaagcacctggacaagtacatcccctacaagtacgtgatctacaacggcgagagcttcgagtacgagttcatctacaagcaccagcagaagaagggcgagtacgtgaacagatgcctgttcatcaagagcagcctgctgggcagcggcgactggcaccagtactacgacatcgtgtacatgaagccccacggcagactgcagaaggtgatgaaccacatcaccgacggccccagaaaggacctggtgaagggcaagcagatcgccgccgccctgatgctggacagcaccttcagcatcctgcagacctgggacaccatcaacctgaacagcttcttcacccagttcgagcagttctgcttcgtgctgcagcagcccatgatctacgagggccaggcccagctgtggaccgacctgcagtacagagagaaggaggtgaagagatacctgtggcagcacctgaagaagcacgtggtgcccctgcccgacggcaagagcaccgacttcctgcccgtggactgccccgtgagaagcaagctgaagaccggcctgatcgtgctgttcgtggtggagaagatcgagctgctgctggagggcagcctggactggctgtgccacctgctgaccagcgacgccagcagccccgacgagttccacagagacctgagccacatcctgggcatcccccagagctggagactgtacctggtgaacctgtgccagagatgcatggacaccagaacctacacctggctgggcgccctgcccgtgctgcactgctgcatggagctggcccccagacacaaggacgcctggagacagcccgaggacacctgggccgccctggagggcctgagcttcagccccttcagagagcagatgctggacaccagcagcctgctgcagttcatgagagagaagcagcacctgctgagcatcgacgagcccctgttcagaagctggttcagcctgctgcccctgagccacctggtgatgtacatggagaacttcatcgagcacctgggcagattccccgcccacatcctggactgcctgagcggcatctactacagactgcccggcctggagcaggtgctgaacacccaggacgtgcaggacgtgcagaacgtgcagaacatcctggagatgctgctgagactgctggacacctacagagacaagatccccgaggaggccctgagccccagctacctgaccgtgtgcctgaagctgcacgaggccatctgcagcagcaccaagctgctgaagttctacgagctgcccgccctgagcgccgagatcgtgtgcagaatgatcagactgctgagcctggtggacagcgccggccagagagacgagaccggcaacaacagcgtgcagaccgtgttccagggcaccctggccgccaccaagagatggctgagagaggtgttcaccaagaacatgctgaccagcagcggcgccagcttcacctacgtgaaggagatcgaggtgtggagaagactggtggagatccagttccccgccgagcacggctggaaggagagcctgctgggcgacatggagtggagactgaccaaggaggagcccctgagccagatcaccgcctactgcaacagctgctgggacaccaagggcctggaggacagcgtggccaagaccttcgagaagtgcatcatcgaggccgtgagcagcgcctgccagagccagaccagcatcctgcagggcttcagctacagcgacctgagaaagttcggcatcgtgctgagcgccgtgatcaccaagagctggcccagaaccgccgacaacttcaacgacatcctgaagcacctgctgaccctggccgacgtgaagcacgtgttcagactgtgcggcaccgacgagaagatcctggccaacgtgaccgaggacgccaagagactgatcgccgtggccgacagcgtgctgaccaaggtggtgggcgacctgctgagcggcaccatcctggtgggccagctggagctgatcatcaagcacaagaaccagttcctggacatctggcagctgagagagaagagcctgagcccccaggacgagcagtgcgccgtggaggaggccctggactggagaagagaggagctgctgctgctgaagaaggagaagagatgcgtggacagcctgctgaagatgtgcggcaacgtgaagcacctgatccaggtggacttcggcgtgctggccgtgagacacagccaggacctgagcagcaagagactgaacgacaccgtgaccgtgagactgagcaccagcagcaacagccagagagccacccactaccacctgagcagccaggtgcaggagatggccggcaagatcgacctgctgagagacagccacatcttccagctgttctggagagaggccgccgagcccctgagcgagcccaaggaggaccaggaggccgccgagctgctgagcgagcccgaggaggagagcgagagacacatcctggagctggaggaggtgtacgactacctgtaccagcccagctacagaaagttcatcaagctgcaccaggacctgaagagcggcgaggtgaccctggccgagatcgacgtgatcttcaaggacttcgtgaacaagtacaccgacctggacagcgagctgaagatcatgtgcaccgtggaccaccaggaccagagagactggatcaaggacagagtggagcagatcaaggagtaccaccacctgcaccaggccgtgcacgccgccaaggtgatcctgcaggtgaaggagagcctgggcctgaacggcgacttcagcgtgctgaacaccctgctgaacttcaccgacaacttcgacgacttcagaagagagaccctggaccagatcaaccaggagctgatccaggccaagaagctgctgcaggacatcagcgaggccagatgcaagggcctgcaggccctgagcctgagaaaggagttcatctgctgggtgagagaggccctgggcggcatcaacgagctgaaggtgttcgtggacctggccagcatcagcgccggcgagaacgacatcgacgtggacagagtggcctgcttccacgacgccgtgcagggctacgccagcctgctgttcaagctggaccccagcgtggacttcagcgccttcatgaagcacctgaagaagctgtggaaggccctggacaaggaccagtacctgcccagaaagctgtgcgacagcgccagaaacctggagtggctgaagaccgtgaacgagagccacggcagcgtggagagaagcagcctgaccctggccaccgccatcaaccagagaggcatctacgtgatccaggcccccaagggcggccagaagatcagccccgacaccgtgctgcacctgatcctgcccgagagccccggcagccacgaggagagcagagagtacagcctggaggaggtgaaggagctgctgaacaagctgatgctgatgagcggcaagaaggacagaaacaacaccgaggtggagagattcagcgaggtgttctgcagcgtgcagagactgagccaggccttcatcgacctgcacagcgccggcaacatgctgttcagaacctggatcgccatggcctactgcagccccaagcagggcgtgagcctgcagatggacttcggcctggacctggtgaccgagctgaaggagggcggcgacgtgaccgagctgctggccgccctgtgcagacagatggagcacttcctggacagctggaagagattcgtgacccagaagagaatggagcacttctacctgaacttctacaccgccgagcagctggtgtacctgagcaccgagctgagaaagcagccccccagcgacgccgccctgaccatgctgagcttcatcaagagcaactgcaccctgagagacgtgctgagagccagcgtgggctgcggcagcgaggccgccagatacagaatgagaagagtgatggaggagctgcccctgatgctgctgagcgagttcagcctggtggacaagctgagaatcatcatggagcagagcatgagatgcctgcccgccttcctgcccgactgcctggacctggagaccctgggccactgcctggcccacctggccggcatgggcggcagccccgtggagagatgcctgcccagaggcctgcaggtgggccagcccaacctggtggtgtgcggccacagcgaggtgctgcccgccgccctggccgtgtacatgcagacccccagccagcccctgcccacctacgacgaggtgctgctgtgcacccccgccaccaccttcgaggaggtggccctgctgctgagaagatgcctgaccctgggcagcctgggccacaaggtgtacagcctgctgttcgccgaccagctgagctacgaggtggccagacaggccgaggagctgttccacaacctgtgcacccagcagcacagagaggactaccagctggtgatggtgtgcgacggcgactgggagcactgctacctgcccagcgccttcagccagcacaaggtgttcgtgaccccccaggcccccctggaggccatccaggcctacctggccggccactacagagtgcccaagcagaccctgagcgccgccgccgtgttcaacgacagactgtgcgtgggcatcgtggccagcgagagagccggcgtgggcaagagcctgtacgtgaagagactgcacgacaagatgaagatgcagctgaacgtgaagaacgtgcccctgaagaccatcagactgatcgacccccaggtggacgagagcagagtgctgggcgccctgctgcccttcctggacgcccagtaccagaaggtgcccgtgctgttccacctggacgtgaccagcagcgtgcagaccggcatctgggtgttcctgttcaagctgctgatcctgcagtacctgatggacatcaacggcaagatgtggctgagaaacccctgccacctgtacatcgtggagatcctggagagaagaaccagcgtgcccagcagaagcagcagcgccctgagaaccagagtgccccagttcagcttcctggacatcttccccaaggtgacctgcagaccccccaaggaggtgatcgacatggagctgagcgccctgagaagcgacaccgagcccggcatggacctgtgggagttctgcagcgagaccttccagagaccctaccagtacctgagaagattcaaccagaaccaggacctggacaccttccagtaccaggagggcagcgtggagggcacccccgaggagtgcctgcagcacttcctgttccactgcggcgtgatcaaccccagctggagcgagctgagaaacttcgccagattcctgaactaccagctgagagactgcgaggccagcctgttctgcaaccccagcttcatcggcgacaccctgagaggcttcaagaagttcgtggtgaccttcatgatcttcatggccagagacttcgccacccccagcctgcacaccagcgaccagagccccggcaagcacatggtgaccatggacggcgtgagagaggaggacctggcccccttcagcctgagaaagagatgggagagcgagccccacccctacgtgttcttcaacgacgaccacaccaccatgaccttcatcggcttccacctgcagcccaacatcaacggcagcgtggacgccatcagccacctgaccggcaaggtgatcaagagagacgtgatgaccagagacctgtaccagggcctgctgctgcagagagtgcccttcaacgtggacttcgacaagctgcccagacacaagaagctggagagactgtgcctgaccctgggcatcccccaggccaccgaccccgacaagacctacgagctgaccaccgacaacatgctgaagatcctggccatcgagatgagattcagatgcggcatccccgtgatcatcatgggcgagaccggctgcggcaagaccagactgatcaagttcctgagcgacctgagaagaggcggcaccaacgccgacaccatcaagctggtgaaggtgcacggcggcaccaccgccgacatgatctacagcagagtgagagaggccgagaacgtggccttcgccaacaaggaccagcaccagctggacaccatcctgttcttcgacgaggccaacaccaccgaggccatcagctgcatcaaggaggtgctgtgcgaccacatggtggacggccagcccctggccgaggacagcggcctgcacatcatcgccgcctgcaacccctacagaaagcacagcgaggagatgatctgcagactggagagcgccggcctgggctacagagtgagcatggaggagaccgccgacagactgggcagcatccccctgagacagctggtgtacagagtgcacgccctgccccccagcctgatccccctggtgtgggacttcggccagctgagcgacgtggccgagaagctgtacatccagcagatcgtgcagagactggtggagagcatcagcctggacgagaacggcaccagagtgatcaccgaggtgctgtgcgccagccagggcttcatgagaaagaccgaggacgagtgcagcttcgtgagcctgagagacgtggagagatgcgtgaaggtgttcagatggttccacgagcacagcgccatgctgctggcccagctgaacgccttcctgagcaagagcagcgtgagcaagaaccacaccgagagagaccccgtgctgtggagcctgatgctggccatcggcgtgtgctaccacgccagcctggagaagaaggacagctacagaaaggccatcgccagattcttccccaagccctacgacgacagcagactgctgctggacgagatcaccagagcccaggacctgttcctggacggcgtgcccctgagaaagaccatcgccaagaacctggccctgaaggagaacgtgttcatgatggtggtgtgcatcgagctgaagatccccctgttcctggtgggcaagcccggcagcagcaagagcctggccaagaccatcgtggccgacgccatgcagggccccgccgcctacagcgacctgttcagaagcctgaagcaggtgcacctggtgagcttccagtgcagcccccacagcaccccccagggcatcatcagcaccttcagacagtgcgccagattccagcagggcaaggacctgcagcagtacgtgagcgtggtggtgctggacgaggtgggcctggccgaggacagccccaagatgcccctgaagaccctgcaccccctgctggaggacggctgcatcgaggacgaccccgccccccacaagaaggtgggcttcgtgggcatcagcaactgggccctggaccccgccaagatgaacagaggcatcttcgtgagcagaggcagccccaacgagaccgagctgatcgagagcgccaagggcatctgcagcagcgacatcctggtgcaggacagagtgcagggctacttcgccagcttcgccaaggcctacgagaccgtgtgcaagagacaggacaaggagttcttcggcctgagagactactacagcctgatcaagatggtgttcgccgccgccaaggccagcaacagaaagcccagcccccaggacatcgcccaggccgtgctgagaaacttcagcggcaaggacgacatccaggccctggacatcttcctggccaacctgcccgaggccaagtgcagcgaggaggtgagccccatgcagctgatcaagcagaacatcttcggccccagccagaaggtgcccggcggcgagcaggaggacgccgagagcagatacctgctggtgctgaccaagaactacgtggccctgcagatcctgcagcagaccttcttcgagggcgaccagcagcccgagatcatcttcggcagcggcttccccaaggaccaggagtacacccagctgtgcagaaacatcaacagagtgaagatctgcatggagaccggcaagatggtgctgctgctgaacctgcagaacctgtacgagagcctgtacgacgccctgaaccagtactacgtgcacctgggcggccagaagtacgtggacctgggcctgggcacccacagagtgaagtgcagagtgcaccccaacttcagactgatcgtgatcgaggagaaggacgtggtgtacaagcacttccccatccccctgatcaacagactggagaagcactacctggacatcaacaccgtgctggagaagtggcagaagagcatcgtggaggagctgtgcgcctgggtggagaagttcatcaacgtgaaggcccaccacttccagaagagacacaagtacagccccagcgacgtgttcatcggctaccacagcgacgcctgcgccagcgtggtgctgcaggtgatcgagagacagggccccagagccctgaccgaggagctgcaccagaaggtgagcgaggaggccaagagcatcctgctgaactgcgccacccccgacgccgtggtgagactgagcgcctacagcctgggcggcttcgccgccgagtggctgagccaggagtacttccacagacagagacacaacagcttcgccgacttcctgcaggcccacctgcacaccgccgacctggagagacacgccatcttcaccgagatcaccaccttcagcagactgctgaccagccacgactgcgagatcctggagagcgaggtgaccggcagagcccccaagcccaccctgctgtggctgcagcagttcgacaccgagtacagcttcctgaaggaggtgagaaactgcctgaccaacaccgccaagtgcaagatcctgatcttccagaccgacttcgaggacggcatcagaagcgcccagctgatcgccagcgccaagtacagcgtgatcaacgagatcaacaagatcagagagaacgaggacagaatcttcgtgtacttcatcaccaagctgagcagagtgggcagaggcaccgcctacgtgggcttccacggcggcctgtggcagagcgtgcacatcgacgacctgagaagaagcaccctgatggtgagcgacgtgaccagactgcagcacgtgaccatcagccagctgttcgcccccggcgacctgcccgagctgggcctggagcacagagccgaggacggccacgaggaggccatggagaccgaggccagcaccagcggcgaggtggccgaggtggccgaggaggccatggagaccgagagcagcgagaaggtgggcaaggagaccagcgagctgggcggcagcgacgtgagcatcctggacaccaccagactgctgagaagctgcgtgcagagcgccgtgggcatgctgagagaccagaacgagagctgcaccagaaacatgagaagagtggtgctgctgctgggcctgctgaacgaggacgacgcctgccacgccagcttcctgagagtgagcaagatgagactgagcgtgttcctgaagaagcaggaggagagccagttccaccccctggagtggctggccagagaggcctgcaaccaggacgccctgcaggaggccggcaccttcagacacaccctgtggaagagagtgcagggcgccgtgacccccctgctggccagcatgatcagcttcatcgacagagacggcaacctggagctgctgaccagacccgacacccccccctgggccagagacctgtggatgttcatcttcagcgacaccatgctgctgaacatccccctggtgatgaacaacgagagacacaagggcgagatggcctacatcgtggtgcagaaccacatgaacctgagcgagaacgccagcaacaacgtgcccttcagctggaagatcaaggactacctggaggagctgtgggtgcaggcccagtacatcaccgacgccgagggcctgcccaagaagttcgtggacatcttccagcagacccccctgggcagattcctggcccagctgcacggcgagccccagcaggagctgctgcagtgctacctgaaggacttcatcctgctgaccatgagagtgagcaccgaggaggagctgaagttcctgcagatggccctgtggagctgcaccagaaagctgaaggccgccagcgaggcccccgaggaggaggtgagcctgccctgggtgcacctggcctaccagagattcagaagcagactgcagaacttcagcagaatcctgaccatctacccccaggtgctgcacagcctgatggaggccagatggaaccacgagctggccggctgcgagatgaccctggacgccttcgccgccatggcctgcaccgagatgctgaccagaaacaccctgaagcccagcccccaggcctggctgcagctggtgaagaacctgagcatgcccctggagctgatctgcagcgacgagcacatgcagggcagcggcagcctggcccaggccgtgatcagagaggtgagagcccagtggagcagaatcttcagcaccgccctgttcgtggagcacgtgctgctgggcaccgagagcagagtgcccgagctgcagggcctggtgaccgagcacgtgttcctgctggacaagtgcctgagagagaacagcgacgtgaagacccacggccccttcgaggccgtgatgagaaccctgtgcgagtgcaaggagaccgccagcaagaccctgagcagattcggcatccagccctgcagcatctgcctgggcgacgccaaggaccccgtgtgcctgccctgcgaccacgtgcactgcctgagatgcctgagagcctggttcgccagcgagcagatgatctgcccctactgcctgaccgccctgcccgacgagttcagccccgccgtgagccaggcccacagagaggccatcgagaagcacgccagattcagacagatgtgcaacagcttcttcgtggacctggtgagcaccatctgcttcaaggacaacgccccccccgagaaggaggtgatcgagagcctgctgagcctgctgttcgtgcagaagggcagactgagagacgccgcccagagacactgcgagcacaccaagagcctgagccccttcaacgacgtggtggacaagacccccgtgatcagaagcgtgatcctgaagctgctgctgaagtacagcttccacgacgtgaaggactacatccaggagtacctgaccctgctgaagaagaaggccttcatcaccgaggacaagaccgagctgtacatgctgttcatcaactgcctggaggacagcatcctggagaagaccagcgcctacagcagaaacgacgagctgaaccacctggaggaggagggcagattcctgaaggcctacagccccgccagcagaggcagagagcccgccaacgaggccagcgtggagtacctgcaggaggtggccagaatcagactgtgcctggacagagccgccgacttcctgagcgagcccgagggcggccccgagatggccaaggagaagcagtgctacctgcagcaggtgaagcagttctgcatcagagtggagaacgactggcacagagtgtacctggtgagaaagctgagcagccagagaggcatggagttcgtgcagggcctgagcaagcccggcagaccccaccagtgggtgttccccaaggacgtggtgaagcagcagggcctgagacaggaccaccccggccagatggacagatacctggtgtacggcgacgagtacaaggccctgagagacgccgtggccaaggccgtgctggagtgcaagcccctgggcatcaagaccgccctgaaggcctgcaagaccccccagagccagcagagcgcctacttcctgctgaccctgttcagagaggtggccatcctgtacagaagccacaacgccagcctgcaccccacccccgagcagtgcgaggccgtgagcaagttcatcggcgagtgcaagatcctgagcccccccgacatcagcagattcgccaccagcctggtggacaacagcgtgcccctgctgagagccggccccagcgacagcaacctggacggcaccgtgaccgagatggccatccacgccgccgccgtgctgctgtgcggccagaacgagctgctggagcccctgaagaacctggccttcagccccgccaccatggcccacgccttcctgcccaccatgcccgaggacctgctggcccaggccagaagatggaagggcctggagagagtgcactggtacacctgccccaacggccacccctgcagcgtgggcgagtgcggcagacccatggagcagagcatctgcatcgactgccacgcccccatcggcggcatcgaccacaagcccagagacggcttccacctggtgaaggacaaggccgacagaacccagaccggccacgtgctgggcaacccccagagaagagacgtggtgacctgcgacagaggcctgccccccgtggtgttcctgctgatcagactgctgacccacctggccctgctgctgggcgccagccagagcagccaggccctgatcaacatcatcaagccccccgtgagagaccccaagggcttcctgcagcagcacatcctgaaggacctggagcagctggccaagatgctgggccacagcgccgacgagaccatcggcgtggtgcacctggtgctgagaagactgctgcaggagcagcaccagctgagcagcagaagactgctgaacttcgacaccgagctgagcaccaaggagatgagaaacaactgggagaaggagatcgccgccgtgatcagccccgagctggagcacctggacaagaccctgcccaccatgaacaacctgatcagccaggacaagagaatcagcagcaaccccgtggccaagatcatctacggcgaccccgtgaccttcctgccccacctgcccagaaagagcgtggtgcactgcagcaagatctggagctgcagaaagagaatcaccgtggagtacctgcagcacatcgtggagcagaagaacggcaaggagagagtgcccatcctgtggcacttcctgcagaaggaggccgagctgagactggtgaagttcctgcccgagatcctggccctgcagagagacctggtgaagcagttccagaacgtgcagcaggtggagtacagcagcatcagaggcttcctgagcaagcacagcagcgacggcctgagacagctgctgcacaacagaatcaccgtgttcctgagcacctggaacaagctgagaagaagcctggagaccaacggcgagatcaacctgcccaaggactactgcagcaccgacctggacctggacaccgagttcgagatcctgctgcccagaagaagaggcctgggcctgtgcgccaccgccctggtgagctacctgatcagactgcacaacgagatcgtgtacgccgtggagaagctgagcaaggagaacaacagctacagcgtggacgccgccgaggtgaccgagctgcacgtgatcagctacgaggtggagagagacctgacccccctgatcctgagcaactgccagtaccaggtggaggagggcagagagaccgtgcaggagttcgacctggagaagatccagagacagatcgtgagcagattcctgcagggcaagcccagactgagcctgaagggcatccccaccctggtgtacagacacgactggaactacgagcacctgttcatggacatcaagaacaagatggcccaggacagcctgcccagcagcgtgatcagcgccatcagcggccagctgcagagctacagcgacgcctgcgaggtgctgagcgtggtggaggtgaccctgggcttcctgagcaccgccggcggcgaccccaacatgcagctgaacgtgtacacccaggacatcctgcagatgggcgaccagaccatccacgtgctgaaggccctgaacagatgccagctgaagcacaccatcgccctgtggcagttcctgagcgcccacaagagcgagcagctgctgagactgcacaaggagcccttcggcgagatcagcagcagatacaaggccgacctgagccccgagaacgccaagctgctgagcaccttcctgaaccagaccggcctggacgccttcctgctggagctgcacgagatgatcatcctgaagctgaagaacccccagacccagaccgaggagagattcagaccccagtggagcctgagagacaccctggtgagctacatgcagaccaaggagagcgagatcctgcccgagatggccagccagttccccgaggagatcctgctggccagctgcgtgagcgtgtggaagaccgccgccgtgctgaagtggaacagagagatgagatag

SEQ ID NO: 97679 - DNA, 2772 bp, Artificial Sequence
  Description of Artificial Sequence: Synthetic coding sequence
atggaggagggcaacaacaacgaggaggtgatccacctgaacaacttccactgccacagaggccaggagtggatcaacctgagagacggccccatcaccatcagcgacagcagcgacgaggagagaatccccatgctggtgacccccgccccccagcagcacgaggaggaggacctggacgacgacgtgatcctgaccgagaccaacaagccccagagaagcagacccaacctgatcaagcccgccgcccagtggcaggacctgaagagactgggcgaggagagacccaagaagagcagagccgccttcgagagcgacaagagcagctacttcagcgtgtgcaacaaccccctgttcgacagcggcgcccaggacgacagcgaggacgactacggcgagttcctggacctgggcccccccggcatcagcgagttcaccaagcccagcggccagaccgagagagagcccaagcccggccccagccacaaccaggccgccaacgacatcgtgaaccccagaagcgagcagaaggtgatcatcctggaggagggcagcctgctgtacaccgagagcgaccccctggagacccagaaccagagcagcgaggacagcgagaccgagctgctgagcaacctgggcgagagcgccgccctggccgacgaccaggccatcgaggaggactgctggctggaccacccctacttccagagcctgaaccagcagcccagagagatcaccaaccaggtggtgccccaggagagacagcccgaggccgagctgggcagactgctgttccagcacgagttccccggccccgccttccccagacccgagccccagcagggcggcatcagcggccccagcagcccccagcccgcccaccccctgggcgagttcgaggaccagcagctggccagcgacgacgaggagcccggccccgccttccccatgcaggagagccaggagcccaacctggagaacatctggggccaggaggccgccgaggtggaccaggagctggtggagctgctggtgaaggagaccgaggccagattccccgacgtggccaacggcttcatcgaggagatcatccacttcaagaactactacgacctgaacgtgctgtgcaacttcctgctggagaaccccgactaccccaagagagaggacagaatcatcatcaaccccagcagcagcctgctggccagccaggacgagaccaagctgcccaagatcgacttcttcgactacagcaagctgacccccctggaccagagatgcttcatccaggccgccgacctgctgatggccgacttcaaggtgctgagcagccaggacatcaagtgggccctgcacgagctgaagggccactacgccatcaccagaaaggccctgagcgacgccatcaagaagtggcaggagctgagccccgagaccagcggcaagagaaagaagagaaagcagatgaaccagtacagctacatcgacttcaagttcgagcagggcgacatcaagatcgagaagagaatgttcttcctggagaacaagagaagacactgcagaagctacgacagaagagccctgctgcccgccgtgcagcaggagcaggagttctacgagcagaagatcaaggagatggccgagcacgaggacttcctgctggccctgcagatgaacgaggagcagtaccagaaggacggccagctgatcgagtgcagatgctgctacggcgagttccccttcgaggagctgacccagtgcgccgacgcccacctgttctgcaaggagtgcctgatcagatacgcccaggaggccgtgttcggcagcggcaagctggagctgagctgcatggagggcagctgcacctgcagcttccccaccagcgagctggagaaggtgctgccccagaccatcctgtacaagtactacgagagaaaggccgaggaggaggtggccgccgcctacgccgacgagctggtgagatgccccagctgcagcttccccgccctgctggacagcgacgtgaagagattcagctgccccaacccccactgcagaaaggagacctgcagaaagtgccagggcctgtggaaggagcacaacggcctgacctgcgaggagctggccgagaaggacgacatcaagtacagaaccagcatcgaggagaagatgaccgccgccagaatcagaaagtgccacaagtgcggcaccggcctgatcaagagcgagggctgcaacagaatgagctgcagatgcggcgcccagatgtgctacctgtgcagagtgagcatcaacggctacgaccacttctgccagcaccccagaagccccggcgccccctgccaggagtgcagcagatgcagcctgtggaccgaccccaccgaggacgacgagaagctgatcgaggagatccagaaggaggccgaggaggagcagaagagaaagaacggcgagaacaccttcaagagaatcggcccccccctggagaagcccgtggagaaggtgcagagagtggaggccctgcccagacccgtgccccagaacctgccccagccccagatgcccccctacgccttcgcccacccccccttccccctgccccccgtgagacccgtgttcaacaacttccccctgaacatgggccccatccccgccccctacgtgccccccctgcccaacgtgagagtgaactacgacttcggccccatccacatgcccctggagcacaacctgcccatgcacttcggcccccagcccagacacagattctag

SEQ ID NO: 97680 - DNA, 63 bp, Artificial Sequence
  Description of Artificial Sequence: Synthetic coding sequence
atggaggagggcaacaacaacgaggaggtgatccacctgaacaacttccactgccacagatag

SEQ ID NO: 97681 - DNA, 2601 bp, Artificial Sequence
  Description of Artificial Sequence: Synthetic coding sequence
atggaggagggcaacaacaacgaggaggtgatccacctgaacaacttccactgccacagaggccaggagtggatcaacctgagagacggccccatcaccatcagcgacagcagcgacgaggagagaatccccatgctggtgacccccgccccccagcagcacgaggaggaggacctggacgacgacgtgatcctgaccgaggacgacagcgaggacgactacggcgagttcctggacctgggcccccccggcatcagcgagttcaccaagcccagcggccagaccgagagagagcccaagcccggccccagccacaaccaggccgccaacgacatcgtgaaccccagaagcgagcagaaggtgatcatcctggaggagggcagcctgctgtacaccgagagcgaccccctggagacccagaaccagagcagcgaggacagcgagaccgagctgctgagcaacctgggcgagagcgccgccctggccgacgaccaggccatcgaggaggactgctggctggaccacccctacttccagagcctgaaccagcagcccagagagatcaccaaccaggtggtgccccaggagagacagcccgaggccgagctgggcagactgctgttccagcacgagttccccggccccgccttccccagacccgagccccagcagggcggcatcagcggccccagcagcccccagcccgcccaccccctgggcgagttcgaggaccagcagctggccagcgacgacgaggagcccggccccgccttccccatgcaggagagccaggagcccaacctggagaacatctggggccaggaggccgccgaggtggaccaggagctggtggagctgctggtgaaggagaccgaggccagattccccgacgtggccaacggcttcatcgaggagatcatccacttcaagaactactacgacctgaacgtgctgtgcaacttcctgctggagaaccccgactaccccaagagagaggacagaatcatcatcaaccccagcagcagcctgctggccagccaggacgagaccaagctgcccaagatcgacttcttcgactacagcaagctgacccccctggaccagagatgcttcatccaggccgccgacctgctgatggccgacttcaaggtgctgagcagccaggacatcaagtgggccctgcacgagctgaagggccactacgccatcaccagaaaggccctgagcgacgccatcaagaagtggcaggagctgagccccgagaccagcggcaagagaaagaagagaaagcagatgaaccagtacagctacatcgacttcaagttcgagcagggcgacatcaagatcgagaagagaatgttcttcctggagaacaagagaagacactgcagaagctacgacagaagagccctgctgcccgccgtgcagcaggagcaggagttctacgagcagaagatcaaggagatggccgagcacgaggacttcctgctggccctgcagatgaacgaggagcagtaccagaaggacggccagctgatcgagtgcagatgctgctacggcgagttccccttcgaggagctgacccagtgcgccgacgcccacctgttctgcaaggagtgcctgatcagatacgcccaggaggccgtgttcggcagcggcaagctggagctgagctgcatggagggcagctgcacctgcagcttccccaccagcgagctggagaaggtgctgccccagaccatcctgtacaagtactacgagagaaaggccgaggaggaggtggccgccgcctacgccgacgagctggtgagatgccccagctgcagcttccccgccctgctggacagcgacgtgaagagattcagctgccccaacccccactgcagaaaggagacctgcagaaagtgccagggcctgtggaaggagcacaacggcctgacctgcgaggagctggccgagaaggacgacatcaagtacagaaccagcatcgaggagaagatgaccgccgccagaatcagaaagtgccacaagtgcggcaccggcctgatcaagagcgagggctgcaacagaatgagctgcagatgcggcgcccagatgtgctacctgtgcagagtgagcatcaacggctacgaccacttctgccagcaccccagaagccccggcgccccctgccaggagtgcagcagatgcagcctgtggaccgaccccaccgaggacgacgagaagctgatcgaggagatccagaaggaggccgaggaggagcagaagagaaagaacggcgagaacaccttcaagagaatcggcccccccctggagaagcccgtggagaaggtgcagagagtggaggccctgcccagacccgtgccccagaacctgccccagccccagatgcccccctacgccttcgcccacccccccttccccctgccccccgtgagacccgtgttcaacaacttccccctgaacatgggccccatccccgccccctacgtgccccccctgcccaacgtgagagtgaactacgacttcggccccatccacatgcccctggagcacaacctgcccatgcacttcggcccccagcccagacacagattctag

SEQ ID NO: 97682 - DNA, 2037 bp, Artificial Sequence
  Description of Artificial Sequence: Synthetic coding sequence
atggaggagggcaacaacaacgaggaggtgatccacctgaacaacttccactgccacagaggccaggagtggatcaacctgagagacggccccatcaccatcagcgacagcagcgacgaggagagaatccccatgctggtgacccccgccccccagcagcacgaggaggaggacctggacgacgacgtgatcctgaccgagaccaacaagccccagagaagcagacccaacctgatcaagcccgccgcccagtggcaggaggccgccgaggtggaccaggagctggtggagctgctggtgaaggagaccgaggccagattccccgacgtggccaacggcttcatcgaggagatcatccacttcaagaactactacgacctgaacgtgctgtgcaacttcctgctggagaaccccgactaccccaagagagaggacagaatcatcatcaaccccagcagcagcctgctggccagccaggacgagaccaagctgcccaagatcgacttcttcgactacagcaagctgacccccctggaccagagatgcttcatccaggccgccgacctgctgatggccgacttcaaggtgctgagcagccaggacatcaagtgggccctgcacgagctgaagggccactacgccatcaccagaaaggccctgagcgacgccatcaagaagtggcaggagctgagccccgagaccagcggcaagagaaagaagagaaagcagatgaaccagtacagctacatcgacttcaagttcgagcagggcgacatcaagatcgagaagagaatgttcttcctggagaacaagagaagacactgcagaagctacgacagaagagccctgctgcccgccgtgcagcaggagcaggagttctacgagcagaagatcaaggagatggccgagcacgaggacttcctgctggccctgcagatgaacgaggagcagtaccagaaggacggccagctgatcgagtgcagatgctgctacggcgagttccccttcgaggagctgacccagtgcgccgacgcccacctgttctgcaaggagtgcctgatcagatacgcccaggaggccgtgttcggcagcggcaagctggagctgagctgcatggagggcagctgcacctgcagcttccccaccagcgagctggagaaggtgctgccccagaccatcctgtacaagtactacgagagaaaggccgaggaggaggtggccgccgcctacgccgacgagctggtgagatgccccagctgcagcttccccgccctgctggacagcgacgtgaagagattcagctgccccaacccccactgcagaaaggagacctgcagaaagtgccagggcctgtggaaggagcacaacggcctgacctgcgaggagctggccgagaaggacgacatcaagtacagaaccagcatcgaggagaagatgaccgccgccagaatcagaaagtgccacaagtgcggcaccggcctgatcaagagcgagggctgcaacagaatgagctgcagatgcggcgcccagatgtgctacctgtgcagagtgagcatcaacggctacgaccacttctgccagcaccccagaagccccggcgccccctgccaggagtgcagcagatgcagcctgtggaccgaccccaccgaggacgacgagaagctgatcgaggagatccagaaggaggccgaggaggagcagaagagaaagaacggcgagaacaccttcaagagaatcggcccccccctggagaagcccgtggagaaggtgcagagagtggaggccctgcccagacccgtgccccagaacctgccccagccccagatgcccccctacgccttcgcccacccccccttccccctgccccccgtgagacccgtgttcaacaacttccccctgaacatgggccccatccccgccccctacgtgccccccctgcccaacgtgagagtgaactacgacttcggccccatccacatgcccctggagcacaacctgcccatgcacttcggcccccagcccagacacagattctag

SEQ ID NO: 97683 - DNA, 447 bp, Artificial Sequence
  Description of Artificial Sequence: Synthetic coding sequence
atgagcagcgacttcccccactacaacttcagaatgcccaacatcggcttccagaacctgcccctgaacatctacatcgtggtgttcggcaccgccatcttcgtgttcatcctgagcctgctgttctgctgctacctgatcagactgagacaccaggcccacaaggagttctacgcctacaagcaggtgatcctgaaggagaaggtgaaggagctgaacctgcacgagctgtgcgccgtgtgcctggaggacttcaagcccagagacgagctgggcatctgcccctgcaagcacgccttccacagaaagtgcctgatcaagtggctggaggtgagaaaggtgtgccccctgtgcaacatgcccgtgctgcagctggcccagctgcacagcaagcaggacagaggccccccccagggccccctgcccggcgccgagaacatcgtgtag

SEQ ID NO: 97684 - DNA, 447 bp, Artificial Sequence; identical to SEQ ID NO: 97683
  Description of Artificial Sequence: Synthetic coding sequence

SEQ ID NO: 97685 - DNA, 510 bp, Artificial Sequence
  Description of Artificial Sequence: Synthetic coding sequence
atgctgaacaagagcggcgagagcagataccccgccctgttccccgtgctgggcggcagcagcatgagcagcgacttcccccactacaacttcagaatgcccaacatcggcttccagaacctgcccctgaacatctacatcgtggtgttcggcaccgccatcttcgtgttcatcctgagcctgctgttctgctgctacctgatcagactgagacaccaggcccacaaggagttctacgcctacaagcaggtgatcctgaaggagaaggtgaaggagctgaacctgcacgagctgtgcgccgtgtgcctggaggacttcaagcccagagacgagctgggcatctgcccctgcaagcacgccttccacagaaagtgcctgatcaagtggctggaggtgagaaaggtgtgccccctgtgcaacatgcccgtgctgcagctggcccagctgcacagcaagcaggacagaggccccccccagggccccctgcccggcgccgagaacatcgtgtag

SEQ ID NO: 97686 - DNA, 510 bp, Artificial Sequence; identical to SEQ ID NO: 97685
  Description of Artificial Sequence: Synthetic coding sequence

SEQ ID NO: 97687 - DNA, 1302 bp, Artificial Sequence
  Description of Artificial Sequence: Synthetic coding sequence
atggaggccgtgtacctggtggtgaacggcctgggcctggtgctggacgtgctgaccctggtgctggacctgaacttcctgctggtgagcagcctgctggccagcctggcctggctgctggccttcgtgtacaacctgccccacaccgtgctgaccagcctgctgcacctgggcagaggcgtgctgctgagcctgctggccctgatcgaggccgtggtgagattcacctgcggcggcctgcaggccctgtgcaccctgctgtacagctgctgcagcggcctggagagcctgaagctgctgggccacctggccagccacggcgccctgagaagcagagagatcctgcacagaggcgtgctgaacgtggtgagcagcggccacgccctgctgagacaggcctgcgacatctgcgccatcgccatgagcctggtggcctacgtgatcaacagcctggtgaacatctgcctgatcggcacccagaacctgttcagcctggtgctggccctgtgggacgccgtgaccggccccctgtggagaatgaccgacgtggtggccgccttcctggcccacatcagcagcagcgccgtggccatggccatcctgctgtggaccccctgccagctggccctggagctgctggccagcgccgccagactgctggccagcttcgtgctggtgaacctgaccggcctggtgctgctggcctgcgtgctggccgtgaccgtgaccgtgctgcaccccgacttcaccctgagactggccacccaggccctgagccagctgcacgccagacccagctaccacagactgagagaggacgtgatgagactgagcagactggccctgggcagcgaggcctggagaagagtgtggagcagaagcctgcagctggccagctggcccaacagaggcggcgcccccggcgccccccagggcgaccccatgagagtgttcagcgtgagaaccagaagacaggacaccctgcccgaggccggcagaagaagcgaggccgaggaggaggaggccagaaccatcagagtgacccccgtgagaggcagagagagactgaacgaggaggagccccccggcggccaggacccctggaagctgctgaaggagcaggaggagagaaagaagtgcgtgatctgccaggaccagagcaagaccgtgctgctgctgccctgcagacacctgtgcctgtgccaggcctgcaccgagatcctgatgagacaccccgtgtaccacagaaactgccccctgtgcagaagaggcatcctgcagaccctgaacgtgtacctgtag

SEQ ID NO: 97688 - DNA, 3219 bp, Artificial Sequence
  Description of Artificial Sequence: Synthetic coding sequence
atgcccggcgaggaggaggagagagccttcctggtggccagagaggagctggccagcgccctgagaagagacagcggccaggccttcagcctggagcagctgagacccctgctggccagcagcctgcccctggccgccagatacctgcagctggacgccgccagactggtgagatgcaacgcccacggcgagcccagaaactacctgaacaccctgagcaccgccctgaacatcctggagaagtacggcagaaacctgctgagcccccagagacccagatactggagaggcgtgaagttcaacaaccccgtgttcagaagcaccgtggacgccgtgcagggcggcagagacgtgctgagactgtacggctacaccgaggagcagcccgacggcctgagcttccccgagggccaggaggagcccgacgagcaccaggtggccaccgtgaccctggaggtgctgctgctgagaaccgagctgagcctgctgctgcagaacacccaccccagacagcaggccctggagcagctgctggaggacaaggtggaggacgacatgctgcagctgagcgagttcgaccccctgctgagagagatcgcccccggccccctgaccacccccagcgtgcccggcagcacccccggcccctgcttcctgtgcggcagcgcccccggcaccctgcactgccccagctgcaagcaggccctgtgccccgcctgcgaccacctgttccacggccaccccagcagagcccaccacctgagacagaccctgcccggcgtgctgcagggcacccacctgagccccagcctgcccgccagcgcccagcccagaccccagagcaccagcctgctggccctgggcgacagcagcctgagcagccccaaccccgccagcgcccacctgccctggcactgcgccgcctgcgccatgctgaacgagccctgggccgtgctgtgcgtggcctgcgacagacccagaggctgcaagggcctgggcctgggcaccgagggcccccagggcaccggcggcctggagcccgacctggccagaggcagatgggcctgccagagctgcaccttcgagaacgaggccgccgccgtgctgtgcagcatctgcgagagacccagactggcccagccccccagcctggtggtggacagcagagacgccggcatctgcctgcagcccctgcagcagggcgacgccctgctggccagcgcccagagccaggtgtggtactgcatccactgcaccttctgcaacagcagccccggctgggtgtgcgtgatgtgcaacagaaccagcagccccatccccgcccagcacgcccccagaccctacgccagcagcctggagaagggcccccccaagcccggcccccccagaagactgagcgcccccctgcccagcagctgcggcgaccccgagaagcagagacaggacaagatgagagaggagggcctgcagctggtgagcatgatcagagagggcgaggccgccggcgcctgccccgaggagatcttcagcgccctgcagtacagcggcaccgaggtgcccctgcagtggctgagaagcgagctgccctacgtgctggagatggtggccgagctggccggccagcaggaccccggcctgggcgccttcagctgccaggaggccagaagagcctggctggacagacacggcaacctggacgaggccgtggaggagtgcgtgagaaccagaagaagaaaggtgcaggagctgcagagcctgggcttcggccccgaggagggcagcctgcaggccctgttccagcacggcggcgacgtgagcagagccctgaccgagctgcagagacagagactggagcccttcagacagagactgtgggacagcggccccgagcccacccccagctgggacggccccgacaagcagagcctggtgagaagactgctggccgtgtacgccctgcccagctggggcagagccgagctggccctgagcctgctgcaggagacccccagaaactacgagctgggcgacgtggtggaggccgtgagacacagccaggacagagccttcctgagaagactgctggcccaggagtgcgccgtgtgcggctgggccctgccccacaacagaatgcaggccctgaccagctgcgagtgcaccatctgccccgactgcttcagacagcacttcaccatcgccctgaaggagaagcacatcaccgacatggtgtgccccgcctgcggcagacccgacctgaccgacgacacccagctgctgagctacttcagcaccctggacatccagctgagagagagcctggagcccgacgcctacgccctgttccacaagaagctgaccgagggcgtgctgatgagagaccccaagttcctgtggtgcgcccagtgcagcttcggcttcatctacgagagagagcagctggaggccacctgcccccagtgccaccagaccttctgcgtgagatgcaagagacagtgggaggagcagcacagaggcagaagctgcgaggacttccagaactggaagagaatgaacgaccccgagtaccaggcccagggcctggccatgtacctgcaggagaacggcatcgactgccccaagtgcaagttcagctacgccctggccagaggcggctgcatgcacttccactgcacccagtgcagacaccagttctgcagcggctgctacaacgccttctacgccaagaacaagtgccccgagcccaactgcagagtgaagaagagcctgcacggccaccaccccagagactgcctgttctacctgagagactggaccgccctgagactgcagaagctgctgcaggacaacaacgtgatgttcaacaccgagccccccgccggcgccagagccgtgcccggcggcggctgcagagtgatcgagcagaaggaggtgcccaacggcctgagagacgaggcctgcggcaaggagacccccgccggctacgccggcctgtgccaggcccactacaaggagtacctggtgagcctgatcaacgcccacagcctggaccccgccaccctgtacgaggtggaggagctggagaccgccaccgagagatacctgcacgtgagaccccagcccctggccggcgaggacccccccgcctaccaggccagactgctgcagaagctgaccgaggaggtgcccctgggccagagcatccccagaagaagaaagtag

SEQ ID NO: 97689 - DNA, 1518 bp, Artificial Sequence
  Description of Artificial Sequence: Synthetic coding sequence
atgcccggcgaggaggaggagagagccttcctggtggccagagaggagctggccagcgccctgagaagagacagcggccaggccttcagcctggagcagctgagacccctgctggccagcagcctgcccctggccgccagatacctgcagctggacgccgccagactggtgagatgcaacgcccacggcgagcccagaaactacctgaacaccctgcccacccccagctgggacggccccgacaagcagagcctggtgagaagactgctggccgtgtacgccctgcccagctggggcagagccgagctggccctgagcctgctgcaggagacccccagaaactacgagctgggcgacgtggtggaggccgtgagacacagccaggacagagccttcctgagaagactgctggcccaggagtgcgccgtgtgcggctgggccctgccccacaacagaatgcaggccctgaccagctgcgagtgcaccatctgccccgactgcttcagacagcacttcaccatcgccctgaaggagaagcacatcaccgacatggtgtgccccgcctgcggcagacccgacctgaccgacgacacccagctgctgagctacttcagcaccctggacatccagctgagagagagcctggagcccgacgcctacgccctgttccacaagaagctgaccgagggcgtgctgatgagagaccccaagttcctgtggtgcgcccagtgcagcttcggcttcatctacgagagagagcagctggaggccacctgcccccagtgccaccagaccttctgcgtgagatgcaagagacagtgcgaggacttccagaactggaagagaatgaacgaccccgagtaccaggcccagggcctggccatgtacctgcaggagaacggcatcgactgccccaagtgcaagttcagctacgccctggccagaggcggctgcatgcacttccactgcacccagtgcagacaccagttctgcagcggctgctacaacgccttctacgccaagaacaagtgccccgagcccaactgcagagtgaagaagagcctgcacggccaccaccccagagactgcctgttctacctgagagactggaccgccctgagactgcagaagctgctgcaggacaacaacgtgatgttcaacaccgagccccccgccggcgccagagccgtgcccggcggcggctgcagagtgatcgagcagaaggaggtgcccaacggcctgagagacgaggcctgcggcaaggagacccccgccggctacgccggcctgtgccaggcccactacaaggagtacctggtgagcctgatcaacgcccacagcctggaccccgccaccctgtacgaggtggaggagctggagaccgccaccgagagatacctgcacgtgagaccccagcccctggccggcgaggacccccccgcctaccaggccagactgctgcagaagctgaccgaggaggtgcccctgggccagagcatccccagaagaagaaagtag

SEQ ID NO: 97690 - DNA, 2766 bp, Artificial Sequence
  Description of Artificial Sequence: Synthetic coding sequence
atggacctgtgcaccagagccggcgagcccagcctgacccagaacacccaccccagacagcaggccctggagcagctgctggaggacaaggtggaggacgacatgctgcagctgagcgagttcgaccccctgctgagagagatcgcccccggccccctgaccacccccagcgtgcccggcagcacccccggcccctgcttcctgtgcggcagcgcccccggcaccctgcactgccccagctgcaagcaggccctgtgccccgcctgcgaccacctgttccacggccaccccagcagagcccaccacctgagacagaccctgcccggcgtgctgcagggcacccacctgagccccagcctgcccgccagcgcccagcccagaccccagagcaccagcctgctggccctgggcgacagcagcctgagcagccccaaccccgccagcgcccacctgccctggcactgcgccgcctgcgccatgctgaacgagccctgggccgtgctgtgcgtggcctgcgacagacccagaggctgcaagggcctgggcctgggcaccgagggcccccagggcaccggcggcctggagcccgacctggccagaggcagatgggcctgccagagctgcaccttcgagaacgaggccgccgccgtgctgtgcagcatctgcgagagacccagactggcccagccccccagcctggtggtggacagcagagacgccggcatctgcctgcagcccctgcagcagggcgacgccctgctggccagcgcccagagccaggtgtggtactgcatccactgcaccttctgcaacagcagccccggctgggtgtgcgtgatgtgcaacagaaccagcagccccatccccgcccagcacgcccccagaccctacgccagcagcctggagaagggcccccccaagcccggcccccccagaagactgagcgcccccctgcccagcagctgcggcgaccccgagaagcagagacaggacaagatgagagaggagggcctgcagctggtgagcatgatcagagagggcgaggccgccggcgcctgccccgaggagatcttcagcgccctgcagtacagcggcaccgaggtgcccctgcagtggctgagaagcgagctgccctacgtgctggagatggtggccgagctggccggccagcaggaccccggcctgggcgccttcagctgccaggaggccagaagagcctggctggacagacacggcaacctggacgaggccgtggaggagtgcgtgagaaccagaagaagaaaggtgcaggagctgcagagcctgggcttcggccccgaggagggcagcctgcaggccctgttccagcacggcggcgacgtgagcagagccctgaccgagctgcagagacagagactggagcccttcagacagagactgtgggacagcggccccgagcccacccccagctgggacggccccgacaagcagagcctggtgagaagactgctggccgtgtacgccctgcccagctggggcagagccgagctggccctgagcctgctgcaggagacccccagaaactacgagctgggcgacgtggtggaggccgtgagacacagccaggacagagccttcctgagaagactgctggcccaggagtgcgccgtgtgcggctgggccctgccccacaacagaatgcaggccctgaccagctgcgagtgcaccatctgccccgactgcttcagacagcacttcaccatcgccctgaaggagaagcacatcaccgacatggtgtgccccgcctgcggcagacccgacctgaccgacgacacccagctgctgagctacttcagcaccctggacatccagctgagagagagcctggagcccgacgcctacgccctgttccacaagaagctgaccgagggcgtgctgatgagagaccccaagttcctgtggtgcgcccagtgcagcttcggcttcatctacgagagagagcagctggaggccacctgcccccagtgccaccagaccttctgcgtgagatgcaagagacagtgggaggagcagcacagaggcagaagctgcgaggacttccagaactggaagagaatgaacgaccccgagtaccaggcccagggcctggccatgtacctgcaggagaacggcatcgactgccccaagtgcaagttcagctacgccctggccagaggcggctgcatgcacttccactgcacccagtgcagacaccagttctgcagcggctgctacaacgccttctacgccaagaacaagtgccccgagcccaactgcagagtgaagaagagcctgcacggccaccaccccagagactgcctgttctacctgagagactggaccgccctgagactgcagaagctgctgcaggacaacaacgtgatgttcaacaccgagccccccgccggcgccagagccgtgcccggcggcggctgcagagtgatcgagcagaaggaggtgcccaacggcctgagagacgaggcctgcggcaaggagacccccgccggctacgccggcctgtgccaggcccactacaaggagtacctggtgagcctgatcaacgcccacagcctggaccccgccaccctgtacgaggtggaggagctggagaccgccaccgagagatacctgcacgtgagaccccagcccctggccggcgaggacccccccgcctaccaggccagactgctgcagaagctgaccgaggaggtgcccctgggccagagcatccccagaagaagaaagtag

SEQ ID NO: 97691 - DNA, 513 bp, Artificial Sequence
  Description of Artificial Sequence: Synthetic coding sequence
atgcccggcgaggaggaggagagagccttcctggtggccagagaggagctggccagcgccctgagaagagacagcggccaggccttcagcctggagcagctgagacccctgctggccagcagcctgcccctggccgccagatacctgcagctggacgccgccagactggtgagatgcaacgcccacggcgagcccagaaactacctgaacaccctgagcaccgccctgaacatcctggagaagtacggcagaaacctgctgagcccccagagacccagatactggagaggcgtgaagttcaacaaccccgtgttcagaagcaccgtggacgccgtgcagggcggcagagacgtgctgagactgtacggctacaccgaggagcagcccgacggcctgagcttccccgagggccaggaggagcccgacgagcaccaggtggccaccgtgaccctggaggtgctgctgctgagaaccgagctgagcctgctgctgcagaacacccaccccagatag

SEQ ID NO: 97692 - DNA, 171 bp, Artificial Sequence
  Description of Artificial Sequence: Synthetic coding sequence
atgcccggcgaggaggaggagagagccttcctggtggccagagaggagctggccagcgccctgagaagagacagcggccaggccttcagcctggagcagctgagacccctgctggccagcagcctgcccctggccgccagatacctgcagctggacgccgccagactgtag

SEQ ID NO: 97693 - DNA, 1122 bp, Artificial Sequence
  Description of Artificial Sequence: Synthetic coding sequence
atgagaaaggccggcgccaccagcatgtgggccagctgctgcggcctgctgaacgaggtgatgggcaccggcgccgtgagaggccagcagagcgccttcgccggcgccaccggccccttcagattcacccccaaccccgagttcagcacctacccccccgccgccaccgagggccccaacatcgtgtgcaaggcctgcggcctgagcttcagcgtgttcagaaagaagcacgtgtgctgcgactgcaagaaggacttctgcagcgtgtgcagcgtgctgcaggagaacctgagaagatgcagcacctgccacctgctgcaggagaccgccttccagagaccccagctgatgagactgaaggtgaaggacctgagacagtacctgatcctgagaaacatccccatcgacacctgcagagagaaggaggacctggtggacctggtgctgtgccaccacggcctgggcagcgaggacgacatggacaccagcagcctgaacagcagcagaagccagaccagcagcttcttcaccagaagcttcttcagcaactacaccgcccccagcgccaccatgagcagcttccagggcgagctgatggacggcgaccagaccagcagaagcggcgtgcccgcccaggtgcagagcgagatcaccagcgccaacaccgaggacgacgacgacgacgacgacgaggacgacgacgacgaggaggagaacgccgaggacagaaaccccggcctgagcaaggagagagtgagagccagcctgagcgacctgagcagcctggacgacgtggagggcatgagcgtgagacagctgaaggagatcctggccagaaacttcgtgaactacagcggctgctgcgagaagtgggagctggtggagaaggtgaacagactgtacaaggagaacgaggagaaccagaagagctacggcgagagactgcagctgcaggacgaggaggacgacagcctgtgcagaatctgcatggacgccgtgatcgactgcgtgctgctggagtgcggccacatggtgacctgcaccaagtgcggcaagagaatgagcgagtgccccatctgcagacagtacgtggtgagagccgtgcacgtgttcaagagctag

SEQ ID NO: 97694 - DNA, 1119 bp, Artificial Sequence
  Description of Artificial Sequence: Synthetic coding sequence
atgaaggccggcgccaccagcatgtgggccagctgctgcggcctgctgaacgaggtgatgggcaccggcgccgtgagaggccagcagagcgccttcgccggcgccaccggccccttcagattcacccccaaccccgagttcagcacctacccccccgccgccaccgagggccccaacatcgtgtgcaaggcctgcggcctgagcttcagcgtgttcagaaagaagcacgtgtgctgcgactgcaagaaggacttctgcagcgtgtgcagcgtgctgcaggagaacctgagaagatgcagcacctgccacctgctgcaggagaccgccttccagagaccccagctgatgagactgaaggtgaaggacctgagacagtacctgatcctgagaaacatccccatcgacacctgcagagagaaggaggacctggtggacctggtgctgtgccaccacggcctgggcagcgaggacgacatggacaccagcagcctgaacagcagcagaagccagaccagcagcttcttcaccagaagcttcttcagcaactacaccgcccccagcgccaccatgagcagcttccagggcgagctgatggacggcgaccagaccagcagaagcggcgtgcccgcccaggtgcagagcgagatcaccagcgccaacaccgaggacgacgacgacgacgacgacgaggacgacgacgacgaggaggagaacgccgaggacagaaaccccggcctgagcaaggagagagtgagagccagcctgagcgacctgagcagcctggacgacgtggagggcatgagcgtgagacagctgaaggagatcctggccagaaacttcgtgaactacagcggctgctgcgagaagtgggagctggtggagaaggtgaacagactgtacaaggagaacgaggagaaccagaagagctacggcgagagactgcagctgcaggacgaggaggacgacagcctgtgcagaatctgcatggacgccgtgatcgactgcgtgctgctggagtgcggccacatggtgacctgcaccaagtgcggcaagagaatgagcgagtgccccatctgcagacagtacgtggtgagagccgtgcacgtgttcaagagctag

SEQ ID NO: 97695 - DNA, 1122 bp, Artificial Sequence; identical to SEQ ID NO: 97693
  Description of Artificial Sequence: Synthetic coding sequence

SEQ ID NO: 97696 - DNA, 1548 bp, Artificial Sequence
  Description of Artificial Sequence: Synthetic coding sequence
atggcctgcaagatcagccccggcgccaacagcgccagcctgcccggccaccccaacaaggtgatctgcgagagagtgagactgcagagcctgttccccctgctgcccagcgaccagaacaccaccgtgcaggaggacgcccacttcaaggccttcttccagagcgaggacagccccagccccaagagacagagactgagccacagcgtgttcgactacaccagcgccagccccgcccccagcccccccatgagaccctgggagatgaccagcaacagacagccccccagcgtgagacccagccagcaccacttcagcggcgagagatgcaacacccccgccagaaacagaagaagcccccccgtgagaagacagagaggcagaagagacagactgagcagacacaacagcatcagccaggacgagaactaccaccacctgccctacgcccagcagcaggccatcgaggagcccagagccttccacccccccaacgtgagccccagactgctgcaccccgccgcccaccccccccagcagaacgccgtgatggtggacatccacgaccagctgcaccagggcaccgtgcccgtgagctacaccgtgaccaccgtggccccccacggcatccccctgtgcaccggccagcacatccccgcctgcagcacccagcaggtgcccggctgcagcgtggtgttcagcggccagcacctgcccgtgtgcagcgtgcccccccccatgctgcaggcctgcagcgtgcagcacctgcccgtgccctacgccgccttcccccccctgatcagcagcgaccccttcctgatccaccccccccacctgagcccccaccaccccccccacctgcccccccccggccagttcgtgcccttccagacccagcagagcagaagccccctgcagagaatcgagaacgaggtggagctgctgggcgagcacctgcccgtgggcggcttcacctacccccccagcgcccacccccccaccctgccccccagcgcccccctgcagttcctgacccacgaccccctgcaccaggaggtgagcttcggcgtgccctacccccccttcatgcccagaagactgaccggcagaagcagatacagaagccagcagcccatccccccccccccctaccaccccagcctgctgccctacgtgctgagcatgctgcccgtgccccccgccgtgggccccaccttcagcttcgagctggacgtggaggacggcgaggtggagaactacgaggccctgctgaacctggccgagagactgggcgaggccaagcccagaggcctgaccaaggccgacatcgagcagctgcccagctacagattcaaccccaacaaccaccagagcgagcagaccctgtgcgtggtgtgcatgtgcgacttcgagagcagacagctgctgagagtgctgccctgcaaccacgagttccacgccaagtgcgtggacaagtggctgaaggccaacagaacctgccccatctgcagagccgacgccagcgaggtgcacagagacagcgagtag

SEQ ID NO: 97697 - DNA, 1299 bp, Artificial Sequence
  Description of Artificial Sequence: Synthetic coding sequence
atgagaccctgggagatgaccagcaacagacagccccccagcgtgagacccagccagcaccacttcagcggcgagagatgcaacacccccgccagaaacagaagaagcccccccgtgagaagacagagaggcagaagagacagactgagcagacacaacagcatcagccaggacgagaactaccaccacctgccctacgcccagcagcaggccatcgaggagcccagagccttccacccccccaacgtgagccccagactgctgcaccccgccgcccaccccccccagcagaacgccgtgatggtggacatccacgaccagctgcaccagggcaccgtgcccgtgagctacaccgtgaccaccgtggccccccacggcatccccctgtgcaccggccagcacatccccgcctgcagcacccagcaggtgcccggctgcagcgtggtgttcagcggccagcacctgcccgtgtgcagcgtgcccccccccatgctgcaggcctgcagcgtgcagcacctgcccgtgccctacgccgccttcccccccctgatcagcagcgaccccttcctgatccaccccccccacctgagcccccaccaccccccccacctgcccccccccggccagttcgtgcccttccagacccagcagagcagaagccccctgcagagaatcgagaacgaggtggagctgctgggcgagcacctgcccgtgggcggcttcacctacccccccagcgcccacccccccaccctgccccccagcgcccccctgcagttcctgacccacgaccccctgcaccaggaggtgagcttcggcgtgccctacccccccttcatgcccagaagactgaccggcagaagcagatacagaagccagcagcccatccccccccccccctaccaccccagcctgctgccctacgtgctgagcatgctgcccgtgccccccgccgtgggccccaccttcagcttcgagctggacgtggaggacggcgaggtggagaactacgaggccctgctgaacctggccgagagactgggcgaggccaagcccagaggcctgaccaaggccgacatcgagcagctgcccagctacagattcaaccccaacaaccaccagagcgagcagaccctgtgcgtggtgtgcatgtgcgacttcgagagcagacagctgctgagagtgctgccctgcaaccacgagttccacgccaagtgcgtggacaagtggctgaaggccaacagaacctgccccatctgcagagccgacgccagcgaggtgcacagagacagcgagtag

SEQ ID NO: 97698 - DNA, 1398 bp, Artificial Sequence
  Description of Artificial Sequence: Synthetic coding sequence
atggcctgcaagagcgaggacagccccagccccaagagacagagactgagccacagcgtgttcgactacaccagcgccagccccgcccccagcccccccatgagaccctgggagatgaccagcaacagacagccccccagcgtgagacccagccagcaccacttcagcggcgagagatgcaacacccccgccagaaacagaagaagcccccccgtgagaagacagagaggcagaagagacagactgagcagacacaacagcatcagccaggacgagaactaccaccacctgccctacgcccagcagcaggccatcgaggagcccagagccttccacccccccaacgtgagccccagactgctgcaccccgccgcccaccccccccagcagaacgccgtgatggtggacatccacgaccagctgcaccagggcaccgtgcccgtgagctacaccgtgaccaccgtggccccccacggcatccccctgtgcaccggccagcacatccccgcctgcagcacccagcaggtgcccggctgcagcgtggtgttcagcggccagcacctgcccgtgtgcagcgtgcccccccccatgctgcaggcctgcagcgtgcagcacctgcccgtgccctacgccgccttcccccccctgatcagcagcgaccccttcctgatccaccccccccacctgagcccccaccaccccccccacctgcccccccccggccagttcgtgcccttccagacccagcagagcagaagccccctgcagagaatcgagaacgaggtggagctgctgggcgagcacctgcccgtgggcggcttcacctacccccccagcgcccacccccccaccctgccccccagcgcccccctgcagttcctgacccacgaccccctgcaccaggaggtgagcttcggcgtgccctacccccccttcatgcccagaagactgaccggcagaagcagatacagaagccagcagcccatccccccccccccctaccaccccagcctgctgccctacgtgctgagcatgctgcccgtgccccccgccgtgggccccaccttcagcttcgagctggacgtggaggacggcgaggtggagaactacgaggccctgctgaacctggccgagagactgggcgaggccaagcccagaggcctgaccaaggccgacatcgagcagctgcccagctacagattcaaccccaacaaccaccagagcgagcagaccctgtgcgtggtgtgcatgtgcgacttcgagagcagacagctgctgagagtgctgccctgcaaccacgagttccacgccaagtgcgtggacaagtggctgaaggccaacagaacctgccccatctgcagagccgacgccagcgaggtgcacagagacagcgagtag

SEQ ID NO: 97699 - DNA, 1299 bp, Artificial Sequence; identical to SEQ ID NO: 97697
  Description of Artificial Sequence: Synthetic coding sequence

SEQ ID NO: 97700 - DNA, 1320 bp, Artificial Sequence
  Description of Artificial Sequence: Synthetic coding sequence
atgcagcacacctgcacccagcagaagaaggtgacctacaagcacatcgccagattcagccccagaaacagactgtgccaggccgacgccgtgttcaacaacaacctggccggcttccagctgcagagcccccccgtgagaagacagagaggcagaagagacagactgagcagacacaacagcatcagccaggacgagaactaccaccacctgccctacgcccagcagcaggccatcgaggagcccagagccttccacccccccaacgtgagccccagactgctgcaccccgccgcccaccccccccagcagaacgccgtgatggtggacatccacgaccagctgcaccagggcaccgtgcccgtgagctacaccgtgaccaccgtggccccccacggcatccccctgtgcaccggccagcacatccccgcctgcagcacccagcaggtgcccggctgcagcgtggtgttcagcggccagcacctgcccgtgtgcagcgtgcccccccccatgctgcaggcctgcagcgtgcagcacctgcccgtgccctacgccgccttcccccccctgatcagcagcgaccccttcctgatccaccccccccacctgagcccccaccaccccccccacctgcccccccccggccagttcgtgcccttccagacccagcagagcagaagccccctgcagagaatcgagaacgaggtggagctgctgggcgagcacctgcccgtgggcggcttcacctacccccccagcgcccacccccccaccctgccccccagcgcccccctgcagttcctgacccacgaccccctgcaccaggaggtgagcttcggcgtgccctacccccccttcatgcccagaagactgaccggcagaagcagatacagaagccagcagcccatccccccccccccctaccaccccagcctgctgccctacgtgctgagcatgctgcccgtgccccccgccgtgggccccaccttcagcttcgagctggacgtggaggacggcgaggtggagaactacgaggccctgctgaacctggccgagagactgggcgaggccaagcccagaggcctgaccaaggccgacatcgagcagctgcccagctacagattcaaccccaacaaccaccagagcgagcagaccctgtgcgtggtgtgcatgtgcgacttcgagagcagacagctgctgagagtgctgccctgcaaccacgagttccacgccaagtgcgtggacaagtggctgaaggccaacagaacctgccccatctgcagagccgacgccagcgaggtgcacagagacagcgagtag

SEQ ID NO: 97701 - DNA, 999 bp, Artificial Sequence
  Description of Artificial Sequence: Synthetic coding sequence
atggtggacatccacgaccagctgcaccagggcaccgtgcccgtgagctacaccgtgaccaccgtggccccccacggcatccccctgtgcaccggccagcacatccccgcctgcagcacccagcaggtgcccggctgcagcgtggtgttcagcggccagcacctgcccgtgtgcagcgtgcccccccccatgctgcaggcctgcagcgtgcagcacctgcccgtgccctacgccgccttcccccccctgatcagcagcgaccccttcctgatccaccccccccacctgagcccccaccaccccccccacctgcccccccccggccagttcgtgcccttccagacccagcagagcagaagccccctgcagagaatcgagaacgaggtggagctgctgggcgagcacctgcccgtgggcggcttcacctacccccccagcgcccacccccccaccctgccccccagcgcccccctgcagttcctgacccacgaccccctgcaccaggaggtgagcttcggcgtgccctacccccccttcatgcccagaagactgaccggcagaagcagatacagaagccagcagcccatccccccccccccctaccaccccagcctgctgccctacgtgctgagcatgctgcccgtgccccccgccgtgggccccaccttcagcttcgagctggacgtggaggacggcgaggtggagaactacgaggccctgctgaacctggccgagagactgggcgaggccaagcccagaggcctgaccaaggccgacatcgagcagctgcccagctacagattcaaccccaacaaccaccagagcgagcagaccctgtgcgtggtgtgcatgtgcgacttcgagagcagacagctgctgagagtgctgccctgcaaccacgagttccacgccaagtgcgtggacaagtggctgaaggccaacagaacctgccccatctgcagagccgacgccagcgaggtgcacagagacagcgagtag

SEQ ID NO: 97702 - DNA, 1320 bp, Artificial Sequence; identical to SEQ ID NO: 97700
  Description of Artificial Sequence: Synthetic coding sequence

SEQ ID NO: 97703 - DNA, 1299 bp, Artificial Sequence; identical to SEQ ID NO: 97697
  Description of Artificial Sequence: Synthetic coding sequence

SEQ ID NO: 97704 - DNA, 1263 bp, Artificial Sequence
  Description of Artificial Sequence: Synthetic coding sequence
atgtggtggagagacctgaccagactgagactgtggctgaagagagaggccatccccggcgagggcagaaaggccgccaaggtgaacgccggcgtgggcgagaagggcatctacaccgccagcagcagaggcggcccccccagcgccagaagcaaggccgtgaccgtggtggccgagggcgccgccagcagaagctggctgagcatggacgcccccgagctgggccccggcctggtggagagactggagcagctggccacctgccccctgtgcggcggcagcttcgaggaccccgtgctgctggcctgcgagcacagcttctgcagagcctgcctggccagaagatggggcaccccccccgccaccggcaccgaggccagccccaccgcctgcccctgctgcggcctgccctgccccagaagaagcctgagaagcaacgtgagactggccgtggaggtgagaatcagcagagagctgagagagaagctggccgagcccggcgccagagccggcagaagaagaggcggcagaatccccaccatgggctgcctggacctgcccggcgaggacatgagaaagacctggagaagattcgaggtgcccaccagcaagagcagcaacagcgaggacgacctgcccgaggactaccccgtggtgaagaagatgctgcacagactgaccgccgacctgaccctggaccccggcaccgcccacagaagactgctgatcagcgccgacagaagaagcgtgcagctggccccccccggcacccccgccccccccgacggccccaagagattcgaccagctgcccgccgtgctgggcgcccagggcttcggcgccggcagacactgctgggaggtggagaccgccgacgccgccagctgcagagacagcagcggcgaggacgccgacgacgaggagagccactacgccgtgggcgccgccggcgagagcgtgcagagaaagggctgcgtgagactgtgccccgccggcgccgtgtgggccgtggagggcagaggcggcagactgtgggccctgaccgcccccgagcccaccctgctgggcggcgtggagcccccccccagaagaatcagagtggacctggactgggagagaggcagagtggccttctacgacggcagaagcctggacctgctgtacgccttccaggcccccggccccctgggcgagagaatcttccccctgttctgcacctgcgaccccagagcccccctgagaatcgtgcccgccgagagctag

SEQ ID NO: 97705 - DNA, 756 bp, Artificial Sequence
  Description of Artificial Sequence: Synthetic coding sequence
atgtggtggagagacctgaccagactgagactgtggctgaagagagaggccatccccggcgagggcagaaaggccgccaaggtgaacgccggcgtgggcgagaagggcatctacaccgccagcagcagaggcggcccccccagcgccagaagcaaggccgtgaccgtggtggccgagggcgccgccagcagaagctggctgagcatggacgcccccgagctgggccccggcctggtggagagactggagcagctggccacctgccccctgtgcggcggcagcttcgaggaccccgtgctgctggcctgcgagcacagcttctgcagagcctgcctggccagaagatggggcaccccccccgccaccggcaccgaggccagccccaccgcctgcccctgctgcggcctgccctgccccagaagaagcctgagaagcaacgtgagactggccgtggaggtgagaatcagcagagagctgctgttcggcggcggcatcccccacagcttcctgggcacccacagccacgcccactgcagaagcatcaacagcaacccccacttcagacccaagatcatgagaccccacctggtgagcaccttccccagaccctgcagcaagcccaaccccttcctgcccagcggcagccagaacctgctgagccccaccgccaccaccgtgctgcccgacttcagccacagcaaccacagcagacccgccatgggcaacagacccagccccagcgtgctggtgaagtag

SEQ ID NO: 97706 - DNA, 1065 bp, Artificial Sequence
  Description of Artificial Sequence: Synthetic coding sequence
atgtggtggagagacctgaccagactgagactgtggctgaagagagaggccatccccggcgagggcagaaaggccgccaaggtgaacgccggcgtgggcgagaagggcatctacaccgccagcagcagaggcggcccccccagcgccagaagcaaggccgtgaccgtggtggccgagggcgccgccagcagaagctggctgagcatggacgcccccgagctgggccccggcctggtggagagactggagcagctggccacctgccccctgtgcggcggcagcttcgaggaccccgtgctgctggcctgcgagcacagcttctgcagagcctgcctggccagaagatggggcaccccccccgccaccggcaccgaggccagccccaccgcctgcccctgctgcggcctgccctgccccagaagaagcctgagaagcaacgtgagactggccgtggaggtgagaatcagcagagagctgagagagaagctggccgagcccggcgccagagccggcagaagaagaggcggcagaatccccaccatgggctgcctggacctgcccggcgaggacatgagaaagacctggagaagattcgaggtgcccacccccaagagcagcaacagcgaggacgacctgcccgaggactaccccgtggtgaagaagatgctgcacagactgaccgccgacctgaccctggaccccggcaccgcccacagaagactgctgatcagcaccgacagaagaagcgtgcagctggccccccccggcacccccgccccccccgacggccccaagagattcgaccagctgcccgccgtgctgggcgcccagggcttcggcgccggcagacactgctgggaggtggagaccgccgacgccgccagctgcagagacagcagcggcgaggacgaggacgacgaggagagccactacgccgtgggcgccgccggcgagagcgtgcagagaaagggctgcgcccccggccccctgggcgagagaatcttccccctgttctgcacctgcgaccccagagcccccctgagaatcgtgcccgccgagagctag

SEQ ID NO: 97707 - DNA, 1065 bp, Artificial Sequence
  Description of Artificial Sequence: Synthetic coding sequence
atgtggtggagagacctgaccagactgagactgtggctgaagagagaggccatccccggcgagggcagaaaggccgccaaggtgaacgccggcgtgggcgagaagggcatctacaccgccagcagcagaggcggcccccccagcgccagaagcaaggccgtgaccgtggtggccgagggcgccgccagcagaagctggctgagcatggacgcccccgagctgggccccggcctggtggagagactggagcagctggccacctgccccctgtgcggcggcagcttcgaggaccccgtgctgctggcctgcgagcacagcttctgcagagcctgcctggccagaagatggggcaccccccccgccaccggcaccgaggccagccccaccgcctgcccctgctgcggcctgccctgccccagaagaagcctgagaagcaacgtgagactggccgtggaggtgagaatcagcagagagctgagagagaagctggccgagcccggcgccagagccggcagaagaagaggcggcagaatccccaccatgggctgcctggacctgcccggcgaggacatgagaaagacctggagaagattcgaggtgcccaccagcaagagcagcaacagcgaggacgacctgcccgaggactaccccgtggtgaagaagatgctgcacagactgaccgccgacctgaccctggaccccggcaccgcccacagaagactgctgatcagcgccgacagaagaagcgtgcagctggccccccccggcacccccgccccccccgacggccccaagagattcgaccagctgcccgccgtgctgggcgcccagggcttcggcgccggcagacactgctgggaggtggagaccgccgacgccgccagctgcagagacagcagcggcgaggacgccgacgacgaggagagccactacgccgtgggcgccgccggcgagagcgtgcagagaaagggctgcgcccccggccccctgggcgagagaatcttccccctgttctgcacctgcgaccccagagcccccctgagaatcgtgcccgccgagagctag

SEQ ID NO: 97708 - DNA, 1263 bp, Artificial Sequence
  Description of Artificial Sequence: Synthetic coding sequence
atgtggtggagagacctgaccagactgagactgtggctgaagagagaggccatccccggcgagggcagaaaggccgccaaggtgaacgccggcgtgggcgagaagggcatctacaccgccagcagcagaggcggcccccccagcgccagaagcaaggccgtgaccgtggtggccgagggcgccgccagcagaagctggctgagcatggacgcccccgagctgggccccggcctggtggagagactggagcagctggccacctgccccctgtgcggcggcagcttcgaggaccccgtgctgctggcctgcgagcacagcttctgcagagcctgcctggccagaagatggggcaccccccccgccaccggcaccgaggccagccccaccgcctgcccctgctgcggcctgccctgccccagaagaagcctgagaagcaacgtgagactggccgtggaggtgagaatcagcagagagctgagagagaagctggccgagcccggcgccagagccggcagaagaagaggcggcagaatccccaccatgggctgcctggacctgcccggcgaggacatgagaaagacctggagaagattcgaggtgcccacccccaagagcagcaacagcgaggacgacctgcccgaggactaccccgtggtgaagaagatgctgcacagactgaccgccgacctgaccctggaccccggcaccgcccacagaagactgctgatcagcaccgacagaagaagcgtgcagctggccccccccggcacccccgccccccccgacggccccaagagattcgaccagctgcccgccgtgctgggcgcccagggcttcggcgccggcagacactgctgggaggtggagaccgccgacgccgccagctgcagagacagcagcggcgaggacgaggacgacgaggagagccactacgccgtgggcgccgccggcgagagcgtgcagagaaagggctgcgtgagactgtgccccgccggcgccgtgtgggccgtggagggcagaggcggcagactgtgggccctgaccgcccccgagcccaccctgctgggcggcgtggagcccccccccagaagaatcagagtggacctggactgggagagaggcagagtggccttctacgacggcagaagcctggacctgctgtacgccttccaggcccccggccccctgggcgagagaatcttccccctgttctgcacctgcgaccccagagcccccctgagaatcgtgcccgccgagagctag

SEQ ID NO: 97709 - DNA, 1065 bp, Artificial Sequence
  Description of Artificial Sequence: Synthetic coding sequence
atgtggtggagagacctgaccagactgagactgtggctgaagagagaggccatccccggcgagggcagaaaggccgccaaggtgaacgccggcgtgggcgagaagggcatctacaccgccagcagcagaggcggcccccccagcgccagaagcaaggccgtgaccgtggtggccgagggcgccgccagcagaagctggctgagcatggacgcccccgagctgggccccggcctggtggagagactggagcagctggccacctgccccctgtgcggcggcagcttcgaggaccccgtgctgctggcctgcgagcacagcttctgcagagcctgcctggccagaagatggggcaccccccccgccaccggcaccgaggccagccccaccgcctgcccctgctgcggcctgccctgccccagaagaagcctgagaagcaacgtgagactggccgtggaggtgagaatcagcagagagctgagagagaagctggccgagcccggcgccagagccggcagaagaagaggcggcagaatccccaccatgggctgcctggacctgcccggcgaggacatgagaaagacctggagaagattcgaggtgcccaccagcaagagcagcaacagcgaggacgacctgcccgaggactaccccgtggtgaagaagatgctgcacagactgaccgccgacctgaccctggaccccggcaccgcccacagaagactgctgatcagcgccgacagaagaagcgtgcagctggccccccccggcacccccgccccccccgacggccccaagagattcaaccagctgcccgccgtgctgggcgcccagggcttcggcgccggcagacactgctgggaggtggagaccgccgacgccgccagctgcagagacagcagcggcgaggacgccgacgacgaggagagccactacgccgtgggcgccgccggcgagagcgtgcagagaaagggctgcgcccccggccccctgggcgagagaatcttccccctgttctgcacctgcgaccccagagcccccctgagaatcgtgcccgccgagagctag

SEQ ID NO: 97710 - DNA, 1263 bp, Artificial Sequence
  Description of Artificial Sequence: Synthetic coding sequence
atgtggtggagagacctgaccagactgagactgtggctgaagagagaggccatccccggcgagggcagaaaggccgccaaggtgaacgccggcgtgggcgagaagggcatctacaccgccagcagcagaggcggcccccccagcgccagaagcaaggccgtgaccgtggtggccgagggcgccgccagcagaagctggctgagcatggacgcccccgagctgggccccggcctggtggagagactggagcagctggccacctgccccctgtgcggcggcagcttcgaggaccccgtgctgctggcctgcgagcacagcttctgcagagcctgcctggccagaagatggggcaccccccccgccaccggcaccgaggccagccccaccgcctgcccctgctgcggcctgccctgccccagaagaagcctgagaagcaacgtgagactggccgtggaggtgagaatcagcagagagctgagagagaagctggccgagcccggcgccagagccggcagaagaagaggcggcagaatccccaccatgggctgcctggacctgcccggcgaggacatgagaaagacctggagaagattcgaggtgcccaccagcaagagcagcaacagcgaggacgacctgcccgaggactaccccgtggtgaagaagatgctgcacagactgaccgccgacctgaccctggaccccggcaccgcccacagaagactgctgatcagcgccgacagaagaagcgtgcagctggccccccccggcacccccgccccccccgacggccccaagagattcgaccagctgcccgccgtgctgggcgcccagggcttcggcgccggcagacactgctgggaggtggagaccgccgacgccgccagctgcagagacagcagcggcgaggacgccgacgacgaggagagccactacgccgtgggcgccgccggcgagagcgtgcagagaaagggctgcgtgagactgtgccccgccggcgccgtgtgggccgtgggcggcagaggcggcagactgtgggccctgaccgcccccgagcccaccctgctgggcggcgtggagcccccccccagaagaatcagagtggacctggactgggagagaggcagagtggccttctacgacggcagaagcctggacctgctgtacgccttccaggcccccggccccctgggcgagagaatcttccccctgttctgcacctgcgaccccagagcccccctgagaatcgtgcccgccgagagctag

SEQ ID NO: 97711 - DNA, 1263 bp, Artificial Sequence; identical to SEQ ID NO: 97704
  Description of Artificial Sequence: Synthetic coding sequence

SEQ ID NO: 97712 - DNA, 1263 bp, Artificial Sequence; identical to SEQ ID NO: 97704
  Description of Artificial Sequence: Synthetic coding sequence

SEQ ID NO: 97713 - DNA, 1065 bp, Artificial Sequence; identical to SEQ ID NO: 97707
  Description of Artificial Sequence: Synthetic coding sequence

SEQ ID NO: 97714 - DNA, 1065 bp, Artificial Sequence; identical to SEQ ID NO: 97707
  Description of Artificial Sequence: Synthetic coding sequence

SEQ ID NO: 97715 - DNA, 1065 bp, Artificial Sequence; identical to SEQ ID NO: 97707
  Description of Artificial Sequence: Synthetic coding sequence

SEQ ID NO: 97716 - DNA, 1263 bp, Artificial Sequence
  Description of Artificial Sequence: Synthetic coding sequence
atgtggtggagagacctgaccagactgagactgtggctgaagagagaggccatccccggcgagggcagaaaggccgccaaggtgaacgccggcgtgggcgagaagggcatctacaccgccagcagcagaggcggcccccccagcgccagaagcaaggccgtgaccgtggtggccgagggcgccgccagcagaagctggctgagcatggacgcccccgagctgggccccggcctggtggagagactggagcagctggccacctgccccctgtgcggcggcagcttcgaggaccccgtgctgctggcctgcgagcacagcttctgcagagcctgcctggccagaagatggggcaccccccccgccaccggcaccgaggccagccccaccgcctgcccctgctgcggcctgccctgccccagaagaagcctgagaagcaacgtgagactggccgtggaggtgagaatcagcagagagctgagagagaagctggccgagcccggcgccagagccggcagaagaagaggcggcagaatccccaccatgggctgcctggacctgcccggcgaggacatgagaaagacctggagaagattcgaggtgcccaccagcaagagcagcaacagcgaggacgacctgcccgaggactaccccgtggtgaagaagatgctgcacagactgaccgccgacctgaccctggaccccggcaccgcccacagaagactgctgatcagcgccgacagaagaagcgtgcagctggccccccccggcacccccgccccccccgacggccccaagagattcaaccagctgcccgccgtgctgggcgcccagggcttcggcgccggcagacactgctgggaggtggagaccgccgacgccgccagctgcagagacagcagcggcgaggacgccgacgacgaggagagccactacgccgtgggcgccgccggcgagagcgtgcagagaaagggctgcgtgagactgtgccccgccggcgccgtgtgggccgtggagggcagaggcggcagactgtgggccctgaccgcccccgagcccaccctgctgggcggcgtggagcccccccccagaagaatcagagtggacctggactgggagagaggcagagtggccttctacgacggcagaagcctggacctgctgtacgccttccaggcccccggccccctgggcgagagaatcttccccctgttctgcacctgcgaccccagagcccccctgagaatcgtgcccgccgagagctag

SEQ ID NO: 97717 - DNA, 1263 bp, Artificial Sequence; identical to SEQ ID NO: 97704
  Description of Artificial Sequence: Synthetic coding sequence

SEQ ID NO: 97718 - DNA, 1065 bp, Artificial Sequence; identical to SEQ ID NO: 97707
  Description of Artificial Sequence: Synthetic coding sequence

SEQ ID NO: 97719 - DNA, 1263 bp, Artificial Sequence; identical to SEQ ID NO: 97704
  Description of Artificial Sequence: Synthetic coding sequence

SEQ ID NO: 97720 - DNA, 1065 bp, Artificial Sequence; identical to SEQ ID NO: 97707
  Description of Artificial Sequence: Synthetic coding sequence

SEQ ID NO: 97721 - DNA, 756 bp, Artificial Sequence; identical to SEQ ID NO: 97705
  Description of Artificial Sequence: Synthetic coding sequence

SEQ ID NO: 97722 - DNA, 756 bp, Artificial Sequence; identical to SEQ ID NO: 97705
  Description of Artificial Sequence: Synthetic coding sequence

SEQ ID NO: 97723 - DNA, 756 bp, Artificial Sequence; identical to SEQ ID NO: 97705
  Description of Artificial Sequence: Synthetic coding sequence

SEQ ID NO: 97724 - DNA, 756 bp, Artificial Sequence; identical to SEQ ID NO: 97705
  Description of Artificial Sequence: Synthetic coding sequence

SEQ ID NO: 97725 - DNA, 756 bp, Artificial Sequence; identical to SEQ ID NO: 97705
  Description of Artificial Sequence: Synthetic coding sequence

SEQ ID NO: 97726 - DNA, 756 bp, Artificial Sequence
  Description of Artificial Sequence: Synthetic coding sequence
atgtggtggagagacctgaccagactgagactgtggctgaagagagaggccatccccggcgagggcagaaaggccgccaaggtgaacgccggcgtgggcgagaagggcatctacaccgccagcagcagaggcggcccccccagcgccagaagcaaggccgtgaccgtggtggccgagggcgccgccagcagaagctggctgagcatggacgcccccgagctgggccccggcctggtggagagactggagcagctggccacctgccccctgtgcggcggcagcttcgaggaccccgtgctgctggcctgcgagcacagcttctgcagagcctgcctggccagaagatggggcaccccccccgccaccggcaccgaggccagccccaccgcctgcccctgctgcggcctgccctgccccagaagaagcctgagaagcaacgtgagactggccgtggaggtgagaatcagcagagagctgctgttcggcggcggcatcccccacagcttcctgggcacccacagccacgcccactgcagaagcatcaacagcaacccccacttcagacccaagatcatgagaccccacctggtgagcaccttccccagaccctgcagcaagcccaaccccttcctgcccagcggcagccagaacctgctgagccccaccgccgccaccgtgctgcccgacttcagccacagcaaccacagcagacccgccatgggcaacagacccagccccagcgtgctggtgaagtag

SEQ ID NO: 97727 - DNA, 756 bp, Artificial Sequence
  Description of Artificial Sequence: Synthetic coding sequence
atgtggtggagagacctgaccagactgagactgtggctgaagagagaggccatccccggcgagggcagaaaggccgccaaggtgaacgccggcgtgggcgagaagggcatctacaccgccagcagcagaggcggcccccccagcgccagaagcaaggccgtgaccgtggtggccgagggcgccgccagcagaagctggctgagcatggacgcccccgagctgggccccggcctggtggagagactggagcagctggccacctgccccctgtgcggcggcagcttcgaggaccccgtgctgctggcctgcgagcacagcttctgcagagcctgcctggccagaagatggggcaccccccccgccaccggcaccgaggccagccccaccgcctgcccctgctgcggcctgccctgccccagaagaagcctgagaagcaacgtgagactggccgtggaggtgagaatcagcagagagctgctgttcggcagaggcatcccccacagcttcctgggcacccacagccacgcccactgcagaagcatcaacagcaacccccacttcagacccaagatcatgagaccccacctggtgagcaccttcccccacccctgcagcaagcccaaccccttcctgcccagcggcagccagaacctgctgagccccaccgccaccaccgtgctgcccgacttcagccacagcaaccacagcagacccgccatgggcaacagacccagccccagcgtgctggtgaagtag

SEQ ID NO: 97728 - DNA, 573 bp, Artificial Sequence
  Description of Artificial Sequence: Synthetic coding sequence
atgagcaccagaaagagaagaggcggcgccatcaacagcagacaggcccagaagagaaccagagaggccaccagcacccccgagatcagcctggaggccgagcccatcgagctggtggagaccgccggcgacgagatcgtggacctgacctgcgagagcctggagcccgtggtggtggacctgacccacaacgacagcgtggtgatcgtggacgagagaagaagacccagaagaaacgccagaagactgccccaggaccacgccgacagctgcgtggtgagcagcgacgacgaggagctgagcagagacagagacgtgtacgtgaccacccacacccccagaaacgccagagacgagggcgccaccggcctgagacccagcggcaccgtgagctgccccatctgcatggacggctacagcgagatcgtgcagaacggcagactgatcgtgagcaccgagtgcggccacgtgttctgcagccagtgcctgagagacagcctgaagaacgccaacacctgccccacctgcagaaagaagatcaaccacaagagataccaccccatctacatctag

SEQ ID NO: 97729 - DNA, 18 bp, Artificial Sequence
  Description of Artificial Sequence: Synthetic coding sequence
atgagcaccagaaagtag

SEQ ID NO: 97730 - DNA, 573 bp, Artificial Sequence; identical to SEQ ID NO: 97728
  Description of Artificial Sequence: Synthetic coding sequence

SEQ ID NO: 97731 - DNA, 573 bp, Artificial Sequence; identical to SEQ ID NO: 97728
  Description of Artificial Sequence: Synthetic coding sequence

SEQ ID NO: 97732 - DNA, 165 bp, Artificial Sequence
  Description of Artificial Sequence: Synthetic coding sequence
atgagcaccagaaagagaagaggcggcgccatcaacagcagacaggcccagaagagaaccagagaggccaccagcacccccgagatcagcctggaggccgagcccatcgagctggtggagaccgccggcgacgagatcgtggacctgacctgcgagagcctgtag

SEQ ID NO: 97733 - DNA, 345 bp, Artificial Sequence
  Description of Artificial Sequence: Synthetic coding sequence
atgagcaccagaaagagaagaggcggcgccatcaacagcagacaggcccagaagagaaccagagaggccaccagcacccccgagatcagcctggaggccgagcccatcgagctggtggagaccgccggcgacgagatcgtggacctgacctgcgagagcctggagcccgtggtggtggacctgacccacaacgacagcgtggtggtgagcgtgggcgtgccccaggtgctgagcgtggtgcccagcgcctggaccgacacccagagaagctgcagaatggacgtgagcagcttcccccagaacgccgccatgagcagcgtggccagcgccagcgtgatcccctag

SEQ ID NO: 97734 - DNA, 573 bp, Artificial Sequence
  Description of Artificial Sequence: Synthetic coding sequence
atgagcaccagaaagagaagaggcggcgccatcaacagcagacaggcccagaagagaaccagagaggccaccagcacccccgagatcagcctggaggccgagcccatcgagctggtggagaccgccggcgacgagatcgtggacctgacctgcgagagcctggagcccgtggtggtggacctgacccacaacgacagcgtggtggtgagcgacgagagaagaagacccagaagaaacgccagaagactgccccaggaccacgccgacagctgcgtggtgagcagcgacgacgaggagctgagcagagacagagacgtgtacgtgaccacccacacccccagaaacgccagagacgagggcgccaccggcctgagacccagcggcaccgtgagctgccccatctgcatggacggctacagcgagatcgtgcagaacggcagactgatcgtgagcaccgagtgcggccacgtgttctgcagccagtgcctgagagacagcctgaagaacgccaacacctgccccacctgcagaaagaagatcaaccacaagagataccaccccatctacatctag

SEQ ID NO: 97735 - DNA, 342 bp, Artificial Sequence
  Description of Artificial Sequence: Synthetic coding sequence
atgagcaccagaaagagaagaggcggcgccatcaacagcagacaggcccagaagagaaccagagaggccaccagcacccccgagatcagcctggaggccgagcccatcgagctggtggagaccgccggcgacgagatcgtggacctgacctgcgagagcctggagcccgtggtggtggacctgacccacaacgacagcgtggtgatcgtggacggcccccaggtgctgagcgtggtgcccagcgcctggaccgacacccagagaagctgcagaatggacgtgagcagcttcccccagaacgccgccatgagcagcgtggccagcgccagcgtgatcccctag

SEQ ID NO: 97736 - DNA, 2352 bp, Artificial Sequence
  Description of Artificial Sequence: Synthetic coding sequence
atgagcggcggccaccagctgcagctggccgccctgtggccctggctgctgatggccaccctgcaggccggcttcggcagaaccggcctggtgctggccgccgccgtggagagcgagagaagcgccgagcagaaggccatcatcagagtgatccccctgaagatggaccccaccggcaagctgaacctgaccctggagggcgtgttcgccggcgtggccgagatcacccccgccgagggcaagctgatgcagagccaccccctgtacctgtgcaacgccagcgacgacgacaacctggagcccggcttcatcagcatcgtgaagctggagagccccagaagagcccccagaccctgcctgagcctggccagcaaggccagaatggccggcgagagaggcgccagcgccgtgctgttcgacatcaccgaggacagagccgccgccgagcagctgcagcagcccctgggcctgacctggcccgtggtgctgatctggggcaacgacgccgagaagctgatggagttcgtgtacaagaaccagaaggcccacgtgagaatcgagctgaaggagccccccgcctggcccgactacgacgtgtggatcctgatgaccgtggtgggcaccatcttcgtgatcatcctggccagcgtgctgagaatcagatgcagacccagacacagcagacccgaccccctgcagcagagaaccgcctgggccatcagccagctggccaccagaagataccaggccagctgcagacaggccagaggcgagtggcccgacagcggcagcagctgcagcagcgcccccgtgtgcgccatctgcctggaggagttcagcgagggccaggagctgagagtgatcagctgcctgcacgagttccacagaaactgcgtggacccctggctgcaccagcacagaacctgccccctgtgcatgttcaacatcaccgagggcgacagcttcagccagagcctgggccccagcagaagctaccaggagcccggcagaagactgcacctgatcagacagcaccccggccacgcccactaccacctgcccgccgcctacctgctgggccccagcagaagcgccgtggccagaccccccagacccggccccttcctgcccagccaggagcccggcatgggccccagacaccacagattccccagagccgcccaccccagagcccccggcgagcagcagagactggccggcgcccagcacccctacgcccagggctggggcctgagccacctgcagagcaccagccagcaccccgccgcctgccccgtgcccctgagaagagccagaccccccgacagcagcggcagcggcgagagctactgcaccgagagaagcggctacctggccgacggccccgccagcgacagcagcagcggcccctgccacggcagcagcagcgacagcgtggtgaactgcaccgacatcagcctgcagggcgtgcacggcagcagcagcaccttctgcagcagcctgagcagcgacttcgaccccctggtgtactgcagccccaagggcgacccccagagagtggacatgcagcccagcgtgaccagcagacccagaagcctggacagcgtggtgcccaccggcgagacccaggtgagcagccacgtgcactaccacagacacagacaccaccactacaagaagagattccagtggcacggcagaaagcccggccccgagaccggcgtgccccagagcagaccccccatccccagaacccagccccagcccgagccccccagccccgaccagcaggtgaccagaagcaacagcgccgcccccagcggcagactgagcaacccccagtgccccagagccctgcccgagcccgcccccggccccgtggacgccagcagcatctgccccagcaccagcagcctgttcaacctgcagaagagcagcctgagcgccagacacccccagagaaagagaagaggcggccccagcgagcccacccccggcagcagaccccaggacgccaccgtgcaccccgcctgccagatcttcccccactacacccccagcgtggcctacccctggagccccgaggcccaccccctgatctgcggcccccccggcctggacaagagactgctgcccgagacccccggcccctgctacagcaacagccagcccgtgtggctgtgcctgacccccagacagcccctggagccccacccccccggcgagggccccagcgagtggagcagcgacaccgccgagggcagaccctgcccctacccccactgccaggtgctgagcgcccagcccggcagcgaggaggagctggaggagctgtgcgagcaggccgtgtag

SEQ ID NO: 97737 - DNA, 2229 bp, Artificial Sequence
  Description of Artificial Sequence: Synthetic coding sequence
atgagcggcggccaccagctgcagctggccgccctgtggccctggctgctgatggccaccctgcaggccggcttcggcagaaccggcctggtgctggccgccgccgtggagagcgagagaagcgccgagcagaaggccatcatcagagtgatccccctgaagatggaccccaccggcaagctgaacctgaccctggagggcgtgttcgccggcgtggccgagatcacccccgccgagggcaagctgatgcaggccagaatggccggcgagagaggcgccagcgccgtgctgttcgacatcaccgaggacagagccgccgccgagcagctgcagcagcccctgggcctgacctggcccgtggtgctgatctggggcaacgacgccgagaagctgatggagttcgtgtacaagaaccagaaggcccacgtgagaatcgagctgaaggagccccccgcctggcccgactacgacgtgtggatcctgatgaccgtggtgggcaccatcttcgtgatcatcctggccagcgtgctgagaatcagatgcagacccagacacagcagacccgaccccctgcagcagagaaccgcctgggccatcagccagctggccaccagaagataccaggccagctgcagacaggccagaggcgagtggcccgacagcggcagcagctgcagcagcgcccccgtgtgcgccatctgcctggaggagttcagcgagggccaggagctgagagtgatcagctgcctgcacgagttccacagaaactgcgtggacccctggctgcaccagcacagaacctgccccctgtgcatgttcaacatcaccgagggcgacagcttcagccagagcctgggccccagcagaagctaccaggagcccggcagaagactgcacctgatcagacagcaccccggccacgcccactaccacctgcccgccgcctacctgctgggccccagcagaagcgccgtggccagaccccccagacccggccccttcctgcccagccaggagcccggcatgggccccagacaccacagattccccagagccgcccaccccagagcccccggcgagcagcagagactggccggcgcccagcacccctacgcccagggctggggcctgagccacctgcagagcaccagccagcaccccgccgcctgccccgtgcccctgagaagagccagaccccccgacagcagcggcagcggcgagagctactgcaccgagagaagcggctacctggccgacggccccgccagcgacagcagcagcggcccctgccacggcagcagcagcgacagcgtggtgaactgcaccgacatcagcctgcagggcgtgcacggcagcagcagcaccttctgcagcagcctgagcagcgacttcgaccccctggtgtactgcagccccaagggcgacccccagagagtggacatgcagcccagcgtgaccagcagacccagaagcctggacagcgtggtgcccaccggcgagacccaggtgagcagccacgtgcactaccacagacacagacaccaccactacaagaagagattccagtggcacggcagaaagcccggccccgagaccggcgtgccccagagcagaccccccatccccagaacccagccccagcccgagccccccagccccgaccagcaggtgaccagaagcaacagcgccgcccccagcggcagactgagcaacccccagtgccccagagccctgcccgagcccgcccccggccccgtggacgccagcagcatctgccccagcaccagcagcctgttcaacctgcagaagagcagcctgagcgccagacacccccagagaaagagaagaggcggccccagcgagcccacccccggcagcagaccccaggacgccaccgtgcaccccgcctgccagatcttcccccactacacccccagcgtggcctacccctggagccccgaggcccaccccctgatctgcggcccccccggcctggacaagagactgctgcccgagacccccggcccctgctacagcaacagccagcccgtgtggctgtgcctgacccccagacagcccctggagccccacccccccggcgagggccccagcgagtggagcagcgacaccgccgagggcagaccctgcccctacccccactgccaggtgctgagcgcccagcccggcagcgaggaggagctggaggagctgtgcgagcaggccgtgtag

SEQ ID NO: 97738 - DNA, 543 bp, Artificial Sequence
  Description of Artificial Sequence: Synthetic coding sequence
atggccgccgccgaggaggaggacggcggccccgagggccccaacagagagagaggcggcgccggcgccaccttcgagtgcaacatctgcctggagaccgccagagaggccgtggtgagcgtgtgcggccacctgtactgctggccctgcctgcaccagtggctggagaccagacccgagagacaggagtgccccgtgtgcaaggccggcatcagcagagagaaggtggtgcccctgtacggcagaggcagccagaagccccaggaccccagactgaagaccccccccagaccccagggccagagacccgcccccgagagcagaggcggcttccagcccttcggcgacaccggcggcttccacttcagcttcggcgtgggcgccttccccttcggcttcttcaccaccgtgttcaacgcccacgagcccttcagaagaggcaccggcgtggacctgggccagggccaccccgccagcagctggcaggacagcctgttcctgttcctggccatcttcttcttcttctggctgctgagcatctag

SEQ ID NO: 97739 - DNA, 543 bp, Artificial Sequence; identical to SEQ ID NO: 97738
  Description of Artificial Sequence: Synthetic coding sequence

SEQ ID NO: 97740 - DNA, 549 bp, Artificial Sequence
  Description of Artificial Sequence: Synthetic coding sequence
atggccgccgccgaggaggaggacggcggccccgagggccccaacagagagagaggcggcgccggcgccaccttcgagtgcaacatctgcctggagaccgccagagaggccgtggtgagcgtgtgcggccacctgtactgctggccctgcctgcaccagtggctggagaccagacccgagagacaggagtgccccgtgtgcaaggccggcatcagcagagagaaggtggtgcccctgtacggcagaggcagccagaagccccaggaccccagactgaagaccccccccagaccccagggccagagacccgcccccgagagcagaggcggcttccagcccttcggcgacaccggcggcttccacttcagcttcggcgtgggcgccttccccttcggcttcttcaccaccgtgttcaacgcccacgagcccttcagaagaggcaccggccccttcagcaccagccccgccttcttccactacctgatcggcaacaccagcagagagttcagaggcagaatctacaacttctggctgcccagaaacctgtag

SEQ ID NO: 97741 - DNA, 543 bp, Artificial Sequence; identical to SEQ ID NO: 97738
  Description of Artificial Sequence: Synthetic coding sequence

SEQ ID NO: 97742 - DNA, 543 bp, Artificial Sequence; identical to SEQ ID NO: 97738
  Description of Artificial Sequence: Synthetic coding sequence

SEQ ID NO: 97743 - DNA, 543 bp, Artificial Sequence; identical to SEQ ID NO: 97738
  Description of Artificial Sequence: Synthetic coding sequence

SEQ ID NO: 97744 - DNA, 543 bp, Artificial Sequence; identical to SEQ ID NO: 97738
  Description of Artificial Sequence: Synthetic coding sequence

SEQ ID NO: 97745 - DNA, 543 bp, Artificial Sequence; identical to SEQ ID NO: 97738
  Description of Artificial Sequence: Synthetic coding sequence

SEQ ID NO: 97746 - DNA, 549 bp, Artificial Sequence; identical to SEQ ID NO: 97740
  Description of Artificial Sequence: Synthetic coding sequence

SEQ ID NO: 97747 - DNA, 549 bp, Artificial Sequence; identical to SEQ ID NO: 97740
  Description of Artificial Sequence: Synthetic coding sequence

SEQ ID NO: 97748 - DNA, 549 bp, Artificial Sequence; identical to SEQ ID NO: 97740
  Description of Artificial Sequence: Synthetic coding sequence

SEQ ID NO: 97749 - DNA, 549 bp, Artificial Sequence; identical to SEQ ID NO: 97740
  Description of Artificial Sequence: Synthetic coding sequence

SEQ ID NO: 97750 - DNA, 549 bp, Artificial Sequence; identical to SEQ ID NO: 97740
  Description of Artificial Sequence: Synthetic coding sequence

SEQ ID NO: 97751 - DNA, 549 bp, Artificial Sequence; identical to SEQ ID NO: 97740
  Description of Artificial Sequence: Synthetic coding sequence

SEQ ID NO: 97752 - DNA, 342 bp, Artificial Sequence
  Description of Artificial Sequence: Synthetic coding sequence
atggccgacgtggaggacggcgaggagacctgcgccctggccagccacagcggcagcagcggcagcaagagcggcggcgacaagatgttcagcctgaagaagtggaacgccgtggccatgtggagctgggacgtggagtgcgacacctgcgccatctgcagagtgcaggtgatggacgcctgcctgagatgccaggccgagaacaagcaggaggactgcgtggtggtgtggggcgagtgcaaccacagcttccacaactgctgcatgagcctgtgggtgaagcagaacaacagatgccccctgtgccagcaggactgggtggtgcagagaatcggcaagtag

SEQ ID NO: 97753 - DNA, 273 bp, Artificial Sequence
  Description of Artificial Sequence: Synthetic coding sequence
atggccgacgtggaggacggcgaggagacctgcgccctggccagccacagcggcagcagcggcagcaagagcggcggcgacaagatgttcagcctgaagaagtggaacgccgtggccatgtggagctgggacgtggagtgcgacacctgcgccatctgcagagtgcagatgcccgtgctggacgtgaagctgaagaccaacaagagaaccgtgctgtggagcggcgagaacgtgatcatccccagcaccaccgccgcctgcccctgcggctag

SEQ ID NO: 97754 - DNA, 294 bp, Artificial Sequence
  Description of Artificial Sequence: Synthetic coding sequence
atggccgacgtggaggacggcgaggagacctgcgccctggccagccacagcggcagcagcggcagcaagagcggcggcgacaagatgttcagcctgaagaagtggaacgccgtggccatgtggagctgggacgtggagtgcgacacctgcgccatctgcagagtgcaggtgatggtggtgtggggcgagtgcaaccacagcttccacaactgctgcatgagcctgtgggtgaagcagaacaacagatgccccctgtgccagcaggactgggtggtgcagagaatcggcaagtag

SEQ ID NO: 97755 - DNA, 1875 bp, Artificial Sequence
  Description of Artificial Sequence: Synthetic coding sequence
atggagaacagcgacagcaacgacaagggcagcggcgaccagagcgccgcccagagaagaagccagatggacagactggacagagaggaggccttctaccagttcgtgaacaacctgagcgaggaggactacagactgatgagagacaacaacctgctgggcacccccggcgagagcaccgaggaggagctgctgagaagactgcagcagatcaaggagggcccccccccccagaacagcgacgagaacagaggcggcgacagcagcgacgacgtgagcaacggcgacagcatcatcgactggctgaacagcgtgagacagaccggcaacaccaccagaagcggccagagaggcaaccagagctggagagccgtgagcagaaccaaccccaacagcggcgacttcagattcagcctggagatcaacgtgaacagaaacaacggcagccagaacagcgagaacgagaacgagcccagcgccagaagaagcagcggcgagaacgtggagaacaacagccagagacaggtggagaaccccagaagcgagagcaccagcgccagacccagcagaagcgagagaaacagcaccgaggccctgaccgaggtgccccccaccagaggccagagaagagccagaagcagaagccccgaccacagaagaaccagagccagagccgagagaagcagaagccccctgcaccccatgagcgagatccccagaagaagccaccacagcatcagcagccagaccttcgagcaccccctggtgaacgagaccgagggcagcagcagaaccagacaccacgtgaccctgagacagcagatcagcggccccgagctgctgagcagaggcctgttcgccgccagcggcaccagaaacgccagccagggcgccggcagcagcgacaccgccgccagcggcgagagcaccggcagcggccagagaccccccaccatcgtgctggacctgcaggtgagaagagtgagacccggcgagtacagacagagagacagcatcgccagcagaaccagaagcagaagccagacccccaacaacaccgtgacctacgagagcgagagaggcggcttcagaagaaccttcagcagaagcgagagagccggcgtgagaacctacgtgagcaccatcagaatccccatcagaagaatcctgaacaccggcctgagcgagaccaccagcgtggccatccagaccatgctgagacagatcatgaccggcttcggcgagctgagctacttcatgtacagcgacagcgacagcgagcccaccggcagcgtgagcaacagaaacatggagagagccgagagcagaagcggcagaggcggcagcggcggcggcagcagcagcggcagcagcagcagcagcagcagcagcagcagcagcagcagcagcagcagcagcagcagcagccccagcagcagcagcggcggcgagagcagcgagaccagcagcgacctgttcgagggcagcaacgagggcagcagcagcagcggcagcagcggcgccagaagagagggcagacacagagcccccgtgaccttcgacgagagcggcagcctgcccttcctgagcctggcccagttcttcctgctgaacgaggacgacgacgaccagcccagaggcctgaccaaggagcagatcgacaacctggccatgagaagcttcggcgagaacgacgccctgaagacctgcagcgtgtgcatcaccgagtacaccgagggcaacaagctgagaaagctgccctgcagccacgagtaccacgtgcactgcatcgacagatggctgagcgagaacagcacctgccccatctgcagaagagccgtgctggccagcggcaacagagagagcgtggtgtag

SEQ ID NO: 97756 - DNA, 1875 bp, Artificial Sequence; identical to SEQ ID NO: 97755
  Description of Artificial Sequence: Synthetic coding sequence

SEQ ID NO: 97757 - DNA, 954 bp, Artificial Sequence
  Description of Artificial Sequence: Synthetic coding sequence
tgactgcccgcccccgccgccgccctgcccggcgcccccccccccccccccggcgtgagaggctaccccgccagagccagaggcctgcagggcgccagcggcggcgccagattccccagcagcctgagcctgcccgtgcccggcaagggcggctgggtggtgagcagagccaagttccccgccctggacagctgcgagatcaccaccgcccaccccagactgtgcttcgccgtgagcccccccttcagctgcagcctgcccctgcccagcctgttcccccacagccccctgctgggcagacccaagagacaggccaagcccgccgccgacgagggcttctgggactgcagcgtgtgcaccttcagaaacagcgccgaggccttcaagtgcagcatctgcgacgtgagaaagggcaccagcaccagaaagcccagaatcaacagccagctggtggcccagcaggtggcccagcagtacgccaccccccccccccccaagaaggagaagaaggagaaggtggagaagcaggacaaggagaagcccgagaaggacaaggagatcagccccagcgtgaccaagaagaacaccaacaagaagaccaagcccaagagcgacatcctgaaggacccccccagcgaggccaacagcatccagagcgccaacgccaccaccaagaccagcgagaccaaccacaccagcagacccagactgaagaacgtggacagaagcaccgcccagcagctggccgtgaccgtgggcaacgtgaccgtgatcatcaccgacttcaaggagaagaccagaagcagcagcaccagcagcagcaccgtgaccagcagcgccggcagcgagcagcagaaccagagcagcagcggcagcgagagcaccgacaagggcagcagcagaagcagcacccccaagggcgacatgagcgccgtgaacgacgagagcttctag

SEQ ID NO: 97758 - DNA, 456 bp, Artificial Sequence
  Description of Artificial Sequence: Synthetic coding sequence
atggacagcgccgcctgcgccgccgccgccacccccgtgcccgccctggccctggccctggcccccgacctggcccaggcccccctggccctgcccggcctgctgagccccagctgcctgctgagcagcggccaggaggtgaacggcagcgagagaggcacctgcctgtggagaccctggctgagcagcaccaacgacagccccagacagatgagaaagctggtggacctggccgccggcggcgccaccgccgccgaggtgaccaaggccgagagcaagttccaccaccccgtgagactgttctggcccaagagcagaagcttcgactacctgtacagcgccggcgagatcctgctgcagaacttccccgtgcaggccaccatcaacctgtacgaggacagcgacagcgaggaggaggaggaggacgaggagcaggaggacgaggaggagaagtag

SEQ ID NO: 97759 - DNA, 315 bp, Artificial Sequence
  Description of Artificial Sequence: Synthetic coding sequence
atggacagcgccgcctgcgccgccgccgccacccccgtgcccgccctggccctggccctggcccccgacctggcccaggcccccctggccctgcccggcctgctgagccccagctgcctgctgagcagcggccaggaggtgaacggcagcgagagactgttctggcccaagagcagaagcttcgactacctgtacagcgccggcgagatcctgctgcagaacttccccgtgcaggccaccatcaacctgtacgaggacagcgacagcgaggaggaggaggaggacgaggagcaggaggacgaggaggagaagtag

SEQ ID NO: 97760 - DNA, 213 bp, Artificial Sequence
  Description of Artificial Sequence: Synthetic coding sequence
atgcccgacggccccggcatgaccgccgccagcggcaagctgtaccagttcagacaccccgtgagactgttctggcccaagagcaagtgctacgactacctgtaccaggaggccgaggccctgctgaagaacttccccatccaggccaccatcagcttctacgaggacagcgacagcgaggacgagatcgaggacctgacctgcgagaactag

SEQ ID NO: 97761 - DNA, 387 bp, Artificial Sequence
  Description of Artificial Sequence: Synthetic coding sequence
atggagaacgccggcggcgccgagggcaccgagagcggcgccgccgcctgcgccgccaccgacggccccaccagaagagccggcgccgacagcggctacgccggcttctggagaccctgggtggacgccggcggcaagaaggaggaggagacccccaaccacgccgccgaggccatgcccgacggccccggcatgaccgccgccagcggcaagctgtaccagttcagacaccccgtgagactgttctggcccaagagcaagtgctacgactacctgtaccaggaggccgaggccctgctgaagaacttccccatccaggccaccatcagcttctacgaggacagcgacagcgaggacgagatcgaggacctgacctgcgagaactag

SEQ ID NO: 97762 - DNA, 444 bp, Artificial Sequence
  Description of Artificial Sequence: Synthetic coding sequence
atggccgccgccgccgacagcttcagcggcggccccgccggcgtgagactgcccagaagcccccccctgaaggtgctggccgagcagctgagaagagacgccgagggcggccccggcgcctggagactgagcagagccgccgccggcagaggccccctggacctggccgccgtgtggatgcagggcagagtggtgatggccgacagaggcgaggccagactgagagaccccagcggcgacttcagcgtgagaggcctggagagagtgcccagaggcagaccctgcctggtgcccggcaagtacgtgatggtgatgggcgtggtgcaggcctgcagccccgagccctgcctgcaggccgtgaagatgaccgacctgagcgacaaccccatccacgagagcatgtgggagctggaggtggaggacctgcacagaaacatcccctag

SEQ ID NO: 97763 - DNA, 255 bp, Artificial Sequence
  Description of Artificial Sequence: Synthetic coding sequence
atgaagcagacccaggtgggcagcctgttcagcctgggcatcagaaaccccgagcccggccccgtgagcggcaccgccgtgcccagacagctggcctggaagagcggcaagtacgtgatggtgatgggcgtggtgcaggcctgcagccccgagccctgcctgcaggccgtgaagatgaccgacctgagcgacaaccccatccacgagagcatgtgggagctggaggtggaggacctgcacagaaacatcccctag

SEQ ID NO: 97764 - DNA, 1431 bp, Artificial Sequence
  Description of Artificial Sequence: Synthetic coding sequence
atggccaacagcgccaaggccgaggagtacgagaagatgagcctggagcaggccaaggccagcgtgaacagcgagaccgagagcagcttcaacatcaacgagaacaccaccgccagcggcaccggcctgagcgagaagaccagcgtgtgcagacaggtggacatcgccagaaagagaaaggagttcgaggacgacctggtgaaggagagcagcagctgcggcaaggacacccccagcaagaagagaaagctggaccccgagatcgtgcccgaggagaaggactgcggcgacgccgagggcaacagcaagaagagaaagagagagaccgaggacgtgcccaaggacaagagcagcaccggcgacggcacccagaacaagagaaagatcgccctggaggacgtgcccgagaagcagaagaacctggaggagggccacagcagcaccgtggccgcccactacaacgagctgcaggaggtgggcctggagaagagaagccagagcagaatcttctacctgagaaacttcaacaactggatgaagagcgtgctgatcggcgagttcctggagaaggtgagacagaagaagaagagagacatcaccgtgctggacctgggctgcggcaagggcggcgacctgctgaagtggaagaagggcagaatcaacaagctggtgtgcaccgacatcgccgacgtgagcgtgaagcagtgccagcagagatacgaggacatgaagaacagaagagacagcgagtacatcttcagcgccgagttcatcaccgccgacagcagcaaggagctgctgatcgacaagttcagagacccccagatgtgcttcgacatctgcagctgccagttcgtgtgccactacagcttcgagagctacgagcaggccgacatgatgctgagaaacgcctgcgagagactgagccccggcggctacttcatcggcaccacccccaacagcttcgagctgatcagaagactggaggccagcgagaccgagagcttcggcaacgagatctacaccgtgaagttccagaagaagggcgactaccccctgttcggctgcaagtacgacttcaacctggagggcgtggtggacgtgcccgagttcctggtgtacttccccctgctgaacgagatggccaagaagtacaacatgaagctggtgtacaagaagaccttcctggagttctacgaggagaagatcaagaacaacgagaacaagatgctgctgaagagaatgcaggccctggagccctaccccgccaacgagagcagcaagctggtgagcgagaaggtggacgactacgagcacgccgccaagtacatgaagaacagccaggtgagactgcccctgggcaccctgagcaagagcgagtgggaggccaccagcatctacctggtgttcgccttcgagaagcagcagtag

SEQ ID NO: 97765 - DNA, 1431 bp, Artificial Sequence; identical to SEQ ID NO: 97764
  Description of Artificial Sequence: Synthetic coding sequence

SEQ ID NO: 97766 - DNA, 705 bp, Artificial Sequence
  Description of Artificial Sequence: Synthetic coding sequence
atgaagaacagaagagacagcgagtacatcttcagcgccgagttcatcaccgccgacagcagcaaggagctgctgatcgacaagttcagagacccccagatgtgcttcgacatctgcagctgccagttcgtgtgccactacagcttcgagagctacgagcaggccgacatgatgctgagaaacgcctgcgagagactgagccccggcggctacttcatcggcaccacccccaacagcttcgagctgatcagaagactggaggccagcgagaccgagagcttcggcaacgagatctacaccgtgaagttccagaagaagggcgactaccccctgttcggctgcaagtacgacttcaacctggagggcgtggtggacgtgcccgagttcctggtgtacttccccctgctgaacgagatggccaagaagtacaacatgaagctggtgtacaagaagaccttcctggagttctacgaggagaagatcaagaacaacgagaacaagatgctgctgaagagaatgcaggccctggagccctaccccgccaacgagagcagcaagctggtgagcgagaaggtggacgactacgagcacgccgccaagtacatgaagaacagccaggtgagactgcccctgggcaccctgagcaagagcgagtgggaggccaccagcatctacctggtgttcgccttcgagaagcagcagtag

SEQ ID NO: 97767 - DNA, 1431 bp, Artificial Sequence; identical to SEQ ID NO: 97764
  Description of Artificial Sequence: Synthetic coding sequence

SEQ ID NO: 97768 - DNA, 390 bp, Artificial Sequence
  Description of Artificial Sequence: Synthetic coding sequence
atgaagagcgtgctgatcggcgagttcctggagaaggtgagacagaagaagaagagagacatcaccgtgctggacctgggctgcggcaagggcggcgacctgctgaagtggaagaagggcagaatcaacaagctggtgtgcaccgacatcgccgacgtgagcgtgaagcagtgccagcagagatacgaggacatgaagaacagaagagacagcgagtacatcttcagcgccgagttcatcaccgccgacagcagcaaggagctgctgatcgacaagttcagagacccccagatgtgcttcgacatctgcagctgccagttcgtgtgccactacagcttcgagagctacgagcaggccgacatgatgctgagaaacgcctgcggcacctag

SEQ ID NO: 97769 - DNA, 468 bp, Artificial Sequence
  Description of Artificial Sequence: Synthetic coding sequence
atggcccccagaacctggtgccccgccggcatcttcggcctgttctgccccctgaccctggcctgcagcagcctgaccatcgccctgaccgactgccagcccatcatcctggtgagccccaccctgagcctgtggatggtggtgagaagcgtgtggatcatgcaggccagcctgctgggcgagcccgaggaggtggccctgggccccatgggcgtggtggccgccaccctggaggtggtgggcaccagagccatgggcgtggccggcatcatgaccgtggacctggagggcatggacatggacatggacgtgcccgagaccatcatggccgagaccagagtggtgatgaccgccacccaggaggagatcaccgagaccatcatgaccaccgagatgagacacgcccacaacatcggcgagacctggatcagcgccctgagcgagcccgtgtgccacaccctgagctag

SEQ ID NO: 97770 - DNA, 474 bp, Artificial Sequence
  Description of Artificial Sequence: Synthetic coding sequence
atgagcagcgaggagggcaagctgttcgtgggcggcctgaacttcaacaccgacgagcaggccctggaggaccacttcagcagcttcggccccatcagcgaggtggtggtggtgaaggacagagagacccagagaagcagaggcttcggcttcatcaccttcaccaaccccgagcacgccagcgtggccatgagagccatgaacggcgagagcctggacggcagacagatcagagtggaccacgccggcaagagcgccagaggcaccagaggcggcggcttcggcgcccacggcagaggcagaagctacagcagaggcggcggcgaccagggctacggcagcggcagatactacgacagcagacccggcggctacggctacggctacggcagaagcagagactacaacggcagaaaccagggcggctacgacagatacagcggcggcaactacagagacaactacgacaactag

SEQ ID NO: 97771 - DNA, 474 bp, Artificial Sequence; identical to SEQ ID NO: 97770
  Description of Artificial Sequence: Synthetic coding sequence

SEQ ID NO: 97772 - DNA, 510 bp, Artificial Sequence
  Description of Artificial Sequence: Synthetic coding sequence
atggcccccagaacctggtgccccgccggcatcttcggcctgttctgccccctgaccctggcctgcagcagcctgaccatcgccctgaccgactgccagcccatcatcctggtgagccccaccctgagcctgtggatggtggtgagaagcgtgtggatcatgcaggccagcctgctgggcgagcccgaggaggtggccctgggccccatgggcgtggtggccgccaccctggaggtggtgggcaccagagccatgggcgtggccggcatcatgaccgtggacctggagggcatggacatggacatggacgtgcccgagaccatcatggccgagaccagagtggtgatgaccgccacccaggaggagatcaccgagaccatcatgaccaccgagatgagacacgcccacaacatcgacacccagggcatcatcagcgaccccggcagcagcttccagatggccgtgttcatcaaggtgttcggcgccgcccccaagcacctgatcctgtag

SEQ ID NO: 97773 - DNA, 2559 bp, Artificial Sequence
  Description of Artificial Sequence: Synthetic coding sequence
atggagtacgagagaagaggcggcagaggcgacagaaccggcagatacggcgccaccgacagaagccaggacgacggcggcgagaacagaagcagagaccacgactacagagacatggactacagaagctaccccagagagtacggcagccaggagggcaagcacgactacgacgacagcagcgaggagcagagcgccgagatcagaggccagctgcagagccacggcgtgcaggccagagaggtgagactgatgagaaacaagagcagcggccagagcagaggcttcgccttcgtggagttcagccacctgcaggacgccaccagatggatggaggccaaccagcacagcctgaacatcctgggccagaaggtgagcatgcactacagcgaccccaagcccaagatcaacgaggactggctgtgcaacaagtgcggcgtgcagaacttcaagagaagagagaagtgcttcaagtgcggcgtgcccaagagcgaggccgagcagaagctgcccctgggcaccagactggaccagcagaccctgcccctgggcggcagagagctgagccagggcctgctgcccctgccccagccctaccaggcccagggcgtgctggccagccaggccctgagccagggcagcgagcccagcagcgagaacgccaacgacaccatcatcctgagaaacctgaacccccacagcaccatggacagcatcctgggcgccctggccccctacgccgtgctgagcagcagcaacgtgagagtgatcaaggacaagcagacccagctgaacagaggcttcgccttcatccagctgagcaccatcgaggccgcccagctgctgcagatcctgcaggccctgcacccccccctgaccatcgacggcaagaccatcaacgtggagttcgccaagggcagcaagagagacatggccagcaacgagggcagcagaatcagcgccgccagcgtggccagcaccgccatcgccgccgcccagtgggccatcagccaggccagccagggcggcgagggcacctgggccaccagcgaggagccccccgtggactacagctactaccagcaggacgagggctacggcaacagccagggcaccgagagcagcctgtacgcccacggctacctgaagggcaccaagggccccggcatcaccggcaccaagggcgaccccaccggcgccggccccgaggccagcctggagcccggcgccgacagcgtgagcatgcaggccttcagcagagcccagcccggcgccgcccccggcatctaccagcagagcgccgaggccagcagcagccagggcaccgccgccaacagccagagctacaccatcatgagccccgccgtgctgaagagcgagctgcagagccccacccaccccagcagcgccctgccccccgccaccagccccaccgcccaggagagctacagccagtaccccgtgcccgacgtgagcacctaccagtacgacgagaccagcggctactactacgacccccagaccggcctgtactacgaccccaacagccagtactactacaacgcccagagccagcagtacctgtactgggacggcgagagaagaacctacgtgcccgccctggagcagagcgccgacggccacaaggagaccggcgcccccagcaaggagggcaaggagaagaaggagaagcacaagaccaagaccgcccagcagatcgccaaggacatggagagatgggccagaagcctgaacaagcagaaggagaacttcaagaacagcttccagcccatcagcagcctgagagacgacgagagaagagagagcgccaccgccgacgccggctacgccatcctggagaagaagggcgccctggccgagagacagcacaccagcatggacctgcccaagctggccagcgacgacagacccagcccccccagaggcctggtggccgcctacagcggcgagagcgacagcgaggaggagcaggagagaggcggccccgagagagaggagaagctgaccgactggcagaagctggcctgcctgctgtgcagaagacagttccccagcaaggaggccctgatcagacaccagcagctgagcggcctgcacaagcagaacctggagatccacagaagagcccacctgagcgagaacgagctggaggccctggagaagaacgacatggagcagatgaagtacagagacagagccgccgagagaagagagaagtacggcatccccgagccccccgagcccaagagaagaaagtacggcggcatcagcaccgccagcgtggacttcgagcagcccaccagagacggcctgggcagcgacaacatcggcagcagaatgctgcaggccatgggctggaaggagggcagcggcctgggcagaaagaagcagggcatcgtgacccccatcgaggcccagaccagagtgagaggcagcggcctgggcgccagaggcagcagctacggcgtgaccagcaccgagagctacaaggagaccctgcacaagaccatggtgaccagattcaacgaggcccagtag

SEQ ID NO: 97774 - DNA, 2562 bp, Artificial Sequence
  Description of Artificial Sequence: Synthetic coding sequence
atggagtacgagagaagaggcggcagaggcgacagaaccggcagatacggcgccaccgacagaagccaggacgacggcggcgagaacagaagcagagaccacgactacagagacatggactacagaagctaccccagagagtacggcagccaggagggcaagcacgactacgacgacagcagcgaggagcagagcgccgagatcagaggccagctgcagagccacggcgtgcaggccagagaggtgagactgatgagaaacaagagcagcggccagagcagaggcttcgccttcgtggagttcagccacctgcaggacgccaccagatggatggaggccaaccagcacagcctgaacatcctgggccagaaggtgagcatgcactacagcgaccccaagcccaagatcaacgaggactggctgtgcaacaagtgcggcgtgcagaacttcaagagaagagagaagtgcttcaagtgcggcgtgcccaagagcgaggccgagcagaagctgcccctgggcaccagactggaccagcagaccctgcccctgggcggcagagagctgagccagggcctgctgcccctgccccagccctaccaggcccagggcgtgctggccagccaggccctgagccagggcagcgagcccagcagcgagaacgccaacgacaccatcatcctgagaaacctgaacccccacagcaccatggacagcatcctgggcgccctggccccctacgccgtgctgagcagcagcaacgtgagagtgatcaaggacaagcagacccagctgaacagaggcttcgccttcatccagctgagcaccatcgtggaggccgcccagctgctgcagatcctgcaggccctgcacccccccctgaccatcgacggcaagaccatcaacgtggagttcgccaagggcagcaagagagacatggccagcaacgagggcagcagaatcagcgccgccagcgtggccagcaccgccatcgccgccgcccagtgggccatcagccaggccagccagggcggcgagggcacctgggccaccagcgaggagccccccgtggactacagctactaccagcaggacgagggctacggcaacagccagggcaccgagagcagcctgtacgcccacggctacctgaagggcaccaagggccccggcatcaccggcaccaagggcgaccccaccggcgccggccccgaggccagcctggagcccggcgccgacagcgtgagcatgcaggccttcagcagagcccagcccggcgccgcccccggcatctaccagcagagcgccgaggccagcagcagccagggcaccgccgccaacagccagagctacaccatcatgagccccgccgtgctgaagagcgagctgcagagccccacccaccccagcagcgccctgccccccgccaccagccccaccgcccaggagagctacagccagtaccccgtgcccgacgtgagcacctaccagtacgacgagaccagcggctactactacgacccccagaccggcctgtactacgaccccaacagccagtactactacaacgcccagagccagcagtacctgtactgggacggcgagagaagaacctacgtgcccgccctggagcagagcgccgacggccacaaggagaccggcgcccccagcaaggagggcaaggagaagaaggagaagcacaagaccaagaccgcccagcagatcgccaaggacatggagagatgggccagaagcctgaacaagcagaaggagaacttcaagaacagcttccagcccatcagcagcctgagagacgacgagagaagagagagcgccaccgccgacgccggctacgccatcctggagaagaagggcgccctggccgagagacagcacaccagcatggacctgcccaagctggccagcgacgacagacccagcccccccagaggcctggtggccgcctacagcggcgagagcgacagcgaggaggagcaggagagaggcggccccgagagagaggagaagctgaccgactggcagaagctggcctgcctgctgtgcagaagacagttccccagcaaggaggccctgatcagacaccagcagctgagcggcctgcacaagcagaacctggagatccacagaagagcccacctgagcgagaacgagctggaggccctggagaagaacgacatggagcagatgaagtacagagacagagccgccgagagaagagagaagtacggcatccccgagccccccgagcccaagagaagaaagtacggcggcatcagcaccgccagcgtggacttcgagcagcccaccagagacggcctgggcagcgacaacatcggcagcagaatgctgcaggccatgggctggaaggagggcagcggcctgggcagaaagaagcagggcatcgtgacccccatcgaggcccagaccagagtgagaggcagcggcctgggcgccagaggcagcagctacggcgtgaccagcaccgagagctacaaggagaccctgcacaagaccatggtgaccagattcaacgaggcccagtag

SEQ ID NO: 97775 - DNA, 2793 bp, Artificial Sequence
  Description of Artificial Sequence: Synthetic coding sequence
atggagtacgagagaagaggcggcagaggcgacagaaccggcagatacggcgccaccgacagaagccaggacgacggcggcgagaacagaagcagagaccacgactacagagacatggactacagaagctaccccagagagtacggcagccaggagggcaagcacgactacgacgacagcagcgaggagcagagcgccgaggacagctacgaggccagccccggcagcgagacccagagaagaagaagaagaagacacagacacagccccaccggcccccccggcttccccagagacggcgactacagagaccaggactacagaaccgagcagggcgaggaggaggaggaggaggaggacgaggaggaggaggagaaggccagcaacatcgtgatgctgagaatgctgccccaggccgccaccgaggacgacatcagaggccagctgcagagccacggcgtgcaggccagagaggtgagactgatgagaaacaagagcagcggccagagcagaggcttcgccttcgtggagttcagccacctgcaggacgccaccagatggatggaggccaaccagcacagcctgaacatcctgggccagaaggtgagcatgcactacagcgaccccaagcccaagatcaacgaggactggctgtgcaacaagtgcggcgtgcagaacttcaagagaagagagaagtgcttcaagtgcggcgtgcccaagagcgaggccgagcagaagctgcccctgggcaccagactggaccagcagaccctgcccctgggcggcagagagctgagccagggcctgctgcccctgccccagccctaccaggcccagggcgtgctggccagccaggccctgagccagggcagcgagcccagcagcgagaacgccaacgacaccatcatcctgagaaacctgaacccccacagcaccatggacagcatcctgggcgccctggccccctacgccgtgctgagcagcagcaacgtgagagtgatcaaggacaagcagacccagctgaacagaggcttcgccttcatccagctgagcaccatcgtggaggccgcccagctgctgcagatcctgcaggccctgcacccccccctgaccatcgacggcaagaccatcaacgtggagttcgccaagggcagcaagagagacatggccagcaacgagggcagcagaatcagcgccgccagcgtggccagcaccgccatcgccgccgcccagtgggccatcagccaggccagccagggcggcgagggcacctgggccaccagcgaggagccccccgtggactacagctactaccagcaggacgagggctacggcaacagccagggcaccgagagcagcctgtacgcccacggctacctgaagggcaccaagggccccggcatcaccggcaccaagggcgaccccaccggcgccggccccgaggccagcctggagcccggcgccgacagcgtgagcatgcaggccttcagcagagcccagcccggcgccgcccccggcatctaccagcagagcgccgaggccagcagcagccagggcaccgccgccaacagccagagctacaccatcatgagccccgccgtgctgaagagcgagctgcagagccccacccaccccagcagcgccctgccccccgccaccagccccaccgcccaggagagctacagccagtaccccgtgcccgacgtgagcacctaccagtacgacgagaccagcggctactactacgacccccagaccggcctgtactacgaccccaacagccagtactactacaacgcccagagccagcagtacctgtactgggacggcgagagaagaacctacgtgcccgccctggagcagagcgccgacggccacaaggagaccggcgcccccagcaaggagggcaaggagaagaaggagaagcacaagaccaagaccgcccagcagatcgccaaggacatggagagatgggccagaagcctgaacaagcagaaggagaacttcaagaacagcttccagcccatcagcagcctgagagacgacgagagaagagagagcgccaccgccgacgccggctacgccatcctggagaagaagggcgccctggccgagagacagcacaccagcatggacctgcccaagctggccagcgacgacagacccagcccccccagaggcctggtggccgcctacagcggcgagagcgacagcgaggaggagcaggagagaggcggccccgagagagaggagaagctgaccgactggcagaagctggcctgcctgctgtgcagaagacagttccccagcaaggaggccctgatcagacaccagcagctgagcggcctgcacaagcagaacctggagatccacagaagagcccacctgagcgagaacgagctggaggccctggagaagaacgacatggagcagatgaagtacagagacagagccgccgagagaagagagaagtacggcatccccgagccccccgagcccaagagaagaaagtacggcggcatcagcaccgccagcgtggacttcgagcagcccaccagagacggcctgggcagcgacaacatcggcagcagaatgctgcaggccatgggctggaaggagggcagcggcctgggcagaaagaagcagggcatcgtgacccccatcgaggcccagaccagagtgagaggcagcggcctgggcgccagaggcagcagctacggcgtgaccagcaccgagagctacaaggagaccctgcacaagaccatggtgaccagattcaacgaggcccagtag

SEQ ID NO: 97776 - DNA, 2010 bp, Artificial Sequence
  Description of Artificial Sequence: Synthetic coding sequence
atgaagatcttcgtgggcaacgtggacggcgccgacaccacccccgaggagctggccgccctgttcgccccctacggcaccgtgatgagctgcgccgtgatgaagcagttcgccttcgtgcacatgagagagaacgccggcgccctgagagccatcgaggccctgcacggccacgagctgagacccggcagagccctggtggtggagatgagcagacccagacccctgaacacctggaagatcttcgtgggcaacgtgagcgccgcctgcaccagccaggagctgagaagcctgttcgagagaagaggcagagtgatcgagtgcgacgtggtgaaggactacgccttcgtgcacatggagaaggaggccgacgccaaggccgccatcgcccagctgaacggcaaggaggtgaagggcaagagaatcaacgtggagctgagcaccaagggccagaagaagggccccggcctggccgtgcagagcggcgacaagaccaagaagcccggcgccggcgacaccgccttccccggcaccggcggcttcagcgccaccttcgactaccagcaggccttcggcaacagcaccggcggcttcgacggccaggccagacagcccaccccccccttcttcggcagagacagaagccccctgagaagaagcccccccagagccagctacgtggcccccctgaccgcccagcccgccacctacagagcccagcccagcgtgagcctgggcgccgcctacagagcccagcccagcgccagcctgggcgtgggctacagaacccagcccatgaccgcccaggccgccagctacagagcccagcccagcgtgagcctgggcgccccctacagaggccagctggccagccccagcagccagagcgccgccgccagcagcctgggcccctacggcggcgcccagcccagcgccagcgccctgagcagctacggcggccaggccgccgccgccagcagcctgaacagctacggcgcccagggcagcagcctggccagctacggcaaccagcccagcagctacggcgcccaggccgccagcagctacggcgtgagagccgccgccagcagctacaacacccagggcgccgccagcagcctgggcagctacggcgcccaggccgccagctacggcgcccagagcgccgccagcagcctggcctacggcgcccaggccgccagctacaacgcccagcccagcgccagctacaacgcccagagcgccccctacgccgcccagcaggccgccagctacagcagccagcccgccgcctacgtggcccagcccgccaccgccgccgcctacgccagccagcccgccgcctacgccgcccaggccaccacccccatggccggcagctacggcgcccagcccgtggtgcagacccagctgaacagctacggcgcccaggccagcatgggcctgagcggcagctacggcgcccagagcgccgccgccgccaccggcagctacggcgccgccgccgcctacggcgcccagcccagcgccaccctggccgccccctacagaacccagagcagcgccagcctggccgccagctacgccgcccagcagcacccccaggccgccgccagctacagaggccagcccggcaacgcctacgacggcgccggccagcccagcgccgcctacctgagcatgagccagggcgccgtggccaacgccaacagcaccccccccccctacgagagaaccagactgagcccccccagagccagctacgacgacccctacaagaaggccgtggccatgagcaagagatacggcagcgacagaagactggccgagctgagcgactacagaagactgagcgagagccagctgagcttcagaagaagccccaccaagagcagcctggactacagaagactgcccgacgcccacagcgactacgccagatacagcggcagctacaacgactacctgagagccgcccagatgcacagcggctaccagagaagaatgtag

SEQ ID NO: 97777 - DNA, 471 bp, Artificial Sequence
  Description of Artificial Sequence: Synthetic coding sequence
atgaagatcttcgtgggcaacgtggacggcgccgacaccacccccgaggagctggccgccctgttcgccccctacggcaccgtgatgagctgcgccgtgatgaagcagttcgccttcgtgcacatgagagagaacgccggcgccctgagagccatcgaggccctgcacggccacgagctgagacccggcagagccctggtggtggagatgagcagacccagacccctgaacacctggaagatcttcgtgggcaacgtgagcgccgcctgcaccagccaggagctgagaagcctgttcgagagaagaggcagagtgatcgagtgcgacgtggtgaaggactacgccttcgtgcacatggagaaggaggccgacgccaaggccgccatcgcccagctgaacggcaaggaggtgaagggcaagagaatcaacgtggagctgagcaccaagggcatggtgcccaccggcgtgtag

SEQ ID NO: 97778 - DNA, 360 bp, Artificial Sequence
  Description of Artificial Sequence: Synthetic coding sequence
atgaagatcttcgtgggcaacgtggacggcgccgacaccacccccgaggagctggccgccctgttcgccccctacggcaccgtgatgagctgcgccgtgatgaagcagttcgccttcgtgcacatgagagagaacgccggcgccctgagagccatcgaggccctgcacggccacgagctgagacccggcagagccctggtggtggagatgagcagacccagacccctgaacacctggaagatcttcgtgggcaacgtgagcgccgcctgcaccagccaggagctgagaagcctgttcgagagaagaggcagagtgatcgagtgcgacgtggtgaagggcatggtgcccaccggcgtgtag

SEQ ID NO: 97779 - DNA, 2934 bp, Artificial Sequence
  Description of Artificial Sequence: Synthetic coding sequence
atgagaaccgccggcagagaccccgtgcccagaagaagccccagatggagaagagccgtgcccctgtgcgagaccagcgccggcagaagagtgacccagctgagaggcgacgacctgagaagacccgccaccatgaagggcaaggagagaagccccgtgaaggccaagagaagcagaggcggcgaggacagcaccagcagaggcgagagaagcaagaagctgggcggcagcggcggcagcaacggcagcagcagcggcaagaccgacagcggcggcggcagcagaagaagcctgcacctggacaagagcagcagcagaggcggcagcagagagtacgacaccggcggcggcagcagcagcagcagactgcacagctacagcagccccagcaccaagaacagcagcggcggcggcgagagcagaagcagcagcagaggcggcggcggcgagagcagaagcagcggcgccgccagcagcgcccccggcggcggcgacggcgccgagtacaagaccctgaagatcagcgagctgggcagccagctgagcgacgaggccgtggaggacggcctgttccacgagttcaagagattcggcgacgtgagcgtgaagatcagccacctgagcggcagcggcagcggcgacgagagagtggccttcgtgaacttcagaagacccgaggacgccagagccgccaagcacgccagaggcagactggtgctgtacgacagacccctgaagatcgaggccgtgtacgtgagcagaagaagaagcagaagccccctggacaaggacacctacccccccagcgccagcgtggtgggcgccagcgtgggcggccacagacacccccccggcggcggcggcggccagagaagcctgagccccggcggcgccgccctgggctacagagactacagactgcagcagctggccctgggcagactgcccccccccccccccccccccctgcccagagacctggagagagagagagactaccccttctacgagagagtgagacccgcctacagcctggagcccagagtgggcgccggcgccggcgccgcccccttcagagaggtggacgagatcagccccgaggacgaccagagagccaacagaaccctgttcctgggcaacctggacatcaccgtgaccgagagcgacctgagaagagccttcgacagattcggcgtgatcaccgaggtggacatcaagagacccagcagaggccagaccagcacctacggcttcctgaagttcgagaacctggacatgagccacagagccaagctggccatgagcggcaagatcatcatcagaaaccccatcaagatcggctacggcaaggccacccccaccaccagactgtgggtgggcggcctgggcccctgggtgcccctggccgccctggccagagagttcgacagattcggcaccatcagaaccatcgactacagaaagggcgacagctgggcctacatccagtacgagagcctggacgccgcccacgccgcctggacccacatgagaggcttccccctgggcggccccgacagaagactgagagtggacttcgccgacaccgagcacagataccagcagcagtacctgcagcccctgcccctgacccactacgagctggtgaccgacgccttcggccacagagcccccgaccccctgagaggcgccagagacagaaccccccccctgctgtacagagacagagacagagacctgtaccccgacagcgactgggtgcccccccccccccccgtgagagagagaagcaccagaaccgccgccaccagcgtgcccgcctacgagcccctggacagcctggacagaagaagagacggctggagcctggacagagacagaggcgacagagacctgcccagcagcagagaccagcccagaaagagaagactgcccgaggagagcggcggcagacacctggacagaagccccgagagcgacagacccagaaagagacactgcgcccccagccccgacagaagccccgagctgagcagcagcagagacagatacaacagcgacaacgacagaagcagcagactgctgctggagagacccagccccatcagagacagaagaggcagcctggagaagagccagggcgacaagagagacagaaagaacagcgccagcgccgagagagacagaaagcacagaaccaccgcccccaccgagggcaagagccccctgaagaaggaggacagaagcgacggcagcgcccccagcaccagcaccgccagcagcaagctgaagagccccagccagaagcaggacggcggcaccgcccccgtggccagcgccagccccaagctgtgcctggcctggcagggcatgctgctgctgaagaacagcaacttccccagcaacatgcacctgctgcagggcgacctgcaggtggccagcagcctgctggtggagggcagcaccggcggcaaggtggcccagctgaagatcacccagagactgagactggaccagcccaagctggacgaggtgaccagaagaatcaaggtggccggccccaacggctacgccatcctgctggccgtgcccggcagcagcgacagcagaagcagcagcagcagcgccgccagcgacaccgccaccagcacccagagacccctgagaaacctggtgagctacctgaagcagaagcaggccgccggcgtgatcagcctgcccgtgggcggcaacaaggacaaggagaacaccggcgtgctgcacgccttccccccctgcgagttcagccagcagttcctggacagccccgccaaggccctggccaagagcgaggaggactacctggtgatgatcatcgtgagaggcttcggcttccagatcggcgtgagatacgagaacaagaagagagagaacctggccctgaccctgctgtag

SEQ ID NO: 97780 - DNA, 2673 bp, Artificial Sequence
  Description of Artificial Sequence: Synthetic coding sequence
atgaagagacagagcgagagagacagcagccccagcggcagaggcagcagcagcagcgccaagagacccagagagagagagagagaggccgaggccggcggcagaagagccgcccacaaggccagcggcggcgccaagcaccccgtgcccgccagagccagagacaagcccagaggcagcggcagcggcggcggcggccacagagacggcagaggcaccggcgacgccaaccacagagccagcagcggcagaagcagcggcagcggcgccggcggcggcggcagaggcggcaaggccagcggcgaccccggcgccagcggcatgagccccagagccagccccctgcccccccccccccccccccccggcgccgagcccgcctgccccggcagcagcgccgccgcccccgagtacaagaccctgctgatcagcagcctgagccccgccctgcccgccgagcacctggaggacagactgttccaccagttcaagagattcggcgagatcagcctgagactgagccacacccccgagctgggcagagtggcctacgtgaacttcagacacccccaggacgccagagaggccagacagcacgccctggccagacagctgctgctgtacgacagacccctgaaggtggagcccgtgtacctgagaggcggcggcggcagcagcagaagaagcagcagcagcagcgccgccgccagcacccccccccccggcccccccgcccccgccgaccccctgggctacctgcccctgcacggcggctaccagtacaagcagagaagcctgagccccgtggccgccccccccctgagagagcccagagccagacacgccgccgccgccttcgccctggacgccgccgccgccgccgccgtgggcctgagcagagagagagccctggactactacggcctgtacgacgacagaggcagaccctacggctaccccgccgtgtgcgaggaggacctgatgcccgaggacgaccagagagccaccagaaacctgttcatcggcaacctggaccacagcgtgagcgaggtggagctgagaagagccttcgagaagtacggcatcatcgaggaggtggtgatcaagagacccgccagaggccagggcggcgcctacgccttcctgaagttccagaacctggacatggcccacagagccaaggtggccatgagcggcagagtgatcggcagaaaccccatcaagatcggctacggcaaggccaaccccaccaccagactgtgggtgggcggcctgggccccaacaccagcctggccgccctggccagagagttcgacagattcggcagcatcagaaccatcgaccacgtgaagggcgacagcttcgcctacatccagtacgagagcctggacgccgcccaggccgcctgcgccaagatgagaggcttccccctgggcggccccgacagaagactgagagtggacttcgccaaggccgaggagaccagatacccccagcagtaccagcccagccccctgcccgtgcactacgagctgctgaccgacggctacaccagacacagaaacctggacgccgacctggtgagagacagaacccccccccacctgctgtacagcgacagagacagaaccttcctggagggcgactggaccagccccagcaagagcagcgacagaagaaacagcctggagggctacagcagaagcgtgagaagcagaagcggcgagagatggggcgccgacggcgacagaggcctgcccaagccctgggaggagagaagaaagagaagaagcctgagcagcgacagaggcagaaccacccacagcccctacgaggagagaagcagaaccaagggcagcggccagcagagcgagagaggcagcgacagaacccccgagagaagcagaaaggagaaccacagcagcgagggcaccaaggagagcagcagcaacagcctgagcaacagcagacacggcgccgaggagagaggccaccaccaccaccaccacgaggccgccgacagcagccacggcaagaaggccagagacagcgagagaaaccacagaaccaccgaggccgagcccaagcccctggaggagcccaagcacgagaccaagaagctgaagaacctgagcgagtacgcccagaccctgcagctgggctggaacggcctgctggtgctgaagaacagctgcttccccaccagcatgcacatcctggagggcgaccagggcgtgatcagcagcctgctgaaggaccacaccagcggcagcaagctgacccagctgaagatcgcccagagactgagactggaccagcccaagctggacgaggtgaccagaagaatcaagcagggcagccccaacggctacgccgtgctgctggccacccaggccacccccagcggcctgggcaccgagggcatgcccaccgtggagcccggcctgcagagaagactgctgagaaacctggtgagctacctgaagcagaagcaggccgccggcgtgatcagcctgcccgtgggcggcagcaagggcagagacggcaccggcatgctgtacgccttccccccctgcgacttcagccagcagtacctgcagagcgccctgagaaccctgggcaagctggaggaggagcacatggtgatcgtgatcgtgagagacaccgcctag

SEQ ID NO: 97781 - DNA, 765 bp, Artificial Sequence
  Description of Artificial Sequence: Synthetic coding sequence
atggagaccgtggtgtgccccccctgggaggagagaagaaagagaagaagcctgagcagcgacagaggcagaaccacccacagcccctacgaggagagaagcagaaccaagggcagcggccagcagagcgagagaggcagcgacagaacccccgagagaagcagaaaggagaaccacagcagcgagggcaccaaggagagcagcagcaacagcctgagcaacagcagacacggcgccgaggagagaggccaccaccaccaccaccacgaggccgccgacagcagccacggcaagaaggccagagacagcgagagaaaccacagaaccaccgaggccgagcccaagcccctggaggagcccaagcacgagaccaagaagctgaagaacctgagcgagtacgcccagaccctgcagctgggctggaacggcctgctggtgctgaagaacagctgcttccccaccagcatgcacatcctggagggcgaccagggcgtgatcagcagcctgctgaaggaccacaccagcggcagcaagctgacccagctgaagatcgcccagagactgagactggaccagcccaagctggacgaggtgaccagaagaatcaagcagggcagccccaacggctacgccgtgctgctggccacccaggccacccccagcggcctgggcaccgagggcatgcccaccgtggagcccggcctgcagagaagactgctgagaaacctggtgagctacctgaagcagaagcaggccgccggctag

SEQ ID NO: 97782 - DNA, 636 bp, Artificial Sequence
  Description of Artificial Sequence: Synthetic coding sequence
atgaagagacagagcgagagaaaccacagaaccaccgaggccgagcccaagcccctggaggagcccaagcacgagaccaagaagctgaagaacctgagcgagtacgcccagaccctgcagctgggctggaacggcctgctggtgctgaagaacagctgcttccccaccagcatgcacatcctggagggcgaccagggcgtgatcagcagcctgctgaaggaccacaccagcggcagcaagctgacccagctgaagatcgcccagagactgagactggaccagcccaagctggacgaggtgaccagaagaatcaagcagggcagccccaacggctacgccgtgctgctggccacccaggccacccccagcggcctgggcaccgagggcatgcccaccgtggagcccggcctgcagagaagactgctgagaaacctggtgagctacctgaagcagaagcaggccgccggcgtgatcagcctgcccgtgggcggcagcaagggcagagacggcaccggcatgctgtacgccttccccccctgcgacttcagccagcagtacctgcagagcgccctgagaaccctgggcaagctggaggaggagcacatggtgatcgtgatcgtgagagacaccgcctag

SEQ ID NO: 97783 - DNA, 1692 bp, Artificial Sequence
  Description of Artificial Sequence: Synthetic coding sequence
atgcccgaggacgaccagagagccaccagaaacctgttcatcggcaacctggaccacagcgtgagcgaggtggagctgagaagagccttcgagaagtacggcatcatcgaggaggtggtgatcaagagacccgccagaggccagggcggcgcctacgccttcctgaagttccagaacctggacatggcccacagagccaaggtggccatgagcggcagagtgatcggcagaaaccccatcaagatcggctacggcaaggccaaccccaccaccagactgtgggtgggcggcctgggccccaacaccagcctggccgccctggccagagagttcgacagattcggcagcatcagaaccatcgaccacgtgaagggcgacagcttcgcctacatccagtacgagagcctggacgccgcccaggccgcctgcgccaagatgagaggcttccccctgggcggccccgacagaagactgagagtggacttcgccaaggccgaggagaccagatacccccagcagtaccagcccagccccctgcccgtgcactacgagctgctgaccgacggctacaccagacacagaaacctggacgccgacctggtgagagacagaacccccccccacctgctgtacagcgacagagacagaaccttcctggagggcgactggaccagccccagcaagagcagcgacagaagaaacagcctggagggctacagcagaagcgtgagaagcagaagcggcgagagatggggcgccgacggcgacagaggcctgcccaagccctgggaggagagaagaaagagaagaagcctgagcagcgacagaggcagaaccacccacagcccctacgaggagagaagcagaaccaagggcagcggccagcagagcgagagaggcagcgacagaacccccgagagaagcagaaaggagaaccacagcagcgagggcaccaaggagagcagcagcaacagcctgagcaacagcagacacggcgccgaggagagaggccaccaccaccaccaccacgaggccgccgacagcagccacggcaagaaggccagagacagcgagagaaaccacagaaccaccgaggccgagcccaagcccctggaggagcccaagcacgagaccaagaagctgaagaacctgagcgagtacgcccagaccctgcagctgggctggaacggcctgctggtgctgaagaacagctgcttccccaccagcatgcacatcctggagggcgaccagggcgtgatcagcagcctgctgaaggaccacaccagcggcagcaagctgacccagctgaagatcgcccagagactgagactggaccagcccaagctggacgaggtgaccagaagaatcaagcagggcagccccaacggctacgccgtgctgctggccacccaggccacccccagcggcctgggcaccgagggcatgcccaccgtggagcccggcctgcagagaagactgctgagaaacctggtgagctacctgaagcagaagcaggccgccggcgtgatcagcctgcccgtgggcggcagcaagggcagagacggcaccggcatgctgtacgccttccccccctgcgacttcagccagcagtacctgcagagcgccctgagaaccctgggcaagctggaggaggagcacatggtgatcgtgatcgtgagagacaccgcctag

SEQ ID NO: 97784 - DNA, 732 bp, Artificial Sequence
  Description of Artificial Sequence: Synthetic coding sequence
atgggcagagtgggcagagccggcagaagccagagaaccaagcagagcaccgtgctggcccccgtgatcgacctgaagagaggcggcagcagcgacgacagacagatcgtggacacccccccccacgtggccgccggcctgaaggaccccgtgcccagcggcttcagcgccggcgaggtgctgatccccctggccgacgagtacgaccccatgttccccaacgactacgagaaggtggtgaagagacagagagaggagagacagagacagagagagctggagagacagaaggagatcgaggagagagagaagagaagaaaggacagacacgaggccagcggcttcgccagaagacccgaccccgacagcgacgaggacgaggactacgagagagagagaagaaagagaagcatgggcggcgccgccatcgccccccccaccagcctggtggagaaggacaaggagctgcccagagacttcccctacgaggaggacagcagacccagaagccagagcagcaaggccgccatccccccccccgtgtacgaggagcaggacagacccagaagccccaccggccccagcaacagcttcctggccaacatgggcggcaccgtggcccacaagatcatgcagaagtacggcttcagagagggccagggcctgggcaagcacgagcagggcctgagcaccgccctgagcgtggagaagaccagcaagagaggcggctag

SEQ ID NO: 97785 - DNA, 1206 bp, Artificial Sequence
  Description of Artificial Sequence: Synthetic coding sequence
atgagcctgtacgacgacctgggcgtggagaccagcgacagcaagaccgagggctggagcaagaacttcaagctgctgcagagccagctgcaggtgaagaaggccgccctgacccaggccaagagccagagaaccaagcagagcaccgtgctggcccccgtgatcgacctgaagagaggcggcagcagcgacgacagacagatcgtggacacccccccccacgtggccgccggcctgaaggaccccgtgcccagcggcttcagcgccggcgaggtgctgatccccctggccgacgagtacgaccccatgttccccaacgactacgagaaggtggtgaagagacagagagaggagagacagagacagagagagctggagagacagaaggagatcgaggagagagagaagagaagaaaggacagacacgaggccagcggcttcgccagaagacccgaccccgacagcgacgaggacgaggactacgagagagagagaagaaagagaagcatgggcggcgccgccatcgccccccccaccagcctggtggagaaggacaaggagctgcccagagacttcccctacgaggaggacagcagacccagaagccagagcagcaaggccgccatccccccccccgtgtacgaggagcaggacagacccagaagccccaccggccccagcaacagcttcctggccaacatgggcggcaccgtggcccacaagatcatgcagaagtacggcttcagagagggccagggcctgggcaagcacgagcagggcctgagcaccgccctgagcgtggagaagaccagcaagagaggcggcaagatcatcgtgggcgacgccaccgagaaggacgccagcaagaagagcgacagcaaccccctgaccgagatcctgaagtgccccaccaaggtggtgctgctgagaaacatggtgggcgccggcgaggtggacgaggacctggaggtggagaccaaggaggagtgcgagaagtacggcaaggtgggcaagtgcgtgatcttcgagatccccggcgcccccgacgacgaggccgtgagaatcttcctggagttcgagagagtggagagcgccatcaaggccgtggtggacctgaacggcagatacttcggcggcagagtggtgaaggcctgcttctacaacctggacaagttcagagtgctggacctggccgagcaggtgtag

SEQ ID NO: 97786 - DNA, 639 bp, Artificial Sequence
  Description of Artificial Sequence: Synthetic coding sequence
atgagcctgtacgacgacctgggcgtggagaccagcgacagcaagaccgagggctggagcaagaacttcaagctgctgcagagccagctgcaggtgaagaaggccgccctgacccaggccaagagccagagaaccaagcagagcaccgtgctggcccccgtgatcgacctgaagagaggcggcagcagcgacgacagacagatcgtggacacccccccccacgtggccgccggcctgaaggaccccgtgcccagcggcttcagcgccggcgaggtgctgatccccctggccgacgagtacgaccccatgttccccaacgactacgagaaggtggtgaagagacagagagaggagagacagagacagagagagctggagagacagaaggagatcgaggagagagagaagagaagaaaggacagacacgaggccagcggcttcgccagaagacccgaccccgacagcgacgaggacgaggactacgagagagagagaagaaagagaagcatgggcggcgccgccatcgccccccccaccagcctggtggagaaggacaaggagctgcccagagacttcccctacgaggaggacagcagacccagaagccagagcagcaaggccgccatcccccccccctag

SEQ ID NO: 97787 - DNA, 666 bp, Artificial Sequence
  Description of Artificial Sequence: Synthetic coding sequence
atgagcctgtacgacgacctgggcgtggagaccagcgacagcaagaccgagggctggagcaagaacttcaagctgctgcagagccagctgcaggtgaagaaggccgccctgacccaggccaagagccagagaaccaagcagagcaccgtgctggcccccgtgatcgacctgaagagaggcggcagcagcgacgacagacagatcgtggacacccccccccacgtggccgccggcctgaaggaccccgtgcccagcggcttcagcgccggcgaggtgctgatccccctggccgacgagtacgaccccatgttccccaacgactacgagaaggtggtgaagagacagagagaggagagacagagacagagagagctggagagacagaaggagatcgaggagagagagaagagaaaggacagacacgaggccagcggcttcgccagaagacccgaccccgacagcgacgaggacgaggactacgagagagagagaagaaagagaagcatgggcggcgccgccatcgccccccccaccagcctggtggagaaggacaaggagctgcccagagacttcccctacgaggaggacagcagacccagaagccagagcagcaaggccgccatccccccccccgtgtacgaggagcaggacagacccagaagctag

SEQ ID NO: 97788 - DNA, 732 bp, Artificial Sequence; identical to SEQ ID NO: 97784
  Description of Artificial Sequence: Synthetic coding sequence

SEQ ID NO: 97789 - DNA, 1206 bp, Artificial Sequence; identical to SEQ ID NO: 97785
  Description of Artificial Sequence: Synthetic coding sequence

SEQ ID NO: 97790 - DNA, 678 bp, Artificial Sequence
  Description of Artificial Sequence: Synthetic coding sequence
tgacccctggccgacgagtacgaccccatgttccccaacgactacgagaaggtggtgaagagacagagagaggagagacagagacagagagagctggagagacagaaggagatcgaggagagagagaagagaagaaaggacagacacgaggccagcggcttcgccagaagacccgaccccgacagcgacgaggacgaggactacgagagagagagaagaaagagaagcatgggcggcgccgccatcgccccccccaccagcctggtggagaaggacaaggagctgcccagagacttcccctacgaggaggacagcagacccagaagccagagcagcaaggccgccatccccccccccgtgtacgaggagcaggacagacccagaagccccaccggccccagcaacagcttcctggccaacatgggcggcaccgtggcccacaagatcatgcagaagtacggcttcagagagggccagggcctgggcaagcacgagcagggcctgagcaccgccctgagcgtggagaagaccagcaagagaggcggcaagatcatcgtgggcgacgccaccgagaagggcgtgagccccggcaagagagtgaccagaggcaagggcctggcccccagcatcagcgacatggccagcctggacccccacgtgagcgccggcggccagtag

SEQ ID NO: 97791 - DNA, 3684 bp, Artificial Sequence
  Description of Artificial Sequence: Synthetic coding sequence
atggtgctggccgccgccatgagccaggacgccgaccccagcggccccgagcagcccgacagagtggcctgcagcgtgcccggcgccagagccagccccgcccccagcggccccagaggcatgcagcagccccccccccccccccagccccccccccccccccaggccggcctgccccagatcatccagaacgccgccaagctgctggacaagaaccccttcagcgtgagcaaccccaaccccctgctgcccagccccgccagcctgcagctggcccagctgcaggcccagctgaccctgcacagactgaagctggcccagaccgccgtgaccaacaacaccgccgccgccaccgtgctgaaccaggtgctgagcaaggtggccatgagccagcccctgttcaaccagctgagacaccccagcgtgatcaccggcccccacggccacgccggcgtgccccagcacgccgccgccatccccagcaccagattccccagcaacgccatcgccttcagcccccccagccagaccagaggccccggccccagcatgaacctgcccaaccagccccccagcgccatggtgatgcaccccttcaccggcgtgatgccccagacccccggccagcccgccgtgatcctgggcatcggcaagaccggccccgcccccgccaccgccggcttctacgagtacggcaaggccagcagcggccagacctacggccccgagaccgacggccagcccggcttcctgcccagcagcgccagcaccagcggcagcgtgacctacgagggccactacagccacaccggccaggacggccaggccgccttcagcaaggacttctacggccccaacagccagggcagccacgtggccagcggcttccccgccgagcaggccggcggcctgaagagcgaggtgggccccctgctgcagggcaccaacagccagtgggagagcccccacggcttcagcggccagagcaagcccgacctgaccgccggccccatgtggccccccccccacaaccagccctacgagctgtacgaccccgaggagcccaccagcgacagaaccccccccagcttcggcggcagactgaacaacagcaagcagggcttcatcggcgccggcagaagagccaaggaggaccaggccctgctgagcgtgagacccctgcaggcccacgagctgaacgacttccacggcgtggcccccctgcacctgccccacatctgcagcatctgcgacaagaaggtgttcgacctgaaggactgggagctgcacgtgaagggcaagctgcacgcccagaagtgcctggtgttcagcgagaacgccggcatcagatgcatcctgggcagcgccgagggcaccctgtgcgccagccccaacagcaccgccgtgtacaaccccgccggcaacgaggactacgccagcaacctgggcaccagctacgtgcccatccccgccagaagcttcacccagagcagccccaccttccccctggccagcgtgggcaccaccttcgcccagagaaagggcgccggcagagtggtgcacatctgcaacctgcccgagggcagctgcaccgagaacgacgtgatcaacctgggcctgcccttcggcaaggtgaccaactacatcctgatgaagagcaccaaccaggccttcctggagatggcctacaccgaggccgcccaggccatggtgcagtactaccaggagaagagcgccgtgatcaacggcgagaagctgctgatcagaatgagcaagagatacaaggagctgcagctgaagaagcccggcaaggccgtggccgccatcatccaggacatccacagccagagagagagagacatgttcagagaggccgacagatacggccccgagagacccagaagcagaagccccgtgagcagaagcctgagccccagaagccacacccccagcttcaccagctgcagcagcagccacagcccccccggccccagcagagccgactggggcaacggcagagacagctgggagcacagcccctacgccagaagagaggaggagagagaccccgccccctggagagacaacggcgacgacaagagagacagaatggacccctgggcccacgacagaaagcaccaccccagacagctggacaaggccgagctggacgagagacccgagggcggcagaccccacagagagaagtaccccagaagcggcagccccaacctgccccacagcgtgagcagctacaagagcagagaggacggctactacagaaaggagcccaaggccaagtgggacaagtacctgaagcagcagcaggacgcccccggcagaagcagaagaaaggacgaggccagactgagagagagcagacacccccaccccgacgacagcggcaaggaggacggcctgggccccaaggtgaccagagcccccgagggcgccaaggccaagcagaacgagaagaacaagaccaagagaaccgacagagaccaggagggcgccgacgacagaaaggagaacaccatggccgagaacgaggccggcaaggaggagcaggagggcatggaggagagcccccagagcgtgggcagacaggagaaggaggccgagttcagcgaccccgagaacaccagaaccaagaaggagcaggactgggagagcgagagcgaggccgagggcgagagctggtaccccaccaacatggaggagctggtgaccgtggacgaggtgggcgaggaggaggacttcatcgtggagcccgacatccccgagctggaggagatcgtgcccatcgaccagaaggacaagatctgccccgagacctgcctgtgcgtgaccaccaccctggacctggacctggcccaggacttccccaaggagggcgtgaaggccgtgggcaacggcgccgccgagatcagcctgaagagccccagagagctgcccagcgccagcaccagctgccccagcgacatggacgtggagatgcccggcctgaacctggacgccgagagaaagcccgccgagagcgagaccggcctgagcctggaggacagcgactgctacgagaaggaggccaagggcgtggagagcagcgacgtgcaccccgcccccaccgtgcagcagatgagcagccccaagcccgccgaggagagagccagacagcccagccccttcgtggacgactgcaagaccagaggcacccccgaggacggcgcctgcgagggcagccccctggaggagaaggccagcccccccatcgagaccgacctgcagaaccaggcctgccaggaggtgctgacccccgagaacagcagatacgtggagatgaagagcctggaggtgagaagccccgagtacaccgaggtggagctgaagcagcccctgagcctgcccagctgggagcccgaggacgtgttcagcgagctgagcatccccctgggcgtggagttcgtggtgcccagaaccggcttctactgcaagctgtgcggcctgttctacaccagcgaggagaccgccaagatgagccactgcagaagcgccgtgcactacagaaacctgcagaagtacctgagccagctggccgaggagggcctgaaggagaccgagggcgccgacagccccagacccgaggacagcggcatcgtgcccagattcgagagaaagaagctgtag

SEQ ID NO: 97792 - DNA, 3378 bp, Artificial Sequence
  Description of Artificial Sequence: Synthetic coding sequence
atggtgctggccgccgccatgagccaggacgccgaccccagcggccccgagcagcccgacagagtggcctgcagcgtgcccggcgccagagccagccccgcccccagcggccccagaggcatgcagcagccccccccccccccccagccccccccccccccccaggccggcctgccccagatcatccagaacgccgccaagctgctggacaagaaccccttcagcgtgagcaaccccaaccccctgctgcccagccccgccagcctgcagctggcccagctgcaggcccagctgaccctgcacagactgaagctggcccagaccgccgtgaccaacaacaccgccgccgccaccgtgctgaaccaggtgctgagcaaggtggccatgagccagcccctgttcaaccagctgagacaccccagcgtgatcaccggcccccacggccacgccggcgtgccccagcacgccgccgccatccccagcaccagattccccagcaacgccatcgccttcagcccccccagccagaccagaggccccggccccagcatgaacctgcccaaccagccccccagcgccatggtgatgcaccccttcaccggcgtgatgccccagacccccggccagcccgccgtgatcctgggcatcggcaagaccggccccgcccccgccaccgccggcttctacgagtacggcaaggccagcagcggccagacctacggccccgagaccgacggccagcccggcttcctgcccagcagcgccagcaccagcggcagcgtgacctacgagggccactacagccacaccggccaggacggccaggccgccttcagcaaggacttctacggccccaacagccagggcagccacgtggccagcggcttccccgccgagcaggccggcggcctgaagagcgaggtgggccccctgctgcagggcaccaacagccagtgggagagcccccacggcttcagcggccagagcaagcccgacctgaccgccggccccatgtggccccccccccacaaccagccctacgagctgtacgaccccgaggagcccaccagcgacagaaccccccccagcttcggcggcagactgaacaacagcaagcagggcttcatcggcgccggcagaagagccaaggaggaccaggccctgctgagcgtgagacccctgcaggcccacgagctgaacgacttccacggcgtggcccccctgcacctgccccacatctgcagcatctgcgacaagaaggtgttcgacctgaaggactgggagctgcacgtgaagggcaagctgcacgcccagaagtgcctggtgttcagcgagaacgccggcatcagatgcatcctgggcagcgccgagggcaccctgtgcgccagccccaacagcaccgccgtgtacaaccccgccggcaacgaggactacgccagcaacctgggcaccagctacgtgcccatccccgccagaagcttcacccagagcagccccaccttccccctggccagcgtgggcaccaccttcgcccagagaaagggcgccggcagagtggtgcacatctgcaacctgcccgagggcagctgcaccgagaacgacgtgatcaacctgggcctgcccttcggcaaggtgaccaactacatcctgatgaagagcaccaaccaggccttcctggagatggcctacaccgaggccgcccaggccatggtgcagtactaccaggagaagagcgccgtgatcaacggcgagaagctgctgatcagaatgagcaagagatacaaggagctgcagctgaagaagcccggcaaggccgtggccgccatcatccaggacatccacagccagagagagagagacatgttcagagaggccgacagatacggccccgagagacccagaagcagaagccccgtgagcagaagcctgagccccagaagccacacccccagcttcaccagctgcagcagcagccacagcccccccggccccagcagagccgactggggcaacggcagagacagctgggagcacagcccctacgccagaagagaggaggagagagaccccgccccctggagagacaacggcgacgacaagagagacagaatggacccctgggcccacgacagaaagcaccaccccagacagctggacaaggccgagctggacgagagacccgagggcggcagaccccacagagagaagtaccccagaagcggcagccccaacctgccccacagcgtgagcagctacaagagcagagaggacggctactacagaaaggagcccaaggccaagtgggacaagtacctgaagcagcagcaggacgcccccggcagaagcagaagaaaggacgaggccagactgagagagagcagacacccccaccccgacgacagcggcaaggaggacggcctgggccccaaggtgaccagagcccccgagggcgccaaggccaagcagaacgagaagaacaagaccaagagaaccgacagagaccaggagggcgccgacgacagaaaggagaacaccatggccgagaacgaggccggcaaggaggagcaggagggcatggaggagagcccccagagcgtgggcagacaggagaaggaggccgagttcagcgaccccgagaacaccagaaccaagaaggagcaggactgggagagcgagagcgaggccgagggcgagagctggtaccccaccaacatggaggagctggtgaccgtggacgaggtgggcgaggaggaggacttcatcgtggagcccgacatccccgagctggaggagatcgtgcccatcgaccagaaggacaagatctgccccgagacctgcctgtgcgtgaccaccaccctggacctggacctggcccaggacttccccaaggagggcgtgaaggccgtgggcaacggcgccgccgagatcagcctgaagagccccagagagctgcccagcgccagcaccagctgccccagcgacatggacgtggagatgcccggcctgaacctggacgccgagagaaagcccgccgagagcgagaccggcctgagcctggaggacagcgactgctacgagaaggaggccaagggcgtggagagcagcgacgtgcaccccgcccccaccgtgcagcagatgagcagccccaagcccgccgaggagagagccagacagcccagccccttcgtggacgactgcaagaccagaggcacccccgaggacggcgcctgcgagggcagccccctggaggagaaggccagcccccccatcgagaccgacctgcagaaccaggcctgccagggcagcgacagcgacaccagactggtgagcggctacagcctgacccccctggagaagacccccggcacctggaagtag

SEQ ID NO: 97793 - DNA, 1263 bp, Artificial Sequence
  Description of Artificial Sequence: Synthetic coding sequence
atggccaccagcctgggcagcaacacctacaacagacagaactgggaggacgccgacttccccatcctgtgccagacctgcctgggcgagaacccctacatcagaatgaccaaggagaagtacggcaaggagtgcaagatctgcgccagacccttcaccgtgttcagatggtgccccggcgtgagaatgagattcaagaagaccgaggtgtgccagacctgcagcaagctgaagaacgtgtgccagacctgcctgctggacctggagtacggcctgcccatccaggtgagagacgccggcctgagcttcaaggacgacatgcccaagagcgacgtgaacaaggagtactacacccagaacatggagagagagatcagcaacagcgacggcaccagacccgtgggcatgctgggcaaggccaccagcaccagcgacatgctgctgaagctggccagaaccaccccctactacaagagaaacagaccccacatctgcagcttctgggtgaagggcgagtgcaagagaggcgaggagtgcccctacagacacgagaagcccaccgaccccgacgaccccctggccgaccagaacatcaaggacagatactacggcatcaacgaccccgtggccgacaagctgctgaagagagccagcaccatgcccagactggacccccccgaggacaagaccatcaccaccctgtacgtgggcggcctgggcgacaccatcaccgagaccgacctgagaaaccacttctaccagttcggcgagatcagaaccatcaccgtggtgcagagacagcagtgcgccttcatccagttcgccaccagacaggccgccgaggtggccgccgagaagagcttcaacaagctgatcgtgaacggcagaagactgaacgtgaagtggggcagaagccaggccgccagaggcaaggagaaggagaaggacggcaccaccgacagcggcatcaagctggagcccgtgcccggcctgcccggcgccctgccccccccccccgccgccgaggaggaggccagcgccaactacttcaacctgccccccagcggcccccccgccgtggtgaacatcgccctgccccccccccccggcatcgcccccccccccccccccggcttcggcccccacatgttccaccccatgggcccccccccccccttcatgagagcccccggccccatccactaccccagccaggacccccagagaatgggcgcccacgccggcaagcacagcagcccctag

SEQ ID NO: 97794 - DNA, 1116 bp, Artificial Sequence
  Description of Artificial Sequence: Synthetic coding sequence
atggccaccagcctgggcagcaacacctacaacagacagaactgggaggacgccgacttccccatcctgtgccagacctgcctgggcgagaacccctacatcagaatgaccaaggagaagtacggcctgcccatccaggtgagagacgccggcctgagcttcaaggacgacatgcccaagagcgacgtgaacaaggagtactacacccagaacatggagagagagatcagcaacagcgacggcaccagacccgtgggcatgctgggcaaggccaccagcaccagcgacatgctgctgaagctggccagaaccaccccctactacaagagaaacagaccccacatctgcagcttctgggtgaagggcgagtgcaagagaggcgaggagtgcccctacagacacgagaagcccaccgaccccgacgaccccctggccgaccagaacatcaaggacagatactacggcatcaacgaccccgtggccgacaagctgctgaagagagccagcaccatgcccagactggacccccccgaggacaagaccatcaccaccctgtacgtgggcggcctgggcgacaccatcaccgagaccgacctgagaaaccacttctaccagttcggcgagatcagaaccatcaccgtggtgcagagacagcagtgcgccttcatccagttcgccaccagacaggccgccgaggtggccgccgagaagagcttcaacaagctgatcgtgaacggcagaagactgaacgtgaagtggggcagaagccaggccgccagaggcaaggagaaggagaaggacggcaccaccgacagcggcatcaagctggagcccgtgcccggcctgcccggcgccctgccccccccccccgccgccgaggaggaggccagcgccaactacttcaacctgccccccagcggcccccccgccgtggtgaacatcgccctgccccccccccccggcatcgcccccccccccccccccggcttcggcccccacatgttccaccccatgggcccccccccccccttcatgagagcccccggccccatccactaccccagccaggacccccagagaatgggcgcccacgccggcaagcacagcagcccctag

SEQ ID NO: 97795 - DNA, 1116 bp, Artificial Sequence
  Description of Artificial Sequence: Synthetic coding sequence
atggccaccagcctgggcagcaacacctacaacagacagaactgggaggacgccgacttccccatcctgtgccagacctgcctgggcgagaacccctacatcagaatggagagagagaagagcggcctgcccatccaggtgagagacgccggcctgagcttcaaggacgacatgcccaagagcgacgtgaacaaggagtactacacccagaacatggagagagagatcagcaacagcgacggcaccagacccgtgggcatgctgggcaaggccaccagcaccagcgacatgctgctgaagctggccagaaccaccccctactacaagagaaacagaccccacatctgcagcttctgggtgaagggcgagtgcaagagaggcgaggagtgcccctacagacacgagaagcccaccgaccccgacgaccccctggccgaccagaacatcaaggacagatactacggcatcaacgaccccgtggccgacaagctgctgaagagagccagcaccatgcccagactggacccccccgaggacaagaccatcaccaccctgtacgtgggcggcctgggcgacaccatcaccgagaccgacctgagaaaccacttctaccagttcggcgagatcagaaccatcaccgtggtgcagagacagcagtgcgccttcatccagttcgccaccagacaggccgccgaggtggccgccgagaagagcttcaacaagctgatcgtgaacggcagaagactgaacgtgaagtggggcagaagccaggccgccagaggcaaggagaaggagaaggacggcaccaccgacagcggcatcaagctggagcccgtgcccggcctgcccggcgccctgccccccccccccgccgccgaggaggaggccagcgccaactacttcaacctgccccccagcggcccccccgccgtggtgaacatcgccctgccccccccccccggcatcgcccccccccccccccccggcttcggcccccacatgttccaccccatgggcccccccccccccttcatgagagcccccggccccatccactaccccagccaggacccccagagaatgggcgcccacgccggcaagcacagcagcccctag

SEQ ID NO: 97796 - DNA, 2532 bp, Artificial Sequence
  Description of Artificial Sequence: Synthetic coding sequence
atgagcttccccccccacctgaacagaccccccatgggcatccccgccctgccccccggcatcccccccccccagttccccggcttccccccccccgtgccccccggcacccccatgatccccgtgcccatgagcatcatggcccccgcccccaccgtgctggtgcccaccgtgagcatggtgggcaagcacctgggcgccagaaaggaccaccccggcctgaaggccaaggagaacgacgagaactgcggccccaccaccaccgtgttcgtgggcaacatcagcgagaaggccagcgacatgctgatcagacagctgctggccaagtgcggcctggtgctgagctggaagagagtgcagggcgccagcggcaagctgcaggccttcggcttctgcgagtacaaggagcccgagagcaccctgagagccctgagactgctgcacgacctgcagatcggcgagaagaagctgctggtgaaggtggacgccaagaccaaggcccagctggacgagtggaaggccaagaagaaggccagcaacggcaacgccagacccgagaccgtgaccaacgacgacgaggaggccctggacgaggagaccaagagaagagaccagatgatcaagggcgccatcgaggtgctgatcagagagtacagcagcgagctgaacgcccccagccaggagagcgacagccaccccagaaagaagaagaaggagaagaaggaggacatcttcagaagattccccgtggcccccctgatcccctaccccctgatcaccaaggaggacatcaacgccatcgagatggaggaggacaagagagacctgatcagcagagagatcagcaagttcagagacacccacaagaagctggaggaggagaagggcaagaaggagaaggagagacaggagatcgagaaggagagaagagagagagagagagagagagagagagagagagagagaagagagagagagagagagagagagagagagagagagagagagaaggagaaggagagagagagagagagagagagagacagagacagagacagaaccaaggagagagacagagacagagacagagagagagacagagacagagacagagagagaagcagcgacagaaacaaggacagaagcagaagcagagagaagagcagagacagagagagagagagagagagagagagagagagagagagagagagagagagagagagagagagagagagagagagagagagagagagagagagagagagagagagagagaaggacaagaagagagacagagaggaggacgaggaggacgcctacgagagaagaaagctggagagaaagctgagagagaaggaggccgcctaccaggagagactgaagaactgggagatcagagagagaaagaagaccagagagtacgagaaggaggccgagagagaggaggagagaagaagagagatggccaaggaggccaagagactgaaggagttcctggaggactacgacgacgacagagacgaccccaagtactacagaggcagcgccctgcagaagagactgagagacagagagaaggagatggaggccgacgagagagacagaaagagagagaaggaggagctggaggagatcagacagagactgctggccgagggccaccccgaccccgacgccgagctgcagagaatggagcaggaggccgagagaagaagacagccccagatcaagcaggagcccgagagcgaggaggaggaggaggagaagcaggagaaggaggagaagagagaggagcccatggaggaggaggaggagcccgagcagaagccctgcctgaagcccaccctgagacccatcagcagcgcccccagcgtgagcagcgccagcggcaacgccacccccaacacccccggcgacgagagcccctgcggcatcatcatcccccacgagaacagccccgaccagcagcagcccgaggagcacagacccaagatcggcctgagcctgaagctgggcgccagcaacagccccggccagcccaacagcgtgaagagaaagaagctgcccgtggacagcgtgttcaacaagttcgaggacgaggacagcgacgacgtgcccagaaagagaaagctggtgcccctggactacggcgaggacgacaagaacgccaccaagggcaccgtgaacaccgaggagaagagaaagcacatcaagagcctgatcgagaagatccccaccgccaagcccgagctgttcgcctaccccctggactggagcatcgtggacagcatcctgatggagagaagaatcagaccctggatcaacaagaagatcatcgagtacatcggcgaggaggaggccaccctggtggacttcgtgtgcagcaaggtgatggcccacagcagcccccagagcatcctggacgacgtggccatggtgctggacgaggaggccgaggtgttcatcgtgaagatgtggagactgctgatctacgagaccgaggccaagaagatcggcctggtgaagtag

SEQ ID NO: 97797 - DNA, 384 bp, Artificial Sequence
  Description of Artificial Sequence: Synthetic coding sequence
atgagcttccccccccacctgaacagaccccccatgggcatccccgccctgccccccggcatcccccccccccagttccccggcttccccccccccgtgccccccggcacccccatgatccccgtgcccatgagcatcatggcccccgcccccaccgtgctggtgcccaccgtgagcatggtgggcaagcacctgggcgccagaaaggaccaccccggcctgaaggccaaggagaacgacgagaactgcggccccaccaccaccgtgttcgtgggcaacatcagcgagaaggccagcgacatgctgatcagacagctgctggccaagtgcggcctggtgctgagctggaagagagtgcagggcgccagcggcaagctgcagtag

SEQ ID NO: 97798 - DNA, 903 bp, Artificial Sequence
  Description of Artificial Sequence: Synthetic coding sequence
atgagcttccccccccacctgaacagaccccccatgggcatccccgccctgccccccggcatcccccccccccagttccccggcttccccccccccgtgccccccggcacccccatgatccccgtgcccatgagcatcatggcccccgcccccaccgtgctggtgcccaccgtgagcatggtgggcaagcacctgggcgccagaaaggaccaccccggcctgaaggccaaggagaacgacgagaactgcggccccaccaccaccgtgttcgtgggcaacatcagcgagaaggccagcgacatgctgatcagacagctgctggccaagtgcggcctggtgctgagctggaagagagtgcagggcgccagcggcaagctgcaggccttcggcttctgcgagtacaaggagcccgagagcaccctgagagccctgagactgctgcacgacctgcagatcggcgagaagaagctgctggtgaaggtggacgccaagaccaaggcccagctggacgagtggaaggccaagaagaaggccagcaacggcaacgccagacccgagaccgtgaccaacgacgacgaggaggccctggacgaggagaccaagagaagagaccagatgatcaagggcgccatcgaggtgctgatcagagagtacagcagcgagctgaacgcccccagccaggagagcgacagccaccccagaaagaagaagaaggagaagaaggaggacatcttcagaagattccccgtggcccccctgatcccctaccccctgatcaccaaggaggacatcaacgccatcgagatggaggaggacaagagagacctgatcagcagagagatcagcaagttcagagacacccacaaggtggtgttcctgagcttccacctgatccccatctag

SEQ ID NO: 97799 - DNA, 885 bp, Artificial Sequence
  Description of Artificial Sequence: Synthetic coding sequence
atgagcttccccccccacctgaacagaccccccatgggcatccccgccctgccccccggcatcccccccccccagttccccggcttccccccccccgtgccccccggcacccccatgatccccgtgcccatgagcatcatggcccccgcccccaccgtgctggtgcccaccgtgagcatggtgggcaagcacctgggcgccagaaaggaccaccccggcctgaaggccaaggagaacgacgagaactgcggccccaccaccaccgtgttcgtgggcaacatcagcgagaaggccagcgacatgctgatcagacagctgctggccaagtgcggcctggtgctgagctggaagagagtgcagggcgccagcggcaagctgcaggccttcggcttctgcgagtacaaggagcccgagagcaccctgagagccctgagactgctgcacgacctgcagatcggcgagaagaagctgctggtgaaggtggacgccaagaccaaggcccagctggacgagtggaaggccaagaagaaggccagcaacggcaacgccagacccgagaccgtgaccaacgacgacgaggaggccctggacgaggagaccaagagaagagaccagatgatcaagggcgccatcgaggtgctgatcagagagtacagcagcgagctgaacgcccccagccaggagagcgacagccaccccagaaagaagaagaaggagaagaaggaggacatcttcagaagattccccgtggcccccctgatcccctaccccctgatcaccaaggaggacatcaacgccatcgagatggaggaggacaagagagacctgatcagcagagagatcagcaagttcagagacacccacaagagaagctacggcgactag

SEQ ID NO: 97800 - DNA, 2532 bp, Artificial Sequence; identical to SEQ ID NO: 97796
  Description of Artificial Sequence: Synthetic coding sequence

SEQ ID NO: 97801 - DNA, 732 bp, Artificial Sequence
  Description of Artificial Sequence: Synthetic coding sequence
atgagcttccccccccacctgaacagaccccccatgggcatccccgccctgccccccggcatcccccccccccagttccccggcttccccccccccgtgccccccggcacccccatgatccccgtgcccatgagcatcatggcccccgcccccaccgtgctggtgcccaccgtgagcatggtgggcaagcacctgggcgccagaaaggaccaccccggcctgaaggccaaggagaacgacgagaactgcggccccaccaccaccgtgttcgtgggcaacatcagcgagaaggccagcgacatgctgatcagacagctgctggccaagtgcggcctggtgctgagctggaagagagtgcagggcgccagcggcaagctgcaggccttcggcttctgcgagtacaaggagcccgagagcaccctgagagccctgagactgctgcacgacctgcagatcggcgagaagaagctgctggtgaaggtggacgccaagaccaaggcccagctggacgagtggaaggccaagaagaaggccagcaacggcaacgccagacccgagaccgtgaccaacgacgacgaggaggccctggacgaggagaccaagagaagagaccagatgatcaagggcgccatcgaggtgctgatcagagagtacagcagcgagctgaacgcccccagccaggagagcgacagccaccccagaaagaagaagaaggagaagaaggaggactag

SEQ ID NO: 97802 - DNA, 885 bp, Artificial Sequence; identical to SEQ ID NO: 97799
  Description of Artificial Sequence: Synthetic coding sequence

SEQ ID NO: 97803 - DNA, 1350 bp, Artificial Sequence
  Description of Artificial Sequence: Synthetic coding sequence
atgctgcccgccgccaccgccagcctgctgggccccctgctgaccgcctgcgccctgctgcccttcgcccagggccagacccccaactacaccagacccgtgttcctgtgcggcggcgacgtgaagggcgagagcggctacgtggccagcgagggcttccccaacctgtacccccccaacaaggagtgcatctggaccatcaccgtgcccgagggccagaccgtgagcctgagcttcagagtgttcgacctggagctgcaccccgcctgcagatacgacgccctggaggtgttcgccggcagcggcaccagcggccagagactgggcagattctgcggcaccttcagacccgcccccctggtggcccccggcaaccaggtgaccctgagaatgaccaccgacgagggcaccggcggcagaggcttcctgctgtggtacagcggcagagccaccagcggcaccgagcaccagttctgcggcggcagactggagaaggcccagggcaccctgaccacccccaactggcccgagagcgactacccccccggcatcagctgcagctggcacatcatcgccccccccgaccaggtgatcgccctgaccttcgagaagttcgacctggagcccgacacctactgcagatacgacagcgtgagcgtgttcaacggcgccgtgagcgacgacagcagaagactgggcaagttctgcggcgacgccgtgcccggcagcatcagcagcgagggcaacgagctgctggtgcagttcgtgagcgacctgagcgtgaccgccgacggcttcagcgccagctacaagaccctgcccagaggcaccgccaaggagggccagggccccggccccaagagaggcaccgagcccaaggtgaagctgccccccaagagccagccccccgagaagaccgaggagagccccagcgcccccgacgcccccacctgccccaagcagtgcagaagaaccggcaccctgcagagcaacttctgcgccagcagcctggtggtgaccgccaccgtgaagagcatggtgagagagcccggcgagggcctggccgtgaccgtgagcctgatcggcgcctacaagaccggcggcctggacctgcccagcccccccaccggcgccagcctgaagttctacgtgccctgcaagcagtgcccccccatgaagaagggcgtgagctacctgctgatgggccaggtggaggagaacagaggccccgtgctgccccccgagagcttcgtggtgctgcacagacccaaccaggaccagatcctgaccaacctgagcaagagaaagtgccccagccagcccgtgagagccgccgccagccaggactag

SEQ ID NO: 97804 - DNA, 1857 bp, Artificial Sequence
  Description of Artificial Sequence: Synthetic coding sequence
atggccggcctgaccctgttcgtgggcagactgccccccagcgccagaagcgagcagctggaggagctgttcagccaggtgggccccgtgaagcagtgcttcgtggtgaccgagaagggcagaaccgtggccgtggactgggccgtggccaaggacaagtacaaggacacccagagcgtgagcgccatcggcgaggagaagagccacgagagcaagcaccaggagagcgtgaagaagaagggcagagaggaggaggacatggaggaggaggagaacgacgacgacgacgacgacgacgacgaggaggacggcgtgttcgacgacgaggacgaggaggaggagaacatcgagagcaaggtgaccaagcccgtgcagatccagaagagagccgtgaagagacccgcccccgccaagagcagcgaccacagcgaggaggacagcgacctggaggagagcgacagcatcgacgacggcgaggagctggcccagagcgacaccagcaccgaggagcaggaggacaaggccgtgcaggtgagcaacaagaagaagagaaagctgcccagcgacgtgaacgagggcaagaccgtgttcatcagaaacctgagcttcgacagcgaggaggaggagctgggcgagctgctgcagcagttcggcgagctgaagtacgtgagaatcgtgctgcaccccgacaccgagcacagcaagggctgcgccttcgcccagttcatgacccaggaggccgcccagaagtgcctgctggccgccagccccgagaacgaggccggcggcctgaagctggacggcagacagctgaaggtggacctggccgtgaccagagacgaggccgccaagctgcagaccaccaaggtgaagaagcccaccggcaccagaaacctgtacctggccagagagggcctgatcagagccggcaccaaggccgccgagggcgtgagcgccgccgacatggccaagagagagagattcgagctgctgaagcaccagaagctgaaggaccagaacatcttcgtgagcagaaccagactgtgcctgcacaacctgcccaaggccgtggacgacaagcagctgagaaagctgctgctgagcgccaccagcggcgagaagggcgtgagaatcaaggagtgcagagtgatgagagacctgaagggcgtgcacggcaacatgaagggccagagcctgggctacgccttcgccgagttccaggagcacgagcacgccctgaaggccctgagactgatcaacaacaaccccgagatcttcggccccctgaagagacccatcgtggagttcagcctggaggacagaagaaagctgaagatgaaggagctgagaatccagagaagcctgcagaagatgagaagcaagcccgccaccggcgagccccagaagggccagcccgagcccgccaaggaccagcagcagaaggccgcccagcaccacaccgaggagcagagcaaggtgccccccgagcagaagagaaaggccggcagcaccagctggaccggcttccagaccaaggccgaggtggagcaggtggagctgcccgacggcaagaagagaagaaaggtgctggccctgcccagccacagaggccccaagatcagactgagagacaagggcaaggtgaagcccgtgcaccccaagaagcccaagccccagatcaaccagtggaagcaggagaagcagcagctgagcagcgagcaggtgagcagaaagaaggccaagggcaacaagaccgagaccagattcaaccagctggtggagcagtacaagcagaagctgctgggccccagcaagggcgcccccctggccaagagaagcaagtggttcgacagctag

SEQ ID NO: 97805 - DNA, 720 bp, Artificial Sequence
  Description of Artificial Sequence: Synthetic coding sequence
atgctgctgcagcccgccccctgcgcccccagcgccggcttccccagacccctggccgcccccggcgccatgcacggcagccagaaggacaccaccttcaccaagatcttcgtgggcggcctgccctaccacaccaccgacgccagcctgagaaagtacttcgagggcttcggcgacatcgaggaggccgtggtgatcaccgacagacagaccggcaagagcagaggctacggcttcgtgaccatggccgacagagccgccgccgagagagcctgcaaggaccccaaccccatcatcgacggcagaaaggccaacgtgaacctggcctacctgggcgccaagcccagaagcctgcagaccggcttcgccatcggcgtgcagcagctgcaccccaccctgatccagagaacctacggcctgaccccccactacatctacccccccgccatcgtgcagcccagcgtggtgatccccgccgcccccgtgcccagcctgagcagcccctacatcgagtacacccccgccagccccgcctacgcccagtacccccccgccacctacgaccagtacccctacgccgccagccccgccaccgccgccagcttcgtgggctacagctaccccgccgccgtgccccaggccctgagcgccgccgcccccgccggcaccaccttcgtgcagtaccaggccccccagctgcagcccgacagaatgcagtag

SEQ ID NO: 97806 - DNA, 477 bp, Artificial Sequence
  Description of Artificial Sequence: Synthetic coding sequence
atggccgacagagccgccgccgagagagcctgcaaggaccccaaccccatcatcgacggcagaaaggccaacgtgaacctggcctacctgggcgccaagcccagaagcctgcagaccggcttcgccatcggcgtgcagcagctgcaccccaccctgatccagagaacctacggcctgaccccccactacatctacccccccgccatcgtgcagcccagcgtggtgatccccgccgcccccgtgcccagcctgagcagcccctacatcgagtacacccccgccagccccgcctacgcccagtacccccccgccacctacgaccagtacccctacgccgccagccccgccaccgccgccagcttcgtgggctacagctaccccgccgccgtgccccaggccctgagcgccgccgcccccgccggcaccaccttcgtgcagtaccaggccccccagctgcagcccgacagaatgcagtag

SEQ ID NO: 97807 - DNA, 366 bp, Artificial Sequence
  Description of Artificial Sequence: Synthetic coding sequence
atgctgctgcagcccgccccctgcgcccccagcgccggcttccccagacccctggccgcccccggcgccatgcacggcagccagaaggacaccaccttcaccaagatcttcgtgggcggcctgccctaccacaccaccgacgccagcctgagaaagtacttcgagggcttcggcgacatcgaggaggccgtggtgatcaccgacagacagaccggcaagagcagaggctacggcttcgtgaccatggccgacagagccgccgccgagagagcctgcaaggaccccaaccccatcatcgacggcagaaaggccaacgtgaacctggcctacctgggcgccaagcccagaagcctgcagaccggctag

SEQ ID NO: 97808 - DNA, 1095 bp, Artificial Sequence
  Description of Artificial Sequence: Synthetic coding sequence
atggtgaagctgttcatcggcaacctgcccagagaggccaccgagcaggagatcagaagcctgttcgagcagtacggcaaggtgctggagtgcgacatcatcaagaactacggcttcgtgcacatcgaggacaagaccgccgccgaggacgccatcagaaacctgcaccactacaagctgcacggcgtgaacatcaacgtggaggccagcaagaacaagagcaagaccagcaccaagctgcacgtgggcaacatcagccccacctgcaccaacaaggagctgagagccaagttcgaggagtacggccccgtgatcgagtgcgacatcgtgaaggactacgccttcgtgcacatggagagagccgaggacgccgtggaggccatcagaggcctggacaacaccgagttccagggcaagagaatgcacgtgcagctgagcaccagcagactgagaaccgcccccggcatgggcgaccagagcggctgctacagatgcggcaaggagggccactggagcaaggagtgccccatcgacagaagcggcagagtggccgacctgaccgagcagtacaacgagcagtacggcgccgtgagaaccccctacaccatgagctacggcgacagcctgtactacaacaacgcctacggcgccctggacgcctactacaagagatgcagagccgccagaagctacgaggccgtggccgccgccgccgccagcgtgtacaactacgccgagcagaccctgagccagctgccccaggtgcagaacaccgccatggccagccacctgaccagcaccagcctggacccctacgacagacacctgctgcccaccagcggcgccgccgccaccgccgccgccgccgccgccgccgccgccgccgtgaccgccgccagcaccagctactacggcagagacagaagccccctgagaagagccaccgcccccgtgcccaccgtgggcgagggctacggctacggccacgagagcgagctgagccaggccagcgccgccgccagaaacagcctgtacgacatggccagatacgagagagagcagtacgccgacagagccagatacagcgccttctag

SEQ ID NO: 97809 - DNA, 1095 bp, Artificial Sequence; identical to SEQ ID NO: 97808
  Description of Artificial Sequence: Synthetic coding sequence

SEQ ID NO: 97810 - DNA, 1095 bp, Artificial Sequence; identical to SEQ ID NO: 97808
  Description of Artificial Sequence: Synthetic coding sequence

SEQ ID NO: 97811 - DNA, 534 bp, Artificial Sequence
  Description of Artificial Sequence: Synthetic coding sequence
atggtgaagctgttcatcggcaacctgcccagagaggccaccgagcaggagatcagaagcctgttcgagcagtacggcaaggtgctggagtgcgacatcatcaagaactacggcttcgtgcacatcgaggacaagaccgccgccgaggacgccatcagaaacctgcaccactacaagctgcacggcgtgaacatcaacgtggaggccagcaagaacaagagcaagaccagcaccaagctgcacgtgggcaacatcagccccacctgcaccaacaaggagctgagagccaagttcgaggagtacggccccgtgatcgagtgcgacatcgtgaaggactacgccttcgtgcacatggagagagccgaggacgccgtggaggccatcagaggcctggacaacaccgagttccagggcgagccccccagcctgggcagaggcctgaacaccagactgtgcgccgagaacggctggatcagcaagagaagaggcctggtgaagatcaccgccgtgggctggctggtgatgaagaagtag

SEQ ID NO: 97812 - DNA, 534 bp, Artificial Sequence; identical to SEQ ID NO: 97811
  Description of Artificial Sequence: Synthetic coding sequence

SEQ ID NO: 97813 - DNA, 522 bp, Artificial Sequence
  Description of Artificial Sequence: Synthetic coding sequence
atggtgaagctgttcatcggcaacctgcccagagaggccaccgagcaggagatcagaagcctgttcgagcagtacggcaaggtgctggagtgcgacatcatcaagaactacggcttcgtgcacatcgaggacaagaccgccgccgaggacgccatcagaaacctgcaccactacaagctgcacggcgtgaacatcaacgtggaggccagcaagaacaagagcaagaccagcaccaagctgcacgtgggcaacatcagccccacctgcaccaacaaggagctgagagccaagttcgaggagtacggccccgtgatcgagtgcgacatcgtgaaggactacgccttcgtgcacatggagagagccgaggacgccgtggaggccatcagaggcctggacaacaccgagttccagggcaagatcacccccgtgaccgagggctactgctgctgcaacaagggccacacctacatcttcaagaactgcaacctgatcctggagagcagaaagagcagaagatgctag

SEQ ID NO: 97814 - DNA, 432 bp, Artificial Sequence
  Description of Artificial Sequence: Synthetic coding sequence
atggtgaagctgttcatcggcaacctgcccagagaggccaccgagcaggagatcagaagcctgttcgagcagtacggcaaggtgctggagtgcgacatcatcaagaactacggcttcgtgcacatcgaggacaagaccgccgccgaggacgccatcagaaacctgcaccactacaagctgcacggcgtgaacatcaacgtggaggccagcaagaacaagagcaagaccagcaccaagctgcacgtgggcaacatcagccccacctgcaccaacaaggagctgagagccaagttcgaggagtacggccccgtgatcgagtgcgacatcgtgaaggactacgccttcgtgcacatggagagagccgaggacgccgtggaggccatcagaggcctggacaacaccgagttccagggcggcatgtgcgtgggctag

SEQ ID NO: 97815 - DNA, 1443 bp, Artificial Sequence
  Description of Artificial Sequence: Synthetic coding sequence
atggccggcgccggccccgcccccggcctgcccggcgccggcggccccgtggtgcccggccccggcgccggcatccccggcaagagcggcgaggagagactgaaggagatggaggccgagatggccctgttcgagcaggaggtgctgggcgcccccgtgcccggcatccccaccgccgtgcccgccgtgcccaccgtgcccaccgtgcccaccgtggaggccatgcaggtgcccgccgcccccgtgatcagacccatcatcgccaccaacacctaccagcaggtgcagcagaccctggaggccagagccgccgccgccgccaccgtggtgccccccatggtgggcggcccccccttcgtgggccccgtgggcttcggccccggcgacagaagccacctggacagccccgaggccagagaggccatgttcctgagaagagccgccgtggccccccagagagcccccatcctgagacccgccttcgtgccccacgtgctgcagagagccgacagcgccctgagcagcgccgccgccggccccagacccatggccctgagacccccccaccaggccctggtgggcccccccctgcccggcccccccggcccccccatgatgctgccccccatggccagagcccccggcccccccctgggcagcatggccgccctgagaccccccctggaggagcccgccgcccccagagagctgggcctgggcctgggcctgggcctgaaggagaaggaggaggccgtggtggccgccgccgccggcctggaggaggccagcgccgccgtggccgtgggcgccggcggcgcccccgccggccccgccgtgatcggccccagcctgcccctggccctggccatgcccctgcccgagcccgagcccctgcccctgcccctggaggtggtgagaggcctgctgccccccctgagaatccccgagctgctgagcctgagacccagacccagaccccccagacccgagcccccccccggcctgatggccctggaggtgcccgagcccctgggcgaggacaagaagaagggcaagcccgagaagctgaagagatgcatcagaaccgccgccggcagcagctgggaggaccccagcctgctggagtgggacgccgacgacttcagaatcttctgcggcgacctgggcaacgaggtgaacgacgacatcctggccagagccttcagcagattccccagcttcctgaaggccaaggtgatcagagacaagagaaccggcaagaccaagggctacggcttcgtgagcttcaaggaccccagcgactacgtgagagccatgagagagatgaacggcaagtacgtgggcagcagacccatcaagctgagaaagagcatgtggaaggacagaaacctggacgtggtgagaaagaagcagaaggagaagaagaagctgggcctgagatag

SEQ ID NO: 97816 - DNA, 1356 bp, Artificial Sequence
  Description of Artificial Sequence: Synthetic coding sequence
atggccggcgccggccccgcccccggcctgcccggcgccggcggccccgtggtgcccggccccggcgccggcatccccggcaagagcggcgaggagagactgaaggagatggaggccgagatggccctgttcgagcaggaggtgctgggcgcccccgtgcccggcatccccaccgccgtgcccgccgtgcccaccgtgcccaccgtgcccaccgtggaggccatgcaggtgcccgccgcccccgtgatcagacccatcatcgccaccaacacctaccagcaggtgcagcagaccctggaggccagagccgccgccgccgccaccgtggtgccccccatggtgggcggcccccccttcgtgggccccgtgggcttcggccccggcgacagaagccacctggacagccccgaggccagagaggccatgttcctgagaagagccgccgccggccccagacccatggccctgagacccccccaccaggccctggtgggcccccccctgcccggcccccccggcccccccatgatgctgccccccatggccagagcccccggcccccccctgggcagcatggccgccctgagaccccccctggaggagcccgccgcccccagagagctgggcctgggcctgggcctgggcctgaaggagaaggaggaggccgtggtggccgccgccgccggcctggaggaggccagcgccgccgtggccgtgggcgccggcggcgcccccgccggccccgccgtgatcggccccagcctgcccctggccctggccatgcccctgcccgagcccgagcccctgcccctgcccctggaggtggtgagaggcctgctgccccccctgagaatccccgagctgctgagcctgagacccagacccagaccccccagacccgagcccccccccggcctgatggccctggaggtgcccgagcccctgggcgaggacaagaagaagggcaagcccgagaagctgaagagatgcatcagaaccgccgccggcagcagctgggaggaccccagcctgctggagtgggacgccgacgacttcagaatcttctgcggcgacctgggcaacgaggtgaacgacgacatcctggccagagccttcagcagattccccagcttcctgaaggccaaggtgatcagagacaagagaaccggcaagaccaagggctacggcttcgtgagcttcaaggaccccagcgactacgtgagagccatgagagagatgaacggcaagtacgtgggcagcagacccatcaagctgagaaagagcatgtggaaggacagaaacctggacgtggtgagaaagaagcagaaggagaagaagaagctgggcctgagatag

SEQ ID NO: 97817 - DNA, 801 bp, Artificial Sequence
  Description of Artificial Sequence: Synthetic coding sequence
atgggcgccgccgccgccgaggccgacagaaccctgttcgtgggcaacctggagaccaaggtgaccgaggagctgctgttcgagctgttccaccaggccggccccgtgatcaaggtgaagatccccaaggacaaggacggcaagcccaagcagttcgccttcgtgaacttcaagcacgaggtgagcgtgccctacgccatgaacctgctgaacggcatcaagctgtacggcagacccatcaagatccagttcagaagcggcagcagccacgccccccaggacgtgagcctgagctacccccagcaccacgtgggcaacagcagccccaccagcaccagccccagcagatacgagagaaccatggacaacatgaccagcagcgcccagatcatccagagaagcttcagcagccccgagaacttccagagacaggccgtgatgaacagcgccctgagacagatgagctacggcggcaagttcggcagcagccccctggaccagagcggcttcagccccagcgtgcagagccacagccacagcttcaaccagagcagcagcagccagtggagacagggcacccccagcagccagagaaaggtgagaatgaacagctacccctacctggccgacagacactacagcagagagcagagatacaccgaccacggcagcgaccaccactacagaggcaagagagacgacttcttctacgaggacagaaaccacgacgactggagccacgactacgacaacagaagagacagcagcagagacggcaagtggagaagcagcagacactag

SEQ ID NO: 97818 - DNA, 525 bp, Artificial Sequence
  Description of Artificial Sequence: Synthetic coding sequence
atggccgacgtgctggacctgcacgaggccggcggcgaggacttcgccatggacgaggacggcgacgagagcatccacaagctgaaggagaaggccaagaagagaaagggcagaggcttcggcagcgaggagggcagcagagccagaatgagagaggactacgacagcgtggagcaggacggcgacgagcccggcccccagagaagcgtggagggctggatcctgttcgtgaccggcgtgcacgaggaggccaccgaggaggacatccacgacaagttcgccgagtacggcgagatcaagaacatccacctgaacctggacagaagaaccggctacctgaagggctacaccctggtggagtacgagacctacaaggaggcccaggccgccatggagggcctgaacggccaggacctgatgggccagcccatcagcgtggactggtgcttcgtgagaggcccccccaagggcaagagaagaggcggcagaagaagaagcagaagccccgacagaagaagaagatag

SEQ ID NO: 97819 - DNA, 522 bp, Artificial Sequence
  Description of Artificial Sequence: Synthetic coding sequence
atggccgacgtgctggacctgcacgaggccggcggcgaggacttcgccatggacgaggacggcgacgagagcatccacaagctgaaggagaaggccaagaagagaaagggcagaggcttcggcagcgagggcagcagagccagaatgagagaggactacgacagcgtggagcaggacggcgacgagcccggcccccagagaagcgtggagggctggatcctgttcgtgaccggcgtgcacgaggaggccaccgaggaggacatccacgacaagttcgccgagtacggcgagatcaagaacatccacctgaacctggacagaagaaccggctacctgaagggctacaccctggtggagtacgagacctacaaggaggcccaggccgccatggagggcctgaacggccaggacctgatgggccagcccatcagcgtggactggtgcttcgtgagaggcccccccaagggcaagagaagaggcggcagaagaagaagcagaagccccgacagaagaagaagatag

SEQ ID NO: 97820 - DNA, 1179 bp, Artificial Sequence
  Description of Artificial Sequence: Synthetic coding sequence
atggtggaggccgacagacccggcaagctgttcatcggcggcctgaacctggagaccgacgagaaggccctggaggccgagttcggcaagtacggcagaatcgtggaggtgctgctgatgaaggacagagagaccaacaagagcagaggcttcgccttcgtgaccttcgagagccccgccgacgccaaggccgccgccagagacatgaacggcaagagcctggacggcaaggccatcaaggtggcccaggccaccaagcccgccttcgagagcagcagaagaggcccccccccccccagaagcagaggcagacccagattcctgagaggcaccagaggcggcggcggcggccccagaagaagccccagcagaggcggccccgacgacgacggcggctacaccgccgacttcgacctgagacccagcagagcccccatgcccatgaagagaggccccccccccagaagagtgggccccccccccaagagagccgcccccagcggccccgccagaagcagcggcggcggcatgagaggcagagccctggccgtgagaggcagagacggctacagcggcccccccagaagagagcccctgccccccagaagagacccctacctgggccccagagacgagggctacagcagcagagacggctacagcagcagagactacagagagcccagaggcttcgcccccagccccggcgagtacacccacagagactacggccacagcagcgtgagagacgactgccccctgagaggctacagcgacagagacggctacggcggcagagacagagactacggcgaccacctgagcagaggcagccacagagagcccttcgagagctacggcgagctgagaggcgccgcccccggcagaggcaccccccccagctacggcggcggcggcagatacgaggagtacagaggctacagccccgacgcctacagcggcggcagagacagctacagcagcagctacggcagaagcgacagatacagcagaggcagacacagagtgggcagacccgacagaggcctgagcctgagcatggagagaggctgccccccccagagagacagctacagcagaagcggctgcagagtgcccagaggcggcggcagactgggcggcagactggagagaggcggcggcagaagcagatactag

SEQ ID NO: 97821 - DNA, 1491 bp, Artificial Sequence
  Description of Artificial Sequence: Synthetic coding sequence
atggtggaggccgaccaccccggcaagctgttcatcggcggcctgaacagagagaccaacgagaagatgctgaaggccgtgttcggcaagcacggccccatcagcgaggtgctgctgatcaaggacagaaccagcaagagcagaggcttcgccttcatcaccttcgagaaccccgccgacgccaagaacgccgccaaggacatgaacggcaagagcctgcacggcaaggccatcaaggtggagcaggccaagaagcccagcttccagagcggcggcagaagaagaccccccgccagcagcagaaacagaagccccagcggcagcctgagaagcgccagaggcagcagaggcggcaccagaggctggctgcccagccacgagggccacctggacgacggcggctacacccccgacctgaagatgagctacagcagaggcctgatccccgtgaagagaggccccagcagcagaagcggcggccccccccccaagaagagcgcccccagcgccgtggccagaagcaacagctggatgggcagccagggccccatgagccagagaagagagaactacggcgtgccccccagaagagccaccatcagcagctggagaaacgacagaatgagcaccagacacgacggctacgccaccaacgacggcaaccaccccagctgccaggagaccagagactacgccccccccagcagaggctacgcctacagagacaacggccacagcaacagagacgagcacagcagcagaggctacagaaaccacagaagcagcagagagaccagagactacgccccccccagcagaggccacgcctacagagactacggccacagcagaagagacgagagctacagcagaggctacagaaacagaagaagcagcagagagaccagagagtacgccccccccagcagaggccacggctacagagactacggccacagcagaagacacgagagctacagcagaggctacagaaaccaccccagcagcagagagaccagagactacgcccccccccacagagactacgcctacagagactacggccacagcagctgggacgagcacagcagcagaggctacagctaccacgacggctacggcgaggccctgggcagagaccacagcgagcacctgagcggcagcagctacagagacgccctgcagagatacggcaccagccacggcgccccccccgccagaggccccagaatgagctacggcggcagcacctgccacgcctacagcaacaccagagacagatacggcagaagctgggagagctacagcagctgcggcgacttccactactgcgacagagagcacgtgtgcagaaaggaccagagaaacccccccagcctgggcagagtgctgcccgaccccagagaggcctgcggcagcagcagctacgtggccagcatcgtggacggcggcgagagcagaagcgagaagggcgacagcagcagatactag

SEQ ID NO: 97822 - DNA, 1491 bp, Artificial Sequence; identical to SEQ ID NO: 97821
  Description of Artificial Sequence: Synthetic coding sequence

SEQ ID NO: 97823 - DNA, 870 bp, Artificial Sequence
  Description of Artificial Sequence: Synthetic coding sequence
atgagcaccagacacgacggctacgccaccaacgacggcaaccaccccagctgccaggagaccagagactacgccccccccagcagaggctacgcctacagagacaacggccacagcaacagagacgagcacagcagcagaggctacagaaaccacagaagcagcagagagaccagagactacgccccccccagcagaggccacgcctacagagactacggccacagcagaagagacgagagctacagcagaggctacagaaacagaagaagcagcagagagaccagagagtacgccccccccagcagaggccacggctacagagactacggccacagcagaagacacgagagctacagcagaggctacagaaaccaccccagcagcagagagaccagagactacgcccccccccacagagactacgcctacagagactacggccacagcagctgggacgagcacagcagcagaggctacagctaccacgacggctacggcgaggccctgggcagagaccacagcgagcacctgagcggcagcagctacagagacgccctgcagagatacggcaccagccacggcgccccccccgccagaggccccagaatgagctacggcggcagcacctgccacgcctacagcaacaccagagacagatacggcagaagctgggagagctacagcagctgcggcgacttccactactgcgacagagagcacgtgtgcagaaaggaccagagaaacccccccagcctgggcagagtgctgcccgaccccagagaggcctgcggcagcagcagctacgtggccagcatcgtggacggcggcgagagcagaagcgagaagggcgacagcagcagatactag

SEQ ID NO: 97824 - DNA, 1266 bp, Artificial Sequence
  Description of Artificial Sequence: Synthetic coding sequence
atgggcaagagactggaccagccccagatgtacccccagtacacctactactacccccactacctgcagaccaagcagagctacgcccccgccccccaccccatggccccccccagccccagcaccaacagcagcagcaacaacagcagcaacaacagcagcggcgagcagctgagcaagaccaacctgtacatcagaggcctgccccccggcaccaccgaccaggacctgatcaagctgtgccagccctacggcaagatcgtgagcaccaaggccatcctggacaagaacaccaaccagtgcaagggctacggcttcgtggacttcgacagccccgccgccgcccagaaggccgtggccagcctgaaggccaacggcgtgcaggcccagatggccaagcagcaggagcaggaccccaccaacctgtacatcagcaacctgcccatcagcatggacgagcaggagctggagaacatgctgaagcccttcggccacgtgatcagcaccagaatcctgagagacgccaacggcgtgagcagaggcgtgggcttcgccagaatggagagcaccgagaagtgcgaggtggtgatccagcacttcaacggcaagtacctgaagaccccccccggcatccccgcccccagcgagcccctgctgtgcaagttcgccgacggcggccagaagaagagacagaaccagagcaagtacacccagaacggcagaccctggcccagagagggcgaggccggcatggccctgacctacgaccccaccgccgccatccagaacggcttctacagcagcccctacagcatcgccaccaacagaatgatcccccagaccagcatcacccccttcatcgccgccagccccgtgagcacctaccaggtgcagagcaccagctggatgccccaccccccctacgtgatgcagcccaccggcgccgtgatcacccccaccatggaccaccccatgagcatgcagcccgccaacatgatgggccccctgacccagcagatgaaccacctgagcctgggcaccaccggcacctacatgaccgccgccgcccccatgcagggcacctacatcccccagtacacccccgtgccccccaccgccgtgagcatcgagggcgtggtggccgacaccagcccccagaccgtggcccccagcagccaggacaccagcggccagcagcagcagatcgccgtggacaccagcaacgagcacgcccccgcctacagctaccagcagagcaagccctag

SEQ ID NO: 97825 - DNA, 1263 bp, Artificial Sequence
  Description of Artificial Sequence: Synthetic coding sequence
atgggcaagagactggaccagccccagatgtacccccagtacacctactactacccccactacctgcagaccaagcagagctacgcccccgccccccaccccatggccccccccagccccagcaccaacagcagcagcaacaacagcagcaacaacagcagcggcgagcagctgagcaagaccaacctgtacatcagaggcctgccccccggcaccaccgaccaggacctgatcaagctgtgccagccctacggcaagatcgtgagcaccaaggccatcctggacaagaacaccaaccagtgcaagggctacggcttcgtggacttcgacagccccgccgccgcccagaaggccgtggccagcctgaaggccaacggcgtgcaggcccagatggccaagcagcaggagcaggaccccaccaacctgtacatcagcaacctgcccatcagcatggacgagcaggagctggagaacatgctgaagcccttcggccacgtgatcagcaccagaatcctgagagacgccaacggcgtgagcagaggcgtgggcttcgccagaatggagagcaccgagaagtgcgaggtggtgatccagcacttcaacggcaagtacctgaagaccccccccggcatccccgcccccagcgagcccctgctgtgcaagttcgccgacggcggccagaagaagagacagaaccagagcaagtacacccagaacggcagaccctggcccagagagggcgaggccggcatggccctgacctacgaccccaccgccgccatccagaacggcttctacagcagcccctacagcatcgccaccaacagaatgatcccccagaccagcatcacccccttcatcgccgccagccccgtgagcacctaccaggtgcagagcaccagctggatgccccaccccccctacgtgatgcagcccaccggcgccgtgatcacccccaccatggaccaccccatgagcatgcagcccgccaacatgatgggccccctgacccagcagatgaaccacctgagcctgggcaccaccggcacctacatgaccgccgccgcccccatgcagggcacctacatcccccagtacacccccgtgccccccaccgccgtgagcatcgagggcgtggtggccgacaccagcccccagaccgtggcccccagcagccaggacaccagcggccagcagcagcagatcgccgtggacaccagcaacgagcacgcccccgcctacagctaccagcagagcaagtag

SEQ ID NO: 97826 - DNA, 1260 bp, Artificial Sequence
  Description of Artificial Sequence: Synthetic coding sequence
atgggcaagagactggaccagccccagatgtacccccagtacacctactactacccccactacctgcagaccaagagctacgcccccgccccccaccccatggccccccccagccccagcaccaacagcagcagcaacaacagcagcaacaacagcagcggcgagcagctgagcaagaccaacctgtacatcagaggcctgccccccggcaccaccgaccaggacctgatcaagctgtgccagccctacggcaagatcgtgagcaccaaggccatcctggacaagaacaccaaccagtgcaagggctacggcttcgtggacttcgacagccccgccgccgcccagaaggccgtggccagcctgaaggccaacggcgtgcaggcccagatggccaagcagcaggagcaggaccccaccaacctgtacatcagcaacctgcccatcagcatggacgagcaggagctggagaacatgctgaagcccttcggccacgtgatcagcaccagaatcctgagagacgccaacggcgtgagcagaggcgtgggcttcgccagaatggagagcaccgagaagtgcgaggtggtgatccagcacttcaacggcaagtacctgaagaccccccccggcatccccgcccccagcgagcccctgctgtgcaagttcgccgacggcggccagaagaagagacagaaccagagcaagtacacccagaacggcagaccctggcccagagagggcgaggccggcatggccctgacctacgaccccaccgccgccatccagaacggcttctacagcagcccctacagcatcgccaccaacagaatgatcccccagaccagcatcacccccttcatcgccgccagccccgtgagcacctaccagggcgccgtgatcacccccaccatggaccaccccatgagcatgcagcccgccaacatgatgggccccctgacccagcagatgaaccacctgagcctgggcaccaccggcaccatccagagccaggacagaatcatgatcctgcaccagctgctgtgccagtacatgaccgccgccgcccccatgcagggcacctacatcccccagtacacccccgtgccccccaccgccgtgagcatcgagggcgtggtggccgacaccagcccccagaccgtggcccccagcagccaggacaccagcggccagcagcagcagatcgccgtggacaccagcaacgagcacgcccccgcctacagctaccagcagagcaagccctag

SEQ ID NO: 97827 - DNA, 1314 bp, Artificial Sequence
  Description of Artificial Sequence: Synthetic coding sequence
atgggcaagagactggaccagccccagatgtacccccagtacacctactactacccccactacctgcagaccaagcagagctacgcccccgccccccaccccatggccccccccagccccagcaccaacagcagcagcaacaacagcagcaacaacagcagcggcgagcagctgagcaagaccaacctgtacatcagaggcctgccccccggcaccaccgaccaggacctgatcaagctgtgccagccctacggcaagatcgtgagcaccaaggccatcctggacaagaacaccaaccagtgcaagggctacggcttcgtggacttcgacagccccgccgccgcccagaaggccgtggccagcctgaaggccaacggcgtgcaggcccagatggccaagcagcaggagcaggaccccaccaacctgtacatcagcaacctgcccatcagcatggacgagcaggagctggagaacatgctgaagcccttcggccacgtgatcagcaccagaatcctgagagacgccaacggcgtgagcagaggcgtgggcttcgccagaatggagagcaccgagaagtgcgaggtggtgatccagcacttcaacggcaagtacctgaagaccccccccggcatccccgcccccagcgagcccctgctgtgcaagttcgccgacggcggccagaagaagagacagaaccagagcaagtacacccagaacggcagaccctggcccagagagggcgaggccggcatggccctgacctacgaccccaccgccgccatccagaacggcttctacagcagcccctacagcatcgccaccaacagaatgatcccccagaccagcatcacccccttcatcgccgccagccccgtgagcacctaccaggtgcagagcaccagctggatgccccaccccccctacgtgatgcagcccaccggcgccgtgatcacccccaccatggaccaccccatgagcatgcagcccgccaacatgatgggccccctgacccagcagatgaaccacctgagcctgggcaccaccggcaccatccagagccaggacagaatcatgatcctgcaccagctgctgtgccagtacatgaccgccgccgcccccatgcagggcacctacatcccccagtacacccccgtgccccccaccgccgtgagcatcgagggcgtggtggccgacaccagcccccagaccgtggcccccagcagccaggacaccagcggccagcagcagcagatcgccgtggacaccagcaacgagcacgcccccgcctacagctaccagcagagcaagccctag

SEQ ID NO: 97828 - DNA, 1305 bp, Artificial Sequence
  Description of Artificial Sequence: Synthetic coding sequence
atgggcaagagactggaccagccccagatgtacccccagtacacctactactacccccactacctgcagaccaagcagagctacgcccccgccccccaccccatggccccccccagccccagcaccaacagcagcagcaacaacagcagcaacaacagcagcggcgagcagctgagcaagaccaacctgtacatcagaggcctgccccccggcaccaccgaccaggacctgatcaagctgtgccagccctacggcaagatcgtgagcaccaaggccatcctggacaagaacaccaaccagtgcaagggctacggcttcgtggacttcgacagccccgccgccgcccagaaggccgtggccagcctgaaggccaacggcgtgcaggcccagatggccaagcagcaggagcaggaccccaccaacctgtacatcagcaacctgcccatcagcatggacgagcaggagctggagaacatgctgaagcccttcggccacgtgatcagcaccagaatcctgagagacgccaacggcgtgagcagaggcgtgggcttcgccagaatggagagcaccgagaagtgcgaggtggtgatccagcacttcaacggcaagtacctgaagaccccccccggcatccccgcccccagcgagcccctgctgtgcaagttcgccgacggcggccagaagaagagacagaaccagagcaagtacacccagaacggcagaccctggcccagagagggcgaggtgctgagaggcagaaccgtgcccagacagaacagagaggccggcatggccctgacctacgaccccaccgccgccatccagaacggcttctacagcagcccctacagcatcgccaccaacagaatgatcccccagaccagcatcacccccttcatcgccgccagccccgtgagcacctaccaggtgcagagcaccagctggatgccccaccccccctacgtgatgcagcccaccggcgccgtgatcacccccaccatggaccaccccatgagcatgcagcccgccaacatgatgggccccctgacccagcagatgaaccacctgagcctgggcaccaccggcacctacatgaccgccgccgcccccatgcagggcacctacatcccccagtacacccccgtgccccccaccgccgtgagcatcgagggcgtggtggccgacaccagcccccagaccgtggcccccagcagccaggacaccagcggccagcagcagcagatcgccgtggacaccagcaacgagcacgcccccgcctacagctaccagcagagcaagccctag

SEQ ID NO: 97829 - DNA, 1311 bp, Artificial Sequence
  Description of Artificial Sequence: Synthetic coding sequence
atgggcaagagactggaccagccccagatgtacccccagtacacctactactacccccactacctgcagaccaagagctacgcccccgccccccaccccatggccccccccagccccagcaccaacagcagcagcaacaacagcagcaacaacagcagcggcgagcagctgagcaagaccaacctgtacatcagaggcctgccccccggcaccaccgaccaggacctgatcaagctgtgccagccctacggcaagatcgtgagcaccaaggccatcctggacaagaacaccaaccagtgcaagggctacggcttcgtggacttcgacagccccgccgccgcccagaaggccgtggccagcctgaaggccaacggcgtgcaggcccagatggccaagcagcaggagcaggaccccaccaacctgtacatcagcaacctgcccatcagcatggacgagcaggagctggagaacatgctgaagcccttcggccacgtgatcagcaccagaatcctgagagacgccaacggcgtgagcagaggcgtgggcttcgccagaatggagagcaccgagaagtgcgaggtggtgatccagcacttcaacggcaagtacctgaagaccccccccggcatccccgcccccagcgagcccctgctgtgcaagttcgccgacggcggccagaagaagagacagaaccagagcaagtacacccagaacggcagaccctggcccagagagggcgaggccggcatggccctgacctacgaccccaccgccgccatccagaacggcttctacagcagcccctacagcatcgccaccaacagaatgatcccccagaccagcatcacccccttcatcgccgccagccccgtgagcacctaccaggtgcagagcaccagctggatgccccaccccccctacgtgatgcagcccaccggcgccgtgatcacccccaccatggaccaccccatgagcatgcagcccgccaacatgatgggccccctgacccagcagatgaaccacctgagcctgggcaccaccggcaccatccagagccaggacagaatcatgatcctgcaccagctgctgtgccagtacatgaccgccgccgcccccatgcagggcacctacatcccccagtacacccccgtgccccccaccgccgtgagcatcgagggcgtggtggccgacaccagcccccagaccgtggcccccagcagccaggacaccagcggccagcagcagcagatcgccgtggacaccagcaacgagcacgcccccgcctacagctaccagcagagcaagccctag

SEQ ID NO: 97830 - DNA, 1302 bp, Artificial Sequence
  Description of Artificial Sequence: Synthetic coding sequence
atgggcaagagactggaccagccccagatgtacccccagtacacctactactacccccactacctgcagaccaagcagagctacgcccccgccccccaccccatggccccccccagccccagcaccaacagcagcagcaacaacagcagcaacaacagcagcggcgagcagctgagcaagaccaacctgtacatcagaggcctgccccccggcaccaccgaccaggacctgatcaagctgtgccagccctacggcaagatcgtgagcaccaaggccatcctggacaagaacaccaaccagtgcaagggctacggcttcgtggacttcgacagccccgccgccgcccagaaggccgtggccagcctgaaggccaacggcgtgcaggcccagatggccaagcagcaggagcaggaccccaccaacctgtacatcagcaacctgcccatcagcatggacgagcaggagctggagaacatgctgaagcccttcggccacgtgatcagcaccagaatcctgagagacgccaacggcgtgagcagaggcgtgggcttcgccagaatggagagcaccgagaagtgcgaggtggtgatccagcacttcaacggcaagtacctgaagaccccccccggcatccccgcccccagcgagcccctgctgtgcaagttcgccgacggcggccagaagaagagacagaaccagagcaagtacacccagaacggcagaccctggcccagagagggcgaggtgctgagaggcagaaccgtgcccagacagaacagagaggccggcatggccctgacctacgaccccaccgccgccatccagaacggcttctacagcagcccctacagcatcgccaccaacagaatgatcccccagaccagcatcacccccttcatcgccgccagccccgtgagcacctaccaggtgcagagcaccagctggatgccccaccccccctacgtgatgcagcccaccggcgccgtgatcacccccaccatggaccaccccatgagcatgcagcccgccaacatgatgggccccctgacccagcagatgaaccacctgagcctgggcaccaccggcacctacatgaccgccgccgcccccatgcagggcacctacatcccccagtacacccccgtgccccccaccgccgtgagcatcgagggcgtggtggccgacaccagcccccagaccgtggcccccagcagccaggacaccagcggccagcagcagcagatcgccgtggacaccagcaacgagcacgcccccgcctacagctaccagcagagcaagtag

SEQ ID NO: 97831 - DNA, 615 bp, Artificial Sequence
  Description of Artificial Sequence: Synthetic coding sequence
atgaacaacggcggcaaggccgagaaggagaacacccccagcgaggccaacctgcaggaggaggaggtgagaaccctgttcgtgagcggcctgcccctggacatcaagcccagagagctgtacctgctgttcagacccttcaagggctacgagggcagcctgatcaagctgaccagcaagcagcccgtgggcttcgtgagcttcgacagcagaagcgaggccgaggccgccaagaacgccctgaacggcatcagattcgaccccgagatcccccagaccctgagactggagttcgccaaggccaacaccaagatggccaagaacaagctggtgggcacccccaaccccagcacccccctgcccaacaccgtgccccagttcatcgccagagagccctacgagctgaccgtgcccgccctgtaccccagcagccccgaggtgtgggccccctaccccctgtaccccgccgagctggcccccgccctgcccccccccgccttcacctaccccgccagcctgcacgcccagctgtgcgagggccagaccgtgagaagaagccaccccctgagcgcccccagccccgacagcgccagcctggcctggttccccgtgtag

SEQ ID NO: 97832 - DNA, 591 bp, Artificial Sequence
  Description of Artificial Sequence: Synthetic coding sequence
atgaacaacggcggcaaggccgagaaggagaacacccccagcgaggccaacctgcaggaggaggaggtgagaaccctgttcgtgagcggcctgcccctggacatcaagcccagagagctgtacctgctgttcagacccttcaagggctacgagggcagcctgatcaagctgaccagcaagcagcccgtgggcttcgtgagcttcgacagcagaagcgaggccgaggccgccaagaacgccctgaacggcatcagattcgaccccgagatcccccagaccctgagactggagttcgccaaggccaacaccaagatggccaagaacaagctggtgggcacccccaaccccagcacccccctgcccaacaccgtgccccagttcatcgccagagagccctacgagctgaccgtgcccgccctgtaccccagcagccccgaggtgtgggccccctaccccctgtaccccgccgagctggcccccgccctgcccccccccgccttcacctaccccgccagcctgcacgcccagatgagatggctgccccccagcgaggccaccagccagggctggaagagcagacagttctgctag

SEQ ID NO: 97833 - DNA, 660 bp, Artificial Sequence
  Description of Artificial Sequence: Synthetic coding sequence
atgaacaacggcggcaaggccgagaaggagaacacccccagcgaggccaacctgcaggaggaggaggtgagaaccctgttcgtgagcggcctgcccctggacatcaagcccagagagctgtacctgctgttcagacccttcaagggctacgagggcagcctgatcaagctgaccagcaagcagcccgtgggcttcgtgagcttcgacagcagaagcgaggccgaggccgccaagaacgccctgaacggcatcagattcgaccccgagatcccccagaccctgagactggagttcgccaaggccaacaccaagatggccaagaacaagctggtgggcacccccaaccccagcacccccctgcccaacaccgtgccccagttcatcgccagagagccctacgagctgaccgtgcccgccctgtaccccagcagccccgaggtgtgggccccctaccccctgtaccccgccgagctggcccccgccctgcccccccccgccttcacctaccccgccagcctgcacgcccagtgcttcagccccgaggccaagcccaacacccccgtgttctgccccctgctgcagcagatcagattcgtgagcggcaacgtgttcgtgacctaccagcccaccgccgaccagcagagagagctgccctgctag

SEQ ID NO: 97834 - DNA, 591 bp, Artificial Sequence; identical to SEQ ID NO: 97832
  Description of Artificial Sequence: Synthetic coding sequence

SEQ ID NO: 97835 - DNA, 462 bp, Artificial Sequence
  Description of Artificial Sequence: Synthetic coding sequence
atgaacaacggcggcaaggccgagaaggagaacacccccagcgaggccaacctgcaggaggaggaggtgagaaccctgttcgtgagcggcctgcccctggacatcaagcccagagagctgtacctgctgttcagacccttcaagggctacgagggcagcctgatcaagctgaccagcaagcagcccgtgggcttcgtgagcttcgacagcagaagcgaggccgaggccgccaagaacgccctgaacggcatcagattcgaccccgagatcccccagaccctgagactggagttcgccaaggccaacaccaagatggccaagaacaagctggtgggcacccccaaccccagcacccccctgcccaacaccgtgccccagttcatcgccagagagcccctgatgagatggctgccccccagcgaggccaccagccagggctggaagagcagacagttctgctag

SEQ ID NO: 97836 - DNA, 1257 bp, Artificial Sequence
  Description of Artificial Sequence: Synthetic coding sequence
atgctggccagccagggcgtgctgctgcacccctacggcgtgcccatgatcgtgcccgccgccccctacctgcccggcctgatccagggcaaccaggaggccgccgccgcccccgacaccatggcccagccctacgccagcgcccagttcgcccccccccagaacggcatccccgccgagtacaccgccccccacccccaccccgcccccgagtacaccggccagaccaccgtgcccgagcacaccctgaacctgtacccccccgcccagacccacagcgagcagagccccgccgacaccagcgcccagaccgtgagcggcaccgccacccagaccgacgacgccgcccccaccgacggccagccccagacccagcccagcgagaacaccgagaacaagagccagcccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagaccgtgaacccctacaccaacggctggaagctgaaccccgtggtgggcgccgtgtacagccccgagttctacgccggcaccgtgctgctgtgccaggccaaccaggagggcagcagcatgtacagcgcccccagcagcctggtgtacaccagcgccatgcccggcttcccctaccccgccgccaccgccgccgccgcctacagaggcgcccacctgagaggcagaggcagaaccgtgtacaacaccttcagagccgccgccccccccccccccatccccgcctacggcggcgtggtgtaccaggagcccgtgtacggcaacaagctgctgcagggcggctacgccgcctacagatacgcccagcccacccccgccaccgccgccgcctacagcgacagctacggcagagtgtacgccgccgacccctaccaccacgccctggcccccgcccccacctacggcgtgggcgccatgaacgccttcgcccccctgaccgacgccaagaccagaagccacgccgacgacgtgggcctggtgctgagcagcctgcaggccagcatctacagaggcggctacaacagattcgccccctactag

SEQ ID NO: 97837 - DNA, 1209 bp, Artificial Sequence
  Description of Artificial Sequence: Synthetic coding sequence
atgatcgtgcccgccgccccctacctgcccggcctgatccagggcaaccaggaggccgccgccgcccccgacaccatggcccagccctacgccagcgcccagttcgcccccccccagaacggcatccccgccgagtacaccgccccccacccccaccccgcccccgagtacaccggccagaccaccgtgcccgagcacaccctgaacctgtacccccccgcccagacccacagcgagcagagccccgccgacaccagcgcccagaccgtgagcggcaccgccacccagaccgacgacgccgcccccaccgacggccagccccagacccagcccagcgagaacaccgagaacaagagccagcccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagaccgtgaacccctacaccaacggctggaagctgaaccccgtggtgggcgccgtgtacagccccgagttctacgccggcaccgtgctgctgtgccaggccaaccaggagggcagcagcatgtacagcgcccccagcagcctggtgtacaccagcgccatgcccggcttcccctaccccgccgccaccgccgccgccgcctacagaggcgcccacctgagaggcagaggcagaaccgtgtacaacaccttcagagccgccgccccccccccccccatccccgcctacggcggcgtggtgtaccaggacggcttctacggcgccgacatctacggcggctacgccgcctacagatacgcccagcccacccccgccaccgccgccgcctacagcgacagctacggcagagtgtacgccgccgacccctaccaccacgccctggcccccgcccccacctacggcgtgggcgccatgaacgccttcgcccccctgaccgacgccaagaccagaagccacgccgacgacgtgggcctggtgctgagcagcctgcaggccagcatctacagaggcggctacaacagattcgccccctactag

SEQ ID NO: 97838 - DNA, 1176 bp, Artificial Sequence
  Description of Artificial Sequence: Synthetic coding sequence
atgctggccagccagggcgtgctgctgcacccctacggcgtgcccatgatcgtgcccgccgccccctacctgcccggcctgatccagggcaaccaggaggccgccgccgcccccgacaccatggcccagccctacgccagcgcccagttcgcccccccccagaacggcatccccgccgagtacaccgccccccacccccaccccgcccccgagtacaccggccagaccaccgtgcccgagcacaccctgaacctgtacccccccgcccagacccacagcgagcagagccccgccgacaccagcgcccagaccgtgagcggcaccgccacccagaccgacgacgccgcccccaccgacggccagccccagacccagcccagcgagaacaccgagaacaagagccagcccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagaccgtgaacccctacaccaacggctggaagctgaaccccgtggtgggcgccgtgtacagccccgagttctacgccgtgcccggcttcccctaccccgccgccaccgccgccgccgcctacagaggcgcccacctgagaggcagaggcagaaccgtgtacaacaccttcagagccgccgccccccccccccccatccccgcctacggcggcgtggtgtaccaggagcccgtgtacggcaacaagctgctgcagggcggctacgccgcctacagatacgcccagcccacccccgccaccgccgccgcctacagcgacagctacggcagagtgtacgccgccgacccctaccaccacgccctggcccccgcccccacctacggcgtgggcgccatgaacgccttcgcccccctgaccgacgccaagaccagaagccacgccgacgacgtgggcctggtgctgagcagcctgcaggccagcatctacagaggcggctacaacagattcgccccctactag

SEQ ID NO: 97839 - DNA, 1188 bp, Artificial Sequence
  Description of Artificial Sequence: Synthetic coding sequence
atgctggccagccagggcgtgctgctgcacccctacggcgtgcccatgatcgtgcccgccgccccctacctgcccggcctgatccagggcaaccaggaggccgccgccgcccccgacaccatggcccagccctacgccagcgcccagttcgcccccccccagaacggcatccccgccgagtacaccgccccccacccccaccccgcccccgagtacaccggccagaccaccgtgcccgagcacaccctgaacctgtacccccccgcccagacccacagcgagcagagccccgccgacaccagcgcccagaccgtgagcggcaccgccacccagaccgacgacgccgcccccaccgacggccagccccagacccagcccagcgagaacaccgagaacaagagccagcccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagaccgtgaacccctacaccaacggctggaagctgaaccccgtggtgggcgccgtgtacagccccgagttctacgccggcaccgtgctgctgtgccaggccaaccaggagggcagcagcatgtacagcgcccccagcagcctggtgtacaccagcgccatgcccggcttcccctaccccgccgccaccgccgccgccgcctacagaggcgcccacctgagaggcagaggcagaaccgtgtacaacaccttcagagccgccgccccccccccccccatccccgcctacggcggcgtggtgtaccaggagcccgtgtacggcaacaagctgctgcagggcggctacgccgcctacagatacgcccagcccacccccgccaccgccgccgcctacagcgacagaaaccagttcgtgttcgtggccgccgacgagatcagctgcaacaccagcgccgtgaccgacgagttcatgctgcccacccccaccaccacccacctgctgcagcccccccccaccgccctggtgccctag

SEQ ID NO: 97840 - DNA, 1179 bp, Artificial Sequence
  Description of Artificial Sequence: Synthetic coding sequence
atgctggccagccagggcgtgctgctgcacccctacggcgtgcccatgatcgtgcccgccgccccctacctgcccggcctgatccagggcaaccaggaggccgccgccgcccccgacaccatggcccagccctacgccagcgcccagttcgcccccccccagaacggcatccccgccgagtacaccgccccccacccccaccccgcccccgagtacaccggccagaccaccgtgcccgagcacaccctgaacctgtacccccccgcccagacccacagcgagcagagccccgccgacaccagcgcccagaccgtgagcggcaccgccacccagaccgacgacgccgcccccaccgacggccagccccagacccagcccagcgagaacaccgagaacaagagccagcccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagaccgtgaacccctacaccaacggctggaagctgaaccccgtggtgggcgccgtgtacagccccgagttctacgccggcaccgtgctgctgtgccaggccaaccaggagggcagcagcatgtacagcgcccccagcagcctggtgtacaccagcgccatgcccggcttcccctaccccgccgccaccgccgccgccgcctacagaggcgcccacctgagaggcagaggcagaaccgtgtacaacaccttcagagccgccgccccccccccccccatccccgcctacggcggcgtggtgtaccaggagcccgtgtacggcaacaagctgctgcagggcggctacgccgcctacagatacgcccagcccacccccgccaccgccgccgcctacagcgacagctacggcagagtgtacgccgccgacccctaccaccacgccctggcccccgcccccacctacggcgtgggcgccatggccagcatctacagaggcggctacaacagattcgccccctactag

SEQ ID NO: 97841 - DNA, 1194 bp, Artificial Sequence
  Description of Artificial Sequence: Synthetic coding sequence
atgaactgcgagagagagcagctgagaggcaaccaggaggccgccgccgcccccgacaccatggcccagccctacgccagcgcccagttcgcccccccccagaacggcatccccgccgagtacaccgccccccacccccaccccgcccccgagtacaccggccagaccaccgtgcccgagcacaccctgaacctgtacccccccgcccagacccacagcgagcagagccccgccgacaccagcgcccagaccgtgagcggcaccgccacccagaccgacgacgccgcccccaccgacggccagccccagacccagcccagcgagaacaccgagaacaagagccagcccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagaccgtgaacccctacaccaacggctggaagctgaaccccgtggtgggcgccgtgtacagccccgagttctacgccggcaccgtgctgctgtgccaggccaaccaggagggcagcagcatgtacagcgcccccagcagcctggtgtacaccagcgccatgcccggcttcccctaccccgccgccaccgccgccgccgcctacagaggcgcccacctgagaggcagaggcagaaccgtgtacaacaccttcagagccgccgccccccccccccccatccccgcctacggcggcgtggtgtaccaggacggcttctacggcgccgacatctacggcggctacgccgcctacagatacgcccagcccacccccgccaccgccgccgcctacagcgacagctacggcagagtgtacgccgccgacccctaccaccacgccctggcccccgcccccacctacggcgtgggcgccatgaacgccttcgcccccctgaccgacgccaagaccagaagccacgccgacgacgtgggcctggtgctgagcagcctgcaggccagcatctacagaggcggctacaacagattcgccccctactag

SEQ ID NO: 97842 - DNA, 1401 bp, Artificial Sequence
  Description of Artificial Sequence: Synthetic coding sequence
atggagaccggccagagaacccacgccagcggcacctacagcttcctggacagaacccagcacagcgacatcaaggccgactgcaacacctgcgtggagatcgaggacagaaaggtgagcagacagcagatgaactgcgagagagagcagctgagaggcaaccaggaggccgccgccgcccccgacaccatggcccagccctacgccagcgcccagttcgcccccccccagaacggcatccccgccgagtacaccgccccccacccccaccccgcccccgagtacaccggccagaccaccgtgcccgagcacaccctgaacctgtacccccccgcccagacccacagcgagcagagccccgccgacaccagcgcccagaccgtgagcggcaccgccacccagaccgacgacgccgcccccaccgacggccagccccagacccagcccagcgagaacaccgagaacaagagccagcccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagaccgtgaacccctacaccaacggctggaagctgaaccccgtggtgggcgccgtgtacagccccgagttctacgccggcaccgtgctgctgtgccaggccaaccaggagggcagcagcatgtacagcgcccccagcagcctggtgtacaccagcgccatgcccggcttcccctaccccgccgccaccgccgccgccgcctacagaggcgcccacctgagaggcagaggcagaaccgtgtacaacaccttcagagccgccgccccccccccccccatccccgcctacggcggcgtggtgtaccaggacggcttctacggcgccgacatctacggcggctacgccgcctacagatacgcccagcccacccccgccaccgccgccgcctacagcgacagaaaccagttcgtgttcgtggccgccgacgagatcagctgcaacaccagcgccgtgaccgacgagttcatgctgcccacccccaccaccacccacctgctgcagcccccccccaccgccctggtgccctgccccaaggtgcccgcccccgcccagaccagcgaggagctgagctgcaccctgcccggcctgtgctgccaggccgccgagaacctgaccgccagcccccccctgctgcagttcatgttcaaggtgatcgtggcccaggagagaaagtag

SEQ ID NO: 97843 - DNA, 1194 bp, Artificial Sequence; identical to SEQ ID NO: 97841
  Description of Artificial Sequence: Synthetic coding sequence

SEQ ID NO: 97844 - DNA, 792 bp, Artificial Sequence
  Description of Artificial Sequence: Synthetic coding sequence
atgaactgcgagagagagcagctgagaggcaaccaggaggccgccgccgcccccgacaccatggcccagccctacgccagcgcccagttcgcccccccccagaacggcatccccgccgagtacaccgccccccacccccaccccgcccccgagtacaccggccagaccaccgtgcccgagcacaccctgaacctgtacccccccgcccagacccacagcgagcagagccccgccgacaccagcgcccagaccgtgagcggcaccgccacccagaccgacgacgccgcccccaccgacggccagccccagacccagcccagcgagaacaccgagaacaagagccagcccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagaccgtgaacccctacaccaacggctggaagctgaaccccgtggtgggcgccgtgtacagccccgagttctacgccggcaccgtgctgctgtgccaggccaaccaggagggcagcagcatgtacagcgcccccagcagcctggtgtacaccagcgccatgcccggcttcccctaccccgccgccaccgcctag

SEQ ID NO: 97845 - DNA, 1113 bp, Artificial Sequence
  Description of Artificial Sequence: Synthetic coding sequence
atgaactgcgagagagagcagctgagaggcaaccaggaggccgccgccgcccccgacaccatggcccagccctacgccagcgcccagttcgcccccccccagaacggcatccccgccgagtacaccgccccccacccccaccccgcccccgagtacaccggccagaccaccgtgcccgagcacaccctgaacctgtacccccccgcccagacccacagcgagcagagccccgccgacaccagcgcccagaccgtgagcggcaccgccacccagaccgacgacgccgcccccaccgacggccagccccagacccagcccagcgagaacaccgagaacaagagccagcccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagaccgtgaacccctacaccaacggctggaagctgaaccccgtggtgggcgccgtgtacagccccgagttctacgccgtgcccggcttcccctaccccgccgccaccgccgccgccgcctacagaggcgcccacctgagaggcagaggcagaaccgtgtacaacaccttcagagccgccgccccccccccccccatccccgcctacggcggcgtggtgtaccaggacggcttctacggcgccgacatctacggcggctacgccgcctacagatacgcccagcccacccccgccaccgccgccgcctacagcgacagctacggcagagtgtacgccgccgacccctaccaccacgccctggcccccgcccccacctacggcgtgggcgccatgaacgccttcgcccccctgaccgacgccaagaccagaagccacgccgacgacgtgggcctggtgctgagcagcctgcaggccagcatctacagaggcggctacaacagattcgccccctactag

SEQ ID NO: 97846 - DNA, 1725 bp, Artificial Sequence
  Description of Artificial Sequence: Synthetic coding sequence
atggcccacaacaagatcccccccagatggctgaactgccccagaagaggccagcccgtggccggcagattcctgcccctgaagaccatgctgggccccagatacgacagccaggtggccgaggagaacagattccaccccagcatgctgagcaactacctgaagagcctgaaggtgaagatgggcctgctggtggacctgaccaacaccagcagattctacgacagaaacgacatcgagaaggagggcatcaagtacatcaagctgcagtgcaagggccacggcgagtgccccaccaccgagaacaccgagaccttcatcagactgtgcgagagattcaacgagagaaacccccccgagctgatcggcgtgcactgcacccacggcttcaacagaaccggcttcctgatctgcgccttcctggtggagaagatggactggagcatcgaggccgccgtggccaccttcgcccaggccagaccccccggcatctacaagggcgactacctgaaggagctgttcagaagatacggcgacatcgaggaggccccccccccccccctgctgcccgactggtgcttcgaggacgacgaggacgaggacgaggacgaggacggcaagaaggagagcgagcccggcagcagcgccagcttcggcaagagaagaaaggagagactgaagctgggcgccatcttcctggagggcgtgaccgtgaagggcgtgacccaggtgaccacccagcccaagctgggcgaggtgcagcagaagtgccaccagttctgcggctgggagggcagcggcttccccggcgcccagcccgtgagcatggacaagcagaacatcaagctgctggacctgaagccctacaaggtgagctggaaggccgacggcaccagatacatgatgctgatcgacggcaccaacgaggtgttcatgatcgacagagacaacagcgtgttccacgtgagcaacctggagttccccttcagaaaggacctgagaatgcacctgagcaacaccctgctggacggcgagatgatcatcgacagagtgaacggccaggccgtgcccagatacctgatctacgacatcatcaagttcaacagccagcccgtgggcgactgcgacttcaacgtgagactgcagtgcatcgagagagagatcatcagccccagacacgagaagatgaagaccggcctgatcgacaagacccaggagcccttcagcgtgagaaacaagcccttcttcgacatctgcaccagcagaaagaagtacaagcccggcagatgcgacgacatcctgaagtggaagccccccagcctgaacagcgtggacttcagactgaagatcaccagaatgggcggcgagggcctgctgccccagaacgtgggcctgctgtacgtgggcggctacgagagacccttcgcccagatcaaggtgaccaaggagctgaagcagtacgacaacaagatcatcgagtgcaagttcgagaacaacagctgggtgttcatgagacagagaaccgacaagagcttccccaacgcctacaacaccgccatggccgtgtgcaacagcatcagcaaccccgtgaccaaggagatgctgttcgagttcatcgacagatgcaccgccgccagccagggccagaagagaaagcaccacctggaccccgacaccgagctgatgcccccccccccccccaagagacccagacccctgacctag

SEQ ID NO: 97847 - DNA, 1626 bp, Artificial Sequence
  Description of Artificial Sequence: Synthetic coding sequence
atggcccacaacaagatcccccccagatggctgaactgccccagaagaggccagcccgtggccggcagattcctgcccctgaagaccatgctgggccccagatacgacagccaggtggccgaggagaacagattccaccccagcatgctgagcaactacctgaagagcctgaaggtgaagatgggcctgctggtggacctgaccaacaccagcagattctacgacagaaacgacatcgagaaggagggcatcaagtacatcaagctgcagtgcaagggccacggcgagtgccccaccaccgagaacaccgagaccttcatcagactgtgcgagagattcaacgagagaaacccccccgagctgatcggcgtgcactgcacccacggcttcaacagaaccggcttcctgatctgcgccttcctggtggagaagatggactggagcatcgaggccgccgtggccaccttcgcccaggccagaccccccggcatctacaagggcgactacctgaaggagctgttcagaagatacggcgacatcgaggaggccccccccccccccctgctgcccgactggtgcttcgaggacgacgaggacgaggacgaggacgaggacggcaagaaggagagcgagcccggcagcagcgccagcttcggcaagagaagaaaggagagactgaagctgggcgccatcttcctggagggcgtgaccgtgaagggcgtgacccaggtgaccacccagcccaagctgggcgaggtgcagcagaagtgccaccagttctgcggctgggagggcagcggcttccccggcgcccagcccgtgagcatggacaagcagaacatcaagctgctggacctgaagccctacaaggtgagctggaaggccgacggcaccagatacatgatgctgatcgacggcaccaacgaggtgttcatgatcgacagagacaacagcgtgttccacgtgagcaacctggagttccccttcagaaaggacctgagaatgcacctgagcaacaccctgctggacggcgagatgatcatcgacagagtgaacggccaggccgtgcccagatacctgatctacgacatcatcaagttcaacagccagcccgtgggcgactgcgacttcaacgtgagactgcagtgcatcgagagagagatcatcagccccagacacgagaagatgaagaccggcctgatcgacaagacccaggagcccttcagcgtgagaaacaagcccttcttcgacatctgcaccagcagaaagctgctggagggcaacttcgccaaggaggtgagccacgagatggacggcctgatcttccagcccaccggcaagtacaagcccggcagatgcgacgacatcctgaagtggaagccccccagcctgaacagcgtggacttcagactgaagatcaccagaatgggcggcgagggcctgctgccccagaacgtgggcctgctgtacgtgggcggctacgagagacccttcgcccagatcaaggtgtgcctgttcatcttcagcgtgctgttcctggacgtgctgctgagcagaatccaccagaacctggccaacaacaaccagcacatcaagatcagctgcagcagcaccctgggcggctag

SEQ ID NO: 97848 - DNA, 1794 bp, Artificial Sequence
  Description of Artificial Sequence: Synthetic coding sequence
atggcccacaacaagatcccccccagatggctgaactgccccagaagaggccagcccgtggccggcagattcctgcccctgaagaccatgctgggccccagatacgacagccaggtggccgaggagaacagattccaccccagcatgctgagcaactacctgaagagcctgaaggtgaagatgggcctgctggtggacctgaccaacaccagcagattctacgacagaaacgacatcgagaaggagggcatcaagtacatcaagctgcagtgcaagggccacggcgagtgccccaccaccgagaacaccgagaccttcatcagactgtgcgagagattcaacgagagaaacccccccgagctgatcggcgtgcactgcacccacggcttcaacagaaccggcttcctgatctgcgccttcctggtggagaagatggactggagcatcgaggccgccgtggccaccttcgcccaggccagaccccccggcatctacaagggcgactacctgaaggagctgttcagaagatacggcgacatcgaggaggccccccccccccccctgctgcccgactggtgcttcgaggacgacgaggacgaggacgaggacgaggacggcaagaaggagagcgagcccggcagcagcgccagcttcggcaagagaagaaaggagagactgaagctgggcgccatcttcctggagggcgtgaccgtgaagggcgtgacccaggtgaccacccagcccaagctgggcgaggtgcagcagaagtgccaccagttctgcggctgggagggcagcggcttccccggcgcccagcccgtgagcatggacaagcagaacatcaagctgctggacctgaagccctacaaggtgagctggaaggccgacggcaccagatacatgatgctgatcgacggcaccaacgaggtgttcatgatcgacagagacaacagcgtgttccacgtgagcaacctggagttccccttcagaaaggacctgagaatgcacctgagcaacaccctgctggacggcgagatgatcatcgacagagtgaacggccaggccgtgcccagatacctgatctacgacatcatcaagttcaacagccagcccgtgggcgactgcgacttcaacgtgagactgcagtgcatcgagagagagatcatcagccccagacacgagaagatgaagaccggcctgatcgacaagacccaggagcccttcagcgtgagaaacaagcccttcttcgacatctgcaccagcagaaagctgctggagggcaacttcgccaaggaggtgagccacgagatggacggcctgatcttccagcccaccggcaagtacaagcccggcagatgcgacgacatcctgaagtggaagccccccagcctgaacagcgtggacttcagactgaagatcaccagaatgggcggcgagggcctgctgccccagaacgtgggcctgctgtacgtgggcggctacgagagacccttcgcccagatcaaggtgaccaaggagctgaagcagtacgacaacaagatcatcgagtgcaagttcgagaacaacagctgggtgttcatgagacagagaaccgacaagagcttccccaacgcctacaacaccgccatggccgtgtgcaacagcatcagcaaccccgtgaccaaggagatgctgttcgagttcatcgacagatgcaccgccgccagccagggccagaagagaaagcaccacctggaccccgacaccgagctgatgcccccccccccccccaagagacccagacccctgacctag

SEQ ID NO: 97849 - DNA, 1707 bp, Artificial Sequence
  Description of Artificial Sequence: Synthetic coding sequence
atgctgggccccagatacgacagccaggtggccgaggagaacagattccaccccagcatgctgagcaactacctgaagagcctgaaggtgaagatgggcctgctggtggacctgaccaacaccagcagattctacgacagaaacgacatcgagaaggagggcatcaagtacatcaagctgcagtgcaagggccacggcgagtgccccaccaccgagaacaccgagaccttcatcagactgtgcgagagattcaacgagagaaacccccccgagctgatcggcgtgcactgcacccacggcttcaacagaaccggcttcctgatctgcgccttcctggtggagaagatggactggagcatcgaggccgccgtggccaccttcgcccaggccagaccccccggcatctacaagggcgactacctgaaggagctgttcagaagatacggcgacatcgaggaggccccccccccccccctgctgcccgactggtgcttcgaggacgacgaggacgaggacgaggacgaggacggcaagaaggagagcgagcccggcagcagcgccagcttcggcaagagaagaaaggagagactgaagctgggcgccatcttcctggagggcgtgaccgtgaagggcgtgacccaggtgaccacccagcccaagctgggcgaggtgcagcagaagtgccaccagttctgcggctgggagggcagcggcttccccggcgcccagcccgtgagcatggacaagcagaacatcaagctgctggacctgaagccctacaaggtgagctggaaggccgacggcaccagatacatgatgctgatcgacggcaccaacgaggtgttcatgatcgacagagacaacagcgtgttccacgtgagcaacctggagttccccttcagaaaggacctgagaatgcacctgagcaacaccctgctggacggcgagatgatcatcgacagagtgaacggccaggccgtgcccagatacctgatctacgacatcatcaagttcaacagccagcccgtgggcgactgcgacttcaacgtgagactgcagtgcatcgagagagagatcatcagccccagacacgagaagatgaagaccggcctgatcgacaagacccaggagcccttcagcgtgagaaacaagcccttcttcgacatctgcaccagcagaaagctgctggagggcaacttcgccaaggaggtgagccacgagatggacggcctgatcttccagcccaccggcaagtacaagcccggcagatgcgacgacatcctgaagtggaagccccccagcctgaacagcgtggacttcagactgaagatcaccagaatgggcggcgagggcctgctgccccagaacgtgggcctgctgtacgtgggcggctacgagagacccttcgcccagatcaaggtgaccaaggagctgaagcagtacgacaacaagatcatcgagtgcaagttcgagaacaacagctgggtgttcatgagacagagaaccgacaagagcttccccaacgcctacaacaccgccatggccgtgtgcaacagcatcagcaaccccgtgaccaaggagatgctgttcgagttcatcgacagatgcaccgccgccagccagggccagaagagaaagcaccacctggaccccgacaccgagctgatgcccccccccccccccaagagacccagacccctgacctag

SEQ ID NO: 97850 - DNA, 1545 bp, Artificial Sequence
  Description of Artificial Sequence: Synthetic coding sequence
atgggcctgctggtggacctgaccaacaccagcagattctacgacagaaacgacatcgagaaggagggcatcaagtacatcaagctgcagtgcaagggccacggcgagtgccccaccaccgagaacaccgagaccttcatcagactgtgcgagagattcaacgagagaaacccccccgagctgatcggcgtgcactgcacccacggcttcaacagaaccggcttcctgatctgcgccttcctggtggagaagatggactggagcatcgaggccgccgtggccaccttcgcccaggccagaccccccggcatctacaagggcgactacctgaaggagctgttcagaagatacggcgacatcgaggaggccccccccccccccctgctgcccgactggtgcttcgaggacgacgaggacgaggacgaggacgaggacggcaagaaggagagcgagcccggcagcagcgccagcttcggcaagagaagaaaggagagactgaagctgggcgccatcttcctggagggcgtgaccgtgaagggcgtgacccaggtgaccacccagcccaagctgggcgaggtgcagcagaagtgccaccagttctgcggctgggagggcagcggcttccccggcgcccagcccgtgagcatggacaagcagaacatcaagctgctggacctgaagccctacaaggtgagctggaaggccgacggcaccagatacatgatgctgatcgacggcaccaacgaggtgttcatgatcgacagagacaacagcgtgttccacgtgagcaacctggagttccccttcagaaaggacctgagaatgcacctgagcaacaccctgctggacggcgagatgatcatcgacagagtgaacggccaggccgtgcccagatacctgatctacgacatcatcaagttcaacagccagcccgtgggcgactgcgacttcaacgtgagactgcagtgcatcgagagagagatcatcagccccagacacgagaagatgaagaccggcctgatcgacaagacccaggagcccttcagcgtgagaaacaagcccttcttcgacatctgcaccagcagaaagaagtacaagcccggcagatgcgacgacatcctgaagtggaagccccccagcctgaacagcgtggacttcagactgaagatcaccagaatgggcggcgagggcctgctgccccagaacgtgggcctgctgtacgtgggcggctacgagagacccttcgcccagatcaaggtgaccaaggagctgaagcagtacgacaacaagatcatcgagtgcaagttcgagaacaacagctgggtgttcatgagacagagaaccgacaagagcttccccaacgcctacaacaccgccatggccgtgtgcaacagcatcagcaaccccgtgaccaaggagatgctgttcgagttcatcgacagatgcaccgccgccagccagggccagaagagaaagcaccacctggaccccgacaccgagctgatgcccccccccccccccaagagacccagacccctgacctag

SEQ ID NO: 97851 - DNA, 1263 bp, Artificial Sequence
  Description of Artificial Sequence: Synthetic coding sequence
atggccgccctggtgagacccgccagattcgtggtgagacccctgctgcaggtggtgcaggcctgggacctggacgccagaagatgggtgagagccctgagaagaagccccgtgaaggtggtgttccccagcggcgaggtggtggagcagaagagagcccccggcaagcagcccagaaaggcccccagcgaggccagcgcccaggagcagagagagaagcagcccctggaggagagcgccagcagagcccccagcacctgggaggagagcggcctgagatacgacaaggcctaccccggcgacagaagactgagcagcgtgatgaccatcgtgaagagcagacccttcagagagaagcagggcaagatcctgctggagggcagaagactgatcagcgacgccctgaaggccggcgccgtgcccaagatgttcttcttcagcagactggagtacctgaaggagctgcccgtggacaagctgaagggcgtgagcctgatcaaggtgaagttcgaggacatcaaggactggagcgacctggtgaccccccagggcatcatgggcatcttcgccaagcccgaccacgtgaagatgacctaccccaagacccagctgcagcacagcctgcccctgctgctgatctgcgacaacctgagagaccccggcaacctgggcaccatcctgagaagcgccgccggcgccggctgcagcaaggtgctgctgaccaagggctgcgtggacgcctgggagcccaaggtgctgagagccggcatgggcgcccacttcagaatgcccatcatcaacaacctggagtgggagaccgtgcccaactacctgccccccgacaccagagtgtacgtggccgacaactgcggcctgtacgcccaggccgagatgagcaacaaggccagcgaccacggctgggtgtgcgaccagagagtgatgaagttccacaagtacgaggaggaggaggacgtggagaccggcgccagccaggactggctgccccacgtggaggtgcagagctacgacagcgactggaccgaggcccccgccgccgtggtgatcggcggcgagacctacggcgtgagcctggagagcctgcagctggccgagagcaccggcggcaagagactgctgatccccgtggtgcccggcgtggacagcctgaacagcgccatggccgccagcatcctgctgttcgagggcaagagacagctgagaggcagagccgaggacctgagcagagacagaagctaccactag

SEQ ID NO: 97852 - DNA, 4182 bp, Artificial Sequence
  Description of Artificial Sequence: Synthetic coding sequence
atgctgagcagacccaagcccggcgagagcgaggtggacctgctgcacttccagagccagttcctggccgccggcgccgcccccgccgtgcagctggtgaagaagggcaacagaggcggcggcgacgccaacagcgacagaccccccctgcaggaccacagagacgtggtgatgctggacaacctgcccgacctgccccccgccctggtgcccagcccccccaagagagccagacccagccccggccactgcctgcccgaggacgaggaccccgaggagagactgagaagacacgaccagcacatcaccgccgtgctgaccaagatcatcgagagagacaccagcagcgtggccgtgaacctgcccgtgcccagcggcgtggccttccccgccgtgttcctgagaagcagagacacccagggcaagagcgccaccagcggcaagagaagcatcttcgcccaggagatcgccgccagaagaatcgccgaggccaagggccccagcgtgggcgaggtggtgcccaacgtgggcccccccgagggcgccgtgacctgcgagacccccacccccagaaaccagggctgccagctgcccggcagcagccacagcttccagggccccaacctggtgaccggcaagggcctgagagaccaggaggccgagcaggaggcccagaccatccacgaggagaacatcgccagactgcaggccatggcccccgaggagatcctgcaggagcagcagagactgctggcccagctggaccccagcctggtggccttcctgagaagccacagccacacccaggagcagaccggcgagaccgccagcgaggagcagagacccggcggccccagcgccaacgtgaccaaggaggagcccctgatgagcgccttcgccagcgagcccagaaagagagacaagctggagcccgaggcccccgccctggccctgcccgtgaccccccagaaggagtggctgcacatggacaccgtggagctggagaagctgcactggacccaggacctgccccccgtgagaagacagcagacccaggagagaatgcaggccagattcagcctgcagggcgagctgctggcccccgacgtggacctgcccacccacctgggcctgcaccaccacggcgaggaggccgagagagccggctacagcctgcaggagctgttccacctgaccagaagccaggtgagccagcagagagccctggccctgcacgtgctggcccaggtgatcagcagagcccaggccggcgagttcggcgacagactggccggcagcgtgctgagcctgctgctggacgccggcttcctgttcctgctgagattcagcctggacgacagagtggacggcgtgatcgccaccgccatcagagccctgagagccctgctggtggcccccggcgacgaggagctgctggacagcaccttcagctggtaccacggcgccctgaccttccccctgatgcccagccaggaggacaaggaggacgaggacgaggacgaggagtgccccgccggcaaggccaagagaaagagccccgaggaggagagcagacccccccccgacctggccagacacgacgtgatcaagggcctgctggccaccagcctgctgcccagactgagatacgtgctggaggtgacctaccccggccccgccgtggtgctggacatcctggccgtgctgatcagactggccagacacagcctggagagcgccaccagagtgctggagtgccccagactgatcgagaccatcgtgagagagttcctgcccaccagctggagccccgtgggcgccggccccacccccagcctgtacaaggtgccctgcgccaccgccatgaagctgctgagagtgctggccagcgccggcagaaacatcgccgccagactgctgagcagcttcgacctgagaagcagactgtgcagaatcatcgccgaggccccccaggagctggccctgccccccgaggaggccgagatgctgagcaccgaggccctgagactgtgggccgtggccgccagctacggccagggcggctacctgtacagagagctgtaccccgtgctgatgagagccctgcaggtggtgcccagagagctgagcacccaccccccccagcccctgagcatgcagagaatcgccagcctgctgaccctgctgacccagctgaccctggccgccggcagcacccccgccgagaccatcagcgacagcgccgaggccagcctgagcgccacccccagcctggtgacctggacccaggtgagcggcctgcagcccctggtggagccctgcctgagacagaccctgaagctgctgagcagacccgagatgtggagagccgtgggccccgtgcccgtggcctgcctgctgttcctgggcgcctactaccaggcctggagccagcagcccagcagctgccccgaggactggctgcaggacatgcagagactgagcgaggagctgctgctgcccctgctgagccagcccaccctgggcagcctgtgggacagcctgagacactgcagcctgctgtgcaaccccctgagctgcgtgcccgccctggaggccccccccagcctggtgagcctgggctgcagcggcggctgccccagactgagcctggccggcagcgccagccccttccccttcctgaccgccctgctgagcctgctgaacaccctggcccagatccacaagggcctgtgcggccagctggccgccatcctggccgcccccggcctgcagaactacttcctgcagtgcgtggcccccggcgccgccccccacctgacccccttcagcgcctgggccctgagacacgagtaccacctgcagtacctggccctggccctggcccagaaggccgccgccctgcagcccctgcccgccacccacgccgccctgtaccacggcatggccctggccctgctgagcagactgctgcccggcagcgagtacctgacccacgagctgctgctgagctgcgtgttcagactggagttcctgcccgagagaaccagcggcggccccgaggccgccgacttcagcgaccagctgagcctgggcagcagcagagtgcccagatgcggccagggcaccctgctggcccaggcctgccaggacctgcccagcatcagaaactgctacctgacccactgcagccccgccagagccagcctgctggccagccaggccctgcacagaggcgagctgcagagagtgcccaccctgctgctgcccatgcccaccgagcccctgctgcccaccgactggcccttcctgcccctgatcagactgtaccacagagccagcgacacccccagcggcctgagccccaccgacaccatgggcaccgccatgagagtgctgcagtgggtgctggtgctggagagctggagaccccaggccctgtgggccgtgccccccgccgccagactggccagactgatgtgcgtgttcctggtggacagcgagctgttcagagagagccccgtgcagcacctggtggccgccctgctggcccagctgtgccagccccaggtgctgcccaacctgaacctggactgcagactgcccggcctgaccagcttccccgacctgtacgccaacttcctggaccacttcgaggccgtgagcttcggcgaccacctgttcggcgccctggtgctgctgcccctgcagagaagattcagcgtgaccctgagactggccctgttcggcgagcacgtgggcgccctgagagccctgagcctgcccctgacccagctgcccgtgagcctggagtgctacaccgtgccccccgaggacaacctggccctgctgcagctgtacttcagaaccctggtgaccggcgccctgagacccagatggtgccccgtgctgtacgccgtggccgtggcccacgtgaacagcttcatcttcagccaggacccccagagcagcgacgaggtgaaggccgccagaagaagcatgctgcagaagacctggctgctggccgacgagggcctgagacagcacctgctgcactacaagctgcccaacagcaccctgcccgagggcttcgagctgtacagccagctgccccccctgagacagcactacctgcagagactgaccagcaccgtgctgcagaacggcgtgagcgagacctag

SEQ ID NO: 97853 - DNA, 1839 bp, Artificial Sequence
  Description of Artificial Sequence: Synthetic coding sequence
atggccgacttcgccggccccagcagcgccggcagaaaggccggcgcccccagatgcagcagaaaggccgccggcaccaagcagaccagcaccctgaagcaggaggacgccagcaagagaaaggccgagctggaggccgccgtgagaaagaagatcgagttcgagagaaaggccctgcacatcgtggagcagctgctggaggagaacatcaccgaggagttcctgatggagtgcggcagattcatcacccccgcccactacagcgacgtggtggacgagagaagcatcgtgaagctgtgcggctaccccctgtgccagaagaagctgggcatcgtgcccaagcagaagtacaagatcagcaccaagaccaacaaggtgtacgacatcaccgagagaaagagcttctgcagcaacttctgctaccaggccagcaagttcttcgaggcccagatccccaagacccccgtgtgggtgagagaggaggagagacaccccgacttccagctgctgaaggaggagcagagcggccacagcggcgaggaggtgcagctgtgcagcaaggccatcaagaccagcgacatcgacaaccccagccacttcgagaagcagtacgagagcagcagcagcagcacccacagcgacagcagcagcgacaacgagcaggacttcgtgagcagcatcctgcccggcaacagacccaacagcaccaacatcagaccccagctgcaccagaagagcatcatgaagaagaaggccggccacaaggccaacagcaagcacaaggacaaggagcagaccgtggtggacgtgaccgagcagctgggcgactgcaagctggacagccaggagaaggacgccacctgcgagctgcccctgcagaaggtgaacacccagagcagcagcaacagcaccctgcccgagagactgaaggccagcgagaacagcgagagcgagtacagcagaagcgagatcaccctggtgggcatcagcaagaagagcgccgagcacttcaagagaaagttcgccaagagcaaccaggtgagcagaagcgtgagcagcagcgtgcaggtgtgccccgaggtgggcaagagaaacctgctgaaggtgctgaaggagaccctgatcgagtggaagaccgaggagaccctgagattcctgtacggccagaactacgccagcgtgtgcctgaagcccgaggccagcctggtgaaggaggagctggacgaggacgacatcatcagcgaccccgacagccacttccccgcctggagagagagccagaacagcctggacgagagcctgcccttcagaggcagcggcaccgccatcaagcccctgcccagctacgagaacctgaagaaggagaccgagaagctgaacctgagaatcagagagttctacagaggcagatacgtgctgggcgaggagaccaccaagagccaggacagcgaggagcacgacagcaccttccccctgatcgacagcagcagccagaaccagatcagaaagagaatcgtgctggagaagctgagcaaggtgctgcccggcctgctggtgcccctgcagatcaccctgggcgacatctacacccagctgaagaacctggtgagaaccttcagactgaccaacagaaacatcatccacaagcccgccgagtggaccctgatcgccatggtgctgctgagcctgctgacccccatcctgggcatccagaagcacagccaggagggcatggtgttcaccagattcctggacaccctgctggaggagctgcacctgaagaacgaggacctggagagcctgaccatcatcttcagaaccagctgcctgcccgagtag

SEQ ID NO: 97854 - DNA, 1755 bp, Artificial Sequence
  Description of Artificial Sequence: Synthetic coding sequence
atggccgacttcgccggccccagcagcgccggcagaaaggccggcgcccccagatgcagcagaaaggccgccggcaccaagcagaccagcaccctgaagcaggaggacgccagcaagagaaaggccgagctggaggccgccgtgagaaagaagatcgagttcgagagaaaggccctgcacatcgtggagcagctgctggaggagaacatcaccgaggagttcctgatggagtgcggcagattcatcacccccgcccactacagcgacgtggtggacgagagaagcatcgtgaagctgtgcggctaccccctgtgccagaagaagctgggcatcgtgcccaagcagaagtacaagatcagcaccaagaccaacaaggtgtacgacatcaccgagagaaagagcttctgcagcaacttctgctaccaggccagcaagttcttcgaggcccagatccccaagacccccgtgtgggtgagagaggaggagagacaccccgacttccagctgctgaaggaggagcagagcggccacagcggcgaggaggtgcagctgtgcagcaaggccatcaagaccagcgacatcgacaaccccagccacttcgagaagcagtacgagagcagcagcagcagcacccacagcgacagcagcagcgacaacgagcaggacttcgtgagcagcatcctgcccggcaacagacccaacagcaccaacatcagaccccagctgcaccagaagagcatcatgaagaagaaggccggccacaaggccaacagcaagcacaaggacaaggagcagaccgtggtggacgtgaccgagcagctgggcgactgcaagctggacagccaggagaaggacgccacctgcgagctgcccctgcagaaggtgaacacccagagcagcagcaacagcaccctgcccgagagactgaaggccagcgagaacagcgagagcgagtacagcagaagcgagatcaccctggtgggcatcagcaagaagagcgccgagcacttcaagagaaagttcgccaagagcaaccaggtgagcagaagcgtgagcagcagcgtgcaggtgtgccccgaggtgggcaagagaaacctgctgaaggtgctgaaggagaccctgatcgagtggaagaccgaggagaccctgagattcctgtacggccagaactacgccagcgtgtgcctgaagcccgaggccagcctggtgaaggaggagctggacgaggacgacatcatcagcgaccccgacagccacttccccgcctggagagagagccagaacagcctggacgagagcctgcccttcagaggcagcggcaccgccatcaagcccctgcccagctacgagaacctgaagaaggagaccgagaagctgaacctgagaatcagagagttctacagaggcagatacgtgctgggcgaggagaccaccaagagccaggacagcgaggagcacgacagcaccttccccctgatcgacagcagcagccagaaccagatcagaaagagaatcgtgctggagaagctgagcaaggtgctgcccggcctgctggtgcccctgcagatcaccctgggcgacatctacacccagctgaagaacctggtgagaaccttcagactgaccaacagaaacatcatccacaagcccgccgagtggaccctgatcgccatggtgctgctgagcttcctgctgaacgtgaagaccagaatcaagaccttcatgatgatctacttccacctgatgaacagctag

SEQ ID NO: 97855 - DNA, 1998 bp, Artificial Sequence
  Description of Artificial Sequence: Synthetic coding sequence
atgaccagcgccaacaaggccatcgagctgcagctgcaggtgaagcagaacgccgaggagctgcaggacttcatgagagacctggagaactgggagaaggacatcaagcagaaggacatggagctgagaagacagaacggcgtgcccgaggagaacctgccccccatcagaaacggcaacttcagaaagaagaagaagggcaaggccaaggagagcagcaagaagaccagagaggagaacaccaagaacagaatcaagagctacgactacgaggcctgggccaagctggacgtggacagaatcctggacgagctggacaaggacgacagcacccacgagagcctgagccaggagagcgagagcgaggaggacggcatccacgtggacagccagaaggccctggtgctgaaggagaagggcaacaagtacttcaagcagggcaagtacgacgaggccatcgactgctacaccaagggcatggacgccgacccctacaaccccgtgctgcccaccaacagagccagcgcctacttcagactgaagaagttcgccgtggccgagagcgactgcaacctggccgtggccctgaacagaagctacaccaaggcctacagcagaagaggcgccgccagattcgccctgcagaagctggaggaggccaagaaggactacgagagagtgctggagctggagcccaacaacttcgaggccaccaacgagctgagaaagatcagccaggccctggccagcaaggagaacagctaccccaaggaggccgacatcgtgatcaagagcaccgagggcgagagaaagcagatcgaggcccagcagaacaagcagcaggccatcagcgagaaggacagaggcaacggcttcttcaaggagggcaagtacgagagagccatcgagtgctacaccagaggcatcgccgccgacggcgccaacgccctgctgcccgccaacagagccatggcctacctgaagatccagaagtacgaggaggccgagaaggactgcacccaggccatcctgctggacggcagctacagcaaggccttcgccagaagaggcaccgccagaaccttcctgggcaagctgaacgaggccaagcaggacttcgagaccgtgctgctgctggagcccggcaacaagcaggccgtgaccgagctgagcaagatcaagaaggagctgatcgagaagggccactgggacgacgtgttcctggacagcacccagagacagaacgtggtgaagcccatcgacaaccccccccaccccggcagcaccaagcccctgaagaaggtgatcatcgaggagaccggcaacctgatccagaccatcgacgtgcccgacagcaccaccgccgccgcccccgagaacaaccccatcaacctggccaacgtgatcgccgccaccggcaccaccagcaagaagaacagcagccaggacgacctgttccccaccagcgacacccccagagccaaggtgctgaagatcgaggaggtgagcgacaccagcagcctgcagccccaggccagcctgaagcaggacgtgtgccagagctacagcgagaagatgcccatcgagatcgagcagaagcccgcccagttcgccaccaccgtgctgccccccatccccgccaacagcttccagctggagagcgacttcagacagctgaagagcagccccgacatgctgtaccagtacctgaagcagatcgagcccagcctgtaccccaagctgttccagaagaacctggaccccgacgtgttcaaccagatcgtgaagatcctgcacgacttctacatcgagaaggagaagcccctgctgatcttcgagatcctgcagagactgagcgagctgaagagattcgacatggccgtgatgttcatgagcgagaccgagaagaagatcgccagagccctgttcaaccacatcgacaagagcggcctgaaggacagcagcgtggaggagctgaagaagagatacggcggctag

SEQ ID NO: 97856 - DNA, 1896 bp, Artificial Sequence
  Description of Artificial Sequence: Synthetic coding sequence
atgaccagcgccaacaaggccatcgagctgcagctgcaggtgaagcagaacgccgaggagctgcaggacttcatgagagacctggagaactgggagaaggacatcaagcagaaggacatggagctgagaagacagaacggcgtgcccgaggagaacctgccccccatcagaaacggcaacttcagaaagaagaagaagggcaaggccaaggagagcagcaagaagaccagagaggagaacaccaagaacagaatcaagagctacgactacgaggcctgggccaagctggacgtggacagaatcctggacgagctggacaaggacgacagcacccacgagagcctgagccaggagagcgagagcgaggaggacggcatccacgtggacagccagaaggccctggtgctgaaggagaagggcaacaagtacttcaagcagggcaagtacgacgaggccatcgactgctacaccaagggcatggacgccgacccctacaaccccgtgctgcccaccaacagagccagcgcctacttcagactgaagaagttcgccgtggccgagagcgactgcaacctggccgtggccctgaacagaagctacaccaaggcctacagcagaagaggcgccgccagattcgccctgcagaagctggaggaggccaagaaggactacgagagagtgctggagctggagcccaacaacttcgaggccaccaacgagctgagaaagatcagccaggccctggccagcaaggagaacagctaccccaaggaggccgacatcgtgatcaagagcaccgagggcgagagaaagcagatcgaggcccagcagaacaagcagcaggccatcagcgagaaggacagaggcaacggcttcttcaaggagggcaagtacgagagagccatcgagtgctacaccagaggcatcgccgccgacggcgccaacgccctgctgcccgccaacagagccatggcctacctgaagatccagaagtacgaggaggccgagaaggactgcacccaggccatcctgctggacggcagctacagcaaggccttcgccagaagaggcaccgccagaaccttcctgggcaagctgaacgaggccaagcaggacttcgagaccgtgctgctgctggagcccggcaacaagcaggccgtgaccgagctgagcaagatcaagaagaagcccctgaagaaggtgatcatcgaggagaccggcaacctgatccagaccatcgacgtgcccgacagcaccaccgccgccgcccccgagaacaaccccatcaacctggccaacgtgatcgccgccaccggcaccaccagcaagaagaacagcagccaggacgacctgttccccaccagcgacacccccagagccaaggtgctgaagatcgaggaggtgagcgacaccagcagcctgcagccccaggccagcctgaagcaggacgtgtgccagagctacagcgagaagatgcccatcgagatcgagcagaagcccgcccagttcgccaccaccgtgctgccccccatccccgccaacagcttccagctggagagcgacttcagacagctgaagagcagccccgacatgctgtaccagtacctgaagcagatcgagcccagcctgtaccccaagctgttccagaagaacctggaccccgacgtgttcaaccagatcgtgaagatcctgcacgacttctacatcgagaaggagaagcccctgctgatcttcgagatcctgcagagactgagcgagctgaagagattcgacatggccgtgatgttcatgagcgagaccgagaagaagatcgccagagccctgttcaaccacatcgacaagagcggcctgaaggacagcagcgtggaggagctgaagaagagatacggcggctag

SEQ ID NO: 97857 - DNA, 1521 bp, Artificial Sequence
  Description of Artificial Sequence: Synthetic coding sequence
atggacgccgacccctacaaccccgtgctgcccaccaacagagccagcgcctacttcagactgaagaagttcgccgtggccgagagcgactgcaacctggccgtggccctgaacagaagctacaccaaggcctacagcagaagaggcgccgccagattcgccctgcagaagctggaggaggccaagaaggactacgagagagtgctggagctggagcccaacaacttcgaggccaccaacgagctgagaaagatcagccaggccctggccagcaaggagaacagctaccccaaggaggccgacatcgtgatcaagagcaccgagggcgagagaaagcagatcgaggcccagcagaacaagcagcaggccatcagcgagaaggacagaggcaacggcttcttcaaggagggcaagtacgagagagccatcgagtgctacaccagaggcatcgccgccgacggcgccaacgccctgctgcccgccaacagagccatggcctacctgaagatccagaagtacgaggaggccgagaaggactgcacccaggccatcctgctggacggcagctacagcaaggccttcgccagaagaggcaccgccagaaccttcctgggcaagctgaacgaggccaagcaggacttcgagaccgtgctgctgctggagcccggcaacaagcaggccgtgaccgagctgagcaagatcaagaaggagctgatcgagaagggccactgggacgacgtgttcctggacagcacccagagacagaacgtggtgaagcccatcgacaaccccccccaccccggcagcaccaagcccctgaagaaggtgatcatcgaggagaccggcaacctgatccagaccatcgacgtgcccgacagcaccaccgccgccgcccccgagaacaaccccatcaacctggccaacgtgatcgccgccaccggcaccaccagcaagaagaacagcagccaggacgacctgttccccaccagcgacacccccagagccaaggtgctgaagatcgaggaggtgagcgacaccagcagcctgcagccccaggccagcctgaagcaggacgtgtgccagagctacagcgagaagatgcccatcgagatcgagcagaagcccgcccagttcgccaccaccgtgctgccccccatccccgccaacagcttccagctggagagcgacttcagacagctgaagagcagccccgacatgctgtaccagtacctgaagcagatcgagcccagcctgtaccccaagctgttccagaagaacctggaccccgacgtgttcaaccagatcgtgaagatcctgcacgacttctacatcgagaaggagaagcccctgctgatcttcgagatcctgcagagactgagcgagctgaagagattcgacatggccgtgatgttcatgagcgagaccgagaagaagatcgccagagccctgttcaaccacatcgacaagagcggcctgaaggacagcagcgtggaggagctgaagaagagatacggcggctag

SEQ ID NO: 97858 - DNA, 4821 bp, Artificial Sequence
  Description of Artificial Sequence: Synthetic coding sequence
atgatcgccgagcccgcccacttctacctgttcggcctgatctgcctgtgcagcggcagcagactgagacaggaggacttcccccccagaatcgtggagcaccccagcgacctgatcgtgagcaagggcgagcccgccaccctgaactgcaaggccgagggcagacccacccccaccatcgagtggtacaagggcggcgagagagtggagaccgacaaggacgaccccagaagccacagaatgctgctgcccagcggcagcctgttcttcctgagaatcgtgcacggcagaaagagcagacccgacgagggcgtgtacgtgtgcgtggccagaaactacctgggcgaggccgtgagccacaacgccagcctggaggtggccatcctgagagacgacttcagacagaaccccagcgacgtgatggtggccgtgggcgagcccgccgtgatggagtgccagccccccagaggccaccccgagcccaccatcagctggaagaaggacggcagccccctggacgacaaggacgagagaatcaccatcagaggcggcaagctgatgatcacctacaccagaaagagcgacgccggcaagtacgtgtgcgtgggcaccaacatggtgggcgagagagagagcgaggtggccgagctgaccgtgctggagagacccagcttcgtgaagagacccagcaacctggccgtgaccgtggacgacagcgccgagttcaagtgcgaggccagaggcgaccccgtgcccaccgtgagatggagaaaggacgacggcgagctgcccaagagcagatacgagatcagagacgaccacaccctgaagatcagaaaggtgaccgccggcgacatgggcagctacacctgcgtggccgagaacatggtgggcaaggccgaggccagcgccaccctgaccgtgcaggcccccagcgagcccccccacttcgtggtgaagcccagagaccaggtggtggccctgggcagaaccgtgaccttccagtgcgaggccaccggcaacccccagcccgccatcttctggagaagagagggcagccagaacctgctgttcagctaccagcccccccagagcagcagcagattcagcgtgagccagaccggcgacctgaccatcaccaacgtgcagagaagcgacgtgggctactacatctgccagaccctgaacgtggccggcagcatcatcaccaaggcctacctggaggtgaccgacgtgatcgccgacagacccccccccgtgatcagacagggccccgtgaaccagaccgtggccgtggacggcaccttcgtgctgagctgcgtggccaccggcagccccgtgcccaccatcctgtggagaaaggacggcgtgctggtgagcacccaggacagcagaatcaagcagctggagaacggcgtgctgcagatcagatacgccaagctgggcgacaccggcagatacacctgcatcgccagcacccccagcggcgaggccacctggagcgcctacatcgaggtgcaggagttcggcgtgcccgtgcagccccccagacccaccgaccccaacctgatccccagcgcccccagcaagcccgaggtgaccgacgtgagcagaaacaccgtgaccctgagctggcagcccaacctgaacagcggcgccacccccaccagctacatcatcgaggccttcagccacgccagcggcagcagctggcagaccgtggccgagaacgtgaagaccgagaccagcgccatcaagggcctgaagcccaacgccatctacctgttcctggtgagagccgccaacgcctacggcatcagcgaccccagccagatcagcgaccccgtgaagacccaggacgtgctgcccaccagccagggcgtggaccacaagcaggtgcagagagagctgggcaacgccgtgctgcacctgcacaaccccaccgtgctgagcagcagcagcatcgaggtgcactggaccgtggaccagcagagccagtacatccagggctacaagatcctgtacagacccagcggcgccaaccacggcgagagcgactggctggtgttcgaggtgagaacccccgccaagaacagcgtggtgatccccgacctgagaaagggcgtgaactacgagatcaaggccagacccttcttcaacgagttccagggcgccgacagcgagatcaagttcgccaagaccctggaggaggcccccagcgcccccccccagggcgtgaccgtgagcaagaacgacggcaacggcaccgccatcctggtgagctggcagcccccccccgaggacacccagaacggcatggtgcaggagtacaaggtgtggtgcctgggcaacgagaccagataccacatcaacaagaccgtggacggcagcaccttcagcgtggtgatccccttcctggtgcccggcatcagatacagcgtggaggtggccgccagcaccggcgccggcagcggcgtgaagagcgagccccagttcatccagctggacgcccacggcaaccccgtgagccccgaggaccaggtgagcctggcccagcagatcagcgacgtggtgaagcagcccgccttcatcgccggcatcggcgccgcctgctggatcatcctgatggtgttcagcatctggctgtacagacacagaaagaagagaaacggcctgaccagcacctacgccggcatcagaaaggtgacctaccagagaggcggcgaggccgtgagcagcggcggcagacccggcctgctgaacatcagcgagcccgccgcccagccctggctggccgacacctggcccaacaccggcaacaaccacaacgactgcagcatcagctgctgcaccgccggcaacggcaacagcgacagcaacctgaccacctacagcagacccgccgactgcatcgccaactacaacaaccagctggacaacaagcagaccaacctgatgctgcccgagagcaccgtgtacggcgacgtggacctgagcaacaagatcaacgagatgaagaccttcaacagccccaacctgaaggacggcagattcgtgaaccccagcggccagcccaccccctacgccaccacccagctgatccagagcaacctgagcaacaacatgaacaacggcagcggcgacagcggcgagaagcactggaagcccctgggccagcagaagcaggaggtggcccccgtgcagtacaacatcgtggagcagaacaagctgaacaaggactacagagccaacgacaccgtgccccccaccatcccctacaaccagagctacgaccagaacaccggcggcagctacaacagcagcgacagaggcagcagcaccagcggcagccagggccacaagaagggcgccagaacccccaaggtgcccaagcagggcggcatgaactgggccgacctgctgccccccccccccgcccacccccccccccacagcaacagcgaggagtacaacatcagcgtggacgagagctacgaccaggagatgccctgccccgtgccccccgccagaatgtacctgcagcaggacgagctggaggaggaggaggacgagagaggccccaccccccccgtgagaggcgccgccagcagccccgccgccgtgagctacagccaccagagcaccgccaccctgacccccagcccccaggaggagctgcagcccatgctgcaggactgccccgaggagaccggccacatgcagcaccagcccgacagaagaagacagcccgtgagccccccccccccccccagacccatcagccccccccacacctacggctacatcagcggccccctggtgagcgacatggacaccgacgcccccgaggaggaggaggacgaggccgacatggaggtggccaagatgcagaccagaagactgctgctgagaggcctggagcagacccccgccagcagcgtgggcgacctggagagcagcgtgaccggcagcatgatcaacggctggggcagcgccagcgaggaggacaacatcagcagcggcagaagcagcgtgagcagcagcgacggcagcttcttcaccgacgccgacttcgcccaggccgtggccgccgccgccgagtacgccggcctgaaggtggccagaagacagatgcaggacgccgccggcagaagacacttccacgccagccagtgccccagacccaccagccccgtgagcaccgacagcaacatgagcgccgccgtgatgcagaagaccagacccgccaagaagctgaagcaccagcccggccacctgagaagagagacctacaccgacgacctgccccccccccccgtgcccccccccgccatcaagagccccaccgcccagagcaagacccagctggaggtgagacccgtggtggtgcccaagctgcccagcatggacgccagaaccgacagaagcagcgacagaaagggcagcagctacaagggcagagaggtgctggacggcagacaggtggtggacatgagaaccaaccccggcgaccccagagaggcccaggagcagcagaacgacggcaagggcagaggcaacaaggccgccaagagagacctgccccccgccaagacccacctgatccaggaggacatcctgccctactgcagacccaccttccccaccagcaacaaccccagagaccccagcagcagcagcagcatgagcagcagaggcagcggcagcagacagagagagcaggccaacgtgggcagaagaaacatcgccgagatgcaggtgctgggcggctacgagagaggcgaggacaacaacgaggagctggaggagaccgagagctag

SEQ ID NO: 97859 - DNA, 4968 bp, Artificial Sequence
  Description of Artificial Sequence: Synthetic coding sequence
atgaagtggaagcacgtgcccttcctggtgatgatcagcctgctgagcctgagccccaaccacctgttcctggcccagctgatccccgaccccgaggacgtggagagaggcaacgaccacggcacccccatccccaccagcgacaacgacgacaacagcctgggctacaccggcagcagactgagacaggaggacttcccccccagaatcgtggagcaccccagcgacctgatcgtgagcaagggcgagcccgccaccctgaactgcaaggccgagggcagacccacccccaccatcgagtggtacaagggcggcgagagagtggagaccgacaaggacgaccccagaagccacagaatgctgctgcccagcggcagcctgttcttcctgagaatcgtgcacggcagaaagagcagacccgacgagggcgtgtacgtgtgcgtggccagaaactacctgggcgaggccgtgagccacaacgccagcctggaggtggccatcctgagagacgacttcagacagaaccccagcgacgtgatggtggccgtgggcgagcccgccgtgatggagtgccagccccccagaggccaccccgagcccaccatcagctggaagaaggacggcagccccctggacgacaaggacgagagaatcaccatcagaggcggcaagctgatgatcacctacaccagaaagagcgacgccggcaagtacgtgtgcgtgggcaccaacatggtgggcgagagagagagcgaggtggccgagctgaccgtgctggagagacccagcttcgtgaagagacccagcaacctggccgtgaccgtggacgacagcgccgagttcaagtgcgaggccagaggcgaccccgtgcccaccgtgagatggagaaaggacgacggcgagctgcccaagagcagatacgagatcagagacgaccacaccctgaagatcagaaaggtgaccgccggcgacatgggcagctacacctgcgtggccgagaacatggtgggcaaggccgaggccagcgccaccctgaccgtgcaggagcccccccacttcgtggtgaagcccagagaccaggtggtggccctgggcagaaccgtgaccttccagtgcgaggccaccggcaacccccagcccgccatcttctggagaagagagggcagccagaacctgctgttcagctaccagcccccccagagcagcagcagattcagcgtgagccagaccggcgacctgaccatcaccaacgtgcagagaagcgacgtgggctactacatctgccagaccctgaacgtggccggcagcatcatcaccaaggcctacctggaggtgaccgacgtgatcgccgacagacccccccccgtgatcagacagggccccgtgaaccagaccgtggccgtggacggcaccttcgtgctgagctgcgtggccaccggcagccccgtgcccaccatcctgtggagaaaggacggcgtgctggtgagcacccaggacagcagaatcaagcagctggagaacggcgtgctgcagatcagatacgccaagctgggcgacaccggcagatacacctgcatcgccagcacccccagcggcgaggccacctggagcgcctacatcgaggtgcagggcaaggtgaacgagttcggcgtgcccgtgcagccccccagacccaccgaccccaacctgatccccagcgcccccagcaagcccgaggtgaccgacgtgagcagaaacaccgtgaccctgagctggcagcccaacctgaacagcggcgccacccccaccagctacatcatcgaggccttcagccacgccagcggcagcagctggcagaccgtggccgagaacgtgaagaccgagaccagcgccatcaagggcctgaagcccaacgccatctacctgttcctggtgagagccgccaacgcctacggcatcagcgaccccagccagatcagcgaccccgtgaagacccaggacgtgctgcccaccagccagggcgtggaccacaagcaggtgcagagagagctgggcaacgccgtgctgcacctgcacaaccccaccgtgctgagcagcagcagcatcgaggtgcactggaccgtggaccagcagagccagtacatccagggctacaagatcctgtacagacccagcggcgccaaccacggcgagagcgactggctggtgttcgaggtgagaacccccgccaagaacagcgtggtgatccccgacctgagaaagggcgtgaactacgagatcaaggccagacccttcttcaacgagttccagggcgccgacagcgagatcaagttcgccaagaccctggaggaggcccccagcgcccccccccagggcgtgaccgtgagcaagaacgacggcaacggcaccgccatcctggtgagctggcagcccccccccgaggacacccagaacggcatggtgcaggagtacaaggtgtggtgcctgggcaacgagaccagataccacatcaacaagaccgtggacggcagcaccttcagcgtggtgatccccttcctggtgcccggcatcagatacagcgtggaggtggccgccagcaccggcgccggcagcggcgtgaagagcgagccccagttcatccagctggacgcccacggcaaccccgtgagccccgaggaccaggtgagcctggcccagcagatcagcgacgtggtgaagcagcccgccttcatcgccggcatcggcgccgcctgctggatcatcctgatggtgttcagcatctggctgtacagacacagaaagaagagaaacggcctgaccagcacctacgccggcatcagaaaggtgcccagcttcaccttcacccccaccgtgacctaccagagaggcggcgaggccgtgagcagcggcggcagacccggcctgctgaacatcagcgagcccgccgcccagccctggctggccgacacctggcccaacaccggcaacaaccacaacgactgcagcatcagctgctgcaccgccggcaacggcaacagcgacagcaacctgaccacctacagcagacccgccgactgcatcgccaactacaacaaccagctggacaacaagcagaccaacctgatgctgcccgagagcaccgtgtacggcgacgtggacctgagcaacaagatcaacgagatgaagaccttcaacagccccaacctgaaggacggcagattcgtgaaccccagcggccagcccaccccctacgccaccacccagctgatccagagcaacctgagcaacaacatgaacaacggcagcggcgacagcggcgagaagcactggaagcccctgggccagcagaagcaggaggtggcccccgtgcagtacaacatcgtggagcagaacaagctgaacaaggactacagagccaacgacaccgtgccccccaccatcccctacaaccagagctacgaccagaacaccggcggcagctacaacagcagcgacagaggcagcagcaccagcggcagccagggccacaagaagggcgccagaacccccaaggtgcccaagcagggcggcatgaactgggccgacctgctgccccccccccccgcccacccccccccccacagcaacagcgaggagtacaacatcagcgtggacgagagctacgaccaggagatgccctgccccgtgccccccgccagaatgtacctgcagcaggacgagctggaggaggaggaggacgagagaggccccaccccccccgtgagaggcgccgccagcagccccgccgccgtgagctacagccaccagagcaccgccaccctgacccccagcccccaggaggagctgcagcccatgctgcaggactgccccgaggagaccggccacatgcagcaccagcccgacagaagaagacagcccgtgagccccccccccccccccagacccatcagccccccccacacctacggctacatcagcggccccctggtgagcgacatggacaccgacgcccccgaggaggaggaggacgaggccgacatggaggtggccaagatgcagaccagaagactgctgctgagaggcctggagcagacccccgccagcagcgtgggcgacctggagagcagcgtgaccggcagcatgatcaacggctggggcagcgccagcgaggaggacaacatcagcagcggcagaagcagcgtgagcagcagcgacggcagcttcttcaccgacgccgacttcgcccaggccgtggccgccgccgccgagtacgccggcctgaaggtggccagaagacagatgcaggacgccgccggcagaagacacttccacgccagccagtgccccagacccaccagccccgtgagcaccgacagcaacatgagcgccgccgtgatgcagaagaccagacccgccaagaagctgaagcaccagcccggccacctgagaagagagacctacaccgacgacctgccccccccccccgtgcccccccccgccatcaagagccccaccgcccagagcaagacccagctggaggtgagacccgtggtggtgcccaagctgcccagcatggacgccagaaccgacagaagcagcgacagaaagggcagcagctacaagggcagagaggtgctggacggcagacaggtggtggacatgagaaccaaccccggcgaccccagagaggcccaggagcagcagaacgacggcaagggcagaggcaacaaggccgccaagagagacctgccccccgccaagacccacctgatccaggaggacatcctgccctactgcagacccaccttccccaccagcaacaaccccagagaccccagcagcagcagcagcatgagcagcagaggcagcggcagcagacagagagagcaggccaacgtgggcagaagaaacatcgccgagatgcaggtgctgggcggctacgagagaggcgaggacaacaacgaggagctggaggagcccagcagctag

SEQ ID NO: 97860 - DNA, 4839 bp, Artificial Sequence
  Description of Artificial Sequence: Synthetic coding sequence
atgatcgccgagcccgcccacttctacctgttcggcctgatctgcctgtgcagcggcagcagactgagacaggaggacttcccccccagaatcgtggagcaccccagcgacctgatcgtgagcaagggcgagcccgccaccctgaactgcaaggccgagggcagacccacccccaccatcgagtggtacaagggcggcgagagagtggagaccgacaaggacgaccccagaagccacagaatgctgctgcccagcggcagcctgttcttcctgagaatcgtgcacggcagaaagagcagacccgacgagggcgtgtacgtgtgcgtggccagaaactacctgggcgaggccgtgagccacaacgccagcctggaggtggccatcctgagagacgacttcagacagaaccccagcgacgtgatggtggccgtgggcgagcccgccgtgatggagtgccagccccccagaggccaccccgagcccaccatcagctggaagaaggacggcagccccctggacgacaaggacgagagaatcaccatcagaggcggcaagctgatgatcacctacaccagaaagagcgacgccggcaagtacgtgtgcgtgggcaccaacatggtgggcgagagagagagcgaggtggccgagctgaccgtgctggagagacccagcttcgtgaagagacccagcaacctggccgtgaccgtggacgacagcgccgagttcaagtgcgaggccagaggcgaccccgtgcccaccgtgagatggagaaaggacgacggcgagctgcccaagagcagatacgagatcagagacgaccacaccctgaagatcagaaaggtgaccgccggcgacatgggcagctacacctgcgtggccgagaacatggtgggcaaggccgaggccagcgccaccctgaccgtgcaggagcccccccacttcgtggtgaagcccagagaccaggtggtggccctgggcagaaccgtgaccttccagtgcgaggccaccggcaacccccagcccgccatcttctggagaagagagggcagccagaacctgctgttcagctaccagcccccccagagcagcagcagattcagcgtgagccagaccggcgacctgaccatcaccaacgtgcagagaagcgacgtgggctactacatctgccagaccctgaacgtggccggcagcatcatcaccaaggcctacctggaggtgaccgacgtgatcgccgacagacccccccccgtgatcagacagggccccgtgaaccagaccgtggccgtggacggcaccttcgtgctgagctgcgtggccaccggcagccccgtgcccaccatcctgtggagaaaggacggcgtgctggtgagcacccaggacagcagaatcaagcagctggagaacggcgtgctgcagatcagatacgccaagctgggcgacaccggcagatacacctgcatcgccagcacccccagcggcgaggccacctggagcgcctacatcgaggtgcaggagttcggcgtgcccgtgcagccccccagacccaccgaccccaacctgatccccagcgcccccagcaagcccgaggtgaccgacgtgagcagaaacaccgtgaccctgagctggcagcccaacctgaacagcggcgccacccccaccagctacatcatcgaggccttcagccacgccagcggcagcagctggcagaccgtggccgagaacgtgaagaccgagaccagcgccatcaagggcctgaagcccaacgccatctacctgttcctggtgagagccgccaacgcctacggcatcagcgaccccagccagatcagcgaccccgtgaagacccaggacgtgctgcccaccagccagggcgtggaccacaagcaggtgcagagagagctgggcaacgccgtgctgcacctgcacaaccccaccgtgctgagcagcagcagcatcgaggtgcactggaccgtggaccagcagagccagtacatccagggctacaagatcctgtacagacccagcggcgccaaccacggcgagagcgactggctggtgttcgaggtgagaacccccgccaagaacagcgtggtgatccccgacctgagaaagggcgtgaactacgagatcaaggccagacccttcttcaacgagttccagggcgccgacagcgagatcaagttcgccaagaccctggaggaggcccccagcgcccccccccagggcgtgaccgtgagcaagaacgacggcaacggcaccgccatcctggtgagctggcagcccccccccgaggacacccagaacggcatggtgcaggagtacaaggtgtggtgcctgggcaacgagaccagataccacatcaacaagaccgtggacggcagcaccttcagcgtggtgatccccttcctggtgcccggcatcagatacagcgtggaggtggccgccagcaccggcgccggcagcggcgtgaagagcgagccccagttcatccagctggacgcccacggcaaccccgtgagccccgaggaccaggtgagcctggcccagcagatcagcgacgtggtgaagcagcccgccttcatcgccggcatcggcgccgcctgctggatcatcctgatggtgttcagcatctggctgtacagacacagaaagaagagaaacggcctgaccagcacctacgccggcatcagaaaggtgcccagcttcaccttcacccccaccgtgacctaccagagaggcggcgaggccgtgagcagcggcggcagacccggcctgctgaacatcagcgagcccgccgcccagccctggctggccgacacctggcccaacaccggcaacaaccacaacgactgcagcatcagctgctgcaccgccggcaacggcaacagcgacagcaacctgaccacctacagcagacccgccgactgcatcgccaactacaacaaccagctggacaacaagcagaccaacctgatgctgcccgagagcaccgtgtacggcgacgtggacctgagcaacaagatcaacgagatgaagaccttcaacagccccaacctgaaggacggcagattcgtgaaccccagcggccagcccaccccctacgccaccacccagctgatccagagcaacctgagcaacaacatgaacaacggcagcggcgacagcggcgagaagcactggaagcccctgggccagcagaagcaggaggtggcccccgtgcagtacaacatcgtggagcagaacaagctgaacaaggactacagagccaacgacaccgtgccccccaccatcccctacaaccagagctacgaccagaacaccggcggcagctacaacagcagcgacagaggcagcagcaccagcggcagccagggccacaagaagggcgccagaacccccaaggtgcccaagcagggcggcatgaactgggccgacctgctgccccccccccccgcccacccccccccccacagcaacagcgaggagtacaacatcagcgtggacgagagctacgaccaggagatgccctgccccgtgccccccgccagaatgtacctgcagcaggacgagctggaggaggaggaggacgagagaggccccaccccccccgtgagaggcgccgccagcagccccgccgccgtgagctacagccaccagagcaccgccaccctgacccccagcccccaggaggagctgcagcccatgctgcaggactgccccgaggagaccggccacatgcagcaccagcccgacagaagaagacagcccgtgagccccccccccccccccagacccatcagccccccccacacctacggctacatcagcggccccctggtgagcgacatggacaccgacgcccccgaggaggaggaggacgaggccgacatggaggtggccaagatgcagaccagaagactgctgctgagaggcctggagcagacccccgccagcagcgtgggcgacctggagagcagcgtgaccggcagcatgatcaacggctggggcagcgccagcgaggaggacaacatcagcagcggcagaagcagcgtgagcagcagcgacggcagcttcttcaccgacgccgacttcgcccaggccgtggccgccgccgccgagtacgccggcctgaaggtggccagaagacagatgcaggacgccgccggcagaagacacttccacgccagccagtgccccagacccaccagccccgtgagcaccgacagcaacatgagcgccgccgtgatgcagaagaccagacccgccaagaagctgaagcaccagcccggccacctgagaagagagacctacaccgacgacctgccccccccccccgtgcccccccccgccatcaagagccccaccgcccagagcaagacccagctggaggtgagacccgtggtggtgcccaagctgcccagcatggacgccagaaccgacagaagcagcgacagaaagggcagcagctacaagggcagagaggtgctggacggcagacaggtggtggacatgagaaccaaccccggcgaccccagagaggcccaggagcagcagaacgacggcaagggcagaggcaacaaggccgccaagagagacctgccccccgccaagacccacctgatccaggaggacatcctgccctactgcagacccaccttccccaccagcaacaaccccagagaccccagcagcagcagcagcatgagcagcagaggcagcggcagcagacagagagagcaggccaacgtgggcagaagaaacatcgccgagatgcaggtgctgggcggctacgagagaggcgaggacaacaacgaggagctggaggagaccgagagctag

SEQ ID NO: 97861 - DNA, 4956 bp, Artificial Sequence
  Description of Artificial Sequence: Synthetic coding sequence
atgaagtggaagcacgtgcccttcctggtgatgatcagcctgctgagcctgagccccaaccacctgttcctggcccagctgatccccgaccccgaggacgtggagagaggcaacgaccacggcacccccatccccaccagcgacaacgacgacaacagcctgggctacaccggcagcagactgagacaggaggacttcccccccagaatcgtggagcaccccagcgacctgatcgtgagcaagggcgagcccgccaccctgaactgcaaggccgagggcagacccacccccaccatcgagtggtacaagggcggcgagagagtggagaccgacaaggacgaccccagaagccacagaatgctgctgcccagcggcagcctgttcttcctgagaatcgtgcacggcagaaagagcagacccgacgagggcgtgtacgtgtgcgtggccagaaactacctgggcgaggccgtgagccacaacgccagcctggaggtggccatcctgagagacgacttcagacagaaccccagcgacgtgatggtggccgtgggcgagcccgccgtgatggagtgccagccccccagaggccaccccgagcccaccatcagctggaagaaggacggcagccccctggacgacaaggacgagagaatcaccatcagaggcggcaagctgatgatcacctacaccagaaagagcgacgccggcaagtacgtgtgcgtgggcaccaacatggtgggcgagagagagagcgaggtggccgagctgaccgtgctggagagacccagcttcgtgaagagacccagcaacctggccgtgaccgtggacgacagcgccgagttcaagtgcgaggccagaggcgaccccgtgcccaccgtgagatggagaaaggacgacggcgagctgcccaagagcagatacgagatcagagacgaccacaccctgaagatcagaaaggtgaccgccggcgacatgggcagctacacctgcgtggccgagaacatggtgggcaaggccgaggccagcgccaccctgaccgtgcaggagcccccccacttcgtggtgaagcccagagaccaggtggtggccctgggcagaaccgtgaccttccagtgcgaggccaccggcaacccccagcccgccatcttctggagaagagagggcagccagaacctgctgttcagctaccagcccccccagagcagcagcagattcagcgtgagccagaccggcgacctgaccatcaccaacgtgcagagaagcgacgtgggctactacatctgccagaccctgaacgtggccggcagcatcatcaccaaggcctacctggaggtgaccgacgtgatcgccgacagacccccccccgtgatcagacagggccccgtgaaccagaccgtggccgtggacggcaccttcgtgctgagctgcgtggccaccggcagccccgtgcccaccatcctgtggagaaaggacggcgtgctggtgagcacccaggacagcagaatcaagcagctggagaacggcgtgctgcagatcagatacgccaagctgggcgacaccggcagatacacctgcatcgccagcacccccagcggcgaggccacctggagcgcctacatcgaggtgcaggagttcggcgtgcccgtgcagccccccagacccaccgaccccaacctgatccccagcgcccccagcaagcccgaggtgaccgacgtgagcagaaacaccgtgaccctgagctggcagcccaacctgaacagcggcgccacccccaccagctacatcatcgaggccttcagccacgccagcggcagcagctggcagaccgtggccgagaacgtgaagaccgagaccagcgccatcaagggcctgaagcccaacgccatctacctgttcctggtgagagccgccaacgcctacggcatcagcgaccccagccagatcagcgaccccgtgaagacccaggacgtgctgcccaccagccagggcgtggaccacaagcaggtgcagagagagctgggcaacgccgtgctgcacctgcacaaccccaccgtgctgagcagcagcagcatcgaggtgcactggaccgtggaccagcagagccagtacatccagggctacaagatcctgtacagacccagcggcgccaaccacggcgagagcgactggctggtgttcgaggtgagaacccccgccaagaacagcgtggtgatccccgacctgagaaagggcgtgaactacgagatcaaggccagacccttcttcaacgagttccagggcgccgacagcgagatcaagttcgccaagaccctggaggaggcccccagcgcccccccccagggcgtgaccgtgagcaagaacgacggcaacggcaccgccatcctggtgagctggcagcccccccccgaggacacccagaacggcatggtgcaggagtacaaggtgtggtgcctgggcaacgagaccagataccacatcaacaagaccgtggacggcagcaccttcagcgtggtgatccccttcctggtgcccggcatcagatacagcgtggaggtggccgccagcaccggcgccggcagcggcgtgaagagcgagccccagttcatccagctggacgcccacggcaaccccgtgagccccgaggaccaggtgagcctggcccagcagatcagcgacgtggtgaagcagcccgccttcatcgccggcatcggcgccgcctgctggatcatcctgatggtgttcagcatctggctgtacagacacagaaagaagagaaacggcctgaccagcacctacgccggcatcagaaaggtgcccagcttcaccttcacccccaccgtgacctaccagagaggcggcgaggccgtgagcagcggcggcagacccggcctgctgaacatcagcgagcccgccgcccagccctggctggccgacacctggcccaacaccggcaacaaccacaacgactgcagcatcagctgctgcaccgccggcaacggcaacagcgacagcaacctgaccacctacagcagacccgccgactgcatcgccaactacaacaaccagctggacaacaagcagaccaacctgatgctgcccgagagcaccgtgtacggcgacgtggacctgagcaacaagatcaacgagatgaagaccttcaacagccccaacctgaaggacggcagattcgtgaaccccagcggccagcccaccccctacgccaccacccagctgatccagagcaacctgagcaacaacatgaacaacggcagcggcgacagcggcgagaagcactggaagcccctgggccagcagaagcaggaggtggcccccgtgcagtacaacatcgtggagcagaacaagctgaacaaggactacagagccaacgacaccgtgccccccaccatcccctacaaccagagctacgaccagaacaccggcggcagctacaacagcagcgacagaggcagcagcaccagcggcagccagggccacaagaagggcgccagaacccccaaggtgcccaagcagggcggcatgaactgggccgacctgctgccccccccccccgcccacccccccccccacagcaacagcgaggagtacaacatcagcgtggacgagagctacgaccaggagatgccctgccccgtgccccccgccagaatgtacctgcagcaggacgagctggaggaggaggaggacgagagaggccccaccccccccgtgagaggcgccgccagcagccccgccgccgtgagctacagccaccagagcaccgccaccctgacccccagcccccaggaggagctgcagcccatgctgcaggactgccccgaggagaccggccacatgcagcaccagcccgacagaagaagacagcccgtgagccccccccccccccccagacccatcagccccccccacacctacggctacatcagcggccccctggtgagcgacatggacaccgacgcccccgaggaggaggaggacgaggccgacatggaggtggccaagatgcagaccagaagactgctgctgagaggcctggagcagacccccgccagcagcgtgggcgacctggagagcagcgtgaccggcagcatgatcaacggctggggcagcgccagcgaggaggacaacatcagcagcggcagaagcagcgtgagcagcagcgacggcagcttcttcaccgacgccgacttcgcccaggccgtggccgccgccgccgagtacgccggcctgaaggtggccagaagacagatgcaggacgccgccggcagaagacacttccacgccagccagtgccccagacccaccagccccgtgagcaccgacagcaacatgagcgccgccgtgatgcagaagaccagacccgccaagaagctgaagcaccagcccggccacctgagaagagagacctacaccgacgacctgccccccccccccgtgcccccccccgccatcaagagccccaccgcccagagcaagacccagctggaggtgagacccgtggtggtgcccaagctgcccagcatggacgccagaaccgacagaagcagcgacagaaagggcagcagctacaagggcagagaggtgctggacggcagacaggtggtggacatgagaaccaaccccggcgaccccagagaggcccaggagcagcagaacgacggcaagggcagaggcaacaaggccgccaagagagacctgccccccgccaagacccacctgatccaggaggacatcctgccctactgcagacccaccttccccaccagcaacaaccccagagaccccagcagcagcagcagcatgagcagcagaggcagcggcagcagacagagagagcaggccaacgtgggcagaagaaacatcgccgagatgcaggtgctgggcggctacgagagaggcgaggacaacaacgaggagctggaggagaccgagagctag

SEQ ID NO: 97862 - DNA, 4656 bp, Artificial Sequence
  Description of Artificial Sequence: Synthetic coding sequence
atgatcgccgagcccgcccacttctacctgttcggcctgatctgcctgtgcagcggcagcagactgagacaggaggacttcccccccagaatcgtggagcaccccagcgacctgatcgtgagcaagggcgagcccgccaccctgaactgcaaggccgagggcagacccacccccaccatcgagtggtacaagggcggcgagagagtggagaccgacaaggacgaccccagaagccacagaatgctgctgcccagcggcagcctgttcttcctgagaatcgtgcacggcagaaagagcagacccgacgagggcgtgtacgtgtgcgtggccagaaactacctgggcgaggccgtgagccacaacgccagcctggaggtggccatcctgagagacgacttcagacagaaccccagcgacgtgatggtggccgtgggcgagcccgccgtgatggagtgccagccccccagaggccaccccgagcccaccatcagctggaagaaggacggcagccccctggacgacaaggacgagagaatcaccatcagaggcggcaagctgatgatcacctacaccagaaagagcgacgccggcaagtacgtgtgcgtgggcaccaacatggtgggcgagagagagagcgaggtggccgagctgaccgtgctggagagacccagcttcgtgaagagacccagcaacctggccgtgaccgtggacgacagcgccgagttcaagtgcgaggccagaggcgaccccgtgcccaccgtgagatggagaaaggacgacggcgagctgcccaagagcagatacgagatcagagacgaccacaccctgaagatcagaaaggtgaccgccggcgacatgggcagctacacctgcgtggccgagaacatggtgggcaaggccgaggccagcgccaccctgaccgtgcaggtgggcagcgagcccccccacttcgtggtgaagcccagagaccaggtggtggccctgggcagaaccgtgaccttccagtgcgaggccaccggcaacccccagcccgccatcttctggagaagagagggcagccagaacctgctgttcagctaccagcccccccagagcagcagcagattcagcgtgagccagaccggcgacctgaccatcaccaacgtgcagagaagcgacgtgggctactacatctgccagaccctgaacgtggccggcagcatcatcaccaaggcctacctggaggtgaccgacgtgatcgccgacagacccccccccgtgatcagacagggccccgtgaaccagaccgtggccgtggacggcaccttcgtgctgagctgcgtggccaccggcagccccgtgcccaccatcctgtggagaaaggacggcgtgctggtgagcacccaggacagcagaatcaagcagctggagaacggcgtgctgcagatcagatacgccaagctgggcgacaccggcagatacacctgcatcgccagcacccccagcggcgaggccacctggagcgcctacatcgaggtgcaggagttcggcgtgcccgtgcagccccccagacccaccgaccccaacctgatccccagcgcccccagcaagcccgaggtgaccgacgtgagcagaaacaccgtgaccctgagctggcagcccaacctgaacagcggcgccacccccaccagctacatcatcgaggccttcagccacgccagcggcagcagctggcagaccgtggccgagaacgtgaagaccgagaccagcgccatcaagggcctgaagcccaacgccatctacctgttcctggtgagagccgccaacgcctacggcatcagcgaccccagccagatcagcgaccccgtgaagacccaggacgtgctgcccaccagccagggcgtggaccacaagcaggtgcagagagagctgggcaacgccgtgctgcacctgcacaaccccaccgtgctgagcagcagcagcatcgaggtgcactggaccgtggaccagcagagccagtacatccagggctacaagatcctgtacagacccagcggcgccaaccacggcgagagcgactggctggtgttcgaggtgagaacccccgccaagaacagcgtggtgatccccgacctgagaaagggcgtgaactacgagatcaaggccagacccttcttcaacgagttccagggcgccgacagcgagatcaagttcgccaagaccctggaggaggcccccagcgcccccccccagggcgtgaccgtgagcaagaacgacggcaacggcaccgccatcctggtgagctggcagcccccccccgaggacacccagaacggcatggtgcaggagtacaaggtgtggtgcctgggcaacgagaccagataccacatcaacaagaccgtggacggcagcaccttcagcgtggtgatccccttcctggtgcccggcatcagatacagcgtggaggtggccgccagcaccggcgccggcagcggcgtgaagagcgagccccagttcatccagctggacgcccacggcaaccccgtgagccccgaggaccaggtgagcctggcccagcagatcagcgacgtggtgaagcagcccgccttcatcgccggcatcggcgccgcctgctggatcatcctgatggtgttcagcatctggctgtacagacacagaaagaagagaaacggcctgaccagcacctacgccggcatcagaaaggtgacctaccagagaggcggcgaggccgtgagcagcggcggcagacccggcctgctgaacatcagcgagcccgccgcccagccctggctggccgacacctggcccaacaccggcaacaaccacaacgactgcagcatcagctgctgcaccgccggcaacggcaacagcgacagcaacctgaccacctacagcagacccggccagcccaccccctacgccaccacccagctgatccagagcaacctgagcaacaacatgaacaacggcagcggcgacagcggcgagaagcactggaagcccctgggccagcagaagcaggaggtggcccccgtgcagtacaacatcgtggagcagaacaagctgaacaaggactacagagccaacgacaccgtgccccccaccatcccctacaaccagagctacgaccagaacaccggcggcagctacaacagcagcgacagaggcagcagcaccagcggcagccagggccacaagaagggcgccagaacccccaaggtgcccaagcagggcggcatgaactgggccgacctgctgccccccccccccgcccacccccccccccacagcaacagcgaggagtacaacatcagcgtggacgagagctacgaccaggagatgccctgccccgtgccccccgccagaatgtacctgcagcaggacgagctggaggaggaggaggacgagagaggccccaccccccccgtgagaggcgccgccagcagccccgccgccgtgagctacagccaccagagcaccgccaccctgacccccagcccccaggaggagctgcagcccatgctgcaggactgccccgaggagaccggccacatgcagcaccagcccgacagaagaagacagcccgtgagccccccccccccccccagacccatcagccccccccacacctacggctacatcagcggccccctggtgagcgacatggacaccgacgcccccgaggaggaggaggacgaggccgacatggaggtggccaagatgcagaccagaagactgctgctgagaggcctggagcagacccccgccagcagcgtgggcgacctggagagcagcgtgaccggcagcatgatcaacggctggggcagcgccagcgaggaggacaacatcagcagcggcagaagcagcgtgagcagcagcgacggcagcttcttcaccgacgccgacttcgcccaggccgtggccgccgccgccgagtacgccggcctgaaggtggccagaagacagatgcaggacgccgccggcagaagacacttccacgccagccagtgccccagacccaccagccccgtgagcaccgacagcaacatgagcgccgccgtgatgcagaagaccagacccgccaagaagctgaagcaccagcccggccacctgagaagagagacctacaccgacgacctgccccccccccccgtgcccccccccgccatcaagagccccaccgcccagagcaagacccagctggaggtgagacccgtggtggtgcccaagctgcccagcatggacgccagaaccgacagaagcagcgacagaaagggcagcagctacaagggcagagaggtgctggacggcagacaggtggtggacatgagaaccaaccccggcgaccccagagaggcccaggagcagcagaacgacggcaagggcagaggcaacaaggccgccaagagagacctgccccccgccaagacccacctgatccaggaggacatcctgccctactgcagacccaccttccccaccagcaacaaccccagagaccccagcagcagcagcagcatgagcagcagaggcagcggcagcagacagagagagcaggccaacgtgggcagaagaaacatcgccgagatgcaggtgctgggcggctacgagagaggcgaggacaacaacgaggagctggaggagaccgagagctag

SEQ ID NO: 97863 - DNA, 4821 bp, Artificial Sequence
  Description of Artificial Sequence: Synthetic coding sequence
atgatcgccgagcccgcccacttctacctgttcggcctgatctgcctgtgcagcggcagcagactgagacaggaggacttcccccccagaatcgtggagcaccccagcgacctgatcgtgagcaagggcgagcccgccaccctgaactgcaaggccgagggcagacccacccccaccatcgagtggtacaagggcggcgagagagtggagaccgacaaggacgaccccagaagccacagaatgctgctgcccagcggcagcctgttcttcctgagaatcgtgcacggcagaaagagcagacccgacgagggcgtgtacgtgtgcgtggccagaaactacctgggcgaggccgtgagccacaacgccagcctggaggtggccatcctgagagacgacttcagacagaaccccagcgacgtgatggtggccgtgggcgagcccgccgtgatggagtgccagccccccagaggccaccccgagcccaccatcagctggaagaaggacggcagccccctggacgacaaggacgagagaatcaccatcagaggcggcaagctgatgatcacctacaccagaaagagcgacgccggcaagtacgtgtgcgtgggcaccaacatggtgggcgagagagagagcgaggtggccgagctgaccgtgctggagagacccagcttcgtgaagagacccagcaacctggccgtgaccgtggacgacagcgccgagttcaagtgcgaggccagaggcgaccccgtgcccaccgtgagatggagaaaggacgacggcgagctgcccaagagcagatacgagatcagagacgaccacaccctgaagatcagaaaggtgaccgccggcgacatgggcagctacacctgcgtggccgagaacatggtgggcaaggccgaggccagcgccaccctgaccgtgcaggtgggcagcgagcccccccacttcgtggtgaagcccagagaccaggtggtggccctgggcagaaccgtgaccttccagtgcgaggccaccggcaacccccagcccgccatcttctggagaagagagggcagccagaacctgctgttcagctaccagcccccccagagcagcagcagattcagcgtgagccagaccggcgacctgaccatcaccaacgtgcagagaagcgacgtgggctactacatctgccagaccctgaacgtggccggcagcatcatcaccaaggcctacctggaggtgaccgacgtgatcgccgacagacccccccccgtgatcagacagggccccgtgaaccagaccgtggccgtggacggcaccttcgtgctgagctgcgtggccaccggcagccccgtgcccaccatcctgtggagaaaggacggcgtgctggtgagcacccaggacagcagaatcaagcagctggagaacggcgtgctgcagatcagatacgccaagctgggcgacaccggcagatacacctgcatcgccagcacccccagcggcgaggccacctggagcgcctacatcgaggtgcaggagttcggcgtgcccgtgcagccccccagacccaccgaccccaacctgatccccagcgcccccagcaagcccgaggtgaccgacgtgagcagaaacaccgtgaccctgagctggcagcccaacctgaacagcggcgccacccccaccagctacatcatcgaggccttcagccacgccagcggcagcagctggcagaccgtggccgagaacgtgaagaccgagaccagcgccatcaagggcctgaagcccaacgccatctacctgttcctggtgagagccgccaacgcctacggcatcagcgaccccagccagatcagcgaccccgtgaagacccaggacgtgctgcccaccagccagggcgtggaccacaagcaggtgcagagagagctgggcaacgccgtgctgcacctgcacaaccccaccgtgctgagcagcagcagcatcgaggtgcactggaccgtggaccagcagagccagtacatccagggctacaagatcctgtacagacccagcggcgccaaccacggcgagagcgactggctggtgttcgaggtgagaacccccgccaagaacagcgtggtgatccccgacctgagaaagggcgtgaactacgagatcaaggccagacccttcttcaacgagttccagggcgccgacagcgagatcaagttcgccaagaccctggaggaggcccccagcgcccccccccagggcgtgaccgtgagcaagaacgacggcaacggcaccgccatcctggtgagctggcagcccccccccgaggacacccagaacggcatggtgcaggagtacaaggtgtggtgcctgggcaacgagaccagataccacatcaacaagaccgtggacggcagcaccttcagcgtggtgatccccttcctggtgcccggcatcagatacagcgtggaggtggccgccagcaccggcgccggcagcggcgtgaagagcgagccccagttcatccagctggacgcccacggcaaccccgtgagccccgaggaccaggtgagcctggcccagcagatcagcgacgtggtgaagcagcccgccttcatcgccggcatcggcgccgcctgctggatcatcctgatggtgttcagcatctggctgtacagacacagaaagaagagaaacggcctgaccagcacctacgccggcatcagaaaggtgacctaccagagaggcggcgaggccgtgagcagcggcggcagacccggcctgctgaacatcagcgagcccgccgcccagccctggctggccgacacctggcccaacaccggcaacaaccacaacgactgcagcatcagctgctgcaccgccggcaacggcaacagcgacagcaacctgaccacctacagcagacccgccgactgcatcgccaactacaacaaccagctggacaacaagcagaccaacctgatgctgcccgagagcaccgtgtacggcgacgtggacctgagcaacaagatcaacgagatgaagaccttcaacagccccaacctgaaggacggcagattcgtgaaccccagcggccagcccaccccctacgccaccacccagctgatccagagcaacctgagcaacaacatgaacaacggcagcggcgacagcggcgagaagcactggaagcccctgggccagcagaagcaggaggtggcccccgtgcagtacaacatcgtggagcagaacaagctgaacaaggactacagagccaacgacaccgtgccccccaccatcccctacaaccagagctacgaccagaacaccggcggcagctacaacagcagcgacagaggcagcagcaccagcggcagccagggccacaagaagggcgccagaacccccaaggtgcccaagcagggcggcatgaactgggccgacctgctgccccccccccccgcccacccccccccccacagcaacagcgaggagtacaacatcagcgtggacgagagctacgaccaggagatgccctgccccgtgccccccgccagaatgtacctgcagcaggacgagctggaggaggaggaggacgagagaggccccaccccccccgtgagaggcgccgccagcagccccgccgccgtgagctacagccaccagagcaccgccaccctgacccccagcccccaggaggagctgcagcccatgctgcaggactgccccgaggagaccggccacatgcagcaccagcccgacagaagaagacagcccgtgagccccccccccccccccagacccatcagccccccccacacctacggctacatcagcggccccctggtgagcgacatggacaccgacgcccccgaggaggaggaggacgaggccgacatggaggtggccaagatgcagaccagaagactgctgctgagaggcctggagcagacccccgccagcagcgtgggcgacctggagagcagcgtgaccggcagcatgatcaacggctggggcagcgccagcgaggaggacaacatcagcagcggcagaagcagcgtgagcagcagcgacggcagcttcttcaccgacgccgacttcgcccaggccgtggccgccgccgccgagtacgccggcctgaaggtggccagaagacagatgcaggacgccgccggcagaagacacttccacgccagccagtgccccagacccaccagccccgtgagcaccgacagcaacatgagcgccgccgtgatgcagaagaccagacccgccaagaagctgaagcaccagcccggccacctgagaagagagacctacaccgacgacctgccccccccccccgtgcccccccccgccatcaagagccccaccgcccagagcaagacccagctggaggtgagacccgtggtggtgcccaagctgcccagcatggacgccagaaccgacagaagcagcgacagaaagggcagcagctacaagggcagagaggtgctggacggcagacaggtggtggacatgagaaccaaccccggcgaccccagagaggcccaggagcagcagaacgacggcaagggcagaggcaacaaggccgccaagagagacctgccccccgccaagacccacctgatccaggaggacatcctgccctactgcagacccaccttccccaccagcaacaaccccagagaccccagcagcagcagcagcatgagcagcagaggcagcggcagcagacagagagagcaggccaacgtgggcagaagaaacatcgccgagatgcaggtgctgggcggctacgagagaggcgaggacaacaacgaggagctggaggagaccgagagctag

SEQ ID NO: 97864 - DNA, 3213 bp, Artificial Sequence
  Description of Artificial Sequence: Synthetic coding sequence
atggccagaagacacgagagagtgaccagaagaatgtggacctgggcccccggcctgctgatgatgaccgtggtgttctggggccaccagggcaacggccagggccagggcagcagactgagacaggaggacttcccccccagaatcgtggagcaccccagcgacgtgatcgtgagcaagggcgagcccaccaccctgaactgcaaggccgagggcagacccacccccaccatcgagtggtacaaggacggcgagagagtggagaccgacaaggacgaccccagaagccacagaatgctgctgcccagcggcagcctgttcttcctgagaatcgtgcacggcagaagaagcaagcccgacgagggcagctacgtgtgcgtggccagaaactacctgggcgaggccgtgagcagaaacgccagcctggaggtggccctgctgagagacgacttcagacagaaccccaccgacgtggtggtggccgccggcgagcccgccatcctggagtgccagccccccagaggccaccccgagcccaccatctactggaagaaggacaaggtgagaatcgacgacaaggaggagagaatcagcatcagaggcggcaagctgatgatcagcaacaccagaaagagcgacgccggcatgtacacctgcgtgggcaccaacatggtgggcgagagagacagcgaccccgccgagctgaccgtgttcgagagacccaccttcctgagaagacccatcaaccaggtggtgctggaggaggaggccgtggagttcagatgccaggtgcagggcgacccccagcccaccgtgagatggaagaaggacgacgccgacctgcccagaggcagatacgacatcaaggacgactacaccctgagaatcaagaagaccatgagcaccgacgagggcacctacatgtgcatcgccgagaacagagtgggcaagatggaggccagcgccaccctgaccgtgagaggcggcgtgatcgcccccccccagttcgtggtgagacccagagaccagatcgtggcccagggcagaaccgtgaccttcccctgcgagaccaagggcaacccccagcccgccgtgttctggcagaaggagggcagccagaacctgctgttccccaaccagccccagcagcccaacagcagatgcagcgtgagccccaccggcgacctgaccatcaccaacatccagagaagcgacgccggctactacatctgccaggccctgaccgtggccggcagcatcctggccaaggcccagctggaggtgaccgacgtgctgaccgacagacccccccccatcatcctgcagggccccgccaaccagaccctggccgtggacggcaccgccctgctgaagtgcaaggccaccggcgaccccctgcccgtgatcagctggctgaaggagggcttcaccttccccggcagagaccccagagccaccatccaggagcagggcaccctgcagatcaagaacctgagaatcagcgacaccggcacctacacctgcgtggccaccagcagcagcggcgagaccagctggagcgccgtgctggacgtgaccgagagcggcgccaccatcagcaagaactacgacctgagcgacctgcccggcccccccagcaagccccaggtgaccgacgtgaccaagaacagcgtgaccctgagctggcagcccggcacccccggcaccctgcccgccagcgcctacatcatcgaggccttcagccagagcgtgagcaacagctggcagaccgtggccaaccacgtgaagaccaccctgtacaccgtgagaggcctgagacccaacaccatctacctgttcatggtgagagccatcaacccccagggcctgagcgaccccagccccatgagcgaccccgtgagaacccaggacatcagcccccccgcccagggcgtggaccacagacaggtgcagaaggagctgggcgacgtgctggtgagactgcacaaccccgtggtgctgacccccaccaccgtgcaggtgacctggaccgtggacagacagccccagttcatccagggctacagagtgatgtacagacagaccagcggcctgcaggccaccagcagctggcagaacctggacgccaaggtgcccaccgagagaagcgccgtgctggtgaacctgaagaagggcgtgacctacgagatcaaggtgagaccctacttcaacgagttccagggcatggacagcgagagcaagaccgtgagaaccaccgaggaggcccccagcgcccccccccagagcgtgaccgtgctgaccgtgggcagctacaacagcaccagcatcagcgtgagctgggacccccccccccccgaccaccagaacggcatcatccaggagtacaagatctggtgcctgggcaacgagaccagattccacatcaacaagaccgtggacgccgccatcagaagcgtgatcatcggcggcctgttccccggcatccagtacagagtggaggtggccgccagcaccagcgccggcgtgggcgtgaagagcgagccccagcccatcatcatcggcagaagaaacgaggtggtgatcaccgagaacaacaacagcatcaccgagcagatcaccgacgtggtgaagcagcccgccttcatcgccggcatcggcggcgcctgctgggtgatcctgatgggcttcagcatctggctgtactggagaagaaagaagagaaagggcctgagcaactacgccgtgaccttccagagaggcgacggcggcctgatgagcaacggcagcagacccggcctgctgaacgccggcgaccccagctacccctggctggccgacagctggcccgccaccagcctgcccgtgaacaacagcaacagcggccccaacgagatcggcaacttcggcagaggcgacgtgctgccccccgtgcccggccagggcgacaagaccgccaccatgctgagcgacggcgccatctacagcagcatcgacttcaccaccaagaccagctacaacagcagcagccagatcacccaggccaccccctacgccaccacccagatcctgcacagcaacagcatccacgagctggccgtggacctgcccgacccccagtggaagagcagcatccagcagaagaccgacctgatgggcttcggctacagcctgcccgaccagaacaagggcaacaacggcgagagcggcagctag

SEQ ID NO: 97865 - DNA, 1713 bp, Artificial Sequence
  Description of Artificial Sequence: Synthetic coding sequence
atgagcaccgacgagggcacctacatgtgcatcgccgagaacagagtgggcaagatggaggccagcgccaccctgaccgtgagaggcggcgtgatcgcccccccccagttcgtggtgagacccagagaccagatcgtggcccagggcagaaccgtgaccttcccctgcgagaccaagggcaacccccagcccgccgtgttctggcagaaggagggcagccagaacctgctgttccccaaccagccccagcagcccaacagcagatgcagcgtgagccccaccggcgacctgaccatcaccaacatccagagaagcgacgccggctactacatctgccaggccctgaccgtggccggcagcatcctggccaaggcccagctggaggtgaccgacgtgctgaccgacagacccccccccatcatcctgcagggccccgccaaccagaccctggccgtggacggcaccgccctgctgaagtgcaaggccaccggcgaccccctgcccgtgatcagctggctgaaggagggcttcaccttccccggcagagaccccagagccaccatccaggagcagggcaccctgcagatcaagaacctgagaatcagcgacaccggcacctacacctgcgtggccaccagcagcagcggcgagaccagctggagcgccgtgctggacgtgaccgagagcggcgccaccatcagcaagaactacgacctgagcgacctgcccggcccccccagcaagccccaggtgaccgacgtgaccaagaacagcgtgaccctgagctggcagcccggcacccccggcaccctgcccgccagcgcctacatcatcgaggccttcagccagagcgtgagcaacagctggcagaccgtggccaaccacgtgaagaccaccctgtacaccgtgagaggcctgagacccaacaccatctacctgttcatggtgagagccatcaacccccagggcctgagcgaccccagccccatgagcgaccccgtgagaacccaggacatcagcccccccgcccagggcgtggaccacagacaggtgcagaaggagctgggcgacgtgctggtgagactgcacaaccccgtggtgctgacccccaccaccgtgcaggtgacctggaccgtggacagacagccccagttcatccagggctacagagtgatgtacagacagaccagcggcctgcaggccaccagcagctggcagaacctggacgccaaggtgcccaccgagagaagcgccgtgctggtgaacctgaagaagggcgtgacctacgagatcaaggtgagaccctacttcaacgagttccagggcatggacagcgagagcaagaccgtgagaaccaccgaggaggcccccagcgcccccccccagagcgtgaccgtgctgaccgtgggcagctacaacagcaccagcatcagcgtgagctgggacccccccccccccgaccaccagaacggcatcatccaggagtacaagatctggtgcctgggcaacgagaccagattccacatcaacaagaccgtggacgccgccatcagaagcgtgatcatcggcggcctgttccccggcatccagtacagagtggaggtggccgccagcaccagcgccggcgtgggcgtgaagagcgagccccagcccaacaacaccggctaccccatctgccacgacaccgacctggccttccagcagcacacctag

SEQ ID NO: 97866 - DNA, 4185 bp, Artificial Sequence
  Description of Artificial Sequence: Synthetic coding sequence
atggccagaagacacgagagagtgaccagaagaatgtggacctgggcccccggcctgctgatgatgaccgtggtgttctggggccaccagggcaacggccagggccagggcagcagactgagacaggaggacttcccccccagaatcgtggagcaccccagcgacgtgatcgtgagcaagggcgagcccaccaccctgaactgcaaggccgagggcagacccacccccaccatcgagtggtacaaggacggcgagagagtggagaccgacaaggacgaccccagaagccacagaatgctgctgcccagcggcagcctgttcttcctgagaatcgtgcacggcagaagaagcaagcccgacgagggcagctacgtgtgcgtggccagaaactacctgggcgaggccgtgagcagaaacgccagcctggaggtggccctgctgagagacgacttcagacagaaccccaccgacgtggtggtggccgccggcgagcccgccatcctggagtgccagccccccagaggccaccccgagcccaccatctactggaagaaggacaaggtgagaatcgacgacaaggaggagagaatcagcatcagaggcggcaagctgatgatcagcaacaccagaaagagcgacgccggcatgtacacctgcgtgggcaccaacatggtgggcgagagagacagcgaccccgccgagctgaccgtgttcgagagacccaccttcctgagaagacccatcaaccaggtggtgctggaggaggaggccgtggagttcagatgccaggtgcagggcgacccccagcccaccgtgagatggaagaaggacgacgccgacctgcccagaggcagatacgacatcaaggacgactacaccctgagaatcaagaagaccatgagcaccgacgagggcacctacatgtgcatcgccgagaacagagtgggcaagatggaggccagcgccaccctgaccgtgagagcccccccccagttcgtggtgagacccagagaccagatcgtggcccagggcagaaccgtgaccttcccctgcgagaccaagggcaacccccagcccgccgtgttctggcagaaggagggcagccagaacctgctgttccccaaccagccccagcagcccaacagcagatgcagcgtgagccccaccggcgacctgaccatcaccaacatccagagaagcgacgccggctactacatctgccaggccctgaccgtggccggcagcatcctggccaaggcccagctggaggtgaccgacgtgctgaccgacagacccccccccatcatcctgcagggccccgccaaccagaccctggccgtggacggcaccgccctgctgaagtgcaaggccaccggcgaccccctgcccgtgatcagctggctgaaggagggcttcaccttccccggcagagaccccagagccaccatccaggagcagggcaccctgcagatcaagaacctgagaatcagcgacaccggcacctacacctgcgtggccaccagcagcagcggcgagaccagctggagcgccgtgctggacgtgaccgagagcggcgccaccatcagcaagaactacgacctgagcgacctgcccggcccccccagcaagccccaggtgaccgacgtgaccaagaacagcgtgaccctgagctggcagcccggcacccccggcaccctgcccgccagcgcctacatcatcgaggccttcagccagagcgtgagcaacagctggcagaccgtggccaaccacgtgaagaccaccctgtacaccgtgagaggcctgagacccaacaccatctacctgttcatggtgagagccatcaacccccagggcctgagcgaccccagccccatgagcgaccccgtgagaacccaggacatcagcccccccgcccagggcgtggaccacagacaggtgcagaaggagctgggcgacgtgctggtgagactgcacaaccccgtggtgctgacccccaccaccgtgcaggtgacctggaccgtggacagacagccccagttcatccagggctacagagtgatgtacagacagaccagcggcctgcaggccaccagcagctggcagaacctggacgccaaggtgcccaccgagagaagcgccgtgctggtgaacctgaagaagggcgtgacctacgagatcaaggtgagaccctacttcaacgagttccagggcatggacagcgagagcaagaccgtgagaaccaccgaggaggcccccagcgcccccccccagagcgtgaccgtgctgaccgtgggcagctacaacagcaccagcatcagcgtgagctgggacccccccccccccgaccaccagaacggcatcatccaggagtacaagatctggtgcctgggcaacgagaccagattccacatcaacaagaccgtggacgccgccatcagaagcgtgatcatcggcggcctgttccccggcatccagtacagagtggaggtggccgccagcaccagcgccggcgtgggcgtgaagagcgagccccagcccatcatcatcggcagaagaaacgaggtggtgatcaccgagaacaacaacagcatcaccgagcagatcaccgacgtggtgaagcagcccgccttcatcgccggcatcggcggcgcctgctgggtgatcctgatgggcttcagcatctggctgtactggagaagaaagaagagaaagggcctgagcaactacgccgtgaccttccagagaggcgacggcggcctgatgagcaacggcagcagacccggcctgctgaacgccggcgaccccagctacccctggctggccgacagctggcccgccaccagcctgcccgtgaacaacagcaacagcggccccaacgagatcggcaacttcggcagaggcgacgtgctgccccccgtgcccggccagggcgacaagaccgccaccatgctgagcgacggcgccatctacagcagcatcgacttcaccaccaagaccagctacaacagcagcagccagatcacccaggccaccccctacgccaccacccagatcctgcacagcaacagcatccacgagctggccgtggacctgcccgacccccagtggaagagcagcatccagcagaagaccgacctgatgggcttcggctacagcctgcccgaccagaacaagggcaacaacggcggcaagggcggcaagaagaagaagaacaagaacagcagcaagccccagaagaacaacggcagcacctgggccaacgtgcccctgccccccccccccgtgcagcccctgcccggcaccgagctggagcactacgccgtggagcagcaggagaacggctacgacagcgacagctggtgcccccccctgcccgtgcagacctacctgcaccagggcctggaggacgagctggaggaggacgacgacagagtgcccaccccccccgtgagaggcgtggccagcagccccgccatcagcttcggccagcagagcaccgccaccctgacccccagccccagagaggagatgcagcccatgctgcaggcccacctggacgagctgaccagagcctaccagttcgacatcgccaagcagacctggcacatccagagcaacaaccagcccccccagccccccgtgccccccctgggctacgtgagcggcgccctgatcagcgacctggagaccgacgtggccgacgacgacgccgacgacgaggaggaggccctggagatccccagacccctgagagccctggaccagacccccggcagcagcatggacaacctggacagcagcgtgaccggcaaggccttcaccagcagccagagacccagacccaccagccccttcagcaccgacagcaacaccagcgccgccctgagccagagccagagacccagacccaccaagaagcacaagggcggcagaatggaccagcagcccgccctgccccacagaagagagggcatgaccgacgaggaggccctggtgccctacagcaagcccagcttccccagccccggcggccacagcagcagcggcaccgccagcagcaagggcagcaccggccccagaaagaccgaggtgctgagagccggccaccagagaaacgccagcgacctgctggacatcggctacatgggcagcaacagccagggccagttcaccggcgagctgtag

SEQ ID NO: 97867 - DNA, 4137 bp, Artificial Sequence
  Description of Artificial Sequence: Synthetic coding sequence
atgagcctgctgatgttcacccagctgctgctgtgcggcttcctgtacgtgagagtggacggcagcagactgagacaggaggacttcccccccagaatcgtggagcaccccagcgacgtgatcgtgagcaagggcgagcccaccaccctgaactgcaaggccgagggcagacccacccccaccatcgagtggtacaaggacggcgagagagtggagaccgacaaggacgaccccagaagccacagaatgctgctgcccagcggcagcctgttcttcctgagaatcgtgcacggcagaagaagcaagcccgacgagggcagctacgtgtgcgtggccagaaactacctgggcgaggccgtgagcagaaacgccagcctggaggtggccctgctgagagacgacttcagacagaaccccaccgacgtggtggtggccgccggcgagcccgccatcctggagtgccagccccccagaggccaccccgagcccaccatctactggaagaaggacaaggtgagaatcgacgacaaggaggagagaatcagcatcagaggcggcaagctgatgatcagcaacaccagaaagagcgacgccggcatgtacacctgcgtgggcaccaacatggtgggcgagagagacagcgaccccgccgagctgaccgtgttcgagagacccaccttcctgagaagacccatcaaccaggtggtgctggaggaggaggccgtggagttcagatgccaggtgcagggcgacccccagcccaccgtgagatggaagaaggacgacgccgacctgcccagaggcagatacgacatcaaggacgactacaccctgagaatcaagaagaccatgagcaccgacgagggcacctacatgtgcatcgccgagaacagagtgggcaagatggaggccagcgccaccctgaccgtgagagcccccccccagttcgtggtgagacccagagaccagatcgtggcccagggcagaaccgtgaccttcccctgcgagaccaagggcaacccccagcccgccgtgttctggcagaaggagggcagccagaacctgctgttccccaaccagccccagcagcccaacagcagatgcagcgtgagccccaccggcgacctgaccatcaccaacatccagagaagcgacgccggctactacatctgccaggccctgaccgtggccggcagcatcctggccaaggcccagctggaggtgaccgacgtgctgaccgacagacccccccccatcatcctgcagggccccgccaaccagaccctggccgtggacggcaccgccctgctgaagtgcaaggccaccggcgaccccctgcccgtgatcagctggctgaaggagggcttcaccttccccggcagagaccccagagccaccatccaggagcagggcaccctgcagatcaagaacctgagaatcagcgacaccggcacctacacctgcgtggccaccagcagcagcggcgagaccagctggagcgccgtgctggacgtgaccgagagcggcgccaccatcagcaagaactacgacctgagcgacctgcccggcccccccagcaagccccaggtgaccgacgtgaccaagaacagcgtgaccctgagctggcagcccggcacccccggcaccctgcccgccagcgcctacatcatcgaggccttcagccagagcgtgagcaacagctggcagaccgtggccaaccacgtgaagaccaccctgtacaccgtgagaggcctgagacccaacaccatctacctgttcatggtgagagccatcaacccccagggcctgagcgaccccagccccatgagcgaccccgtgagaacccaggacatcagcccccccgcccagggcgtggaccacagacaggtgcagaaggagctgggcgacgtgctggtgagactgcacaaccccgtggtgctgacccccaccaccgtgcaggtgacctggaccgtggacagacagccccagttcatccagggctacagagtgatgtacagacagaccagcggcctgcaggccaccagcagctggcagaacctggacgccaaggtgcccaccgagagaagcgccgtgctggtgaacctgaagaagggcgtgacctacgagatcaaggtgagaccctacttcaacgagttccagggcatggacagcgagagcaagaccgtgagaaccaccgaggaggcccccagcgcccccccccagagcgtgaccgtgctgaccgtgggcagctacaacagcaccagcatcagcgtgagctgggacccccccccccccgaccaccagaacggcatcatccaggagtacaagatctggtgcctgggcaacgagaccagattccacatcaacaagaccgtggacgccgccatcagaagcgtgatcatcggcggcctgttccccggcatccagtacagagtggaggtggccgccagcaccagcgccggcgtgggcgtgaagagcgagccccagcccatcatcatcggcagaagaaacgaggtggtgatcaccgagaacaacaacagcatcaccgagcagatcaccgacgtggtgaagcagcccgccttcatcgccggcatcggcggcgcctgctgggtgatcctgatgggcttcagcatctggctgtactggagaagaaagaagagaaagggcctgagcaactacgccgtgaccttccagagaggcgacggcggcctgatgagcaacggcagcagacccggcctgctgaacgccggcgaccccagctacccctggctggccgacagctggcccgccaccagcctgcccgtgaacaacagcaacagcggccccaacgagatcggcaacttcggcagaggcgacgtgctgccccccgtgcccggccagggcgacaagaccgccaccatgctgagcgacggcgccatctacagcagcatcgacttcaccaccaagaccagctacaacagcagcagccagatcacccaggccaccccctacgccaccacccagatcctgcacagcaacagcatccacgagctggccgtggacctgcccgacccccagtggaagagcagcatccagcagaagaccgacctgatgggcttcggctacagcctgcccgaccagaacaagggcaacaacggcggcaagggcggcaagaagaagaagaacaagaacagcagcaagccccagaagaacaacggcagcacctgggccaacgtgcccctgccccccccccccgtgcagcccctgcccggcaccgagctggagcactacgccgtggagcagcaggagaacggctacgacagcgacagctggtgcccccccctgcccgtgcagacctacctgcaccagggcctggaggacgagctggaggaggacgacgacagagtgcccaccccccccgtgagaggcgtggccagcagccccgccatcagcttcggccagcagagcaccgccaccctgacccccagccccagagaggagatgcagcccatgctgcaggcccacctggacgagctgaccagagcctaccagttcgacatcgccaagcagacctggcacatccagagcaacaaccagcccccccagccccccgtgccccccctgggctacgtgagcggcgccctgatcagcgacctggagaccgacgtggccgacgacgacgccgacgacgaggaggaggccctggagatccccagacccctgagagccctggaccagacccccggcagcagcatggacaacctggacagcagcgtgaccggcaaggccttcaccagcagccagagacccagacccaccagccccttcagcaccgacagcaacaccagcgccgccctgagccagagccagagacccagacccaccaagaagcacaagggcggcagaatggaccagcagcccgccctgccccacagaagagagggcatgaccgacgaggaggccctggtgccctacagcaagcccagcttccccagccccggcggccacagcagcagcggcaccgccagcagcaagggcagcaccggccccagaaagaccgaggtgctgagagccggccaccagagaaacgccagcgacctgctggacatcggctacatgggcagcaacagccagggccagttcaccggcgagctgtag

SEQ ID NO: 97868 - DNA, 4185 bp, Artificial Sequence; identical to SEQ ID NO: 97866
  Description of Artificial Sequence: Synthetic coding sequence

SEQ ID NO: 97869 - DNA, 4161 bp, Artificial Sequence
  Description of Artificial Sequence: Synthetic coding sequence
atgctgagatacctgctgaagaccctgctgcagatgaacctgttcgccgacagcctggccggcgacatcagcaacagcagcgagctgctgctgggcttcaacagcagcctggccgccctgaaccacaccctgctgccccccggcgaccccagcctgaacggcagcagagtgggccccgaggacgccatgcccagaatcgtggagcagccccccgacctgctggtgagcagaggcgagcccgccaccctgccctgcagagccgagggcagacccagacccaacatcgagtggtacaagaacggcgccagagtggccaccgtgagagaggaccccagagcccacagactgctgctgcccagcggcgccctgttcttccccagaatcgtgcacggcagaagagccagacccgacgagggcgtgtacacctgcgtggccagaaactacctgggcgccgccgccagcagaaacgccagcctggaggtggccgtgctgagagacgacttcagacagagccccggcaacgtggtggtggccgtgggcgagcccgccgtgctggagtgcgtgccccccagaggccaccccgagcccagcgtgagctggagaaaggacggcgccagactgaaggaggaggagggcagaatcaccatcagaggcggcaagctgatgatgagccacaccctgaagagcgacgccggcatgtacgtgtgcgtggccagcaacatggccggcgagagagagagcgccgccgccgaggtgatggtgctggagagacccagcttcctgagaagacccgtgaaccaggtggtgctggccgacgcccccgtgaccttcctgtgcgaggtgaagggcgaccccccccccagactgagatggagaaaggaggacggcgagctgcccaccggcagatacgagatcagaagcgaccacagcctgtggatcggccacgtgagcgccgaggacgagggcacctacacctgcgtggccgagaacagcgtgggcagagccgaggccagcggcagcctgagcgtgcacgtgcccccccagctggtgacccagccccaggaccagatggccgcccccggcgagagcgtggccttccagtgcgagaccaagggcaaccccccccccgccatcttctggcagaaggagggcagccaggtgctgctgttccccagccagagcctgcagcccaccggcagattcagcgtgagccccagaggccagctgaacatcaccgccgtgcagagaggcgacgccggctactacgtgtgccaggccgtgagcgtggccggcagcatcctggccaaggccctgctggagatcaagggcgccagcctggacggcctgccccccgtgatcctgcagggccccgccaaccagaccctggtgctgggcagcagcgtgtggctgccctgcagagtgaccggcaacccccagcccagcgtgagatggaagaaggacggccagtggctgcagggcgacgacctgcagttcaagaccatggccaacggcaccctgtacatcgccaacgtgcaggagatggacatgggcttctacagctgcgtggccaagagcagcaccggcgaggccacctggagcggctggctgaagatgagagaggactggggcgtgagccccgacccccccaccgagcccagcagcccccccggcgcccccagccagcccgtggtgaccgagatcaccaagaacagcatcaccctgacctggaagcccaacccccagaccggcgccgccgtgaccagctacgtgatcgaggccttcagccccgccgccggcaacacctggagaaccgtggccgacggcgtgcagctggagacccacaccgtgagcggcctgcagcccaacaccatctacctgttcctggtgagagccgtgggcgcctggggcctgagcgagcccagccccgtgagcgagcccgtgagaacccaggacagcagccccagcagacccgtggaggacccctggagaggccagcagggcctggccgaggtggccgtgagactgcaggagcccatcgtgctgggccccagaaccctgcaggtgagctggaccgtggacggccccgtgcagctggtgcagggcttcagagtgagctggagagtggccggccccgagggcggcagctggaccatgctggacctgcagagccccagccagcagagcaccgtgctgagaggcctgccccccggcacccagatccagatcaaggtgcaggcccagggccaggagggcctgggcgccgagagcctgagcgtgaccagaagcatccccgaggaggcccccagcggccccccccagggcgtggccgtggccctgggcggcgacggcaacagcagcatcaccgtgagctgggagccccccctgcccagccagcagaacggcgtgatcaccgagtaccagatctggtgcctgggcaacgagagcagattccacctgaacagaagcgccgccggctgggccagaagcgccatgctgagaggcctggtgcccggcctgctgtacagaaccctggtggccgccgccaccagcgccggcgtgggcgtgcccagcgcccccgtgctggtgcagctgcccagcccccccgacctggagcccggcctggaggtgggcgccggcctggccgtgagactggccagagtgctgagagagcccgccttcctggccggcagcggcgccgcctgcggcgccctgctgctgggcctgtgcgccgccctgtactggagaagaaagcagagaaaggagctgagccactacaccgccagcttcgcctacacccccgccgtgagcttcccccacagcgagggcctgagcggcgccagcagcagaccccccatgggcctgggccccgccccctacagctggctggccgacagctggccccaccccagcagaagccccagcgcccaggagcccagaggcagctgctgccccagcaaccccgaccccgacgacagatactacaacgaggccggcatcagcctgtacctggcccagaccgccagaggcaccgccgcccccggcgagggccccgtgtacagcaccatcgaccccgccggcgaggagctgcagaccttccacggcggcttcccccagcaccccagcggcgacctgggcccctggagccagtacgccccccccgagtggagccagggcgacagcggcgccaagggcggcaaggtgaagctgctgggcaagcccgtgcagatgcccagcctgaactggcccgaggccctgcccccccccccccccagctgcgagctgagctgcctggagggccccgaggaggagctggagggcagcagcgagcccgaggagtggtgcccccccatgcccgagagaagccacctgaccgagcccagcagcagcggcggctgcctggtgacccccagcagaagagagacccccagccccacccccagctacggccagcagagcaccgccaccctgacccccagcccccccgaccccccccagccccccaccgacatgccccacctgcaccagatgcccagaagagtgcccctgggccccagcagccccctgagcgtgagccagcccatgctgggcatcagagaggccagacccgccggcctgggcgccggccccgccgccagcccccacctgagccccagccccgcccccagcaccgccagcagcgcccccggcagaacctggcagggcaacggcgagatgaccccccccctgcagggccccagagccagattcagaaagaagcccaaggccctgccctacagaagagagaacagccccggcgacctgccccccccccccctgcccccccccgaggaggaggccagctgggccctggagctgagagccgccggcagcatgagcagcctggagagagagagaagcggcgagagaaaggccgtgcaggccgtgcccctggccgcccagagagtgctgcaccccgacgaggaggcctggctgccctacagcagacccagcttcctgagcagaggccagggcaccagcacctgcagcaccgccggcagcaacagcagcagaggcagcagcagcagcagaggcagcagaggccccggcagaagcagaagcagaagccagagcagaagccagagccagagacccggccagaagagaagagaggagcccagatag

SEQ ID NO: 97870 - DNA, 4095 bp, Artificial Sequence
  Description of Artificial Sequence: Synthetic coding sequence
atggagagacccgaggacagcctgagcctgtggagcctgaacctgagcccccagttcccctgcctgaacgccctgagacaccccctgagccccggcagcagagtgggccccgaggacgccatgcccagaatcgtggagcagccccccgacctgctggtgagcagaggcgagcccgccaccctgccctgcagagccgagggcagacccagacccaacatcgagtggtacaagaacggcgccagagtggccaccgtgagagaggaccccagagcccacagactgctgctgcccagcggcgccctgttcttccccagaatcgtgcacggcagaagagccagacccgacgagggcgtgtacacctgcgtggccagaaactacctgggcgccgccgccagcagaaacgccagcctggaggtggccgtgctgagagacgacttcagacagagccccggcaacgtggtggtggccgtgggcgagcccgccgtgctggagtgcgtgccccccagaggccaccccgagcccagcgtgagctggagaaaggacggcgccagactgaaggaggaggagggcagaatcaccatcagaggcggcaagctgatgatgagccacaccctgaagagcgacgccggcatgtacgtgtgcgtggccagcaacatggccggcgagagagagagcgccgccgccgaggtgatggtgctggagagacccagcttcctgagaagacccgtgaaccaggtggtgctggccgacgcccccgtgaccttcctgtgcgaggtgaagggcgaccccccccccagactgagatggagaaaggaggacggcgagctgcccaccggcagatacgagatcagaagcgaccacagcctgtggatcggccacgtgagcgccgaggacgagggcacctacacctgcgtggccgagaacagcgtgggcagagccgaggccagcggcagcctgagcgtgcacgtgcccccccagctggtgacccagccccaggaccagatggccgcccccggcgagagcgtggccttccagtgcgagaccaagggcaaccccccccccgccatcttctggcagaaggagggcagccaggtgctgctgttccccagccagagcctgcagcccaccggcagattcagcgtgagccccagaggccagctgaacatcaccgccgtgcagagaggcgacgccggctactacgtgtgccaggccgtgagcgtggccggcagcatcctggccaaggccctgctggagatcaagggcgccagcctggacggcctgccccccgtgatcctgcagggccccgccaaccagaccctggtgctgggcagcagcgtgtggctgccctgcagagtgaccggcaacccccagcccagcgtgagatggaagaaggacggccagtggctgcagggcgacgacctgcagttcaagaccatggccaacggcaccctgtacatcgccaacgtgcaggagatggacatgggcttctacagctgcgtggccaagagcagcaccggcgaggccacctggagcggctggctgaagatgagagaggactggggcgtgagccccgacccccccaccgagcccagcagcccccccggcgcccccagccagcccgtggtgaccgagatcaccaagaacagcatcaccctgacctggaagcccaacccccagaccggcgccgccgtgaccagctacgtgatcgaggccttcagccccgccgccggcaacacctggagaaccgtggccgacggcgtgcagctggagacccacaccgtgagcggcctgcagcccaacaccatctacctgttcctggtgagagccgtgggcgcctggggcctgagcgagcccagccccgtgagcgagcccgtgagaacccaggacagcagccccagcagacccgtggaggacccctggagaggccagcagggcctggccgaggtggccgtgagactgcaggagcccatcgtgctgggccccagaaccctgcaggtgagctggaccgtggacggccccgtgcagctggtgcagggcttcagagtgagctggagagtggccggccccgagggcggcagctggaccatgctggacctgcagagccccagccagcagagcaccgtgctgagaggcctgccccccggcacccagatccagatcaaggtgcaggcccagggccaggagggcctgggcgccgagagcctgagcgtgaccagaagcatccccgaggaggcccccagcggccccccccagggcgtggccgtggccctgggcggcgacggcaacagcagcatcaccgtgagctgggagccccccctgcccagccagcagaacggcgtgatcaccgagtaccagatctggtgcctgggcaacgagagcagattccacctgaacagaagcgccgccggctgggccagaagcgccatgctgagaggcctggtgcccggcctgctgtacagaaccctggtggccgccgccaccagcgccggcgtgggcgtgcccagcgcccccgtgctggtgcagctgcccagcccccccgacctggagcccggcctggaggtgggcgccggcctggccgtgagactggccagagtgctgagagagcccgccttcctggccggcagcggcgccgcctgcggcgccctgctgctgggcctgtgcgccgccctgtactggagaagaaagcagagaaaggagctgagccactacaccgccagcttcgcctacacccccgccgtgagcttcccccacagcgagggcctgagcggcgccagcagcagaccccccatgggcctgggccccgccccctacagctggctggccgacagctggccccaccccagcagaagccccagcgcccaggagcccagaggcagctgctgccccagcaaccccgaccccgacgacagatactacaacgaggccggcatcagcctgtacctggcccagaccgccagaggcaccgccgcccccggcgagggccccgtgtacagcaccatcgaccccgccggcgaggagctgcagaccttccacggcggcttcccccagcaccccagcggcgacctgggcccctggagccagtacgccccccccgagtggagccagggcgacagcggcgccaagggcggcaaggtgaagctgctgggcaagcccgtgcagatgcccagcctgaactggcccgaggccctgcccccccccccccccagctgcgagctgagctgcctggagggccccgaggaggagctggagggcagcagcgagcccgaggagtggtgcccccccatgcccgagagaagccacctgaccgagcccagcagcagcggcggctgcctggtgacccccagcagaagagagacccccagccccacccccagctacggccagcagagcaccgccaccctgacccccagcccccccgaccccccccagccccccaccgacatgccccacctgcaccagatgcccagaagagtgcccctgggccccagcagccccctgagcgtgagccagcccatgctgggcatcagagaggccagacccgccggcctgggcgccggccccgccgccagcccccacctgagccccagccccgcccccagcaccgccagcagcgcccccggcagaacctggcagggcaacggcgagatgaccccccccctgcagggccccagagccagattcagaaagaagcccaaggccctgccctacagaagagagaacagccccggcgacctgccccccccccccctgcccccccccgaggaggaggccagctgggccctggagctgagagccgccggcagcatgagcagcctggagagagagagaagcggcgagagaaaggccgtgcaggccgtgcccctggccgcccagagagtgctgcaccccgacgaggaggcctggctgccctacagcagacccagcttcctgagcagaggccagggcaccagcacctgcagcaccgccggcagcaacagcagcagaggcagcagcagcagcagaggcagcagaggccccggcagaagcagaagcagaagccagagcagaagccagagccagagacccggccagaagagaagagaggagcccagatag

SEQ ID NO: 97871 - DNA, 450 bp, Artificial Sequence
  Description of Artificial Sequence: Synthetic coding sequence
atgaccccccccctgcagggccccagagccagattcagaaagaagcccaaggccctgccctacagaagagagaacagccccggcgacctgccccccccccccctgcccccccccgaggaggaggccagctgggccctggagctgagagccgccggcagcatgagcagcctggagagagagagaagcggcgagagaaaggccgtgcaggccgtgcccctggccgcccagagagtgctgcaccccgacgaggaggcctggctgccctacagcagacccagcttcctgagcagaggccagggcaccagcacctgcagcaccgccggcagcaacagcagcagaggcagcagcagcagcagaggcagcagaggccccggcagaagcagaagcagaagccagagcagaagccagagccagagacccggccagaagagaagagaggagcccagatag

SEQ ID NO: 97872 - DNA, 3024 bp, Artificial Sequence
  Description of Artificial Sequence: Synthetic coding sequence
atgggcagcggcggcgacagcctgctgggcggcagaggcagcctgcccctgctgctgctgctgatcatgggcggcatggcccaggacagccccccccagatcctggtgcacccccaggaccagctgttccagggccccggccccgccagaatgagctgccaggccagcggccagcccccccccaccatcagatggctgctgaacggccagcccctgagcatggtgccccccgacccccaccacctgctgcccgacggcaccctgctgctgctgcagccccccgccagaggccacgcccacgacggccaggccctgagcaccgacctgggcgtgtacacctgcgaggccagcaacagactgggcaccgccgtgagcagaggcgccagactgagcgtggccgtgctgagagaggacttccagatccagcccagagacatggtggccgtggtgggcgagcagttcaccctggagtgcggccccccctggggccaccccgagcccaccgtgagctggtggaaggacggcaagcccctggccctgcagcccggcagacacaccgtgagcggcggcagcctgctgatggccagagccgagaagagcgacgagggcacctacatgtgcgtggccaccaacagcgccggccacagagagagcagagccgccagagtgagcatccaggagccccaggactacaccgagcccgtggagctgctggccgtgagaatccagctggagaacgtgaccctgctgaaccccgaccccgccgagggccccaagcccagacccgccgtgtggctgagctggaaggtgagcggccccgccgcccccgcccagagctacaccgccctgttcagaacccagaccgcccccggcggccagggcgccccctgggccgaggagctgctggccggctggcagagcgccgagctgggcggcctgcactggggccaggactacgagttcaaggtgagacccagcagcggcagagccagaggccccgacagcaacgtgctgctgctgagactgcccgagaaggtgcccagcgcccccccccaggaggtgaccctgaagcccggcaacggcaccgtgttcgtgagctgggtgcccccccccgccgagaaccacaacggcatcatcagaggctaccaggtgtggagcctgggcaacaccagcctgccccccgccaactggaccgtggtgggcgagcagacccagctggagatcgccacccacatgcccggcagctactgcgtgcaggtggccgccgtgaccggcgccggcgccggcgagcccagcagacccgtgtgcctgctgctggagcaggccatggagagagccacccaggagcccagcgagcacggcccctggaccctggagcagctgagagccaccctgaagagacccgaggtgatcgccacctgcggcgtggccctgtggctgctgctgctgggcaccgccgtgtgcatccacagaagaagaagagccagagtgcacctgggccccggcctgtacagatacaccagcgaggacgccatcctgaagcacagaatggaccacagcgacagccagtggctggccgacacctggagaagcaccagcggcagcagagacctgagcagcagcagcagcctgagcagcagactgggcgccgacgccagagaccccctggactgcagaagaagcctgctgagctgggacagcagaagccccggcgtgcccctgctgcccgacaccagcaccttctacggcagcctgatcgccgagctgcccagcagcacccccgccagacccagcccccaggtgcccgccgtgagaagactgcccccccagctggcccagctgagcagcccctgcagcagcagcgacagcctgtgcagcagaagaggcctgagcagccccagactgagcctggcccccgccgaggcctggaaggccaagaagaagcaggagctgcagcacgccaacagcagccccctgctgagaggcagccacagcctggagctgagagcctgcgagctgggcaacagaggcagcaagaacctgagccagagccccggcgccgtgccccaggccctggtggcctggagagccctgggccccaagctgctgagcagcagcaacgagctggtgaccagacacctgccccccgcccccctgttcccccacgagaccccccccacccagagccagcagacccagccccccgtggccccccaggcccccagcagcatcctgctgcccgccgcccccatccccatcctgagcccctgcagcccccccagcccccaggccagcagcctgagcggccccagccccgccagcagcagactgagcagcagcagcctgagcagcctgggcgaggaccaggacagcgtgctgacccccgaggaggtggccctgtgcctggagctgagcgagggcgaggagacccccagaaacagcgtgagccccatgcccagagcccccagcccccccaccacctacggctacatcagcgtgcccaccgccagcgagttcaccgacatgggcagaaccggcggcggcgtgggccccaagggcggcgtgctgctgtgcccccccagaccctgcctgacccccacccccagcgagggcagcctggccaacggctggggcagcgccagcgaggacaacgccgccagcgccagagccagcctggtgagcagcagcgacggcagcttcctggccgacgcccacttcgccagagccctggccgtggccgtggacagcttcggcttcggcctggagcccagagaggccgactgcgtgttcatcgacgccagcagcccccccagccccagagacgagatcttcctgacccccaacctgagcctgcccctgtgggagtggagacccgactggctggaggacatggaggtgagccacacccagagactgggcagaggcatgcccccctggccccccgacagccagatcagcagccagagaagccagctgcactgcagaatgcccaaggccggcgccagccccgtggactacagctag

SEQ ID NO: 97873 - DNA, 2106 bp, Artificial Sequence
  Description of Artificial Sequence: Synthetic coding sequence
atgggcagcggcggcgacagcctgctgggcggcagaggcagcctgcccctgctgctgctgctgatcatggtgctgagagaggacttccagatccagcccagagacatggtggccgtggtgggcgagcagttcaccctggagtgcggccccccctggggccaccccgagcccaccgtgagctggtggaaggacggcaagcccctggccctgcagcccggcagacacaccgtgagcggcggcagcctgctgatggccagagccgagaagagcgacgagggcacctacatgtgcgtggccaccaacagcgccggccacagagagagcagagccgccagagtgagcatccaggagccccaggactacaccgagcccgtggagctgctggccgtgagaatccagctggagaacgtgaccctgctgaaccccgaccccgccgagggccccaagcccagacccgccgtgtggctgagctggaaggtgagcggccccgccgcccccgcccagagctacaccgccctgttcagaacccagaccgcccccggcggccagggcgccccctgggccgaggagctgctggccggctggcagagcgccgagctgggcggcctgcactggggccaggactacgagttcaaggtgagacccagcagcggcagagccagaggccccgacagcaacgtgctgctgctgagactgcccgagaaggtgcccagcgcccccccccaggaggtgaccctgaagcccggcaacggcaccgtgttcgtgagctgggtgcccccccccgccgagaaccacaacggcatcatcagaggctaccaggtgtggagcctgggcaacaccagcctgccccccgccaactggaccgtggtgggcgagcagacccagctggagatcgccacccacatgcccggcagctactgcgtgcaggtggccgccgtgaccggcgccggcgccggcgagcccagcagacccgtgtgcctgctgctggagcaggccatggagagagccacccaggagcccagcgagcacggcccctggaccctggagcagctgagagccaccctgaagagacccgaggtgatcgccacctgcggcgtggccctgtggctgctgctgctgggcaccgccgtgtgcatccacagaagaagaagagccagagtgcacctgggccccggcctgtacagatacaccagcgaggacgccatcctgaagcacagaatggaccacagcgacagccagtggctggccgacacctggagaagcaccagcggcagcagagacctgagcagcagcagcagcctgagcagcagactgggcgccgacgccagagaccccctggactgcagaagaagcctgctgagctgggacagcagaagccccggcgtgcccctgctgcccgacaccagcaccttctacggcagcctgatcgccgagctgcccagcagcacccccgccagacccagcccccaggtgcccgccgtgagaagactgcccccccagctggcccagctgagcagcccctgcagcagcagcgacagcctgtgcagcagaagaggcctgagcagccccagactgagcctggcccccgccgaggcctggaaggccaagaagaagcaggagctgcagcacgccaacagcagccccctgctgagaggcagccacagcctggagctgagagcctgcgagctgggcaacagaggcagcaagaacctgagccagagccccggcgccgtgccccaggccctggtggcctggagagccctgggccccaagctgctgagcagcagcaacgagctggtgaccagacacctgccccccgcccccctgttcccccacgagaccccccccacccagagccagcagacccagccccccgtggccccccaggcccccagcagcatcctgctgcccgccgcccccatccccatcctgagcccctgcagcccccccagcccccaggccagcagcctgagcggccccagccccgccagcagcagactgagcagcagcagcctgagcagcctgggcgaggaccaggacagcgtgctgacccccgaggaggtggccctgtgcctggagctgagcgagggcgaggagaccccctag

SEQ ID NO: 97874 - DNA, 2589 bp, Artificial Sequence
  Description of Artificial Sequence: Synthetic coding sequence
atggtggccgtggtgggcgagcagttcaccctggagtgcggccccccctggggccaccccgagcccaccgtgagctggtggaaggacggcaagcccctggccctgcagcccggcagacacaccgtgagcggcggcagcctgctgatggccagagccgagaagagcgacgagggcacctacatgtgcgtggccaccaacagcgccggccacagagagagcagagccgccagagtgagcatccaggagccccaggactacaccgagcccgtggagctgctggccgtgagaatccagctggagaacgtgaccctgctgaaccccgaccccgccgagggccccaagcccagacccgccgtgtggctgagctggaaggtgagcggccccgccgcccccgcccagagctacaccgccctgttcagaacccagaccgcccccggcggccagggcgccccctgggccgaggagctgctggccggctggcagagcgccgagctgggcggcctgcactggggccaggactacgagttcaaggtgagacccagcagcggcagagccagaggccccgacagcaacgtgctgctgctgagactgcccgagaaggtgcccagcgcccccccccaggaggtgaccctgaagcccggcaacggcaccgtgttcgtgagctgggtgcccccccccgccgagaaccacaacggcatcatcagaggctaccaggtgtggagcctgggcaacaccagcctgccccccgccaactggaccgtggtgggcgagcagacccagctggagatcgccacccacatgcccggcagctactgcgtgcaggtggccgccgtgaccggcgccggcgccggcgagcccagcagacccgtgtgcctgctgctggagcaggccatggagagagccacccaggagcccagcgagcacggcccctggaccctggagcagctgagagccaccctgaagagacccgaggtgatcgccacctgcggcgtggccctgtggctgctgctgctgggcaccgccgtgtgcatccacagaagaagaagagccagagtgcacctgggccccggcctgtacagatacaccagcgaggacgccatcctgaagcacagaatggaccacagcgacagccagtggctggccgacacctggagaagcaccagcggcagcagagacctgagcagcagcagcagcctgagcagcagactgggcgccgacgccagagaccccctggactgcagaagaagcctgctgagctgggacagcagaagccccggcgtgcccctgctgcccgacaccagcaccttctacggcagcctgatcgccgagctgcccagcagcacccccgccagacccagcccccaggtgcccgccgtgagaagactgcccccccagctggcccagctgagcagcccctgcagcagcagcgacagcctgtgcagcagaagaggcctgagcagccccagactgagcctggcccccgccgaggcctggaaggccaagaagaagcaggagctgcagcacgccaacagcagccccctgctgagaggcagccacagcctggagctgagagcctgcgagctgggcaacagaggcagcaagaacctgagccagagccccggcgccgtgccccaggccctggtggcctggagagccctgggccccaagctgctgagcagcagcaacgagctggtgaccagacacctgccccccgcccccctgttcccccacgagaccccccccacccagagccagcagacccagccccccgtggccccccaggcccccagcagcatcctgctgcccgccgcccccatccccatcctgagcccctgcagcccccccagcccccaggccagcagcctgagcggccccagccccgccagcagcagactgagcagcagcagcctgagcagcctgggcgaggaccaggacagcgtgctgacccccgaggaggtggccctgtgcctggagctgagcgagggcgaggagacccccagaaacagcgtgagccccatgcccagagcccccagcccccccaccacctacggctacatcagcgtgcccaccgccagcgagttcaccgacatgggcagaaccggcggcggcgtgggccccaagggcggcgtgctgctgtgcccccccagaccctgcctgacccccacccccagcgagggcagcctggccaacggctggggcagcgccagcgaggacaacgccgccagcgccagagccagcctggtgagcagcagcgacggcagcttcctggccgacgcccacttcgccagagccctggccgtggccgtggacagcttcggcttcggcctggagcccagagaggccgactgcgtgttcatcgacgccagcagcccccccagccccagagacgagatcttcctgacccccaacctgagcctgcccctgtgggagtggagacccgactggctggaggacatggaggtgagccacacccagagactgggcagaggcatgcccccctggccccccgacagccagatcagcagccagagaagccagctgcactgcagaatgcccaaggccggcgccagccccgtggactacagctag

SEQ ID NO: 97875 - DNA, 3708 bp, Artificial Sequence
  Description of Artificial Sequence: Synthetic coding sequence
atgagcggccccaccgacgagaccgccggcgacctgcccgtgaaggacaccggcctgaacctgttcggcatgggcggcctgcaggagaccagcaccaccagaaccatgaagagcagacaggccgtgagcagagtgagcagagaggagctggaggacagattcctgagactgcacgacgagaacatcctgctgaagcagcacgccagaaagcaggaggacaagatcaagagaatggccaccaagctgatcagactggtgaacgacaagaagagatacgagagagtgggcggcggccccaagagactgggcagagacgtggagatggaggagatgatcgagcagctgcaggagaaggtgcacgagctggagaagcagaacgagaccctgaagaacagactgatcagcgccaagcagcagctgcagacccagggctacagacagaccccctacaacaacgtgcagagcagaatcaacaccggcagaagaaaggccaacgagaacgccggcctgcaggagtgccccagaaagggcatcaagttccaggacgccgacgtggccgagaccccccaccccatgttcaccaagtacggcaacagcctgctggaggaggccagaggcgagatcagaaacctggagaacgtgatccagagccagagaggccagatcgaggagctggagcacctggccgagatcctgaagacccagctgagaagaaaggagaacgagatcgagctgagcctgctgcagctgagagagcagcaggccaccgaccagagaagcaacatcagagacaacgtggagatgatcaagctgcacaagcagctggtggagaagagcaacgccctgagcgccatggagggcaagttcatccagctgcaggagaagcagagaaccctgagaatcagccacgacgccctgatggccaacggcgacgagctgaacatgcagctgaaggagcagagactgaagtgctgcagcctggagaagcagctgcacagcatgaagttcagcgagagaagaatcgaggagctgcaggacagaatcaacgacctggagaaggagagagagctgctgaaggagaactacgacaagctgtacgacagcgccttcagcgccgcccacgaggagcagtggaagctgaaggagcagcagctgaaggtgcagatcgcccagctggagaccgccctgaagagcgacctgaccgacaagaccgagatcctggacagactgaagaccgagagagaccagaacgagaagctggtgcaggagaacagagagctgcagctgcagtacctggagcagaagcagcagctggacgagctgaagaagagaatcaagctgtacaaccaggagaacgacatcaacgccgacgagctgagcgaggccctgctgctgatcaaggcccagaaggagcagaagaacggcgacctgagcttcctggtgaaggtggacagcgagatcaacaaggacctggagagaagcatgagagagctgcaggccacccacgccgagaccgtgcaggagctggagaagaccagaaacatgctgatcatgcagcacaagatcaacaaggactaccagatggaggtggaggccgtgaccagaaagatggagaacctgcagcaggactacgagctgaaggtggagcagtacgtgcacctgctggacatcagagccgccagaatccacaagctggaggcccagctgaaggacatcgcctacggcaccaagcagtacaagttcaagcccgagatcatgcccgacgacagcgtggacgagttcgacgagaccatccacctggagagaggcgagaacctgttcgagatccacatcaacaaggtgaccttcagcagcgaggtgctgcaggccagcggcgacaaggagcccgtgaccttctgcacctacgccttctacgacttcgagctgcagaccacccccgtggtgagaggcctgcaccccgagtacaacttcaccagccagtacctggtgcacgtgaacgacctgttcctgcagtacatccagaagaacaccatcaccctggaggtgcaccaggcctacagcaccgagtacgagaccatcgccgcctgccagctgaagttccacgagatcctggagaagagcggcagaatcttctgcaccgccagcctgatcggcaccaagggcgacatccccaacttcggcaccgtggagtactggttcagactgagagtgcccatggaccaggccatcagactgtacagagagagagccaaggccctgggctacatcaccagcaacttcaagggccccgagcacatgcagagcctgagccagcaggcccccaagaccgcccagctgagcagcaccgacagcaccgacggcaacctgaacgagctgcacatcaccatcagatgctgcaaccacctgcagagcagagccagccacctgcagccccacccctacgtggtgtacaagttcttcgacttcgccgaccacgacaccgccatcatccccagcagcaacgacccccagttcgacgaccacatgtacttccccgtgcccatgaacatggacctggacagatacctgaagagcgagagcctgagcttctacgtgttcgacgacagcgacacccaggagaacatctacatcggcaaggtgaacgtgcccctgatcagcctggcccacgacagatgcatcagcggcatcttcgagctgaccgaccaccagaagcaccccgccggcaccatccacgtgatcctgaagtggaagttcgcctacctgccccccagcggcagcatcaccaccgaggacctgggcaacttcatcagaagcgaggagcccgaggtggtgcagagactgccccccgccagcagcgtgagcaccctggtgctggcccccagacccaagcccagacagagactgacccccgtggacaagaaggtgagcttcgtggacatcatgccccaccagagcgacgtgagccaggagggcagcgtggacgaggtgaaggagaacaccgagaagatgcagcagggcaaggacgacgtgagcctgctgagcgagggccagctggccgagcagagcctggccagcagcgaggacgagaccgagatcaccgaggacctggagcccgaggtggaggaggacatgagcgccagcgacagcgacgactgcatcatccccggccccatcagcaagaacatcaagcagcccagcgagaagatcagaatcgagatcatcgccctgagcctgaacgacagccaggtgaccatggacgacaccatccagagactgttcgtggagtgcagattctacagcctgcccgccgaggagacccccgtgagcctgcccaagcccaagagcggccagtgggtgtactacaactacagcaacgtgatctacgtggacaaggagaacaacaaggccaagagagacatcctgaaggccatcctgcagaagcaggagatgcccaacagaagcctgagattcaccgtggtgagcgacccccccgaggacgagcaggacctggagtgcgaggacatcggcgtggcccacgtggacctggccgacatgttccaggagggcagagacctgatcgagcagaacatcgacgtgttcgacgccagagccgacggcgagggcatcggcaagctgagagtgaccgtggaggccctgcacgccctgcagagcgtgtacaagcagtacagagacgacctggaggcctag

SEQ ID NO: 97876 - DNA, 3948 bp, Artificial Sequence
  Description of Artificial Sequence: Synthetic coding sequence
atgagcggccccaccgacgagaccgccggcgacctgcccgtgaaggacaccggcctgaacctgttcggcatgggcggcctgcaggagaccagcaccaccagaaccatgaagagcagacaggccgtgagcagagtgagcagagaggagctggaggacagattcctgagactgcacgacgagaacatcctgctgaagcagcacgccagaaagcaggaggacaagatcaagagaatggccaccaagctgatcagactggtgaacgacaagaagagatacgagagagtgggcggcggccccaagagactgggcagagacgtggagatggaggagatgatcgagcagctgcaggagaaggtgcacgagctggagaagcagaacgagaccctgaagaacagactgatcagcgccaagcagcagctgcagacccagggctacagacagaccccctacaacaacgtgcagagcagaatcaacaccggcagaagaaaggccaacgagaacgccggcctgcaggagtgccccagaaagggcatcaagttccaggacgccgacgtggccgagaccccccaccccatgttcaccaagtacggcaacagcctgctggaggaggccagaggcgagatcagaaacctggagaacgtgatccagagccagagaggccagatcgaggagctggagcacctggccgagatcctgaagacccagctgagaagaaaggagaacgagatcgagctgagcctgctgcagctgagagagcagcaggccaccgaccagagaagcaacatcagagacaacgtggagatgatcaagctgcacaagcagctggtggagaagagcaacgccctgagcgccatggagggcaagttcatccagctgcaggagaagcagagaaccctgagaatcagccacgacgccctgatggccaacggcgacgagctgaacatgcagctgaaggagcagagactgaagtgctgcagcctggagaagcagctgcacagcatgaagttcagcgagagaagaatcgaggagctgcaggacagaatcaacgacctggagaaggagagagagctgctgaaggagaactacgacaagctgtacgacagcgccttcagcgccgcccacgaggagcagtggaagctgaaggagcagcagctgaaggtgcagatcgcccagctggagaccgccctgaagagcgacctgaccgacaagaccgagatcctggacagactgaagaccgagagagaccagaacgagaagctggtgcaggagaacagagagctgcagctgcagtacctggagcagaagcagcagctggacgagctgaagaagagaatcaagctgtacaaccaggagaacgacatcaacgccgacgagctgagcgaggccctgctgctgatcaaggcccagaaggagcagaagaacggcgacctgagcttcctggtgaaggtggacagcgagatcaacaaggacctggagagaagcatgagagagctgcaggccacccacgccgagaccgtgcaggagctggagaagaccagaaacatgctgatcatgcagcacaagatcaacaaggactaccagatggaggtggaggccgtgaccagaaagatggagaacctgcagcaggactacgagctgaaggtggagcagtacgtgcacctgctggacatcagagccgccagaatccacaagctggaggcccagctgaaggacatcgcctacggcaccaagcagtacaagttcaagcccgagatcatgcccgacgacagcgtggacgagttcgacgagaccatccacctggagagaggcgagaacctgttcgagatccacatcaacaaggtgaccttcagcagcgaggtgctgcaggccagcggcgacaaggagcccgtgaccttctgcacctacgccttctacgacttcgagctgcagaccacccccgtggtgagaggcctgcaccccgagtacaacttcaccagccagtacctggtgcacgtgaacgacctgttcctgcagtacatccagaagaacaccatcaccctggaggtgcaccaggcctacagcaccgagtacgagaccatcgccgcctgccagctgaagttccacgagatcctggagaagagcggcagaatcttctgcaccgccagcctgatcggcaccaagggcgacatccccaacttcggcaccgtggagtactggttcagactgagagtgcccatggaccaggccatcagactgtacagagagagagccaaggccctgggctacatcaccagcaacttcaagggccccgagcacatgcagagcctgagccagcaggcccccaagaccgcccagctgagcagcaccgacagcaccgacggcaacctgaacgagctgcacatcaccatcagatgctgcaaccacctgcagagcagagccagccacctgcagccccacccctacgtggtgtacaagttcttcgacttcgccgaccacgacaccgccatcatccccagcagcaacgacccccagttcgacgaccacatgtacttccccgtgcccatgaacatggacctggacagatacctgaagagcgagagcctgagcttctacgtgttcgacgacagcgacacccaggagaacatctacatcggcaaggtgaacgtgcccctgatcagcctggcccacgacagatgcatcagcggcatcttcgagctgaccgaccaccagaagcaccccgccggcaccatccacgtgatcctgaagtggaagttcgcctacctgccccccagcggcagcatcaccaccgaggacctgggcaacttcatcagaagcgaggagcccgaggtggtgcagagactgccccccgccagcagcgtgagcaccctggtgctggcccccagacccaagcccagacagagactgacccccgtggacaagaaggtgagcttcgtggacatcatgccccaccagagcgacgagaccagccccccccccgaggacagaaaggagatcagccccgaggtggagcacatccccgagatcgagatcaacatgctgaccgtgccccacgtgcccaaggtgagccaggagggcagcgtggacgaggtgaaggagaacaccgagaagatgcagcagggcaaggacgacgtgagcctgctgagcgagggccagctggccgagcagagcctggccagcagcgaggacgagaccgagatcaccgaggacctggagcccgaggtggaggaggacatgagcgccagcgacagcgacgactgcatcatccccggccccatcagcaagaacatcaagcagagcctggccctgagccccggcctgggctgcagcagcgccatcagcgcccactgcaacttcagactgcccggcagcagcgacttccccgccagcgccagccaggtggacggcatcaccggcgcctgccaccacacccagcccagcgagaagatcagaatcgagatcatcgccctgagcctgaacgacagccaggtgaccatggacgacaccatccagagactgttcgtggagtgcagattctacagcctgcccgccgaggagacccccgtgagcctgcccaagcccaagagcggccagtgggtgtactacaactacagcaacgtgatctacgtggacaaggagaacaacaaggccaagagagacatcctgaaggccatcctgcagaagcaggagatgcccaacagaagcctgagattcaccgtggtgagcgacccccccgaggacgagcaggacctggagtgcgaggacatcggcgtggcccacgtggacctggccgacatgttccaggagggcagagacctgatcgagcagaacatcgacgtgttcgacgccagagccgacggcgagggcatcggcaagctgagagtgaccgtggaggccctgcacgccctgcagagcgtgtacaagcagtacagagacgacctggaggcctag

SEQ ID NO: 97877 - DNA, 1956 bp, Artificial Sequence
  Description of Artificial Sequence: Synthetic coding sequence
atggccgcccccctgctgcacaccagactgcccggcgacgccgccgccagcagcagcgccgtgaagaagctgggcgccagcagaaccggcatcagcaacatgagagccctggagaacgacttcttcaacagcccccccagaaagaccgtgagattcggcggcaccgtgaccgaggtgctgctgaagtacaagaagggcgagaccaacgacttcgagctgctgaagaaccagctgctggaccccgacatcaaggacgaccagatcatcaactggctgctggagttcagaagcagcatcatgtacctgaccaaggacttcgagcagctgatcagcatcatcctgagactgccctggctgaacagaagccagaccgtggtggaggagtacctggccttcctgggcaacctggtgagcgcccagaccgtgttcctgagaccctgcctgagcatgatcgccagccacttcgtgccccccagagtgatcatcaaggagggcgacgtggacgtgagcgacagcgacgacgaggacgacaacctgcccgccaacttcgacacctgccacagagccctgcagatcatcgccagatacgtgcccagcaccccctggttcctgatgcccatcctggtggagaagttccccttcgtgagaaagagcgagagaaccctggagtgctacgtgcacaacctgctgagaatcagcgtgtacttccccaccctgagacacgagatcctggagctgatcatcgagaagctgctgaagctggacgtgaacgccagcagacagggcatcgaggacgccgaggagaccgccacccagacctgcggcggcaccgacagcaccgagggcctgttcaacatggacgaggacgaggagaccgagcacgagaccaaggccggccccgagagactggaccagatggtgcaccccgtggccgagagactggacatcctgatgagcctggtgctgagctacatgaaggacgtgtgctacgtggacggcaaggtggacaacggcaagaccaaggacctgtacagagacctgatcaacatcttcgacaagctgctgctgcccacccacgccagctgccacgtgcagttcttcatgttctacctgtgcagcttcaagctgggcttcgccgaggccttcctggagcacctgtggaagaagctgcaggaccccagcaaccccgccatcatcagacaggccgccggcaactacatcggcagcttcctggccagagccaagttcatccccctgatcaccgtgaagagctgcctggacctgctggtgaactggctgcacatctacctgaacaaccaggacagcggcaccaaggccttctgcgacgtggccctgcacggccccttctacagcgcctgccaggccgtgttctacaccttcgtgttcagacacaagcagctgctgagcggcaacctgaaggagggcctgcagtacctgcagagcctgaacttcgagagaatcgtgatgagccagctgaaccccctgaagatctgcctgcccagcgtggtgaacttcttcgccgccatcaccaacaagtaccagctggtgttctgctacaccatcatcgagagaaacaacagacagatgctgcccgtgatcagaagcaccgccggcggcgacagcgtgcagatctgcaccaaccccctggacaccttcttccccttcgacccctgcgtgctgaagagaagcaagaagttcatcgaccccatctaccaggtgtgggaggacatgagcgccgaggagctgcaggagttcaagaagcccatgaagaaggacatcgtggaggacgaggacgacgacttcctgaagggcgaggtgccccagaacgacaccgtgatcggcatcacccccagcagcttcgacacccacttcagaagccccagcagcagcgtgggcagcccccccgtgctgtacatgcagcccagccccctgtag

SEQ ID NO: 97878 - DNA, 1857 bp, Artificial Sequence
  Description of Artificial Sequence: Synthetic coding sequence
atgagagccctggagaacgacttcttcaacagcccccccagaaagaccgtgagattcggcggcaccgtgaccgaggtgctgctgaagtacaagaagggcgagaccaacgacttcgagctgctgaagaaccagctgctggaccccgacatcaaggacgaccagatcatcaactggctgctggagttcagaagcagcatcatgtacctgaccaaggacttcgagcagctgatcagcatcatcctgagactgccctggctgaacagaagccagaccgtggtggaggagtacctggccttcctgggcaacctggtgagcgcccagaccgtgttcctgagaccctgcctgagcatgatcgccagccacttcgtgccccccagagtgatcatcaaggagggcgacgtggacgtgagcgacagcgacgacgaggacgacaacctgcccgccaacttcgacacctgccacagagccctgcagatcatcgccagatacgtgcccagcaccccctggttcctgatgcccatcctggtggagaagttccccttcgtgagaaagagcgagagaaccctggagtgctacgtgcacaacctgctgagaatcagcgtgtacttccccaccctgagacacgagatcctggagctgatcatcgagaagctgctgaagctggacgtgaacgccagcagacagggcatcgaggacgccgaggagaccgccacccagacctgcggcggcaccgacagcaccgagggcctgttcaacatggacgaggacgaggagaccgagcacgagaccaaggccggccccgagagactggaccagatggtgcaccccgtggccgagagactggacatcctgatgagcctggtgctgagctacatgaaggacgtgtgctacgtggacggcaaggtggacaacggcaagaccaaggacctgtacagagacctgatcaacatcttcgacaagctgctgctgcccacccacgccagctgccacgtgcagttcttcatgttctacctgtgcagcttcaagctgggcttcgccgaggccttcctggagcacctgtggaagaagctgcaggaccccagcaaccccgccatcatcagacaggccgccggcaactacatcggcagcttcctggccagagccaagttcatccccctgatcaccgtgaagagctgcctggacctgctggtgaactggctgcacatctacctgaacaaccaggacagcggcaccaaggccttctgcgacgtggccctgcacggccccttctacagcgcctgccaggccgtgttctacaccttcgtgttcagacacaagcagctgctgagcggcaacctgaaggagggcctgcagtacctgcagagcctgaacttcgagagaatcgtgatgagccagctgaaccccctgaagatctgcctgcccagcgtggtgaacttcttcgccgccatcaccaacaagtaccagctggtgttctgctacaccatcatcgagagaaacaacagacagatgctgcccgtgatcagaagcaccgccggcggcgacagcgtgcagatctgcaccaaccccctggacaccttcttccccttcgacccctgcgtgctgaagagaagcaagaagttcatcgaccccatctaccaggtgtgggaggacatgagcgccgaggagctgcaggagttcaagaagcccatgaagaaggacatcgtggaggacgaggacgacgacttcctgaagggcgaggtgccccagaacgacaccgtgatcggcatcacccccagcagcttcgacacccacttcagaagccccagcagcagcgtgggcagcccccccgtgctgtacatgcagcccagccccctgtag

SEQ ID NO: 97879 - DNA, 1866 bp, Artificial Sequence
  Description of Artificial Sequence: Synthetic coding sequence
atggccgcccccctgctgcacaccagactgcccggcgacgccgccgccagcagcagcgccgtgaagaagctgggcgccagcagaaccggcatcagcaacatgagagccctggagaacgacttcttcaacagcccccccagaaagaccgtgagattcggcggcaccgtgaccgaggtgctgctgaagtacaagaagggcgagaccaacgacttcgagctgctgaagaaccagctgctggaccccgacatcaagagactgccctggctgaacagaagccagaccgtggtggaggagtacctggccttcctgggcaacctggtgagcgcccagaccgtgttcctgagaccctgcctgagcatgatcgccagccacttcgtgccccccagagtgatcatcaaggagggcgacgtggacgtgagcgacagcgacgacgaggacgacaacctgcccgccaacttcgacacctgccacagagccctgcagatcatcgccagatacgtgcccagcaccccctggttcctgatgcccatcctggtggagaagttccccttcgtgagaaagagcgagagaaccctggagtgctacgtgcacaacctgctgagaatcagcgtgtacttccccaccctgagacacgagatcctggagctgatcatcgagaagctgctgaagctggacgtgaacgccagcagacagggcatcgaggacgccgaggagaccgccacccagacctgcggcggcaccgacagcaccgagggcctgttcaacatggacgaggacgaggagaccgagcacgagaccaaggccggccccgagagactggaccagatggtgcaccccgtggccgagagactggacatcctgatgagcctggtgctgagctacatgaaggacgtgtgctacgtggacggcaaggtggacaacggcaagaccaaggacctgtacagagacctgatcaacatcttcgacaagctgctgctgcccacccacgccagctgccacgtgcagttcttcatgttctacctgtgcagcttcaagctgggcttcgccgaggccttcctggagcacctgtggaagaagctgcaggaccccagcaaccccgccatcatcagacaggccgccggcaactacatcggcagcttcctggccagagccaagttcatccccctgatcaccgtgaagagctgcctggacctgctggtgaactggctgcacatctacctgaacaaccaggacagcggcaccaaggccttctgcgacgtggccctgcacggccccttctacagcgcctgccaggccgtgttctacaccttcgtgttcagacacaagcagctgctgagcggcaacctgaaggagggcctgcagtacctgcagagcctgaacttcgagagaatcgtgatgagccagctgaaccccctgaagatctgcctgcccagcgtggtgaacttcttcgccgccatcaccaacaagtaccagctggtgttctgctacaccatcatcgagagaaacaacagacagatgctgcccgtgatcagaagcaccgccggcggcgacagcgtgcagatctgcaccaaccccctggacaccttcttccccttcgacccctgcgtgctgaagagaagcaagaagttcatcgaccccatctaccaggtgtgggaggacatgagcgccgaggagctgcaggagttcaagaagcccatgaagaaggacatcgtggaggacgaggacgacgacttcctgaagggcgaggtgccccagaacgacaccgtgatcggcatcacccccagcagcttcgacacccacttcagaagccccagcagcagcgtgggcagcccccccgtgctgtacatgcagcccagccccctgtag

SEQ ID NO: 97880 - DNA, 1410 bp, Artificial Sequence
  Description of Artificial Sequence: Synthetic coding sequence
atgatcgccagccacttcgtgccccccagagtgatcatcaaggagggcgacgtggacgtgagcgacagcgacgacgaggacgacaacctgcccgccaacttcgacacctgccacagagccctgcagatcatcgccagatacgtgcccagcaccccctggttcctgatgcccatcctggtggagaagttccccttcgtgagaaagagcgagagaaccctggtgaacgccagcagacagggcatcgaggacgccgaggagaccgccacccagacctgcggcggcaccgacagcaccgagggcctgttcaacatggacgaggacgaggagaccgagcacgagaccaaggccggccccgagagactggaccagatggtgcaccccgtggccgagagactggacatcctgatgagcctggtgctgagctacatgaaggacgtgtgctacgtggacggcaaggtggacaacggcaagaccaaggacctgtacagagacctgatcaacatcttcgacaagctgctgctgcccacccacgccagctgccacgtgcagttcttcatgttctacctgtgcagcttcaagctgggcttcgccgaggccttcctggagcacctgtggaagaagctgcaggaccccagcaaccccgccatcatcagacaggccgccggcaactacatcggcagcttcctggccagagccaagttcatccccctgatcaccgtgaagagctgcctggacctgctggtgaactggctgcacatctacctgaacaaccaggacagcggcaccaaggccttctgcgacgtggccctgcacggccccttctacagcgcctgccaggccgtgttctacaccttcgtgttcagacacaagcagctgctgagcggcaacctgaaggagggcctgcagtacctgcagagcctgaacttcgagagaatcgtgatgagccagctgaaccccctgaagatctgcctgcccagcgtggtgaacttcttcgccgccatcaccaacaagtaccagctggtgttctgctacaccatcatcgagagaaacaacagacagatgctgcccgtgatcagaagcaccgccggcggcgacagcgtgcagatctgcaccaaccccctggacaccttcttccccttcgacccctgcgtgctgaagagaagcaagaagttcatcgaccccatctaccaggtgtgggaggacatgagcgccgaggagctgcaggagttcaagaagcccatgaagaaggacatcgtggaggacgaggacgacgacttcctgaagggcgaggtgccccagaacgacaccgtgatcggcatcacccccagcagcttcgacacccacttcagaagccccagcagcagcgtgggcagcccccccgtgctgtacatgcagcccagccccctgtag

SEQ ID NO: 97881 - DNA, 792 bp, Artificial Sequence
  Description of Artificial Sequence: Synthetic coding sequence
atgagactgggcctgtgcgtggtggccctggtgctgagctggacccacctgaccatcagcagcagaggcatcaagggcaagagacagagaagaatcagcgccgagggcagccaggcctgcgccaagggctgcgagctgtgcagcgaggtgaacggctgcctgaagtgcagccccaagctgttcatcctgctggagagaaacgacatcagacaggtgggcgtgtgcctgcccagctgcccccccggctacttcgacgccagaaaccccgacatgaacaagtgcatcaagtgcaagatcgagcactgcgaggcctgcttcagccacaacttctgcaccaagtgcaaggagggcctgtacctgcacaagggcagatgctaccccgcctgccccgagggcagcagcgccgccaacggcaccatggagtgcagcagccccgcccagtgcgagatgagcgagtggagcccctggggcccctgcagcaagaagcagcagctgtgcggcttcagaagaggcagcgaggagagaaccagaagagtgctgcacgcccccgtgggcgaccacgccgcctgcagcgacaccaaggagaccagaagatgcaccgtgagaagagtgccctgccccgagggccagaagagaagaaagggcggccagggcagaagagagaacgccaacagaaacctggccagaaaggagagcaaggaggccggcgccggcagcagaagaagaaagggccagcagcagcagcagcagcagggcaccgtgggccccctgaccagcgccggccccgcctag

SEQ ID NO: 97882 - DNA, 792 bp, Artificial Sequence; identical to SEQ ID NO: 97881
  Description of Artificial Sequence: Synthetic coding sequence

SEQ ID NO: 97883 - DNA, 792 bp, Artificial Sequence; identical to SEQ ID NO: 97881
  Description of Artificial Sequence: Synthetic coding sequence

SEQ ID NO: 97884 - DNA, 603 bp, Artificial Sequence
  Description of Artificial Sequence: Synthetic coding sequence
atgagactgggcctgtgcgtggtggccctggtgctgagctggacccacctgaccatcagcagcagaggcatcaagggcaagagacagagaagaatcagcgccgagggcagccaggcctgcgccaagggctgcgagctgtgcagcgaggtgaacggctgcctgaagtgcagccccaagctgttcatcctgctggagagaaacgacatcagacaggtgggcgtgtgcctgcccagctgcccccccggctacttcgacgccagaaaccccgacatgaacaagtgcatcaagtgcaagatcgagcactgcgaggcctgcttcagccacaacttctgcaccaagtgcaaggagggcctgtacctgcacaagggcagatgctaccccgcctgccccgagggcagcagcgccgccaacggcaccatggagtgcagcagccccggccagaagagaagaaagggcggccagggcagaagagagaacgccaacagaaacctggccagaaaggagagcaaggaggccggcgccggcagcagaagaagaaagggccagcagcagcagcagcagcagggcaccgtgggccccctgaccagcgccggccccgcctag

SEQ ID NO: 97885 - DNA, 711 bp, Artificial Sequence
  Description of Artificial Sequence: Synthetic coding sequence
atgatcttcagagtgagcgccgagggcagccaggcctgcgccaagggctgcgagctgtgcagcgaggtgaacggctgcctgaagtgcagccccaagctgttcatcctgctggagagaaacgacatcagacaggtgggcgtgtgcctgcccagctgcccccccggctacttcgacgccagaaaccccgacatgaacaagtgcatcaagtgcaagatcgagcactgcgaggcctgcttcagccacaacttctgcaccaagtgcaaggagggcctgtacctgcacaagggcagatgctaccccgcctgccccgagggcagcagcgccgccaacggcaccatggagtgcagcagccccgcccagtgcgagatgagcgagtggagcccctggggcccctgcagcaagaagcagcagctgtgcggcttcagaagaggcagcgaggagagaaccagaagagtgctgcacgcccccgtgggcgaccacgccgcctgcagcgacaccaaggagaccagaagatgcaccgtgagaagagtgccctgccccgagggccagaagagaagaaagggcggccagggcagaagagagaacgccaacagaaacctggccagaaaggagagcaaggaggccggcgccggcagcagaagaagaaagggccagcagcagcagcagcagcagggcaccgtgggccccctgaccagcgccggccccgcctag

SEQ ID NO: 97886 - DNA, 732 bp, Artificial Sequence
  Description of Artificial Sequence: Synthetic coding sequence
atgcagttcagactgttcagcttcgccctgatcatcctgaactgcatggactacagccactgccagggcaacagatggagaagaagcaagagagccagctacgtgagcaaccccatctgcaagggctgcctgagctgcagcaaggacaacggctgcagcagatgccagcagaagctgttcttcttcctgagaagagagggcatgagacagtacggcgagtgcctgcacagctgccccagcggctactacggccacagagcccccgacatgaacagatgcgccagatgcagaatcgagaactgcgacagctgcttcagcaaggacttctgcaccaagtgcaaggtgggcttctacctgcacagaggcagatgcttcgacgagtgccccgacggcttcgcccccctggaggagaccatggagtgcgtggagggctgcgaggtgggccactggagcgagtggggcacctgcagcagaaacaacagaacctgcggcttcaagtggggcctggagaccagaaccagacagatcgtgaagaagcccgtgaaggacaccatcctgtgccccaccatcgccgagagcagaagatgcaagatgaccatgagacactgccccggcggcaagagaacccccaaggccaaggagaagagaaacaagaagaagaagagaaagctgatcgagagagcccaggagcagcacagcgtgttcctggccaccgacagagccaaccagtag

SEQ ID NO: 97887 - DNA, 540 bp, Artificial Sequence
  Description of Artificial Sequence: Synthetic coding sequence
atgcagttcagactgttcagcttcgccctgatcatcctgaactgcatggactacagccactgccagggcaacagatggagaagaagcaagagaggctgcagaatcgagaactgcgacagctgcttcagcaaggacttctgcaccaagtgcaaggtgggcttctacctgcacagaggcagatgcttcgacgagtgccccgacggcttcgcccccctggaggagaccatggagtgcgtgggctgcgaggtgggccactggagcgagtggggcacctgcagcagaaacaacagaacctgcggcttcaagtggggcctggagaccagaaccagacagatcgtgaagaagcccgtgaaggacaccatcctgtgccccaccatcgccgagagcagaagatgcaagatgaccatgagacactgccccggcggcaagagaacccccaaggccaaggagaagagaaacaagaagaagaagagaaagctgatcgagagagcccaggagcagcacagcgtgttcctggccaccgacagagccaaccagtag

SEQ ID NO: 97888 - DNA, 540 bp, Artificial Sequence; identical to SEQ ID NO: 97887
  Description of Artificial Sequence: Synthetic coding sequence

SEQ ID NO: 97889 - DNA, 531 bp, Artificial Sequence
  Description of Artificial Sequence: Synthetic coding sequence
atgagacagtacggcgagtgcctgcacagctgccccagcggctactacggccacagagcccccgacatgaacagatgcgccagatgcagaatcgagaactgcgacagctgcttcagcaaggacttctgcaccaagtgcaaggtgggcttctacctgcacagaggcagatgcttcgacgagtgccccgacggcttcgcccccctggaggagaccatggagtgcgtggagggctgcgaggtgggccactggagcgagtggggcacctgcagcagaaacaacagaacctgcggcttcaagtggggcctggagaccagaaccagacagatcgtgaagaagcccgtgaaggacaccatcctgtgccccaccatcgccgagagcagaagatgcaagatgaccatgagacactgccccggcggcaagagaacccccaaggccaaggagaagagaaacaagaagaagaagagaaagctgatcgagagagcccaggagcagcacagcgtgttcctggccaccgacagagccaaccagtag

SEQ ID NO: 97890 - DNA, 507 bp, Artificial Sequence
  Description of Artificial Sequence: Synthetic coding sequence
atgagacagtacggcgagtgcctgcacagctgccccagcggctactacggccacagagcccccgacatgaacagatgcgccagatgcagaatcgagaactgcgacagctgcttcagcaaggacttctgcaccaagtgcaaggtgggcttctacctgcacagaggcagatgcttcgacgagtgccccgacggcttcgcccccctggaggagaccatggagtgcgtggagggctgcgaggtgggccactggagcgagtggggcacctgcagcagaaacaacagaacctgcggcttcaagtggggcctggagaccagaaccagacagatcgtgaagaagcccgtgaaggacaccatcctgtgccccaccatcgccgagagcagaagatgcaagatgaccatgagacactgccccggcggcaagagaacccccaaggccaaggagaagagaaacaagaagaagaagagaaagctgatcgagagagcccaggagcagcacagcgtgttctag

SEQ ID NO: 97891 - DNA, 270 bp, Artificial Sequence
  Description of Artificial Sequence: Synthetic coding sequence
atgagacagtacggcgagtgcctgcacagctgccccagcggctactacggccacagagcccccgacatgaacagatgcgccagatgcagaatcgagaactgcgacagctgcttcagcaaggacttctgcaccaagtgcaaggtgggcttctacctgcacagaggcagatgcttcgacgagtgccccgacggcttcgcccccctggaggagaccatggagtgcgtggagggctgcgaggtgggccactggagcgagtggggcacctgctag

SEQ ID NO: 97892 - DNA, 366 bp, Artificial Sequence
  Description of Artificial Sequence: Synthetic coding sequence
atgcagttcagactgttcagcttcgccctgatcatcctgaactgcatggactacagccactgccagggcaacagatggagaagaagcaagagagccagctacgtgagcaaccccatctgcaagggctgcctgagctgcagcaaggacaacggctgcagcagatgccagcagaagctgttcttcttcctgagaagagagggcatgagacagtacggcgagtgcctgcacagctgccccagcggctactacggccacagagcccccgacatgaacagatgcgccagatgcagaatcgagaactgcgacagctgcttcagcaaggacttctgcaccaagtgcaaggtgggcttctacctgcacagatag

SEQ ID NO: 97893 - DNA, 234 bp, Artificial Sequence
  Description of Artificial Sequence: Synthetic coding sequence
atgcagttcagactgttcagcttcgccctgatcatcctgaactgcatggactacagccactgccagggcaacagatggagaagaagcaagagagccagctacgtgagcaaccccatctgcaagggctgcctgagctgcagcaaggacaacggctgcagcagatgccagcagaagctgttcttcttcctgagaagagagggcatgagacagtacggcgagtgcctgcacagctag

SEQ ID NO: 97894 - DNA, 1410 bp, Artificial Sequence
  Description of Artificial Sequence: Synthetic coding sequence
atggccttcctgatgcacctgctggtgtgcgtgttcggcatgggcagctgggtgaccatcaacggcctgtgggtggagctgcccctgctggtgatggagctgcccgagggctggtacctgcccagctacctgaccgtggtgatccagctggccaacatcggccccctgctggtgaccctgctgcaccacttcagacccagctgcctgagcgaggtgcccatcatcttcaccctgctgggcgtgggcaccgtgacctgcatcatcttcgccttcctgtggaacatgaccagctgggtgctggacggccaccacagcatcgccttcctggtgctgaccttcttcctggccctggtggactgcaccagcagcgtgaccttcctgcccttcatgagcagactgcccacctactacctgaccaccttcttcgtgggcgagggcctgagcggcctgctgcccgccctggtggccctggcccagggcagcggcctgaccacctgcgtgaacgtgaccgagatcagcgacagcgtgcccagccccgtgcccaccagagagaccgacatcgcccagggcgtgcccagagccctggtgagcgccctgcccggcatggaggcccccctgagccacctggagagcagatacctgcccgcccacttcagccccctggtgttcttcctgctgctgagcatcatgatggcctgctgcctggtggccttcttcgtgctgcagagacagcccagatgctgggaggccagcgtggaggacctgctgaacgaccaggtgaccctgcacagcatcagacccagagaggagaacgacctgggccccgccggcaccgtggacagcagccagggccagggctacctggaggagaaggccgccccctgctgccccgcccacctggccttcatctacaccctggtggccttcgtgaacgccctgaccaacggcatgctgcccagcgtgcagacctacagctgcctgagctacggccccgtggcctaccacctggccgccaccctgagcatcgtggccaaccccctggccagcctggtgagcatgttcctgcccaacagaagcctgctgttcctgggcgtgctgagcgtgctgggcacctgcttcggcggctacaacatggccatggccgtgatgagcccctgccccctgctgcagggccactggggcggcgaggtgctgatcgtggccagctgggtgctgttcagcggctgcctgagctacgtgaaggtgatgctgggcgtggtgctgagagacctgagcagaagcgccctgctgtggtgcggcgccgccgtgcagctgggcagcctgctgggcgccctgctgatgttccccctggtgaacgtgctgagactgttcagcagcgccgacttctgcaacctgcactgccccgcctag

SEQ ID NO: 97895 - DNA, 519 bp, Artificial Sequence
  Description of Artificial Sequence: Synthetic coding sequence
atgagagcccccctgtgcctgctgctgctggtggcccacgccgtggacatgctggccctgaacagaagaaagaagcaggtgggcaccggcctgggcggcaactgcaccggctgcatcatctgcagcgaggagaacggctgcagcacctgccagcagagactgttcctgttcatcagaagagagggcatcagacagtacggcaagtgcctgcacgactgcccccccggctacttcggcatcagaggccaggaggtgaacagatgcaagaagtgcggcgccacctgcgagagctgcttcagccaggacttctgcatcagatgcaagagacagttctacctgtacaagggcaagtgcctgcccacctgcccccccggcaccctggcccaccagaacaccagagagtgccaggagagaagccccggccagaagaagggcagaaaggacagaagacccagaaaggacagaaagctggacagaagactggacgtgagacccagacagcccggcctgcagccctag

SEQ ID NO: 97896 - DNA, 2133 bp, Artificial Sequence
  Description of Artificial Sequence: Synthetic coding sequence
atgagaggcagactgtgcgtgggcagagccgccgccgccgccgccgccgtggccgtgcccctggccggcggccaggagggcagccccggcggcggcagaagaggcagcagaggcaccaccatggtgaagaagagaaagggcagagtggtgatcgacagcgacaccgaggacagcggcagcgacgagaacctggaccaggagctgctgagcctggccaagagaaagagaagcgacagcgaggagaaggagccccccgtgagccagcccgccgccagcagcgacagcgagaccagcgacagcgacgacgagtggaccttcggcagcaacaagaacaagaagaagggcaaggccagaaagatcgagaagaagggcaccatgaagaagcaggccaacaagaccgccagcagcggcagcagcgacaaggacagcagcgccgagagcagcgcccccgaggagggcgaggtgagcgacagcgacagcaacagcagcagcagcagcagcgacagcgacagcagcagcgaggacgaggagttccacgacggctacggcgaggacctgatgggcgacgaggaggacagagccagactggagcagatgaccgagaaggagagagagcaggagctgttcaacagaatcgagaagagagaggtgctgaagagaagattcgagatcaagaagaagctgaagaccgccaagaagaaggagaagaaggagaagaagaagaagcaggaggaggagcaggagaagaagaagctgacccagatccaggagagccaggtgaccagccacaacaaggagagaagaagcaagagagacgagaagctggacaagaagagccaggccatggaggagctgaaggccgagagagagaagagaaagaacagaaccgccgagctgctggccaagaagcagcccctgaagaccagcgaggtgtacagcgacgacgaggaggaggaggaggacgacaagagcagcgagaagagcgacagaagcagcagaaccagcagcagcgacgaggaggaggagaaggaggagatcccccccaagagccagcccgtgagcctgcccgaggagctgaacagagtgagactgagcagacacaagctggagagatggtgccacatgcccttcttcgccaagaccgtgaccggctgcttcgtgagaatcggcatcggcaaccacaacagcaagcccgtgtacagagtggccgagatcaccggcgtggtggagaccgccaaggtgtaccagctgggcggcaccagaaccaacaagggcctgcagctgagacacggcaacgaccagagagtgttcagactggagttcgtgagcaaccaggagttcaccgagagcgagttcatgaagtggaaggaggccatgttcagcgccggcatgcagctgcccaccctggacgagatcaacaagaaggagctgagcatcaaggaggccctgaactacaagttcaacgaccaggacatcgaggagatcgtgaaggagaaggagagattcagaaaggccccccccaactacgccatgaagaagacccagctgctgaaggagaaggccatggccgaggacctgggcgaccaggacaaggccaagcagatccaggaccagctgaacgagctggaggagagagccgaggccctggacagacagagaaccaagaacatcagcgccatcagctacatcaaccagagaaacagagagtggaacatcgtggagagcgagaaggccctggtggccgagagccacaacatgaagaaccagcagatggaccccttcaccagaagacagtgcaagcccaccatcgtgagcaacagcagagaccccgccgtgcaggccgccatcctggcccagctgaacgccaagtacggcagcggcgtgctgcccgacgcccccaaggagatgagcaagggccagggcaaggacaaggacctgaacagcaagagcgccagcgacctgagcgaggacctgttcaaggtgcacgacttcgacgtgaagatcgacctgcaggtgcccagcagcgagagcaaggccctggccatcaccagcaaggccccccccgccaaggacggcgcccccagaagaagcctgaacctggaggactacaagaagagaagaggcctgatctag

SEQ ID NO: 97897 - DNA, 4551 bp, Artificial Sequence
  Description of Artificial Sequence: Synthetic coding sequence
atggacagcccccccaagctgaccggcgagaccctgatcgtgcaccacatccccctggtgcactgccaggtgcccgacagacagtgctgcggcggcgccggcggcggcggcggcagcaccagacccaaccccttctgcccccccgagctgggcatcacccagcccgaccaggacctgggccaggccgacagcctgctgttcagcagcctgcacagcacccccggcggcaccgccagaagcatcgacagcaccaagagcagaagcagagacggcagaggccccggcgcccccaagagacacaaccccttcctgctgcaggagggcgtgggcgagcccggcctgggcgacctgtacgacgacagcatcggcgacagcgccacccagcagagcttccacctgcacggcaccggccagcccaacttccacctgagcagcttccagctgccccccagcggccccagagtgggcagaccctggggcaccaccagaagcagagccggcgtggtggagggccaggagcaggagcccgtgatgaccctggacacccagcagtgcggcaccagccactgctgcagacccgagctggaggccgagaccatggagctggacgagtgcggcggccccggcggcagcggcagcggcggcggcgccagcgacaccagcggcttcagcttcgaccaggagtggaagctgagcagcgacgagagccccagaaaccccggctgcagcggcagcggcgaccagcactgcagatgcagcagcaccagcagccagagcgaggccgccgaccagagcatgggctacgtgagcgacagcagctgcaacagcagcgacggcgtgctggtgaccttcagcaccctgtacaacaagatgcacggcacccccagagccaacctgaacagcgccccccagagctgcagcgacagcagcttctgcagccacagcgaccccggcgccttctacctggacctgcagcccagccccttcgagagcaagatgagctacgagagccaccaccccgagagcggcggcagagagggcggctacggctgcccccacgccagcagccccgagctggacgccaactgcaacagctacagaccccactgcgagccctgccccgccgtggccgacctgaccgcctgcttccagagccaggccagactggtggtggccacccagaactactacaagctggtgacctgcgacctgagcagccagagcagccccagccccgccggcagcagcatcaccagctgcagcgaggagcacaccaagatcagccccccccccggccccggccccgaccccggccccagccagcccagcgagtactacctgttccagaagcccgaggtgcagcccgaggagcaggaggccgtgagcagcagcacccaggccgccgccgccgtgggccccaccgtgctggagggccaggtgtacaccaacaccagcccccccaacctgagcaccggcagacagagaagcagaagctacgacagaagcctgcagagaagcccccccgtgagactgggcagcctggagagaatgctgagctgccccgtgagactgagcgagggccccgccgccatggccggccccggcagcccccccagaagagtgaccagcttcgccgagctggccaagggcagaaagaagaccggcggcagcggcagcccccccctgagagtgagcgtgggcgacagcagccaggagttcagccccatccaggaggcccagcaggacagaggcgcccccctggacgagggcacctgctgcagccacagcctgccccccatgcccctgggccccggcatggacctgctgggccccgaccccagccccccctggagcacccaggtgtgccagggcccccacagcagcgagatgccccccgccggcctgagagccaccggccagggccccctggcccagctgatggaccccggccccgccctgcccggcagccccgccaacagccacacccagagagacgccagagccagagccgacggcggcggcaccgagagcagacccgtgctgagatacagcaaggagcagagacccaccaccctgcccatccagcccttcgtgttccagcaccacttccccaagcagctggccaaggccagagccctgcacagcctgagccagctgtacagcctgagcggctgcagcagaacccagcagcccgcccccctggccgcccccgccgcccaggtgagcgtgcccgcccccagcggcgagccccaggccagcacccccagagccaccggcagaggcgccagaaaggccggcagcgagcccgagaccagcagacccagccccctgggcagctacagccccatcagaagcgtgggccccttcggccccagcaccgacagcagcgccagcaccagctgcagccccccccccgagcagcccaccgccaccgagagcctgcccccctggagccacagctgccccagcgccgtgagacccgccaccagccagcagccccagaaggaggaccagaagatcctgaccctgaccgagtacagactgcacggcaccggcagcctgccccccctgggcagctggagaagcggcctgagcagagccgagagcctggccagaggcggcggcgagggcagcatggccaccagacccagcaacgccaaccacctgagcccccaggccctgaagtggagagagtacagaagaaagaaccccctgggcccccccggcctgagcggcagcctggacagaagaagccaggaggccagactggccagaagaaaccccatcttcgagttccccggcagcctgagcgccgccagccacctgaactgcagactgaacggccaggccgtgaagcccctgcccctgacctgccccgacttccaggaccccttcagcctgaccgagaagccccccgccgagttctgcctgagccccgacggcagcagcgaggccatcagcatcgacctgctgcagaagaagggcctggtgaaggccgtgaacatcgccgtggacctgatcgtggcccacttcggcaccagcagagaccccggcgtgaaggccaagctgggcaacagcagcgtgagccccaacgtgggccacctggtgctgaagtacctgtgccccgccgtgagagccgtgctggaggacggcctgaaggccttcgtgctggacgtgatcatcggccagagaaagaacatgccctggagcgtggtggaggccagcacccagctgggccccagcaccaaggtgctgcacggcctgtacaacaaggtgagccagttccccgagctgaccagccacaccatgagattcaacgccttcatcctgggcctgctgaacatcagaagcctggagttctggttcaaccacctgtacaaccacgaggacatcatccagacccactaccagccctggggcttcctgagcgccgcccacaccgtgtgccccggcctgttcgaggagctgctgctgctgctgcagcccctggccctgctgcccttcagcctggacctgctgttccagcacagactgctgcagagcggccagcagcagagacagcacaaggagctgctgagagtgagccaggacctgctgctgagcgcccacagcaccctgcagctggccagagccagaggccaggagggccccggcgacgtggacagagccgcccagggcgagagagtgaagggcgtgggcgccagcgagggcggcgaggaggaggaggaggaggaggagaccgaggaggtggccgaggccgccggcggcagcggcagagccagatgggccagaggcggccaggccggctggtggtaccagctgatgcagagcagccaggtgtacatcgacggcagcatcgagggcagcagattccccagaggcagcagcaacagcagcagcgagaagaagaagggcgccggcggcggcggccccccccaggcccccccccccagagagggcgtggtggagggcgccgaggcctgccccgccagcgaggaggccctgggcagagagagaggctggcccttctggatgggcagcccccccgacagcgtgctggccgagctgagaagaagcagagagagagagggccccgccgccagccccgccgagaacgaggagggcgccagcgagcccagccccggcggcatcaagtggggccacctgttcggcagcagaaaggcccagagagaggccagacccaccaacagactgcccagcgactggctgagcctggacaagagcatgttccagctggtggcccagaccgtgggcagcagaagagagcccgagcccaaggagagcctgcaggagccccacagccccgccctgcccagcagccccccctgcgaggtgcaggccctgtgccaccacctggccaccggccccggccagctgagcttccacaagggcgacatcctgagagtgctgggcagagccggcggcgactggctgagatgcagcagaggccccgacagcggcctggtgcccctggcctacgtgaccctgacccccacccccagccccacccccggcagcagccagaactag

SEQ ID NO: 97898 - DNA, 4551 bp, Artificial Sequence; identical to SEQ ID NO: 97897
  Description of Artificial Sequence: Synthetic coding sequence

SEQ ID NO: 97899 - DNA, 2775 bp, Artificial Sequence
  Description of Artificial Sequence: Synthetic coding sequence
atggacagcccccccaagctgaccggcgagaccctgatcgtgcaccacatccccctggtgcactgccaggtgcccgacagacagtgctgcggcggcgccggcggcggcggcggcagcaccagacccaaccccttctgcccccccgagctgggcatcacccagcccgaccaggacctgggccaggccgacagcctgctgttcagcagcctgcacagcacccccggcggcaccgccagaagcatcgacagcaccaagagcagaagcagagacggcagaggccccggcgcccccaagagacacaaccccttcctgctgcaggagggcgtgggcgagcccggcctgggcgacctgtacgacgacagcatcggcgacagcgccacccagcagagcttccacctgcacggcaccggccagcccaacttccacctgagcagcttccagctgccccccagcggccccagagtgggcagaccctggggcaccaccagaagcagagccggcgtggtggagggccaggagcaggagcccgtgatgaccctggacacccagcagtgcggcaccagccactgctgcagacccgagctggaggccgagaccatggagctggacgagtgcggcggccccggcggcagcggcagcggcggcggcgccagcgacaccagcggcttcagcttcgaccaggagtggaagctgagcagcgacgagagccccagaaaccccggctgcagcggcagcggcgaccagcactgcagatgcagcagcaccagcagccagagcgaggccgccgaccagagcatgggctacgtgagcgacagcagctgcaacagcagcgacggcgtgctggtgaccttcagcaccctgtacaacaagatgcacggcacccccagagccaacctgaacagcgccccccagagctgcagcgacagcagcttctgcagccacagcgaccccggcgccttctacctggacctgcagcccagccccttcgagagcaagatgagctacgagagccaccaccccgagagcggcggcagagagggcggctacggctgcccccacgccagcagccccgagctggacgccaactgcaacagctacagaccccactgcgagccctgccccgccgtggccgacctgaccgcctgcttccagagccaggccagactggtggtggccacccagaactactacaagctggtgacctgcgacctgagcagccagagcagccccagccccgccggcagcagcatcaccagctgcagcgaggagcacaccaagatcagccccccccccggccccggccccgaccccggccccagccagcccagcgagtactacctgttccagaagcccgaggtgcagcccgaggagcaggaggccgtgagcagcagcacccaggccgccgccgccgtgggccccaccgtgctggagggccaggtgtacaccaacaccagcccccccaacctgagcaccggcagacagagaagcagaagctacgacagaagcctgcagagaagcccccccgtgagactgggcagcctggagagaatgctgagctgccccgtgagactgagcgagggccccgccgccatggccggccccggcagcccccccagaagagtgaccagcttcgccgagctggccaagggcagaaagaagaccggcggcagcggcagcccccccctgagagtgagcgtgggcgacagcagccaggagttcagccccatccaggaggcccagcaggacagaggcgcccccctggacgagggcacctgctgcagccacagcctgccccccatgcccctgggccccggcatggacctgctgggccccgaccccagccccccctggagcacccaggtgtgccagggcccccacagcagcgagatgccccccgccggcctgagagccaccggccagggccccctggcccagctgatggaccccggccccgccctgcccggcagccccgccaacagccacacccagagagacgccagagccagagccgacggcggcggcaccgagagcagacccgtgctgagatacagcaaggagcagagacccaccaccctgcccatccagcccttcgtgttccagcaccacttccccaagcagctggccaaggccagagccctgcacagcctgagccagctgtacagcctgagcggctgcagcagaacccagcagcccgcccccctggccgcccccgccgcccaggtgagcgtgcccgcccccagcggcgagccccaggccagcacccccagagccaccggcagaggcgccagaaaggccggcagcgagcccgagaccagcagacccagccccctgggcagctacagccccatcagaagcgtgggccccttcggccccagcaccgacagcagcgccagcaccagctgcagccccccccccgagcagcccaccgccaccgagagcctgcccccctggagccacagctgccccagcgccgtgagacccgccaccagccagcagccccagaaggaggaccagaagatcctgaccctgaccgagtacagactgcacggcaccggcagcctgccccccctgggcagctggagaagcggcctgagcagagccgagagcctggccagaggcggcggcgagggcagcatggccaccagacccagcaacgccaaccacctgagcccccaggccctgaagtggagagagtacagaagaaagaaccccctgggcccccccggcctgagcggcagcctggacagaagaagccaggaggccagaaccggctag

SEQ ID NO: 97900 - DNA, 591 bp, Artificial Sequence
  Description of Artificial Sequence: Synthetic coding sequence
atgagcatgctgagactgcagaagagactggccagcagcgtgctgagatgcggcaagaagaaggtgtggctggaccccaacgagaccaacgagatcgccaacgccaacagcagacagcagatcagaaagctgatcaaggacggcctgatcatcagaaagcccgtgaccgtgcacagcagagccagatgcagaaagaacaccctggccagaagaaagggcagacacatgggcatcggcaagagaaagggcaccgccaacgccagaatgcccgagaaggtgacctggatgagaagaatgagaatcctgagaagactgctgagaagatacagagagagcaagaagatcgacagacacatgtaccacagcctgtacctgaaggtgaagggcaacgtgttcaagaacaagagaatcctgatggagcacatccacaagctgaaggccgacaaggccagaaagaagctgctggccgaccaggccgaggccagaagaagcaagaccaaggaggccagaaagagaagagaggagagactgcaggccaagaaggaggagatcatcaagaccctgagcaaggaggaggagaccaagaagtag

SEQ ID NO: 97901 - DNA, 1341 bp, Artificial Sequence
  Description of Artificial Sequence: Synthetic coding sequence
atggaggccagcttcgtgcagaccaccatggccctgggcctgagcagcaagaaggccagcagcagaaacgtggccgtggagagaaagaacctgatcaccgtgtgcagattcagcgtgaagaccctgctggagaagtacaccgccgagcccatcgacgacagcagcgaggagttcgtgaacttcgccgccatcctggagcagatcctgagccacagattcaaggcctgcgcccccgccggccccgtgagctggttcagcagcgacggccagagaggcttctgggactacatcagactggcctgcagcaaggtgcccaacaactgcgtgagcagcatcgagaacatggagaacatcagcaccgccagagccaagggcagagcctggatcagagtggccctgatggagaagagaatgagcgagtacatcaccaccgccctgagagacaccagaaccaccagaagattctacgacagcggcgccatcatgctgagagacgaggccaccatcctgaccggcatgctgatcggcctgagcgccatcgacttcagcttctgcctgaagggcgaggtgctggacggcaagacccccgtggtgatcgactacaccccctacctgaagttcacccagagctacgactacctgaccgacgaggaggagagacacagcgccgagagcagcaccagcgaggacaacagccccgagcacccctacctgcccctggtgaccgacgaggacagctggtacagcaagtggcacaagatggagcagaagttcagaatcgtgtacgcccagaagggctacctggaggagctggtgagactgagagagagccagctgaaggacctggaggccgagaacagaagactgcagctgcagctggaggaggccgccgcccagaaccagagagagaagagagagctggagggcgtgatcctggagctgcaggagcagctgaccggcctgatccccagcgaccacgcccccctggcccagggcagcaaggagctgaccacccccctggtgaaccagtggcccagcctgggcaccctgaacggcgccgagggcgccagcaacagcaagctgtacagaagacacagcttcatgagcaccgagcccctgagcgccgaggccagcctgagcagcgacagccagagactgggcgagggcaccagagacgaggagccctggggccccatcggcaaggaccccacccccagcatgctgggcctgtgcggcagcctggccagcatccccagctgcaagagcctggccagcttcaagagcaacgagtgcctggtgagcgacagccccgagggcagccccgccctgagccccagctag

SEQ ID NO: 97902 - DNA, 1371 bp, Artificial Sequence
  Description of Artificial Sequence: Synthetic coding sequence
atgaagatcgaggaggtgaagagcaccaccaagacccagagaatcgccagccacagccacgtgaagggcctgggcctggacgagagcggcctggccaagcaggccgccagcggcctggtgggccaggagaacgccagagaggcctgcggcgtgatcgtggagctgatcaagagcaagaagatggccggcagagccgtgctgctggccggcccccccggcaccggcaagaccgccctggccctggccatcgcccaggagctgggcagcaaggtgcccttctgccccatggtgggcagcgaggtgtacagcaccgagatcaagaagaccgaggtgctgatggagaacttcagaagagccatcggcctgagaatcaaggagaccaaggaggtgtacgagggcgaggtgaccgagctgaccccctgcgagaccgagaaccccatgggcggctacggcaagaccatcagccacgtgatcatcggcctgaagaccgccaagggcaccaagcagctgaagctggaccccagcatcttcgagagcctgcagaaggagagagtggaggccggcgacgtgatctacatcgaggccaacagcggcgccgtgaagagacagggcagatgcgacacctacgccaccgagttcgacctggaggccgaggagtacgtgcccctgcccaagggcgacgtgcacaagaagaaggagatcatccaggacgtgaccctgcacgacctggacgtggccaacgccagaccccagggcggccaggacatcctgagcatgatgggccagctgatgaagcccaagaagaccgagatcaccgacaagctgagaggcgagatcaacaaggtggtgaacaagtacatcgaccagggcatcgccgagctggtgcccggcgtgctgttcgtggacgaggtgcacatgctggacatcgagtgcttcacctacctgcacagagccctggagagcagcatcgcccccatcgtgatcttcgccagcaacagaggcaactgcgtgatcagaggcaccgaggacatcaccagcccccacggcatccccctggacctgctggacagagtgatgatcatcagaaccatgctgtacaccccccaggagatgaagcagatcatcaagatcagagcccagaccgagggcatcaacatcagcgaggaggccctgaaccacctgggcgagatcggcaccaagaccaccctgagatacagcgtgcagctgctgacccccgccaacctgctggccaagatcaacggcaaggacagcatcgagaaggagcacgtggaggagatcagcgagctgttctacgacgccaagagcagcgccaagatcctggccgaccagcaggacaagtacatgaagtag

SEQ ID NO: 97903 - DNA, 1161 bp, Artificial Sequence
  Description of Artificial Sequence: Synthetic coding sequence
atgaagatcgaggaggtgaagagcaccaccaagacccagagaatcgccagccacagccacgtgaagggcctgggcctggacgagagcggcctggccaagcaggccgccagcggcctggtgggccaggagaacgccagagaggcctgcggcgtgatcgtggagctgatcaagagcaagaagatggccggcagagccgtgctgctggccggcccccccggcaccggcaagaccgccctggccctggccatcgcccaggagctgggcagcaaggtgcccttctgccccatggtgggcagcgaggtgtacagcaccgagatcaagaagaccgaggtgctgatggagaacttcagaagagccatcggcctgagaatcaaggagaccaaggaggtgtacgagggcgaggtgaccgagctgaccccctgcgagaccgagaaccccatgggcggctacggcaagaccatcagccacgtgatcatcggcctgaagaccgccaagggcaccaagcagctgaagctggaccccagcatcttcgagagcctgcagaaggagagagtggaggccggcgacgtgatctacatcgaggccaacagcggcgccgtgaagagacagggcagatgcgacacctacgccaccgagttcgacctggaggccgaggagtacgtgcccctgcccaagggcgacgtgcacaagaagaaggagatcatccaggacgtgaccctgcacgacctggacgtggccaacgccagaccccagggcggccaggacatcctgagcatgatgggccagctgatgaagcccaagaagaccgagatcaccgacaagctgagaggcgagatcaacaaggtggtgaacaagtacatcgaccagggcatcgccgagctggtgcccggcgtgctgttcgtggacgaggtgcacatgctggacatcgagtgcttcacctacctgcacagagccctggagagcagcatcgcccccatcgtgatcttcgccagcaacagaggcaactgcgtgatcagaggcaccgaggacatcaccagcccccacggcatccccctggacctgctggacagagtgatgatcatcagaaccatgctgtacaccccccaggagatgaagcaggtgctgagcgccgccgccgaccccggccagctggcctgctag

SEQ ID NO: 97904 - DNA, 2502 bp, Artificial Sequence; identical to SEQ ID NO: 89408
  Description of Artificial Sequence: Synthetic coding sequence

SEQ ID NO: 97905 - DNA, 1257 bp, Artificial Sequence
  Description of Artificial Sequence: Synthetic coding sequence
atggtgggccagctggccgccagaagagccgccggcgtggtgctggagatgatcagagagggcaagatcgccggcagagccgtgctgatcgccggccagcccggcaccggcaagaccgccatcgccatgggcatggcccaggccctgggccccgacacccccttcaccgccatcgccggcagcgagatcttcagcctggagatgagcaagaccgaggccctgacccaggccttcagaagaagcatcggcgtgagaatcaaggaggagaccgagatcatcgagggcgaggtggtggagatccagatcgacagacccgccaccggcaccggcagcaaggtgggcaagctgaccctgaagaccaccgagatggagaccatctacgacctgggcaccaagatgatcgagagcctgaccaaggacaaggtgcaggccggcgacgtgatcaccatcgacaaggccaccggcaagatcagcaagctgggcagaagcttcaccagagccagagactacgacgccatgggcagccagaccaagttcgtgcagtgccccgacggcgagctgcagaagagaaaggaggtggtgcacaccgtgagcctgcacgagatcgacgtgatcaacagcagaacccagggcttcctggccctgttcagcggcgacaccggcgagatcaagagcgaggtgagagagcagatcaacgccaaggtggccgagtggagagaggagggcaaggccgagatcatccccggcgtgctgttcatcgacgaggtgcacatgctggacatcgagagcttcagcttcctgaacagagccctggagagcgacatggcccccgtgctgatcatggccaccaacagaggcatcaccagaatcagaggcaccagctaccagagcccccacggcatccccatcgacctgctggacagactgctgatcgtgagcaccaccccctacagcgagaaggacaccaagcagatcctgagaatcagatgcgaggaggaggacgtggagatgagcgaggacgcctacaccgtgctgaccagaatcggcctggagaccagcctgagatacgccatccagctgatcaccgccgccagcctggtgtgcagaaagagaaagggcaccgaggtgcaggtggacgacatcaagagagtgtacagcctgttcctggacgagagcagaagcacccagtacatgaaggagtaccaggacgccttcctgttcaacgagctgaagggcgagaccatggacaccagctag

SEQ ID NO: 97906 - DNA, 1392 bp, Artificial Sequence; identical to SEQ ID NO: 80441
  Description of Artificial Sequence: Synthetic coding sequence

SEQ ID NO: 97907 - DNA, 15102 bp, Artificial Sequence
  Description of Artificial Sequence: Synthetic coding sequence
atgggcgacgccgagggcgaggacgaggtgcagttcctgagaaccgacgacgaggtggtgctgcagtgcagcgccaccgtgctgaaggagcagctgaagctgtgcctggccgccgagggcttcggcaacagactgtgcttcctggagcccaccagcaacgcccagaacgtgccccccgacctggccatctgctgcttcgtgctggagcagagcctgagcgtgagagccctgcaggagatgctggccaacaccgtggaggccggcgtggagagcagccagggcggcggccacagaaccctgctgtacggccacgccatcctgctgagacacgcccacagcagaatgtacctgagctgcctgaccaccagcagaagcatgaccgacaagctggccttcgacgtgggcctgcaggaggacgccaccggcgaggcctgctggtggaccatgcaccccgccagcaagcagagaagcgagggcgagaaggtgagagtgggcgacgacatcatcctggtgagcgtgagcagcgagagatacctgcacctgagcaccgccagcggcgagctgcaggtggacgccagcttcatgcagaccctgtggaacatgaaccccatctgcagcagatgcgaggagggcttcgtgaccggcggccacgtgctgagactgttccacggccacatggacgagtgcctgaccatcagccccgccgacagcgacgaccagagaagactggtgtactacgagggcggcgccgtgtgcacccacgccagaagcctgtggagactggagcccctgagaatcagctggagcggcagccacctgagatggggccagcccctgagagtgagacacgtgaccaccggccagtacctggccctgaccgaggaccagggcctggtggtggtggacgccagcaaggcccacaccaaggccaccagcttctgcttcagaatcagcaaggagaagctggacgtggcccccaagagagacgtggagggcatgggcccccccgagatcaagtacggcgagagcctgtgcttcgtgcagcacgtggccagcggcctgtggctgacctacgccgcccccgaccccaaggccctgagactgggcgtgctgaagaagaaggccatgctgcaccaggagggccacatggacgacgccctgagcctgaccagatgccagcaggaggagagccaggccgccagaatgatccacagcaccaacggcctgtacaaccagttcatcaagagcctggacagcttcagcggcaagcccagaggcagcggcccccccgccggcaccgccctgcccatcgagggcgtgatcctgagcctgcaggacctgatcatctacttcgagccccccagcgaggacctgcagcacgaggagaagcagagcaagctgagaagcctgagaaacagacagagcctgttccaggaggagggcatgctgagcatggtgctgaactgcatcgacagactgaacgtgtacaccaccgccgcccacttcgccgagttcgccggcgaggaggccgccgagagctggaaggagatcgtgaacctgctgtacgagctgctggccagcctgatcagaggcaacagaagcaactgcgccctgttcagcaccaacctggactggctggtgagcaagctggacagactggaggccagcagcggcatcctggaggtgctgtactgcgtgctgatcgagagccccgaggtgctgaacatcatccaggagaaccacatcaagagcatcatcagcctgctggacaagcacggcagaaaccacaaggtgctggacgtgctgtgcagcctgtgcgtgtgcaacggcgtggccgtgagaagcaaccaggacctgatcaccgagaacctgctgcccggcagagagctgctgctgcagaccaacctgatcaactacgtgaccagcatcagacccaacatcttcgtgggcagagccgagggcaccacccagtacagcaagtggtacttcgaggtgatggtggacgaggtgacccccttcctgaccgcccaggccacccacctgagagtgggctgggccctgaccgagggctacaccccctaccccggcgccggcgagggctggggcggcaacggcgtgggcgacgacctgtacagctacggcttcgacggcctgcacctgtggaccggccacgtggccagacccgtgaccagccccggccagcacctgctggcccccgaggacgtgatcagctgctgcctggacctgagcgtgcccagcatcagcttcagaatcaacggctgccccgtgcagggcgtgttcgagagcttcaacctggacggcctgttcttccccgtggtgagcttcagcgccggcgtgaaggtgagattcctgctgggcggcagacacggcgagttcaagttcctgcccccccccggctacgccccctgccacgaggccgtgctgcccagagagagactgcacctggagcccatcaaggagtacagaagagagggccccagaggcccccacctggtgggccccagcagatgcctgagccacaccgacttcgtgccctgccccgtggacaccgtgcagatcgtgctgcccccccacctggagagaatcagagagaagctggccgagaacatccacgagctgtgggccctgaccagaatcgagcagggctggacctacggccccgtgagagacgacaacaagagactgcacccctgcctggtggacttccacagcctgcccgagcccgagagaaactacaacctgcagatgagcggcgagaccctgaagaccctgctggccctgggctgccacgtgggcatggccgacgagaaggccgaggacaacctgaagaagaccaagctgcccaagacctacatgatgagcaacggctacaagcccgcccccctggacctgagccacgtgagactgacccccgcccagaccaccctggtggacagactggccgagaacggccacaacgtgtgggccagagacagagtgggccagggctggagctacagcgccgtgcaggacatccccgccagaagaaaccccagactggtgccctacagactgctggacgaggccaccaagagaagcaacagagacagcctgtgccaggccgtgagaaccctgctgggctacggctacaacatcgagccccccgaccaggagcccagccaggtggagaaccagagcagatgcgacagagtgagaatcttcagagccgagaagagctacaccgtgcagagcggcagatggtacttcgagttcgaggccgtgaccaccggcgagatgagagtgggctgggccagacccgagctgagacccgacgtggagctgggcgccgacgagctggcctacgtgttcaacggccacagaggccagagatggcacctgggcagcgagcccttcggcagaccctggcagcccggcgacgtggtgggctgcatgatcgacctgaccgagaacaccatcatcttcaccctgaacggcgaggtgctgatgagcgacagcggcagcgagaccgccttcagagagatcgagatcggcgacggcttcctgcccgtgtgcagcctgggccccggccaggtgggccacctgaacctgggccaggacgtgagcagcctgagattcttcgccatctgcggcctgcaggagggcttcgagcccttcgccatcaacatgcagagacccgtgaccacctggttcagcaagggcctgccccagttcgagcccgtgcccctggagcacccccactacgaggtgagcagagtggacggcaccgtggacacccccccctgcctgagactgacccacagaacctggggcagccagaacagcctggtggagatgctgttcctgagactgagcctgcccgtgcagttccaccagcacttcagatgcaccgccggcgccacccccctggccccccccggcctgcagccccccgccgaggacgaggccagagccgccgagcccgaccccgactacgagaacctgagaagaagcgccggcggctggagcgaggccgagaacggcaaggagggcaccgccaaggagggcgcccccggcggcaccccccaggccggcggcgaggcccagcccgccagagccgagaacgagaaggacgccaccaccgagaagaacaagaagagaggcttcctgttcaaggccaagaaggtggccatgatgacccagccccccgccacccccaccctgcccagactgccccacgacgtggtgcccgccgacaacagagacgaccccgagatcatcctgaacaccaccacctactactacagcgtgagagtgttcgccggccaggagcccagctgcgtgtgggccggctgggtgacccccgactaccaccagcacgacatgagcttcgacctgagcaaggtgagagtggtgaccgtgaccatgggcgacgagcagggcaacgtgcacagcagcctgaagtgcagcaactgctacatggtgtggggcggcgacttcgtgagccccggccagcagggcagaatcagccacaccgacctggtgatcggctgcctggtggacctggccaccggcctgatgaccttcaccgccaacggcaaggagagcaacaccttcttccaggtggagcccaacaccaagctgttccccgccgtgttcgtgctgcccacccaccagaacgtgatccagttcgagctgggcaagcagaagaacatcatgcccctgagcgccgccatgttccagagcgagagaaagaaccccgccccccagtgcccccccagactggagatgcagatgctgatgcccgtgagctggagcagaatgcccaaccacttcctgcaggtggagaccagaagagccggcgagagactgggctgggccgtgcagtgccaggagcccctgaccatgatggccctgcacatccccgaggagaacagatgcatggacatcctggagctgagcgagagactggacctgcagagattccacagccacaccctgagactgtacagagccgtgtgcgccctgggcaacaacagagtggcccacgccctgtgcagccacgtggaccaggcccagctgctgcacgccctggaggacgcccacctgcccggccccctgagagccggctactacgacctgctgatcagcatccacctggagagcgcctgcagaagcagaagaagcatgctgagcgagtacatcgtgcccctgacccccgagaccagagccatcaccctgttcccccccggcagaagcaccgagaacggccaccccagacacggcctgcccggcgtgggcgtgaccaccagcctgagacccccccaccacttcagccccccctgcttcgtggccgccctgcccgccgccggcgccgccgaggcccccgccagactgagccccgccatccccctggaggccctgagagacaaggccctgagaatgctgggcgaggccgtgagagacggcggccagcacgccagagaccccgtgggcggcagcgtggagttccagttcgtgcccgtgctgaagctggtgagcaccctgctggtgatgggcatcttcggcgacgaggacgtgaagcagatcctgaagatgatcgagcccgaggtgttcaccgaggaggaggaggaggaggacgaggaggaggagggcgaggaggaggacgaggaggagaaggaggaggacgaggaggagaccgcccaggagaaggaggacgaggagaaggaggaggaggaggccgccgagggcgagaaggaggagggcctggaggagggcctgctgcagatgaagctgcccgagagcgtgaagctgcagatgtgccacctgctggagtacttctgcgaccaggagctgcagcacagagtggagagcctggccgccttcgccgagagatacgtggacaagctgcaggccaaccagagaagcagatacggcctgctgatcaaggccttcagcatgaccgccgccgagaccgccagaagaaccagagagttcagaagccccccccaggagcagatcaacatgctgctgcagttcaaggacggcaccgacgaggaggactgccccctgcccgaggagatcagacaggacctgctggacttccaccaggacctgctggcccactgcggcatccagctggacggcgaggaggaggagcccgaggaggagaccaccctgggcagcagactgatgagcctgctggagaaggtgagactggtgaagaagaaggaggagaagcccgaggaggagagaagcgccgaggagagcaagcccagaagcctgcaggagctggtgagccacatggtggtgagatgggcccaggaggacttcgtgcagagccccgagctggtgagagccatgttcagcctgctgcacagacagtacgacggcctgggcgagctgctgagagccctgcccagagcctacaccatcagccccagcagcgtggaggacaccatgagcctgctggagtgcctgggccagatcagaagcctgctgatcgtgcagatgggcccccaggaggagaacctgatgatccagagcatcggcaacatcatgaacaacaaggtgttctaccagcaccccaacctgatgagagccctgggcatgcacgagaccgtgatggaggtgatggtgaacgtgctgggcggcggcgagagcaaggagatcagattccccaagatggtgaccagctgctgcagattcctgtgctacttctgcagaatcagcagacagaaccagagaagcatgttcgaccacctgagctacctgctggagaacagcggcatcggcctgggcatgcagggcagcacccccctggacgtggccgccgccagcgtgatcgacaacaacgagctggccctggccctgcaggagcaggacctggagaaggtggtgagctacctggccggctgcggcctgcagagctgccccatgctggtggccaagggctaccccgacatcggctggaacccctgcggcggcgagagatacctggacttcctgagattcgccgtgttcgtgaacggcgagagcgtggaggagaacgccaacgtggtggtgagactgctgatcagaaagcccgagtgcttcggccccgccctgagaggcgagggcggcagcggcctgctggccgccatcgaggaggccatcagaatcagcgaggaccccgccagagacggccccggcatcagaagagacagaagaagagagcacttcggcgaggagccccccgaggagaacagagtgcacctgggccacgccatcatgagcttctacgccgccctgatcgacctgctgggcagatgcgcccccgagatgcacctgatccaggccggcaagggcgaggccctgagaatcagagccatcctgagaagcctggtgcccctggaggacctggtgggcatcatcagcctgcccctgcagatccccaccctgggcaaggacggcgccctggtgcagcccaagatgagcgccagcttcgtgcccgaccacaaggccagcatggtgctgttcctggacagagtgtacggcatcgagaaccaggacttcctgctgcacgtgctggacgtgggcttcctgcccgacatgagagccgccgccagcctggacaccgccaccttcagcaccaccgagatggccctggccctgaacagatacctgtgcctggccgtgctgcccctgatcaccaagtgcgcccccctgttcgccggcaccgagcacagagccatcatggtggacagcatgctgcacaccgtgtacagactgagcagaggcagaagcctgaccaaggcccagagagacgtgatcgaggactgcctgatgagcctgtgcagatacatcagacccagcatgctgcagcacctgctgagaagactggtgttcgacgtgcccatcctgaacgagttcgccaagatgcccctgaagctgctgaccaaccactacgagagatgctggaagtactactgcctgcccaccggctgggccaacttcggcgtgaccagcgaggaggagctgcacctgaccagaaagctgttctggggcatcttcgacagcctggcccacaagaagtacgaccccgagctgtacagaatggccatgccctgcctgtgcgccatcgccggcgccctgccccccgactacgtggacgccagctacagcagcaaggccgagaagaaggccaccgtggacgccgagggcaacttcgaccccagacccgtggagaccctgaacgtgatcatccccgagaagctggacagcttcatcaacaagttcgccgagtacacccacgagaagtgggccttcgacaagatccagaacaactggagctacggcgagaacatcgacgaggagctgaagacccaccccatgctgagaccctacaagaccttcagcgagaaggacaaggagatctacagatggcccatcaaggagagcctgaaggccatgatcgcctgggagtggaccatcgagaaggccagagagggcgaggaggagaagaccgagaagaagaagaccagaaagatcagccagagcgcccagacctacgaccccagagagggctacaacccccagccccccgacctgagcgccgtgaccctgagcagagagctgcaggccatggccgagcagctggccgagaactaccacaacacctggggcagaaagaagaagcaggagctggaggccaagggcggcggcacccaccccctgctggtgccctacgacaccctgaccgccaaggagaaggccagagacagagagaaggcccaggagctgctgaagttcctgcagatgaacggctacgccgtgaccagaggcctgaaggacatggagctggacagcagcagcatcgagaagagattcgccttcggcttcctgcagcagctgctgagatggatggacatcagccaggagttcatcgcccacctggaggccgtggtgagcagcggcagagtggagaagagcccccacgagcaggagatcaagttcttcgccaagatcctgctgcccctgatcaaccagtacttcaccaaccactgcctgtacttcctgagcacccccgccaaggtgctgggcagcggcggccacgccagcaacaaggagaaggagatgatcaccagcctgttctgcaagctggccgccctggtgagacacagagtgagcctgttcggcaccgacgcccccgccgtggtgaactgcctgcacatcctggccagaagcctggacgccagaaccgtgatgaagagcggccccgagatcgtgaaggccggcctgagaagcttcttcgagagcgccagcgaggacatcgagaagatggtggagaacctgagactgggcaaggtgagccaggccagaacccaggtgaagggcgtgggccagaacctgacctacaccaccgtggccctgctgcccgtgctgaccaccctgttccagcacatcgcccagcaccagttcggcgacgacgtgatcctggacgacgtgcaggtgagctgctacagaaccctgtgcagcatctacagcctgggcaccaccaagaacacctacgtggagaagctgagacccgccctgggcgagtgcctggccagactggccgccgccatgcccgtggccttcctggagccccagctgaacgagtacaacgcctgcagcgtgtacaccaccaagagccccagagagagagccatcctgggcctgcccaacagcgtggaggagatgtgccccgacatccccgtgctggagagactgatggccgacatcggcggcctggccgagagcggcgccagatacaccgagatgccccacgtgatcgagatcaccctgcccatgctgtgcagctacctgcccagatggtgggagagaggccccgaggccccccccagcgccctgcccgccggcgccccccccccctgcaccgccgtgaccagcgaccacctgaacagcctgctgggcaacatcctgagaatcatcgtgaacaacctgggcatcgacgaggccagctggatgaagagactggccgtgttcgcccagcccatcgtgagcagagccagacccgagctgctgcagagccacttcatccccaccatcggcagactgagaaagagagccggcaaggtggtgagcgaggaggagcagctgagactggaggccaaggccgaggcccaggagggcgagctgctggtgagagacgagttcagcgtgctgtgcagagacctgtacgccctgtaccccctgctgatcagatacgtggacaacaacagagcccagtggctgaccgagcccaaccccagcgccgaggagctgttcagaatggtgggcgagatcttcatctactggagcaagagccacaacttcaagagagaggagcagaacttcgtggtgcagaacgagatcaacaacatgagcttcctgaccgccgacaacaagagcaagatggccaagagcggcggcagcgaccaggagagaaccaagaagaagagaagaggcgacagatacagcgtgcagaccagcctgatcgtggccaccctgaagaagatgctgcccatcggcctgaacatgtgcgcccccaccgaccaggacctgatcaccctggccaagaccagatacgccctgaaggacaccgacgaggaggtgagagagttcctgcacaacaacctgcacctgcagggcaaggtggagggcagccccagcctgagatggcagatggccctgtacagaggcgtgcccggcagagaggaggacgccgacgaccccgagaagatcgtgagaagagtgcaggaggtgagcgccgtgctgtactacctggaccagaccgagcacccctacaagagcaagaaggccgtgtggcacaagctgctgagcaagcagagaagaagagccgtggtggcctgcttcagaatgacccccctgtacaacctgcccacccacagagcctgcaacatgttcctggagagctacaaggccgcctggatcctgaccgaggaccacagcttcgaggacagaatgatcgacgacctgagcaaggccggcgagcaggaggaggaggaggaggaggtggaggagaagaagcccgaccccctgcaccagctggtgctgcacttcagcagaaccgccctgaccgagaagagcaagctggacgaggactacctgtacatggcctacgccgacatcatggccaagagctgccacctggaggagggcggcgagaacggcgaggccgaggaggaggtggaggtgagcttcgaggagaagcagatggagaagcagagactgctgtaccagcaggccagactgcacaccagaggcgccgccgagatggtgctgcagatgatcagcgcctgcaagggcgagaccggcgccatggtgagcagcaccctgaagctgggcatcagcatcctgaacggcggcaacgccgaggtgcagcagaagatgctggactacctgaaggacaagaaggaggtgggcttcttccagagcatccaggccctgatgcagacctgcagcgtgctggacctgaacgccttcgagagacagaacaaggccgagggcctgggcatggtgaacgaggacggcaccgtgatcaacagacagaacggcgagaaggtgatggccgacgacgagttcacccaggacctgttcagattcctgcagctgctgtgcgagggccacaacaacgacttccagaactacctgagaacccagaccggcaacaccaccaccatcaacatcatcatctgcaccgtggactacctgctgagactgcaggagagcatcagcgacttctactggtactacagcggcaaggacgtgatcgaggagcagggcaagagaaacttcagcaaggccatgagcgtggccaagcaggtgttcaacagcctgaccgagtacatccagggcccctgcaccggcaaccagcagagcctggcccacagcagactgtgggacgccgtggtgggcttcctgcacgtgttcgcccacatgatgatgaagctggcccaggacagcagccagatcgagctgctgaaggagctgctggacctgcagaaggacatggtggtgatgctgctgagcctgctggagggcaacgtggtgaacggcatgatcgccagacagatggtggacatgctggtggagagcagcagcaacgtggagatgatcctgaagttcttcgacatgttcctgaagctgaaggacatcgtgggcagcgaggccttccaggactacgtgaccgaccccagaggcctgatcagcaagaaggacttccagaaggccatggacagccagaagcagttcagcggccccgagatccagttcctgctgagctgcagcgaggccgacgagaacgagatgatcaactgcgaggagttcgccaacagattccaggagcccgccagagacatcggcttcaacgtggccgtgctgctgaccaacctgagcgagcacgtgccccacgaccccagactgcacaacttcctggagctggccgagagcatcctggagtacttcagaccctacctgggcagaatcgagatcatgggcgccagcagaagaatcgagagaatctacttcgagatcagcgagaccaacagagcccagtgggagatgccccaggtgaaggagagcaagagacagttcatcttcgacgtggtgaacgagggcggcgaggccgagaagatggagctgttcgtgagcttctgcgaggacaccatcttcgagatgcagatcgccgcccagatcagcgagcccgagggcgagcccgagaccgacgaggacgagggcgccggcgccgccgaggccggcgccgagggcgccgaggagggcgccgccggcctggagggcaccgccgccaccgccgccgccggcgccaccgccagagtggtggccgccgccggcagagccctgagaggcctgagctacagaagcctgagaagaagagtgagaagactgagaagactgaccgccagagaggccgccaccgccgtggccgccctgctgtgggccgccgtgaccagagccggcgccgccggcgccggcgccgccgccggcgccctgggcctgctgtggggcagcctgttcggcggcggcctggtggagggcgccaagaaggtgaccgtgaccgagctgctggccggcatgcccgaccccaccagcgacgaggtgcacggcgagcagcccgccggccccggcggcgacgccgacggcgagggcgccagcgagggcgccggcgacgccgccgagggcgccggcgacgaggaggaggccgtgcacgaggccggccccggcggcgccgacggcgccgtggccgtgaccgacggcggccccttcagacccgagggcgccggcggcctgggcgacatgggcgacaccacccccgccgagccccccacccccgagggcagccccatcctgaagagaaagctgggcgtggacggcgtggaggaggagctgccccccgagcccgagcccgagcccgagcccgagctggagcccgagaaggccgacgccgagaacggcgagaaggaggaggtgcccgagcccacccccgagccccccaagaagcaggccccccccagccccccccccaagaaggaggaggccggcggcgagttctggggcgagctggaggtgcagagagtgaagttcctgaactacctgagcagaaacttctacaccctgagattcctggccctgttcctggccttcgccatcaacttcatcctgctgttctacaaggtgagcgacagcccccccggcgaggacgacatggagggcagcgccgccggcgacgtgagcggcgccggcagcggcggcagcagcggctggggcctgggcgccggcgaggaggccgagggcgacgaggacgagaacatggtgtactacttcctggaggagagcaccggctacatggagcccgccctgagatgcctgagcctgctgcacaccctggtggccttcctgtgcatcatcggctacaactgcctgaaggtgcccctggtgatcttcaagagagagaaggagctggccagaaagctggagttcgacggcctgtacatcaccgagcagcccgaggacgacgacgtgaagggccagtgggacagactggtgctgaacacccccagcttccccagcaactactgggacaagttcgtgaagagaaaggtgctggacaagcacggcgacatctacggcagagagagaatcgccgagctgctgggcatggacctggccaccctggagatcaccgcccacaacgagagaaagcccaaccccccccccggcctgctgacctggctgatgagcatcgacgtgaagtaccagatctggaagttcggcgtgatcttcaccgacaacagcttcctgtacctgggctggtacatggtgatgagcctgctgggccactacaacaacttcttcttcgccgcccacctgctggacatcgccatgggcgtgaagaccctgagaaccatcctgagcagcgtgacccacaacggcaagcagctggtgatgaccgtgggcctgctggccgtggtggtgtacctgtacaccgtggtggccttcaacttcttcagaaagttctacaacaagagcgaggacgaggacgagcccgacatgaagtgcgacgacatgatgacctgctacctgttccacatgtacgtgggcgtgagagccggcggcggcatcggcgacgagatcgaggaccccgccggcgacgagtacgagctgtacagagtggtgttcgacatcaccttcttcttcttcgtgatcgtgatcctgctggccatcatccagggcctgatcatcgacgccttcggcgagctgagagaccagcaggagcaggtgaaggaggacatggagaccaagtgcttcatctgcggcatcggcagcgactacttcgacaccaccccccacggcttcgagacccacaccctggaggagcacaacctggccaactacatgttcttcctgatgtacctgatcaacaaggacgagaccgagcacaccggccaggagagctacgtgtggaagatgtaccaggagagatgctgggacttcttccccgccggcgactgcttcagaaagcagtacgaggaccagctgagctag

SEQ ID NO: 97908 - DNA, 15117 bp, Artificial Sequence
  Description of Artificial Sequence: Synthetic coding sequence
atgggcgacgccgagggcgaggacgaggtgcagttcctgagaaccgacgacgaggtggtgctgcagtgcagcgccaccgtgctgaaggagcagctgaagctgtgcctggccgccgagggcttcggcaacagactgtgcttcctggagcccaccagcaacgcccagaacgtgccccccgacctggccatctgctgcttcgtgctggagcagagcctgagcgtgagagccctgcaggagatgctggccaacaccgtggaggccggcgtggagagcagccagggcggcggccacagaaccctgctgtacggccacgccatcctgctgagacacgcccacagcagaatgtacctgagctgcctgaccaccagcagaagcatgaccgacaagctggccttcgacgtgggcctgcaggaggacgccaccggcgaggcctgctggtggaccatgcaccccgccagcaagcagagaagcgagggcgagaaggtgagagtgggcgacgacatcatcctggtgagcgtgagcagcgagagatacctgcacctgagcaccgccagcggcgagctgcaggtggacgccagcttcatgcagaccctgtggaacatgaaccccatctgcagcagatgcgaggagggcttcgtgaccggcggccacgtgctgagactgttccacggccacatggacgagtgcctgaccatcagccccgccgacagcgacgaccagagaagactggtgtactacgagggcggcgccgtgtgcacccacgccagaagcctgtggagactggagcccctgagaatcagctggagcggcagccacctgagatggggccagcccctgagagtgagacacgtgaccaccggccagtacctggccctgaccgaggaccagggcctggtggtggtggacgccagcaaggcccacaccaaggccaccagcttctgcttcagaatcagcaaggagaagctggacgtggcccccaagagagacgtggagggcatgggcccccccgagatcaagtacggcgagagcctgtgcttcgtgcagcacgtggccagcggcctgtggctgacctacgccgcccccgaccccaaggccctgagactgggcgtgctgaagaagaaggccatgctgcaccaggagggccacatggacgacgccctgagcctgaccagatgccagcaggaggagagccaggccgccagaatgatccacagcaccaacggcctgtacaaccagttcatcaagagcctggacagcttcagcggcaagcccagaggcagcggcccccccgccggcaccgccctgcccatcgagggcgtgatcctgagcctgcaggacctgatcatctacttcgagccccccagcgaggacctgcagcacgaggagaagcagagcaagctgagaagcctgagaaacagacagagcctgttccaggaggagggcatgctgagcatggtgctgaactgcatcgacagactgaacgtgtacaccaccgccgcccacttcgccgagttcgccggcgaggaggccgccgagagctggaaggagatcgtgaacctgctgtacgagctgctggccagcctgatcagaggcaacagaagcaactgcgccctgttcagcaccaacctggactggctggtgagcaagctggacagactggaggccagcagcggcatcctggaggtgctgtactgcgtgctgatcgagagccccgaggtgctgaacatcatccaggagaaccacatcaagagcatcatcagcctgctggacaagcacggcagaaaccacaaggtgctggacgtgctgtgcagcctgtgcgtgtgcaacggcgtggccgtgagaagcaaccaggacctgatcaccgagaacctgctgcccggcagagagctgctgctgcagaccaacctgatcaactacgtgaccagcatcagacccaacatcttcgtgggcagagccgagggcaccacccagtacagcaagtggtacttcgaggtgatggtggacgaggtgacccccttcctgaccgcccaggccacccacctgagagtgggctgggccctgaccgagggctacaccccctaccccggcgccggcgagggctggggcggcaacggcgtgggcgacgacctgtacagctacggcttcgacggcctgcacctgtggaccggccacgtggccagacccgtgaccagccccggccagcacctgctggcccccgaggacgtgatcagctgctgcctggacctgagcgtgcccagcatcagcttcagaatcaacggctgccccgtgcagggcgtgttcgagagcttcaacctggacggcctgttcttccccgtggtgagcttcagcgccggcgtgaaggtgagattcctgctgggcggcagacacggcgagttcaagttcctgcccccccccggctacgccccctgccacgaggccgtgctgcccagagagagactgcacctggagcccatcaaggagtacagaagagagggccccagaggcccccacctggtgggccccagcagatgcctgagccacaccgacttcgtgccctgccccgtggacaccgtgcagatcgtgctgcccccccacctggagagaatcagagagaagctggccgagaacatccacgagctgtgggccctgaccagaatcgagcagggctggacctacggccccgtgagagacgacaacaagagactgcacccctgcctggtggacttccacagcctgcccgagcccgagagaaactacaacctgcagatgagcggcgagaccctgaagaccctgctggccctgggctgccacgtgggcatggccgacgagaaggccgaggacaacctgaagaagaccaagctgcccaagacctacatgatgagcaacggctacaagcccgcccccctggacctgagccacgtgagactgacccccgcccagaccaccctggtggacagactggccgagaacggccacaacgtgtgggccagagacagagtgggccagggctggagctacagcgccgtgcaggacatccccgccagaagaaaccccagactggtgccctacagactgctggacgaggccaccaagagaagcaacagagacagcctgtgccaggccgtgagaaccctgctgggctacggctacaacatcgagccccccgaccaggagcccagccaggtggagaaccagagcagatgcgacagagtgagaatcttcagagccgagaagagctacaccgtgcagagcggcagatggtacttcgagttcgaggccgtgaccaccggcgagatgagagtgggctgggccagacccgagctgagacccgacgtggagctgggcgccgacgagctggcctacgtgttcaacggccacagaggccagagatggcacctgggcagcgagcccttcggcagaccctggcagcccggcgacgtggtgggctgcatgatcgacctgaccgagaacaccatcatcttcaccctgaacggcgaggtgctgatgagcgacagcggcagcgagaccgccttcagagagatcgagatcggcgacggcttcctgcccgtgtgcagcctgggccccggccaggtgggccacctgaacctgggccaggacgtgagcagcctgagattcttcgccatctgcggcctgcaggagggcttcgagcccttcgccatcaacatgcagagacccgtgaccacctggttcagcaagggcctgccccagttcgagcccgtgcccctggagcacccccactacgaggtgagcagagtggacggcaccgtggacacccccccctgcctgagactgacccacagaacctggggcagccagaacagcctggtggagatgctgttcctgagactgagcctgcccgtgcagttccaccagcacttcagatgcaccgccggcgccacccccctggccccccccggcctgcagccccccgccgaggacgaggccagagccgccgagcccgaccccgactacgagaacctgagaagaagcgccggcggctggagcgaggccgagaacggcaaggagggcaccgccaaggagggcgcccccggcggcaccccccaggccggcggcgaggcccagcccgccagagccgagaacgagaaggacgccaccaccgagaagaacaagaagagaggcttcctgttcaaggccaagaaggtggccatgatgacccagccccccgccacccccaccctgcccagactgccccacgacgtggtgcccgccgacaacagagacgaccccgagatcatcctgaacaccaccacctactactacagcgtgagagtgttcgccggccaggagcccagctgcgtgtgggccggctgggtgacccccgactaccaccagcacgacatgagcttcgacctgagcaaggtgagagtggtgaccgtgaccatgggcgacgagcagggcaacgtgcacagcagcctgaagtgcagcaactgctacatggtgtggggcggcgacttcgtgagccccggccagcagggcagaatcagccacaccgacctggtgatcggctgcctggtggacctggccaccggcctgatgaccttcaccgccaacggcaaggagagcaacaccttcttccaggtggagcccaacaccaagctgttccccgccgtgttcgtgctgcccacccaccagaacgtgatccagttcgagctgggcaagcagaagaacatcatgcccctgagcgccgccatgttccagagcgagagaaagaaccccgccccccagtgcccccccagactggagatgcagatgctgatgcccgtgagctggagcagaatgcccaaccacttcctgcaggtggagaccagaagagccggcgagagactgggctgggccgtgcagtgccaggagcccctgaccatgatggccctgcacatccccgaggagaacagatgcatggacatcctggagctgagcgagagactggacctgcagagattccacagccacaccctgagactgtacagagccgtgtgcgccctgggcaacaacagagtggcccacgccctgtgcagccacgtggaccaggcccagctgctgcacgccctggaggacgcccacctgcccggccccctgagagccggctactacgacctgctgatcagcatccacctggagagcgcctgcagaagcagaagaagcatgctgagcgagtacatcgtgcccctgacccccgagaccagagccatcaccctgttcccccccggcagaagcaccgagaacggccaccccagacacggcctgcccggcgtgggcgtgaccaccagcctgagacccccccaccacttcagccccccctgcttcgtggccgccctgcccgccgccggcgccgccgaggcccccgccagactgagccccgccatccccctggaggccctgagagacaaggccctgagaatgctgggcgaggccgtgagagacggcggccagcacgccagagaccccgtgggcggcagcgtggagttccagttcgtgcccgtgctgaagctggtgagcaccctgctggtgatgggcatcttcggcgacgaggacgtgaagcagatcctgaagatgatcgagcccgaggtgttcaccgaggaggaggaggaggaggacgaggaggaggagggcgaggaggaggacgaggaggagaaggaggaggacgaggaggagaccgcccaggagaaggaggacgaggagaaggaggaggaggaggccgccgagggcgagaaggaggagggcctggaggagggcctgctgcagatgaagctgcccgagagcgtgaagctgcagatgtgccacctgctggagtacttctgcgaccaggagctgcagcacagagtggagagcctggccgccttcgccgagagatacgtggacaagctgcaggccaaccagagaagcagatacggcctgctgatcaaggccttcagcatgaccgccgccgagaccgccagaagaaccagagagttcagaagccccccccaggagcagatcaacatgctgctgcagttcaaggacggcaccgacgaggaggactgccccctgcccgaggagatcagacaggacctgctggacttccaccaggacctgctggcccactgcggcatccagctggacggcgaggaggaggagcccgaggaggagaccaccctgggcagcagactgatgagcctgctggagaaggtgagactggtgaagaagaaggaggagaagcccgaggaggagagaagcgccgaggagagcaagcccagaagcctgcaggagctggtgagccacatggtggtgagatgggcccaggaggacttcgtgcagagccccgagctggtgagagccatgttcagcctgctgcacagacagtacgacggcctgggcgagctgctgagagccctgcccagagcctacaccatcagccccagcagcgtggaggacaccatgagcctgctggagtgcctgggccagatcagaagcctgctgatcgtgcagatgggcccccaggaggagaacctgatgatccagagcatcggcaacatcatgaacaacaaggtgttctaccagcaccccaacctgatgagagccctgggcatgcacgagaccgtgatggaggtgatggtgaacgtgctgggcggcggcgagagcaaggagatcagattccccaagatggtgaccagctgctgcagattcctgtgctacttctgcagaatcagcagacagaaccagagaagcatgttcgaccacctgagctacctgctggagaacagcggcatcggcctgggcatgcagggcagcacccccctggacgtggccgccgccagcgtgatcgacaacaacgagctggccctggccctgcaggagcaggacctggagaaggtggtgagctacctggccggctgcggcctgcagagctgccccatgctggtggccaagggctaccccgacatcggctggaacccctgcggcggcgagagatacctggacttcctgagattcgccgtgttcgtgaacggcgagagcgtggaggagaacgccaacgtggtggtgagactgctgatcagaaagcccgagtgcttcggccccgccctgagaggcgagggcggcagcggcctgctggccgccatcgaggaggccatcagaatcagcgaggaccccgccagagacggccccggcatcagaagagacagaagaagagagcacttcggcgaggagccccccgaggagaacagagtgcacctgggccacgccatcatgagcttctacgccgccctgatcgacctgctgggcagatgcgcccccgagatgcacctgatccaggccggcaagggcgaggccctgagaatcagagccatcctgagaagcctggtgcccctggaggacctggtgggcatcatcagcctgcccctgcagatccccaccctgggcaaggacggcgccctggtgcagcccaagatgagcgccagcttcgtgcccgaccacaaggccagcatggtgctgttcctggacagagtgtacggcatcgagaaccaggacttcctgctgcacgtgctggacgtgggcttcctgcccgacatgagagccgccgccagcctggacaccgccaccttcagcaccaccgagatggccctggccctgaacagatacctgtgcctggccgtgctgcccctgatcaccaagtgcgcccccctgttcgccggcaccgagcacagagccatcatggtggacagcatgctgcacaccgtgtacagactgagcagaggcagaagcctgaccaaggcccagagagacgtgatcgaggactgcctgatgagcctgtgcagatacatcagacccagcatgctgcagcacctgctgagaagactggtgttcgacgtgcccatcctgaacgagttcgccaagatgcccctgaagctgctgaccaaccactacgagagatgctggaagtactactgcctgcccaccggctgggccaacttcggcgtgaccagcgaggaggagctgcacctgaccagaaagctgttctggggcatcttcgacagcctggcccacaagaagtacgaccccgagctgtacagaatggccatgccctgcctgtgcgccatcgccggcgccctgccccccgactacgtggacgccagctacagcagcaaggccgagaagaaggccaccgtggacgccgagggcaacttcgaccccagacccgtggagaccctgaacgtgatcatccccgagaagctggacagcttcatcaacaagttcgccgagtacacccacgagaagtgggccttcgacaagatccagaacaactggagctacggcgagaacatcgacgaggagctgaagacccaccccatgctgagaccctacaagaccttcagcgagaaggacaaggagatctacagatggcccatcaaggagagcctgaaggccatgatcgcctgggagtggaccatcgagaaggccagagagggcgaggaggagaagaccgagaagaagaagaccagaaagatcagccagagcgcccagacctacgaccccagagagggctacaacccccagccccccgacctgagcgccgtgaccctgagcagagagctgcaggccatggccgagcagctggccgagaactaccacaacacctggggcagaaagaagaagcaggagctggaggccaagggcggcggcacccaccccctgctggtgccctacgacaccctgaccgccaaggagaaggccagagacagagagaaggcccaggagctgctgaagttcctgcagatgaacggctacgccgtgaccagaggcctgaaggacatggagctggacagcagcagcatcgagaagagattcgccttcggcttcctgcagcagctgctgagatggatggacatcagccaggagttcatcgcccacctggaggccgtggtgagcagcggcagagtggagaagagcccccacgagcaggagatcaagttcttcgccaagatcctgctgcccctgatcaaccagtacttcaccaaccactgcctgtacttcctgagcacccccgccaaggtgctgggcagcggcggccacgccagcaacaaggagaaggagatgatcaccagcctgttctgcaagctggccgccctggtgagacacagagtgagcctgttcggcaccgacgcccccgccgtggtgaactgcctgcacatcctggccagaagcctggacgccagaaccgtgatgaagagcggccccgagatcgtgaaggccggcctgagaagcttcttcgagagcgccagcgaggacatcgagaagatggtggagaacctgagactgggcaaggtgagccaggccagaacccaggtgaagggcgtgggccagaacctgacctacaccaccgtggccctgctgcccgtgctgaccaccctgttccagcacatcgcccagcaccagttcggcgacgacgtgatcctggacgacgtgcaggtgagctgctacagaaccctgtgcagcatctacagcctgggcaccaccaagaacacctacgtggagaagctgagacccgccctgggcgagtgcctggccagactggccgccgccatgcccgtggccttcctggagccccagctgaacgagtacaacgcctgcagcgtgtacaccaccaagagccccagagagagagccatcctgggcctgcccaacagcgtggaggagatgtgccccgacatccccgtgctggagagactgatggccgacatcggcggcctggccgagagcggcgccagatacaccgagatgccccacgtgatcgagatcaccctgcccatgctgtgcagctacctgcccagatggtgggagagaggccccgaggccccccccagcgccctgcccgccggcgccccccccccctgcaccgccgtgaccagcgaccacctgaacagcctgctgggcaacatcctgagaatcatcgtgaacaacctgggcatcgacgaggccagctggatgaagagactggccgtgttcgcccagcccatcgtgagcagagccagacccgagctgctgcagagccacttcatccccaccatcggcagactgagaaagagagccggcaaggtggtgagcgaggaggagcagctgagactggaggccaaggccgaggcccaggagggcgagctgctggtgagagacgagttcagcgtgctgtgcagagacctgtacgccctgtaccccctgctgatcagatacgtggacaacaacagagcccagtggctgaccgagcccaaccccagcgccgaggagctgttcagaatggtgggcgagatcttcatctactggagcaagagccacaacttcaagagagaggagcagaacttcgtggtgcagaacgagatcaacaacatgagcttcctgaccgccgacaacaagagcaagatggccaaggccggcgacatccagagcggcggcagcgaccaggagagaaccaagaagaagagaagaggcgacagatacagcgtgcagaccagcctgatcgtggccaccctgaagaagatgctgcccatcggcctgaacatgtgcgcccccaccgaccaggacctgatcaccctggccaagaccagatacgccctgaaggacaccgacgaggaggtgagagagttcctgcacaacaacctgcacctgcagggcaaggtggagggcagccccagcctgagatggcagatggccctgtacagaggcgtgcccggcagagaggaggacgccgacgaccccgagaagatcgtgagaagagtgcaggaggtgagcgccgtgctgtactacctggaccagaccgagcacccctacaagagcaagaaggccgtgtggcacaagctgctgagcaagcagagaagaagagccgtggtggcctgcttcagaatgacccccctgtacaacctgcccacccacagagcctgcaacatgttcctggagagctacaaggccgcctggatcctgaccgaggaccacagcttcgaggacagaatgatcgacgacctgagcaaggccggcgagcaggaggaggaggaggaggaggtggaggagaagaagcccgaccccctgcaccagctggtgctgcacttcagcagaaccgccctgaccgagaagagcaagctggacgaggactacctgtacatggcctacgccgacatcatggccaagagctgccacctggaggagggcggcgagaacggcgaggccgaggaggaggtggaggtgagcttcgaggagaagcagatggagaagcagagactgctgtaccagcaggccagactgcacaccagaggcgccgccgagatggtgctgcagatgatcagcgcctgcaagggcgagaccggcgccatggtgagcagcaccctgaagctgggcatcagcatcctgaacggcggcaacgccgaggtgcagcagaagatgctggactacctgaaggacaagaaggaggtgggcttcttccagagcatccaggccctgatgcagacctgcagcgtgctggacctgaacgccttcgagagacagaacaaggccgagggcctgggcatggtgaacgaggacggcaccgtgatcaacagacagaacggcgagaaggtgatggccgacgacgagttcacccaggacctgttcagattcctgcagctgctgtgcgagggccacaacaacgacttccagaactacctgagaacccagaccggcaacaccaccaccatcaacatcatcatctgcaccgtggactacctgctgagactgcaggagagcatcagcgacttctactggtactacagcggcaaggacgtgatcgaggagcagggcaagagaaacttcagcaaggccatgagcgtggccaagcaggtgttcaacagcctgaccgagtacatccagggcccctgcaccggcaaccagcagagcctggcccacagcagactgtgggacgccgtggtgggcttcctgcacgtgttcgcccacatgatgatgaagctggcccaggacagcagccagatcgagctgctgaaggagctgctggacctgcagaaggacatggtggtgatgctgctgagcctgctggagggcaacgtggtgaacggcatgatcgccagacagatggtggacatgctggtggagagcagcagcaacgtggagatgatcctgaagttcttcgacatgttcctgaagctgaaggacatcgtgggcagcgaggccttccaggactacgtgaccgaccccagaggcctgatcagcaagaaggacttccagaaggccatggacagccagaagcagttcagcggccccgagatccagttcctgctgagctgcagcgaggccgacgagaacgagatgatcaactgcgaggagttcgccaacagattccaggagcccgccagagacatcggcttcaacgtggccgtgctgctgaccaacctgagcgagcacgtgccccacgaccccagactgcacaacttcctggagctggccgagagcatcctggagtacttcagaccctacctgggcagaatcgagatcatgggcgccagcagaagaatcgagagaatctacttcgagatcagcgagaccaacagagcccagtgggagatgccccaggtgaaggagagcaagagacagttcatcttcgacgtggtgaacgagggcggcgaggccgagaagatggagctgttcgtgagcttctgcgaggacaccatcttcgagatgcagatcgccgcccagatcagcgagcccgagggcgagcccgagaccgacgaggacgagggcgccggcgccgccgaggccggcgccgagggcgccgaggagggcgccgccggcctggagggcaccgccgccaccgccgccgccggcgccaccgccagagtggtggccgccgccggcagagccctgagaggcctgagctacagaagcctgagaagaagagtgagaagactgagaagactgaccgccagagaggccgccaccgccgtggccgccctgctgtgggccgccgtgaccagagccggcgccgccggcgccggcgccgccgccggcgccctgggcctgctgtggggcagcctgttcggcggcggcctggtggagggcgccaagaaggtgaccgtgaccgagctgctggccggcatgcccgaccccaccagcgacgaggtgcacggcgagcagcccgccggccccggcggcgacgccgacggcgagggcgccagcgagggcgccggcgacgccgccgagggcgccggcgacgaggaggaggccgtgcacgaggccggccccggcggcgccgacggcgccgtggccgtgaccgacggcggccccttcagacccgagggcgccggcggcctgggcgacatgggcgacaccacccccgccgagccccccacccccgagggcagccccatcctgaagagaaagctgggcgtggacggcgtggaggaggagctgccccccgagcccgagcccgagcccgagcccgagctggagcccgagaaggccgacgccgagaacggcgagaaggaggaggtgcccgagcccacccccgagccccccaagaagcaggccccccccagccccccccccaagaaggaggaggccggcggcgagttctggggcgagctggaggtgcagagagtgaagttcctgaactacctgagcagaaacttctacaccctgagattcctggccctgttcctggccttcgccatcaacttcatcctgctgttctacaaggtgagcgacagcccccccggcgaggacgacatggagggcagcgccgccggcgacgtgagcggcgccggcagcggcggcagcagcggctggggcctgggcgccggcgaggaggccgagggcgacgaggacgagaacatggtgtactacttcctggaggagagcaccggctacatggagcccgccctgagatgcctgagcctgctgcacaccctggtggccttcctgtgcatcatcggctacaactgcctgaaggtgcccctggtgatcttcaagagagagaaggagctggccagaaagctggagttcgacggcctgtacatcaccgagcagcccgaggacgacgacgtgaagggccagtgggacagactggtgctgaacacccccagcttccccagcaactactgggacaagttcgtgaagagaaaggtgctggacaagcacggcgacatctacggcagagagagaatcgccgagctgctgggcatggacctggccaccctggagatcaccgcccacaacgagagaaagcccaaccccccccccggcctgctgacctggctgatgagcatcgacgtgaagtaccagatctggaagttcggcgtgatcttcaccgacaacagcttcctgtacctgggctggtacatggtgatgagcctgctgggccactacaacaacttcttcttcgccgcccacctgctggacatcgccatgggcgtgaagaccctgagaaccatcctgagcagcgtgacccacaacggcaagcagctggtgatgaccgtgggcctgctggccgtggtggtgtacctgtacaccgtggtggccttcaacttcttcagaaagttctacaacaagagcgaggacgaggacgagcccgacatgaagtgcgacgacatgatgacctgctacctgttccacatgtacgtgggcgtgagagccggcggcggcatcggcgacgagatcgaggaccccgccggcgacgagtacgagctgtacagagtggtgttcgacatcaccttcttcttcttcgtgatcgtgatcctgctggccatcatccagggcctgatcatcgacgccttcggcgagctgagagaccagcaggagcaggtgaaggaggacatggagaccaagtgcttcatctgcggcatcggcagcgactacttcgacaccaccccccacggcttcgagacccacaccctggaggagcacaacctggccaactacatgttcttcctgatgtacctgatcaacaaggacgagaccgagcacaccggccaggagagctacgtgtggaagatgtaccaggagagatgctgggacttcttccccgccggcgactgcttcagaaagcagtacgaggaccagctgagctag

SEQ ID NO: 97909 - DNA, 15102 bp, Artificial Sequence
  Description of Artificial Sequence: Synthetic coding sequence
atgggcgacgccgagggcgaggacgaggtgcagttcctgagaaccgacgacgaggtggtgctgcagtgcagcgccaccgtgctgaaggagcagctgaagctgtgcctggccgccgagggcttcggcaacagactgtgcttcctggagcccaccagcaacgcccagaacgtgccccccgacctggccatctgctgcttcgtgctggagcagagcctgagcgtgagagccctgcaggagatgctggccaacaccgtggaggccggcgtggagagcagccagggcggcggccacagaaccctgctgtacggccacgccatcctgctgagacacgcccacagcagaatgtacctgagctgcctgaccaccagcagaagcatgaccgacaagctggccttcgacgtgggcctgcaggaggacgccaccggcgaggcctgctggtggaccatgcaccccgccagcaagcagagaagcgagggcgagaaggtgagagtgggcgacgacatcatcctggtgagcgtgagcagcgagagatacctgcacctgagcaccgccagcggcgagctgcaggtggacgccagcttcatgcagaccctgtggaacatgaaccccatctgcagcagatgcgaggagggcttcgtgaccggcggccacgtgctgagactgttccacggccacatggacgagtgcctgaccatcagccccgccgacagcgacgaccagagaagactggtgtactacgagggcggcgccgtgtgcacccacgccagaagcctgtggagactggagcccctgagaatcagctggagcggcagccacctgagatggggccagcccctgagagtgagacacgtgaccaccggccagtacctggccctgaccgaggaccagggcctggtggtggtggacgccagcaaggcccacaccaaggccaccagcttctgcttcagaatcagcaaggagaagctggacgtggcccccaagagagacgtggagggcatgggcccccccgagatcaagtacggcgagagcctgtgcttcgtgcagcacgtggccagcggcctgtggctgacctacgccgcccccgaccccaaggccctgagactgggcgtgctgaagaagaaggccatgctgcaccaggagggccacatggacgacgccctgagcctgaccagatgccagcaggaggagagccaggccgccagaatgatccacagcaccaacggcctgtacaaccagttcatcaagagcctggacagcttcagcggcaagcccagaggcagcggcccccccgccggcaccgccctgcccatcgagggcgtgatcctgagcctgcaggacctgatcatctacttcgagccccccagcgaggacctgcagcacgaggagaagcagagcaagctgagaagcctgagaaacagacagagcctgttccaggaggagggcatgctgagcatggtgctgaactgcatcgacagactgaacgtgtacaccaccgccgcccacttcgccgagttcgccggcgaggaggccgccgagagctggaaggagatcgtgaacctgctgtacgagctgctggccagcctgatcagaggcaacagaagcaactgcgccctgttcagcaccaacctggactggctggtgagcaagctggacagactggaggccagcagcggcatcctggaggtgctgtactgcgtgctgatcgagagccccgaggtgctgaacatcatccaggagaaccacatcaagagcatcatcagcctgctggacaagcacggcagaaaccacaaggtgctggacgtgctgtgcagcctgtgcgtgtgcaacggcgtggccgtgagaagcaaccaggacctgatcaccgagaacctgctgcccggcagagagctgctgctgcagaccaacctgatcaactacgtgaccagcatcagacccaacatcttcgtgggcagagccgagggcaccacccagtacagcaagtggtacttcgaggtgatggtggacgaggtgacccccttcctgaccgcccaggccacccacctgagagtgggctgggccctgaccgagggctacaccccctaccccggcgccggcgagggctggggcggcaacggcgtgggcgacgacctgtacagctacggcttcgacggcctgcacctgtggaccggccacgtggccagacccgtgaccagccccggccagcacctgctggcccccgaggacgtgatcagctgctgcctggacctgagcgtgcccagcatcagcttcagaatcaacggctgccccgtgcagggcgtgttcgagagcttcaacctggacggcctgttcttccccgtggtgagcttcagcgccggcgtgaaggtgagattcctgctgggcggcagacacggcgagttcaagttcctgcccccccccggctacgccccctgccacgaggccgtgctgcccagagagagactgcacctggagcccatcaaggagtacagaagagagggccccagaggcccccacctggtgggccccagcagatgcctgagccacaccgacttcgtgccctgccccgtggacaccgtgcagatcgtgctgcccccccacctggagagaatcagagagaagctggccgagaacatccacgagctgtgggccctgaccagaatcgagcagggctggacctacggccccgtgagagacgacaacaagagactgcacccctgcctggtggacttccacagcctgcccgagcccgagagaaactacaacctgcagatgagcggcgagaccctgaagaccctgctggccctgggctgccacgtgggcatggccgacgagaaggccgaggacaacctgaagaagaccaagctgcccaagacctacatgatgagcaacggctacaagcccgcccccctggacctgagccacgtgagactgacccccgcccagaccaccctggtggacagactggccgagaacggccacaacgtgtgggccagagacagagtgggccagggctggagctacagcgccgtgcaggacatccccgccagaagaaaccccagactggtgccctacagactgctggacgaggccaccaagagaagcaacagagacagcctgtgccaggccgtgagaaccctgctgggctacggctacaacatcgagccccccgaccaggagcccagccaggtggagaaccagagcagatgcgacagagtgagaatcttcagagccgagaagagctacaccgtgcagagcggcagatggtacttcgagttcgaggccgtgaccaccggcgagatgagagtgggctgggccagacccgagctgagacccgacgtggagctgggcgccgacgagctggcctacgtgttcaacggccacagaggccagagatggcacctgggcagcgagcccttcggcagaccctggcagcccggcgacgtggtgggctgcatgatcgacctgaccgagaacaccatcatcttcaccctgaacggcgaggtgctgatgagcgacagcggcagcgagaccgccttcagagagatcgagatcggcgacggcttcctgcccgtgtgcagcctgggccccggccaggtgggccacctgaacctgggccaggacgtgagcagcctgagattcttcgccatctgcggcctgcaggagggcttcgagcccttcgccatcaacatgcagagacccgtgaccacctggttcagcaagggcctgccccagttcgagcccgtgcccctggagcacccccactacgaggtgagcagagtggacggcaccgtggacacccccccctgcctgagactgacccacagaacctggggcagccagaacagcctggtggagatgctgttcctgagactgagcctgcccgtgcagttccaccagcacttcagatgcaccgccggcgccacccccctggccccccccggcctgcagccccccgccgaggacgaggccagagccgccgagcccgaccccgactacgagaacctgagaagaagcgccggcggctggagcgaggccgagaacggcaaggagggcaccgccaaggagggcgcccccggcggcaccccccaggccggcggcgaggcccagcccgccagagccgagaacgagaaggacgccaccaccgagaagaacaagaagagaggcttcctgttcaaggccaagaaggtggccatgatgacccagccccccgccacccccaccctgcccagactgccccacgacgtggtgcccgccgacaacagagacgaccccgagatcatcctgaacaccaccacctactactacagcgtgagagtgttcgccggccaggagcccagctgcgtgtgggccggctgggtgacccccgactaccaccagcacgacatgagcttcgacctgagcaaggtgagagtggtgaccgtgaccatgggcgacgagcagggcaacgtgcacagcagcctgaagtgcagcaactgctacatggtgtggggcggcgacttcgtgagccccggccagcagggcagaatcagccacaccgacctggtgatcggctgcctggtggacctggccaccggcctgatgaccttcaccgccaacggcaaggagagcaacaccttcttccaggtggagcccaacaccaagctgttccccgccgtgttcgtgctgcccacccaccagaacgtgatccagttcgagctgggcaagcagaagaacatcatgcccctgagcgccgccatgttccagagcgagagaaagaaccccgccccccagtgcccccccagactggagatgcagatgctgatgcccgtgagctggagcagaatgcccaaccacttcctgcaggtggagaccagaagagccggcgagagactgggctgggccgtgcagtgccaggagcccctgaccatgatggccctgcacatccccgaggagaacagatgcatggacatcctggagctgagcgagagactggacctgcagagattccacagccacaccctgagactgtacagagccgtgtgcgccctgggcaacaacagagtggcccacgccctgtgcagccacgtggaccaggcccagctgctgcacgccctggaggacgcccacctgcccggccccctgagagccggctactacgacctgctgatcagcatccacctggagagcgcctgcagaagcagaagaagcatgctgagcgagtacatcgtgcccctgacccccgagaccagagccatcaccctgttcccccccggcagaagcaccgagaacggccaccccagacacggcctgcccggcgtgggcgtgaccaccagcctgagacccccccaccacttcagccccccctgcttcgtggccgccctgcccgccgccggcgccgccgaggcccccgccagactgagccccgccatccccctggaggccctgagagacaaggccctgagaatgctgggcgaggccgtgagagacggcggccagcacgccagagaccccgtgggcggcagcgtggagttccagttcgtgcccgtgctgaagctggtgagcaccctgctggtgatgggcatcttcggcgacgaggacgtgaagcagatcctgaagatgatcgagcccgaggtgttcaccgaggaggaggaggaggaggacgaggaggaggagggcgaggaggaggacgaggaggagaaggaggaggacgaggaggagaccgcccaggagaaggaggacgaggagaaggaggaggaggaggccgccgagggcgagaaggaggagggcctggaggagggcctgctgcagatgaagctgcccgagagcgtgaagctgcagatgtgccacctgctggagtacttctgcgaccaggagctgcagcacagagtggagagcctggccgccttcgccgagagatacgtggacaagctgcaggccaaccagagaagcagatacggcctgctgatcaaggccttcagcatgaccgccgccgagaccgccagaagaaccagagagttcagaagccccccccaggagcagatcaacatgctgctgcagttcaaggacggcaccgacgaggaggactgccccctgcccgaggagatcagacaggacctgctggacttccaccaggacctgctggcccactgcggcatccagctggacggcgaggaggaggagcccgaggaggagaccaccctgggcagcagactgatgagcctgctggagaaggtgagactggtgaagaagaaggaggagaagcccgaggaggagagaagcgccgaggagagcaagcccagaagcctgcaggagctggtgagccacatggtggtgagatgggcccaggaggacttcgtgcagagccccgagctggtgagagccatgttcagcctgctgcacagacagtacgacggcctgggcgagctgctgagagccctgcccagagcctacaccatcagccccagcagcgtggaggacaccatgagcctgctggagtgcctgggccagatcagaagcctgctgatcgtgcagatgggcccccaggaggagaacctgatgatccagagcatcggcaacatcatgaacaacaaggtgttctaccagcaccccaacctgatgagagccctgggcatgcacgagaccgtgatggaggtgatggtgaacgtgctgggcggcggcgagagcaaggagatcagattccccaagatggtgaccagctgctgcagattcctgtgctacttctgcagaatcagcagacagaaccagagaagcatgttcgaccacctgagctacctgctggagaacagcggcatcggcctgggcatgcagggcagcacccccctggacgtggccgccgccagcgtgatcgacaacaacgagctggccctggccctgcaggagcaggacctggagaaggtggtgagctacctggccggctgcggcctgcagagctgccccatgctggtggccaagggctaccccgacatcggctggaacccctgcggcggcgagagatacctggacttcctgagattcgccgtgttcgtgaacggcgagagcgtggaggagaacgccaacgtggtggtgagactgctgatcagaaagcccgagtgcttcggccccgccctgagaggcgagggcggcagcggcctgctggccgccatcgaggaggccatcagaatcagcgaggaccccgccagagacggccccggcatcagaagagacagaagaagagagcacttcggcgaggagccccccgaggagaacagagtgcacctgggccacgccatcatgagcttctacgccgccctgatcgacctgctgggcagatgcgcccccgagatgcacctgatccaggccggcaagggcgaggccctgagaatcagagccatcctgagaagcctggtgcccctggaggacctggtgggcatcatcagcctgcccctgcagatccccaccctgggcaaggacggcgccctggtgcagcccaagatgagcgccagcttcgtgcccgaccacaaggccagcatggtgctgttcctggacagagtgtacggcatcgagaaccaggacttcctgctgcacgtgctggacgtgggcttcctgcccgacatgagagccgccgccagcctggacaccgccaccttcagcaccaccgagatggccctggccctgaacagatacctgtgcctggccgtgctgcccctgatcaccaagtgcgcccccctgttcgccggcaccgagcacagagccatcatggtggacagcatgctgcacaccgtgtacagactgagcagaggcagaagcctgaccaaggcccagagagacgtgatcgaggactgcctgatgagcctgtgcagatacatcagacccagcatgctgcagcacctgctgagaagactggtgttcgacgtgcccatcctgaacgagttcgccaagatgcccctgaagctgctgaccaaccactacgagagatgctggaagtactactgcctgcccaccggctgggccaacttcggcgtgaccagcgaggaggagctgcacctgaccagaaagctgttctggggcatcttcgacagcctggcccacaagaagtacgaccccgagctgtacagaatggccatgccctgcctgtgcgccatcgccggcgccctgccccccgactacgtggacgccagctacagcagcaaggccgagaagaaggccaccgtggacgccgagggcaacttcgaccccagacccgtggagaccctgaacgtgatcatccccgagaagctggacagcttcatcaacaagttcgccgagtacacccacgagaagtgggccttcgacaagatccagaacaactggagctacggcgagaacatcgacgaggagctgaagacccaccccatgctgagaccctacaagaccttcagcgagaaggacaaggagatctacagatggcccatcaaggagagcctgaaggccatgatcgcctgggagtggaccatcgagaaggccagagagggcgaggaggagaagaccgagaagaagaagaccagaaagatcagccagagcgcccagacctacgaccccagagagggctacaacccccagccccccgacctgagcgccgtgaccctgagcagagagctgcaggccatggccgagcagctggccgagaactaccacaacacctggggcagaaagaagaagcaggagctggaggccaagggcggcggcacccaccccctgctggtgccctacgacaccctgaccgccaaggagaaggccagagacagagagaaggcccaggagctgctgaagttcctgcagatgaacggctacgccgtgaccagaggcctgaaggacatggagctggacagcagcagcatcgagaagagattcgccttcggcttcctgcagcagctgctgagatggatggacatcagccaggagttcatcgcccacctggaggccgtggtgagcagcggcagagtggagaagagcccccacgagcaggagatcaagttcttcgccaagatcctgctgcccctgatcaaccagtacttcaccaaccactgcctgtacttcctgagcacccccgccaaggtgctgggcagcggcggccacgccagcaacaaggagaaggagatgatcaccagcctgttctgcaagctggccgccctggtgagacacagagtgagcctgttcggcaccgacgcccccgccgtggtgaactgcctgcacatcctggccagaagcctggacgccagaaccgtgatgaagagcggccccgagatcgtgaaggccggcctgagaagcttcttcgagagcgccagcgaggacatcgagaagatggtggagaacctgagactgggcaaggtgagccaggccagaacccaggtgaagggcgtgggccagaacctgacctacaccaccgtggccctgctgcccgtgctgaccaccctgttccagcacatcgcccagcaccagttcggcgacgacgtgatcctggacgacgtgcaggtgagctgctacagaaccctgtgcagcatctacagcctgggcaccaccaagaacacctacgtggagaagctgagacccgccctgggcgagtgcctggccagactggccgccgccatgcccgtggccttcctggagccccagctgaacgagtacaacgcctgcagcgtgtacaccaccaagagccccagagagagagccatcctgggcctgcccaacagcgtggaggagatgtgccccgacatccccgtgctggagagactgatggccgacatcggcggcctggccgagagcggcgccagatacaccgagatgccccacgtgatcgagatcaccctgcccatgctgtgcagctacctgcccagatggtgggagagaggccccgaggccccccccagcgccctgcccgccggcgccccccccccctgcaccgccgtgaccagcgaccacctgaacagcctgctgggcaacatcctgagaatcatcgtgaacaacctgggcatcgacgaggccagctggatgaagagactggccgtgttcgcccagcccatcgtgagcagagccagacccgagctgctgcagagccacttcatccccaccatcggcagactgagaaagagagccggcaaggtggtgagcgaggaggagcagctgagactggaggccaaggccgaggcccaggagggcgagctgctggtgagagacgagttcagcgtgctgtgcagagacctgtacgccctgtaccccctgctgatcagatacgtggacaacaacagagcccagtggctgaccgagcccaaccccagcgccgaggagctgttcagaatggtgggcgagatcttcatctactggagcaagagccacaacttcaagagagaggagcagaacttcgtggtgcagaacgagatcaacaacatgagcttcctgaccgccgacaacaagagcaagatggccaaggccggcgacatccagagcggcggcagcgaccaggagagaaccaagaagaagagaagaggcgacagatacagcgtgcagaccagcctgatcgtggccaccctgaagaagatgctgcccatcggcctgaacatgtgcgcccccaccgaccaggacctgatcaccctggccaagaccagatacgccctgaaggacaccgacgaggaggtgagagagttcctgcacaacaacctgcacctgcagggcaaggtggagggcagccccagcctgagatggcagatggccctgtacagaggcgtgcccggcagagaggaggacgccgacgaccccgagaagatcgtgagaagagtgcaggaggtgagcgccgtgctgtactacctggaccagaccgagcacccctacaagagcaagaaggccgtgtggcacaagctgctgagcaagcagagaagaagagccgtggtggcctgcttcagaatgacccccctgtacaacctgcccacccacagagcctgcaacatgttcctggagagctacaaggccgcctggatcctgaccgaggaccacagcttcgaggacagaatgatcgacgacctgagcaaggccggcgagcaggaggaggaggaggaggaggtggaggagaagaagcccgaccccctgcaccagctggtgctgcacttcagcagaaccgccctgaccgagaagagcaagctggacgaggactacctgtacatggcctacgccgacatcatggccaagagctgccacctggaggagggcggcgagaacggcgaggccgaggaggaggtggaggtgagcttcgaggagaagcagatggagaagcagagactgctgtaccagcaggccagactgcacaccagaggcgccgccgagatggtgctgcagatgatcagcgcctgcaagggcgagaccggcgccatggtgagcagcaccctgaagctgggcatcagcatcctgaacggcggcaacgccgaggtgcagcagaagatgctggactacctgaaggacaagaaggaggtgggcttcttccagagcatccaggccctgatgcagacctgcagcgtgctggacctgaacgccttcgagagacagaacaaggccgagggcctgggcatggtgaacgaggacggcaccgtgggcgagaaggtgatggccgacgacgagttcacccaggacctgttcagattcctgcagctgctgtgcgagggccacaacaacgacttccagaactacctgagaacccagaccggcaacaccaccaccatcaacatcatcatctgcaccgtggactacctgctgagactgcaggagagcatcagcgacttctactggtactacagcggcaaggacgtgatcgaggagcagggcaagagaaacttcagcaaggccatgagcgtggccaagcaggtgttcaacagcctgaccgagtacatccagggcccctgcaccggcaaccagcagagcctggcccacagcagactgtgggacgccgtggtgggcttcctgcacgtgttcgcccacatgatgatgaagctggcccaggacagcagccagatcgagctgctgaaggagctgctggacctgcagaaggacatggtggtgatgctgctgagcctgctggagggcaacgtggtgaacggcatgatcgccagacagatggtggacatgctggtggagagcagcagcaacgtggagatgatcctgaagttcttcgacatgttcctgaagctgaaggacatcgtgggcagcgaggccttccaggactacgtgaccgaccccagaggcctgatcagcaagaaggacttccagaaggccatggacagccagaagcagttcagcggccccgagatccagttcctgctgagctgcagcgaggccgacgagaacgagatgatcaactgcgaggagttcgccaacagattccaggagcccgccagagacatcggcttcaacgtggccgtgctgctgaccaacctgagcgagcacgtgccccacgaccccagactgcacaacttcctggagctggccgagagcatcctggagtacttcagaccctacctgggcagaatcgagatcatgggcgccagcagaagaatcgagagaatctacttcgagatcagcgagaccaacagagcccagtgggagatgccccaggtgaaggagagcaagagacagttcatcttcgacgtggtgaacgagggcggcgaggccgagaagatggagctgttcgtgagcttctgcgaggacaccatcttcgagatgcagatcgccgcccagatcagcgagcccgagggcgagcccgagaccgacgaggacgagggcgccggcgccgccgaggccggcgccgagggcgccgaggagggcgccgccggcctggagggcaccgccgccaccgccgccgccggcgccaccgccagagtggtggccgccgccggcagagccctgagaggcctgagctacagaagcctgagaagaagagtgagaagactgagaagactgaccgccagagaggccgccaccgccgtggccgccctgctgtgggccgccgtgaccagagccggcgccgccggcgccggcgccgccgccggcgccctgggcctgctgtggggcagcctgttcggcggcggcctggtggagggcgccaagaaggtgaccgtgaccgagctgctggccggcatgcccgaccccaccagcgacgaggtgcacggcgagcagcccgccggccccggcggcgacgccgacggcgagggcgccagcgagggcgccggcgacgccgccgagggcgccggcgacgaggaggaggccgtgcacgaggccggccccggcggcgccgacggcgccgtggccgtgaccgacggcggccccttcagacccgagggcgccggcggcctgggcgacatgggcgacaccacccccgccgagccccccacccccgagggcagccccatcctgaagagaaagctgggcgtggacggcgtggaggaggagctgccccccgagcccgagcccgagcccgagcccgagctggagcccgagaaggccgacgccgagaacggcgagaaggaggaggtgcccgagcccacccccgagccccccaagaagcaggccccccccagccccccccccaagaaggaggaggccggcggcgagttctggggcgagctggaggtgcagagagtgaagttcctgaactacctgagcagaaacttctacaccctgagattcctggccctgttcctggccttcgccatcaacttcatcctgctgttctacaaggtgagcgacagcccccccggcgaggacgacatggagggcagcgccgccggcgacgtgagcggcgccggcagcggcggcagcagcggctggggcctgggcgccggcgaggaggccgagggcgacgaggacgagaacatggtgtactacttcctggaggagagcaccggctacatggagcccgccctgagatgcctgagcctgctgcacaccctggtggccttcctgtgcatcatcggctacaactgcctgaaggtgcccctggtgatcttcaagagagagaaggagctggccagaaagctggagttcgacggcctgtacatcaccgagcagcccgaggacgacgacgtgaagggccagtgggacagactggtgctgaacacccccagcttccccagcaactactgggacaagttcgtgaagagaaaggtgctggacaagcacggcgacatctacggcagagagagaatcgccgagctgctgggcatggacctggccaccctggagatcaccgcccacaacgagagaaagcccaaccccccccccggcctgctgacctggctgatgagcatcgacgtgaagtaccagatctggaagttcggcgtgatcttcaccgacaacagcttcctgtacctgggctggtacatggtgatgagcctgctgggccactacaacaacttcttcttcgccgcccacctgctggacatcgccatgggcgtgaagaccctgagaaccatcctgagcagcgtgacccacaacggcaagcagctggtgatgaccgtgggcctgctggccgtggtggtgtacctgtacaccgtggtggccttcaacttcttcagaaagttctacaacaagagcgaggacgaggacgagcccgacatgaagtgcgacgacatgatgacctgctacctgttccacatgtacgtgggcgtgagagccggcggcggcatcggcgacgagatcgaggaccccgccggcgacgagtacgagctgtacagagtggtgttcgacatcaccttcttcttcttcgtgatcgtgatcctgctggccatcatccagggcctgatcatcgacgccttcggcgagctgagagaccagcaggagcaggtgaaggaggacatggagaccaagtgcttcatctgcggcatcggcagcgactacttcgacaccaccccccacggcttcgagacccacaccctggaggagcacaacctggccaactacatgttcttcctgatgtacctgatcaacaaggacgagaccgagcacaccggccaggagagctacgtgtggaagatgtaccaggagagatgctgggacttcttccccgccggcgactgcttcagaaagcagtacgaggaccagctgagctag

SEQ ID NO: 97910 - DNA, 2031 bp, Artificial Sequence
  Description of Artificial Sequence: Synthetic coding sequence
atgaagagcggccccgagatcgtgaaggccggcctgagaagcttcttcgagagcgccagcgaggacatcgagaagatggtggagaacctgagactgggcaaggtgagccaggccagaacccaggtgaagggcgtgggccagaacctgacctacaccaccgtggccctgctgcccgtgctgaccaccctgttccagcacatcgcccagcaccagttcggcgacgacgtgatcctggacgacgtgcaggtgagctgctacagaaccctgtgcagcatctacagcctgggcaccaccaagaacacctacgtggagaagctgagacccgccctgggcgagtgcctggccagactggccgccgccatgcccgtggccttcctggagccccagctgaacgagtacaacgcctgcagcgtgtacaccaccaagagccccagagagagagccatcctgggcctgcccaacagcgtggaggagatgtgccccgacatccccgtgctggagagactgatggccgacatcggcggcctggccgagagcggcgccagatacaccgagatgccccacgtgatcgagatcaccctgcccatgctgtgcagctacctgcccagatggtgggagagaggccccgaggccccccccagcgccctgcccgccggcgccccccccccctgcaccgccgtgaccagcgaccacctgaacagcctgctgggcaacatcctgagaatcatcgtgaacaacctgggcatcgacgaggccagctggatgaagagactggccgtgttcgcccagcccatcgtgagcagagccagacccgagctgctgcagagccacttcatccccaccatcggcagactgagaaagagagccggcaaggtggtgagcgaggaggagcagctgagactggaggccaaggccgaggcccaggagggcgagctgctggtgagagacgagttcagcgtgctgtgcagagacctgtacgccctgtaccccctgctgatcagatacgtggacaacaacagagcccagtggctgaccgagcccaaccccagcgccgaggagctgttcagaatggtgggcgagatcttcatctactggagcaagagccacaacttcaagagagaggagcagaacttcgtggtgcagaacgagatcaacaacatgagcttcctgaccgccgacaacaagagcaagatggccaaggccggcgacatccagagcggcggcagcgaccaggagagaaccaagaagaagagaagaggcgacagatacagcgtgcagaccagcctgatcgtggccaccctgaagaagatgctgcccatcggcctgaacatgtgcgcccccaccgaccaggacctgatcaccctggccaagaccagatacgccctgaaggacaccgacgaggaggtgagagagttcctgcacaacaacctgcacctgcagggcaaggtggagggcagccccagcctgagatggcagatggccctgtacagaggcgtgcccggcagagaggaggacgccgacgaccccgagaagatcgtgagaagagtgcaggaggtgagcgccgtgctgtactacctggaccagaccgagcacccctacaagagcaagaaggccgtgtggcacaagctgctgagcaagcagagaagaagagccgtggtggcctgcttcagaatgacccccctgtacaacctgcccacccacagagcctgcaacatgttcctggagagctacaaggccgcctggatcctgaccgaggaccacagcttcgaggacagaatgatcgacgacctgagcaaggccggcgagcaggaggaggaggaggaggaggtggaggagaagaagcccgaccccctgcaccagctggtgctgcacttcagcagaaccgccctgaccgagaagagcaagctggacgaggactacctgtacatggcctacgccgacatcatggccaagagctgccacctggaggagggcggcgagaacggcgaggccgaggaggaggtggaggtgagcttcgaggagaagcagtag

SEQ ID NO: 97911 - DNA, 14922 bp, Artificial Sequence
  Description of Artificial Sequence: Synthetic coding sequence
ctgggccccagaagcagcagcaacaagctgagcaacaagaagatgatgaagtggttctgcagcgccccccagcccagcaccaagaacaacagaagctacgcctggcagcagaaggacctggccaccgacttcgtgagctggagccccctgcccatccccagaatgtgcccccagaccagccccagcgcccccctgtgctggagcagccccagcctgagcggcagatgcagaagatgctggctgaccccctggagaaaccagaagggccagctggacatcatcaagtggagcttcggcctgaagaccgcccagggcggcggccacagaaccctgctgtacggccacgccatcctgctgagacacagctacagcggcatgtacctgtgctgcctgagcaccagcagaagcagcaccgacaagctggccttcgacgtgggcctgcaggaggacaccaccggcgaggcctgctggtggaccatccaccccgccagcaagcagagaagcgagggcgagaaggtgagagtgggcgacgacctgatcctggtgagcgtgagcagcgagagatacctgcacctgagctacggcaacggcagcctgcacgtggacgccgccttccagcagaccctgtggagcgtggcccccatcagcagcggcagcgaggccgcccagggctacctgatcggcggcgacgtgctgagactgctgcacggccacatggacgagtgcctgaccgtgcccagcggcgagcacggcgaggagcagagaagaaccgtgcactacgagggcggcgccgtgagcgtgcacgccagaagcctgtggagactggagaccctgagagtggcctggagcggcagccacatcagatggggccagcccttcagactgagacacgtgaccaccggcaagtacctgagcctgatggaggacaagaacctgctgctgatggacaaggagaaggccgacgtgaagagcaccgccttcaccttcagaagcagcaaggagaagctggacgtgggcgtgagaaaggaggtggacggcatgggcaccagcgagatcaagtacggcgacagcgtgtgctacatccagcacgtggacaccggcctgtggctgacctaccagagcgtggacgtgaagagcgtgagaatgggcagcatccagagaaaggccatcatgcaccacgagggccacatggacgacggcatcagcctgagcagaagccagcacgaggagagcagaaccgccagagtgatcagaagcaccgtgttcctgttcaacagattcatcagaggcctggacgccctgagcaagaaggccaaggccagcaccgtggacctgcccatcgagagcgtgagcctgagcctgcaggacctgatcggctacttccacccccccgacgagcacctggagcacgaggacaagcagaacagactgagagccctgaagaacagacagaacctgttccaggaggagggcatgatcaacctggtgctggagtgcatcgacagactgcacgtgtacagcagcgccgcccacttcgccgacgtggccggcagagaggccggcgagagctggaagagcatcctgaacagcctgtacgagctgctggccgccctgatcagaggcaacagaaagaactgcgcccagttcagcggcagcctggactggctgatcagcagactggagagactggaggccagcagcggcatcctggaggtgctgcactgcgtgctggtggagagccccgaggccctgaacatcatcaaggagggccacatcaagagcatcatcagcctgctggacaagcacggcagaaaccacaaggtgctggacgtgctgtgcagcctgtgcgtgtgccacggcgtggccgtgagaagcaaccagcacctgatctgcgacaacctgctgcccggcagagacctgctgctgcagaccagactggtgaaccacgtgagcagcatgagacccaacatcttcctgggcgtgagcgagggcagcgcccagtacaagaagtggtactacgagctgatggtggaccacaccgagcccttcgtgaccgccgaggccacccacctgagagtgggctgggccagcaccgagggctacagcccctaccccggcggcggcgaggagtggggcggcaacggcgtgggcgacgacctgttcagctacggcttcgacggcctgcacctgtggagcggctgcatcgccagaaccgtgagcagccccaaccagcacctgctgagaaccgacgacgtgatcagctgctgcctggacctgagcgcccccagcatcagcttcagaatcaacggccagcccgtgcagggcatgttcgagaacttcaacatcgacggcctgttcttccccgtggtgagcttcagcgccggcatcaaggtgagattcctgctgggcggcagacacggcgagttcaagttcctgcccccccccggctacgccccctgctacgaggccgtgctgcccaaggagaagctgaaggtggagcacagcagagagtacaagcaggagagaacctacaccagagacctgctgggccccaccgtgagcctgacccaggccgccttcacccccatccccgtggacaccagccagatcgtgctgcccccccacctggagagaatcagagagaagctggccgagaacatccacgagctgtgggtgatgaacaagatcgagctgggctggcagtacggccccgtgagagacgacaacaagagacagcacccctgcctggtggagttcagcaagctgcccgagcaggagagaaactacaacctgcagatgagcctggagaccctgaagaccctgctggccctgggctgccacgtgggcatcagcgacgagcacgccgaggacaaggtgaagaagatgaagctgcccaagaactaccagctgaccagcggctacaagcccgcccccatggacctgagcttcatcaagctgacccccagccaggaggccatggtggacaagctggccgagaacgcccacaacgtgtgggccagagacagaatcagacagggctggacctacggcatccagcaggacgtgaagaacagaagaaaccccagactggtgccctacaccctgctggacgacagaaccaagaagagcaacaaggacagcctgagagaggccgtgagaaccctgctgggctacggctacaacctggaggcccccgaccaggaccacgccgccagagccgaggtgtgcagcggcaccggcgagagattcagaatcttcagagccgagaagacctacgccgtgaaggccggcagatggtacttcgagttcgagaccgtgaccgccggcgacatgagagtgggctggagcagacccggctgccagcccgaccaggagctgggcagcgacgagagagccttcgccttcgacggcttcaaggcccagagatggcaccagggcaacgagcactacggcagaagctggcaggccggcgacgtggtgggctgcatggtggacatgaacgagcacaccatgatgttcaccctgaacggcgagatcctgctggacgacagcggcagcgagctggccttcaaggacttcgacgtgggcgacggcttcatccccgtgtgcagcctgggcgtggcccaggtgggcagaatgaacttcggcaaggacgtgagcaccctgaagtacttcaccatctgcggcctgcaggagggctacgagcccttcgccgtgaacaccaacagagacatcaccatgtggctgagcaagagactgccccagttcctgcaggtgcccagcaaccacgagcacatcgaggtgaccagaatcgacggcaccatcgacagcagcccctgcctgaaggtgacccagaagagcttcggcagccagaacagcaacaccgacatcatgttctacagactgagcatgcccatcgagtgcgccgaggtgttcagcaagaccgtggccggcggcctgcccggcgccggcctgttcggccccaagaacgacctggaggactacgacgccgacagcgacttcgaggtgctgatgaagaccgcccacggccacctggtgcccgacagagtggacaaggacaaggaggccaccaagcccgagttcaacaaccacaaggactacgcccaggagaagcccagcagactgaagcagagattcctgctgagaagaaccaagcccgactacagcaccagccacagcgccagactgaccgaggacgtgctggccgacgacagagacgactacgacttcctgatgcagaccagcacctactactacagcgtgagaatcttccccggccaggagcccgccaacgtgtgggtgggctggatcaccagcgacttccaccagtacgacaccggcttcgacctggacagagtgagaaccgtgaccgtgaccctgggcgacgagaagggcaaggtgcacgagagcatcaagagaagcaactgctacatggtgtgcgccggcgagagcatgagccccggccagggcagaaacaacaacggcctggagatcggctgcgtggtggacgccgccagcggcctgctgaccttcatcgccaacggcaaggagctgagcacctactaccaggtggagcccagcaccaagctgttccccgccgtgttcgcccaggccaccagccccaacgtgttccagttcgagctgggcagaatcaagaacgtgatgcccctgagcgccggcctgttcaagagcgagcacaagaaccccgtgccccagtgcccccccagactgcacgtgcagttcctgagccacgtgctgtggagcagaatgcccaaccagttcctgaaggtggacgtgagcagaatcagcgagagacagggctggctggtgcagtgcctggaccccctgcagttcatgagcctgcacatccccgaggagaacagaagcgtggacatcctggagctgaccgagcaggaggagctgctgaagttccactaccacaccctgagactgtacagcgccgtgtgcgccctgggcaaccacagagtggcccacgccctgtgcagccacgtggacgagccccagctgctgtacgccatcgagaacaagtacatgcccggcctgctgagagccggctactacgacctgctgatcgacatccacctgagcagctacgccaccgccagactgatgatgaacaacgagtacatcgtgcccatgaccgaggagaccaagagcatcaccctgttccccgacgagaacaagaagcacggcctgcccggcatcggcctgagcaccagcctgagacccagaatgcagttcagcagccccagcttcgtgagcatcagcaacgagtgctaccagtacagccccgagttccccctggacatcctgaagagcaagaccatccagatgctgaccgaggccgtgaaggagggcagcctgcacgccagagaccccgtgggcggcaccaccgagttcctgttcgtgcccctgatcaagctgttctacaccctgctgatcatgggcatcttccacaacgaggacctgaagcacatcctgcagctgatcgagcccagcgtgttcaaggaggccgccacccccgaggaggagagcgacaccctggagaaggagctgagcgtggacgacgccaagctgcagggcgccggcgaggaggaggccaagggcggcaagagacccaaggagggcctgctgcagatgaagctgcccgagcccgtgaagctgcagatgtgcctgctgctgcagtacctgtgcgactgccaggtgagacacagaatcgaggccatcgtggccttcagcgacgacttcgtggccaagctgcaggacaaccagagattcagatacaacgaggtgatgcaggccctgaacatgagcgccgccctgaccgccagaaagaccaaggagttcagaagccccccccaggagcagatcaacatgctgctgaacttcaaggacgacaagagcgagtgcccctgccccgaggagatcagagaccagctgctggacttccacgaggacctgatgacccactgcggcatcgagctggacgaggacggcagcctggacggcaacagcgacctgaccatcagaggcagactgctgagcctggtggagaaggtgacctacctgaagaagaagcaggccgagaagcccgtggagagcgacagcaagaagagcagcaccctgcagcagctgatcagcgagaccatggtgagatgggcccaggagagcgtgatcgaggaccccgagctggtgagagccatgttcgtgctgctgcacagacagtacgacggcatcggcggcctggtgagagccctgcccaagacctacaccatcaacggcgtgagcgtggaggacaccatcaacctgctggccagcctgggccagatcagaagcctgctgagcgtgagaatgggcaaggaggaggagaagctgatgatcagaggcctgggcgacatcatgaacaacaaggtgttctaccagcaccccaacctgatgagagccctgggcatgcacgagaccgtgatggaggtgatggtgaacgtgctgggcggcggcgagagcaaggagatcaccttccccaagatggtggccaactgctgcagattcctgtgctacttctgcagaatcagcagacagaaccagaaggccatgttcgaccacctgagctacctgctggagaacagcagcgtgggcctggccagccccgccatgagaggcagcacccccctggacgtggccgccgccagcgtgatggacaacaacgagctggccctggccctgagagagcccgacctggagaaggtggtgagatacctggccggctgcggcctgcagagctgccagatgctggtgagcaagggctaccccgacatcggctggaaccccgtggagggcgagagatacctggacttcctgagattcgccgtgttctgcaacggcgagagcgtggaggagaacgccaacgtggtggtgagactgctgatcagaagacccgagtgcttcggccccgccctgagaggcgagggcggcaacggcctgctggccgccatggaggaggccatcaagatcgccgaggaccccagcagagacggccccagccccaacagcggcagcagcaagaccctggacaccgaggaggaggaggacgacaccatccacatgggcaacgccatcatgaccttctacagcgccctgatcgacctgctgggcagatgcgcccccgagatgcacctgatccacgccggcaagggcgaggccatcagaatcagaagcatcctgagaagcctgatccccctgggcgacctggtgggcgtgatcagcatcgccttccagatgcccaccatcgccaaggacggcaacgtggtggagcccgacatgagcgccggcttctgccccgaccacaaggccgccatggtgctgttcctggacagagtgtacggcatcgaggtgcaggacttcctgctgcacctgctggaggtgggcttcctgcccgacctgagagccgccgccagcctggacaccgccgccctgagcgccaccgacatggccctggccctgaacagatacctgtgcaccgccgtgctgcccctgctgaccagatgcgcccccctgttcgccggcaccgagcaccacgccagcctgatcgacagcctgctgcacaccgtgtacagactgagcaagggctgcagcctgaccaaggcccagagagacagcatcgaggtgtgcctgctgagcatctgcggccagctgagacccagcatgatgcagcacctgctgagaagactggtgttcgacgtgcccctgctgaacgagcacgccaagatgcccctgaagctgctgaccaaccactacgagagatgctggaagtactactgcctgcccggcggctggggcaacttcggcgccgccagcgaggaggagctgcacctgagcagaaagctgttctggggcatcttcgacgccctgagccagaagaagtacgagcaggagctgttcaagctggccctgccctgcctgagcgccgtggccggcgccctgccccccgactacatggagagcaactacgtgagcatgatggagaagcagagcagcatggacagcgagggcaacttcaacccccagcccgtggacaccagcaacatcaccatccccgagaagctggagtacttcatcaacaagtacgccgagcacagccacgacaagtggagcatggacaagctggccaacggctggatctacggcgagatctacagcgacagcagcaaggtgcagcccctgatgaagccctacaagctgctgagcgagaaggagaaggagatctacagatggcccatcaaggagagcctgaagaccatgctggcctggggctggagaatcgagagaaccagagagggcgacagcatggccctgtacaacagaaccagaagaatcagccagaccagccaggtgagcgtggacgccgcccacggctacagccccagagccatcgacatgagcaacgtgaccctgagcagagacctgcacgccatggccgagatgatggccgagaactaccacaacatctgggccaagaagaagaagatggagctggagagcaagggcggcggcaaccaccccctgctggtgccctacgacaccctgaccgccaaggagaaggccaaggacagagagaaggcccaggacatcctgaagttcctgcagatcaacggctacgccgtgagcagaggcttcaaggacctggagctggacacccccagcatcgagaagagattcgcctacagcttcctgcagcagctgatcagatacgtggacgaggcccaccagtacatcctggagttcgacggcggcagcagaggcaagggcgagcacttcccctacgagcaggagatcaagttcttcgccaaggtggtgctgcccctgatcgaccagtacttcaagaaccacagactgtacttcctgagcgccgccagcagacccctgtgcagcggcggccacgccagcaacaaggagaaggagatggtgaccagcctgttctgcaagctgggcgtgctggtgagacacagaatcagcctgttcggcaacgacgccaccagcatcgtgaactgcctgcacatcctgggccagaccctggacgccagaaccgtgatgaagaccggcctggagagcgtgaagagcgccctgagagccttcctggacaacgccgccgaggacctggagaagaccatggagaacctgaagcagggccagttcacccacaccagaaaccagcccaagggcgtgacccagatcatcaactacaccaccgtggccctgctgcccatgctgagcagcctgttcgagcacatcggccagcaccagttcggcgaggacctgatcctggaggacgtgcaggtgagctgctacagaatcctgaccagcctgtacgccctgggcaccagcaagagcatctacgtggagagacagagaagcgccctgggcgagtgcctggccgccttcgccggcgccttccccgtggccttcctggagacccacctggacaagcacaacatctacagcatctacaacaccaagagcagcagagagagagccgccctgagcctgcccaccaacgtggaggacgtgtgccccaacatccccagcctggagaagctgatggaggagatcgtggagctggccgagagcggcatcagatacacccagatgccccacgtgatggaggtgatcctgcccatgctgtgcagctacatgagcagatggtgggagcacggccccgagaacaaccccgagagagccgagatgtgctgcaccgccctgaacagcgagcacatgaacaccctgctgggcaacatcctgaagatcatctacaacaacctgggcatcgacgagggcgcctggatgaagagactggccgtgttcagccagcccatcatcaacaaggtgaagccccagctgctgaagacccacttcctgcccctgatggagaagctgaagaagaaggccgccaccgtggtgagcgaggaggaccacctgaaggccgaggccagaggcgacatgagcgaggccgagctgctgatcctggacgagttcaccaccctggccagagacctgtacgccttctaccccctgctgatcagattcgtggactacaacagagccaagtggctgaaggagcccaaccccgaggccgaggagctgttcagaatggtggccgaggtgttcatctactggagcaagagccacaacttcaagagagaggagcagaacttcgtggtgcagaacgagatcaacaacatgagcttcctgatcaccgacaccaagagcaagatgagcaaggccgccgtgagcgaccaggagagaaagaagatgaagagaaagggcgacagatacagcatgcagaccagcctgatcgtggccgccctgaagagactgctgcccatcggcctgaacatctgcgcccccggcgaccaggagctgatcgccctggccaagaacagattcagcctgaaggacaccgaggacgaggtgagagacatcatcagaagcaacatccacctgcagggcaagctggaggaccccgccatcagatggcagatggccctgtacaaggacctgcccaacagaaccgacgacaccagcgaccccgagaagaccgtggagagagtgctggacatcgccaacgtgctgttccacctggagcagaagagcaagagagtgggcagaagacactactgcctggtggagcacccccagagaagcaagaaggccgtgtggcacaagctgctgagcaagcagagaaagagagccgtggtggcctgcttcagaatggcccccctgtacaacctgcccagacacagagccgtgaacctgttcctgcagggctacgagaagagctggatcgagaccgaggagcactacttcgaggacaagctgatcgaggacctggccaagcccggcgccgagccccccgaggaggacgagggcaccaagagagtggaccccctgcaccagctgatcctgctgttcagcagaaccgccctgaccgagaagtgcaagctggaggaggacttcctgtacatggcctacgccgacatcatggccaagagctgccacgacgaggaggacgacgacggcgaggaggaggtgaagagcttcgaggtgaccggcagccagagaagcaaggagaaggagatggagaagcagaagctgctgtaccagcaggccagactgcacgacagaggcgccgccgagatggtgctgcagaccatcagcgccagcaagggcgagaccggccccatggtggccgccaccctgaagctgggcatcgccatcctgaacggcggcaacagcaccgtgcagcagaagatgctggactacctgaaggagaagaaggacgtgggcttcttccagagcctggccggcctgatgcagagctgcagcgtgctggacctgaacgccttcgagagacagaacaaggccgagggcctgggcatggtgaccgaggagggcagcggcgagaaggtgctgcaggacgacgagttcacctgcgacctgttcagattcctgcagctgctgtgcgagggccacaacagcgacttccagaactacctgagaacccagaccggcaacaacaccaccgtgaacatcatcatcagcaccgtggactacctgctgagagtgcaggagagcatcagcgacttctactggtactacagcggcaaggacgtgatcgacgagcagggccagagaaacttcagcaaggccatccaggtggccaagcaggtgttcaacaccctgaccgagtacatccagggcccctgcaccggcaaccagcagagcctggcccacagcagactgtgggacgccgtggtgggcttcctgcacgtgttcgcccacatgcagatgaagctgagccaggacagcagccagatcgagctgctgaaggagctgatggacctgcagaaggacatggtggtgatgctgctgagcatgctggagggcaacgtggtgaacggcaccatcggcaagcagatggtggacatgctggtggagagcagcaacaacgtggagatgatcctgaagttcttcgacatgttcctgaagctgaaggacctgaccagcagcgacaccttcaaggagtacgaccccgacggcaagggcgtgatcagcaagagagacttccacaaggccatggagagccacaagcactacacccagagcgagaccgagttcctgctgagctgcgccgagaccgacgagaacgagaccctggactacgaggagttcgtgaagagattccacgagcccgccaaggacatcggcttcaacgtggccgtgctgctgaccaacctgagcgagcacatgcccaacgacaccagactgcagaccttcctggagctggccgagagcgtgctgaactacttccagcccttcctgggcagaatcgagatcatgggcagcgccaagagaatcgagagagtgtacttcgagatcagcgagagcagcagaacccagtgggagaagccccaggtgaaggagagcaagagacagttcatcttcgacgtggtgaacgagggcggcgagaaggagaagatggagctgttcgtgaacttctgcgaggacaccatcttcgagatgcagctggccgcccagatcagcgagagcgacctgaacgagagaagcgccaacaaggaggagagcgagaaggagagacccgaggagcagggccccagaatggccttcttcagcatcctgaccgtgagaagcgccctgttcgccctgagatacaacatcctgaccctgatgagaatgctgagcctgaagagcctgaagaagcagatgaagaaggtgaagaagatgaccgtgaaggacatggtgaccgccttcttcagcagctactggagcatcttcatgaccctgctgcacttcgtggccagcgtgttcagaggcttcttcagaatcatctgcagcctgctgctgggcggcagcctggtggagggcgccaagaagatcaaggtggccgagctgctggccaacatgcccgaccccacccaggacgaggtgagaggcgacggcgaggagggcgagagaaagcccctggaggccgccctgcccagcgaggacctgaccgacctgaaggagctgaccgaggagagcgacctgctgagcgacatcttcggcctggacctgaagagagagggcggccagtacaagctgatcccccacaaccccaacgccggcctgagcgacctgatgagcaaccccgtgcccatgcccgaggtgcaggagaagttccaggagcagaaggccaaggaggaggagaaggaggagaaggaggagaccaagagcgagcccgagaaggccgagggcgaggacggcgagaaggaggagaaggccaaggaggacaagggcaagcagaagctgagacagctgcacacccacagatacggcgagcccgaggtgcccgagagcgccttctggaagaagatcatcgcctaccagcagaagctgctgaactacttcgccagaaacttctacaacatgagaatgctggccctgttcgtggccttcgccatcaacttcatcctgctgttctacaaggtgagcaccagcagcgtggtggagggcaaggagctgcccaccagaagcagcagcgagaacgccaaggtgaccagcctggacagcagcagccacagaatcatcgccgtgcactacgtgctggaggagagcagcggctacatggagcccaccctgagaatcctggccatcctgcacaccgtgatcagcttcttctgcatcatcggctactactgcctgaaggtgcccctggtgatcttcaagagagagaaggaggtggccagaaagctggagttcgacggcctgtacatcaccgagcagcccagcgaggacgacatcaagggccagtgggacagactggtgatcaacacccagagcttccccaacaactactgggacaagttcgtgaagagaaaggtgatggacaagtacggcgagttctacggcagagacagaatcagcgagctgctgggcatggacaaggccgccctggacttcagcgacgccagagagaagaagaagcccaagaaggacagcagcctgagcgccgtgctgaacagcatcgacgtgaagtaccagatgtggaagctgggcgtggtgttcaccgacaacagcttcctgtacctggcctggtacatgaccatgagcgtgctgggccactacaacaacttcttcttcgccgcccacctgctggacatcgccatgggcttcaagaccctgagaaccatcctgagcagcgtgacccacaacggcaagcagctggtgctgaccgtgggcctgctggccgtggtggtgtacctgtacaccgtggtggccttcaacttcttcagaaagttctacaacaagagcgaggacggcgacacccccgacatgaagtgcgacgacatgctgacctgctacatgttccacatgtacgtgggcgtgagagccggcggcggcatcggcgacgagatcgaggaccccgccggcgacgagtacgagatctacagaatcatcttcgacatcaccttcttcttcttcgtgatcgtgatcctgctggccatcatccagggcctgatcatcgacgccttcggcgagctgagagaccagcaggagcaggtgaaggaggacatggagaccaagtgcttcatctgcggcatcggcaacgactacttcgacaccgtgccccacggcttcgagacccacaccctgcaggagcacaacctggccaactacctgttcttcctgatgtacctgatcaacaaggacgagaccgagcacaccggccaggagagctacgtgtggaagatgtaccaggagagatgctgggagttcttccccgccggcgactgcttcagaaagcagtacgaggaccagctgaactag

SEQ ID NO: 97912 - DNA, 14904 bp, Artificial Sequence
  Description of Artificial Sequence: Synthetic coding sequence
atggccgacggcggcgagggcgaggacgagatccagttcctgagaaccgacgacgaggtggtgctgcagtgcaccgccaccatccacaaggagcagcagaagctgtgcctggccgccgagggcttcggcaacagactgtgcttcctggagagcaccagcaacagcaagaacgtgccccccgacctgagcatctgcaccttcgtgctggagcagagcctgagcgtgagagccctgcaggagatgctggccaacaccgtggagaagagcgagggccaggtggacgtggagaagtggaagttcatgatgaagaccgcccagggcggcggccacagaaccctgctgtacggccacgccatcctgctgagacacagctacagcggcatgtacctgtgctgcctgagcaccagcagaagcagcaccgacaagctggccttcgacgtgggcctgcaggaggacaccaccggcgaggcctgctggtggaccatccaccccgccagcaagcagagaagcgagggcgagaaggtgagagtgggcgacgacctgatcctggtgagcgtgagcagcgagagatacctgcacctgagctacggcaacggcagcctgcacgtggacgccgccttccagcagaccctgtggagcgtggcccccatcagcagcggcagcgaggccgcccagggctacctgatcggcggcgacgtgctgagactgctgcacggccacatggacgagtgcctgaccgtgcccagcggcgagcacggcgaggagcagagaagaaccgtgcactacgagggcggcgccgtgagcgtgcacgccagaagcctgtggagactggagaccctgagagtggcctggagcggcagccacatcagatggggccagcccttcagactgagacacgtgaccaccggcaagtacctgagcctgatggaggacaagaacctgctgctgatggacaaggagaaggccgacgtgaagagcaccgccttcaccttcagaagcagcaaggagaagctggacgtgggcgtgagaaaggaggtggacggcatgggcaccagcgagatcaagtacggcgacagcgtgtgctacatccagcacgtggacaccggcctgtggctgacctaccagagcgtggacgtgaagagcgtgagaatgggcagcatccagagaaaggccatcatgcaccacgagggccacatggacgacggcatcagcctgagcagaagccagcacgaggagagcagaaccgccagagtgatcagaagcaccgtgttcctgttcaacagattcatcagaggcctggacgccctgagcaagaaggccaaggccagcaccgtggacctgcccatcgagagcgtgagcctgagcctgcaggacctgatcggctacttccacccccccgacgagcacctggagcacgaggacaagcagaacagactgagagccctgaagaacagacagaacctgttccaggaggagggcatgatcaacctggtgctggagtgcatcgacagactgcacgtgtacagcagcgccgcccacttcgccgacgtggccggcagagaggccggcgagagctggaagagcatcctgaacagcctgtacgagctgctggccgccctgatcagaggcaacagaaagaactgcgcccagttcagcggcagcctggactggctgatcagcagactggagagactggaggccagcagcggcatcctggaggtgctgcactgcgtgctggtggagagccccgaggccctgaacatcatcaaggagggccacatcaagagcatcatcagcctgctggacaagcacggcagaaaccacaaggtgctggacgtgctgtgcagcctgtgcgtgtgccacggcgtggccgtgagaagcaaccagcacctgatctgcgacaacctgctgcccggcagagacctgctgctgcagaccagactggtgaaccacgtgagcagcatgagacccaacatcttcctgggcgtgagcgagggcagcgcccagtacaagaagtggtactacgagctgatggtggaccacaccgagcccttcgtgaccgccgaggccacccacctgagagtgggctgggccagcaccgagggctacagcccctaccccggcggcggcgaggagtggggcggcaacggcgtgggcgacgacctgttcagctacggcttcgacggcctgcacctgtggagcggctgcatcgccagaaccgtgagcagccccaaccagcacctgctgagaaccgacgacgtgatcagctgctgcctggacctgagcgcccccagcatcagcttcagaatcaacggccagcccgtgcagggcatgttcgagaacttcaacatcgacggcctgttcttccccgtggtgagcttcagcgccggcatcaaggtgagattcctgctgggcggcagacacggcgagttcaagttcctgcccccccccggctacgccccctgctacgaggccgtgctgcccaaggagaagctgaaggtggagcacagcagagagtacaagcaggagagaacctacaccagagacctgctgggccccaccgtgagcctgacccaggccgccttcacccccatccccgtggacaccagccagatcgtgctgcccccccacctggagagaatcagagagaagctggccgagaacatccacgagctgtgggtgatgaacaagatcgagctgggctggcagtacggccccgtgagagacgacaacaagagacagcacccctgcctggtggagttcagcaagctgcccgagcaggagagaaactacaacctgcagatgagcctggagaccctgaagaccctgctggccctgggctgccacgtgggcatcagcgacgagcacgccgaggacaaggtgaagaagatgaagctgcccaagaactaccagctgaccagcggctacaagcccgcccccatggacctgagcttcatcaagctgacccccagccaggaggccatggtggacaagctggccgagaacgcccacaacgtgtgggccagagacagaatcagacagggctggacctacggcatccagcaggacgtgaagaacagaagaaaccccagactggtgccctacaccctgctggacgacagaaccaagaagagcaacaaggacagcctgagagaggccgtgagaaccctgctgggctacggctacaacctggaggcccccgaccaggaccacgccgccagagccgaggtgtgcagcggcaccggcgagagattcagaatcttcagagccgagaagacctacgccgtgaaggccggcagatggtacttcgagttcgagaccgtgaccgccggcgacatgagagtgggctggagcagacccggctgccagcccgaccaggagctgggcagcgacgagagagccttcgccttcgacggcttcaaggcccagagatggcaccagggcaacgagcactacggcagaagctggcaggccggcgacgtggtgggctgcatggtggacatgaacgagcacaccatgatgttcaccctgaacggcgagatcctgctggacgacagcggcagcgagctggccttcaaggacttcgacgtgggcgacggcttcatccccgtgtgcagcctgggcgtggcccaggtgggcagaatgaacttcggcaaggacgtgagcaccctgaagtacttcaccatctgcggcctgcaggagggctacgagcccttcgccgtgaacaccaacagagacatcaccatgtggctgagcaagagactgccccagttcctgcaggtgcccagcaaccacgagcacatcgaggtgaccagaatcgacggcaccatcgacagcagcccctgcctgaaggtgacccagaagagcttcggcagccagaacagcaacaccgacatcatgttctacagactgagcatgcccatcgagtgcgccgaggtgttcagcaagaccgtggccggcggcctgcccggcgccggcctgttcggccccaagaacgacctggaggactacgacgccgacagcgacttcgaggtgctgatgaagaccgcccacggccacctggtgcccgacagagtggacaaggacaaggaggccaccaagcccgagttcaacaaccacaaggactacgcccaggagaagcccagcagactgaagcagagattcctgctgagaagaaccaagcccgactacagcaccagccacagcgccagactgaccgaggacgtgctggccgacgacagagacgactacgacttcctgatgcagaccagcacctactactacagcgtgagaatcttccccggccaggagcccgccaacgtgtgggtgggctggatcaccagcgacttccaccagtacgacaccggcttcgacctggacagagtgagaaccgtgaccgtgaccctgggcgacgagaagggcaaggtgcacgagagcatcaagagaagcaactgctacatggtgtgcgccggcgagagcatgagccccggccagggcagaaacaacaacggcctggagatcggctgcgtggtggacgccgccagcggcctgctgaccttcatcgccaacggcaaggagctgagcacctactaccaggtggagcccagcaccaagctgttccccgccgtgttcgcccaggccaccagccccaacgtgttccagttcgagctgggcagaatcaagaacgtgatgcccctgagcgccggcctgttcaagagcgagcacaagaaccccgtgccccagtgcccccccagactgcacgtgcagttcctgagccacgtgctgtggagcagaatgcccaaccagttcctgaaggtggacgtgagcagaatcagcgagagacagggctggctggtgcagtgcctggaccccctgcagttcatgagcctgcacatccccgaggagaacagaagcgtggacatcctggagctgaccgagcaggaggagctgctgaagttccactaccacaccctgagactgtacagcgccgtgtgcgccctgggcaaccacagagtggcccacgccctgtgcagccacgtggacgagccccagctgctgtacgccatcgagaacaagtacatgcccggcctgctgagagccggctactacgacctgctgatcgacatccacctgagcagctacgccaccgccagactgatgatgaacaacgagtacatcgtgcccatgaccgaggagaccaagagcatcaccctgttccccgacgagaacaagaagcacggcctgcccggcatcggcctgagcaccagcctgagacccagaatgcagttcagcagccccagcttcgtgagcatcagcaacgagtgctaccagtacagccccgagttccccctggacatcctgaagagcaagaccatccagatgctgaccgaggccgtgaaggagggcagcctgcacgccagagaccccgtgggcggcaccaccgagttcctgttcgtgcccctgatcaagctgttctacaccctgctgatcatgggcatcttccacaacgaggacctgaagcacatcctgcagctgatcgagcccagcgtgttcaaggaggccgccacccccgaggaggagagcgacaccctggagaaggagctgagcgtggacgacgccaagctgcagggcgccggcgaggaggaggccaagggcggcaagagacccaaggagggcctgctgcagatgaagctgcccgagcccgtgaagctgcagatgtgcctgctgctgcagtacctgtgcgactgccaggtgagacacagaatcgaggccatcgtggccttcagcgacgacttcgtggccaagctgcaggacaaccagagattcagatacaacgaggtgatgcaggccctgaacatgagcgccgccctgaccgccagaaagaccaaggagttcagaagccccccccaggagcagatcaacatgctgctgaacttcaaggacgacaagagcgagtgcccctgccccgaggagatcagagaccagctgctggacttccacgaggacctgatgacccactgcggcatcgagctggacgaggacggcagcctggacggcaacagcgacctgaccatcagaggcagactgctgagcctggtggagaaggtgacctacctgaagaagaagcaggccgagaagcccgtggagagcgacagcaagaagagcagcaccctgcagcagctgatcagcgagaccatggtgagatgggcccaggagagcgtgatcgaggaccccgagctggtgagagccatgttcgtgctgctgcacagacagtacgacggcatcggcggcctggtgagagccctgcccaagacctacaccatcaacggcgtgagcgtggaggacaccatcaacctgctggccagcctgggccagatcagaagcctgctgagcgtgagaatgggcaaggaggaggagaagctgatgatcagaggcctgggcgacatcatgaacaacaaggtgttctaccagcaccccaacctgatgagagccctgggcatgcacgagaccgtgatggaggtgatggtgaacgtgctgggcggcggcgagagcaaggagatcaccttccccaagatggtggccaactgctgcagattcctgtgctacttctgcagaatcagcagacagaaccagaaggccatgttcgaccacctgagctacctgctggagaacagcagcgtgggcctggccagccccgccatgagaggcagcacccccctggacgtggccgccgccagcgtgatggacaacaacgagctggccctggccctgagagagcccgacctggagaaggtggtgagatacctggccggctgcggcctgcagagctgccagatgctggtgagcaagggctaccccgacatcggctggaaccccgtggagggcgagagatacctggacttcctgagattcgccgtgttctgcaacggcgagagcgtggaggagaacgccaacgtggtggtgagactgctgatcagaagacccgagtgcttcggccccgccctgagaggcgagggcggcaacggcctgctggccgccatggaggaggccatcaagatcgccgaggaccccagcagagacggccccagccccaacagcggcagcagcaagaccctggacaccgaggaggaggaggacgacaccatccacatgggcaacgccatcatgaccttctacagcgccctgatcgacctgctgggcagatgcgcccccgagatgcacctgatccacgccggcaagggcgaggccatcagaatcagaagcatcctgagaagcctgatccccctgggcgacctggtgggcgtgatcagcatcgccttccagatgcccaccatcgccaaggacggcaacgtggtggagcccgacatgagcgccggcttctgccccgaccacaaggccgccatggtgctgttcctggacagagtgtacggcatcgaggtgcaggacttcctgctgcacctgctggaggtgggcttcctgcccgacctgagagccgccgccagcctggacaccgccgccctgagcgccaccgacatggccctggccctgaacagatacctgtgcaccgccgtgctgcccctgctgaccagatgcgcccccctgttcgccggcaccgagcaccacgccagcctgatcgacagcctgctgcacaccgtgtacagactgagcaagggctgcagcctgaccaaggcccagagagacagcatcgaggtgtgcctgctgagcatctgcggccagctgagacccagcatgatgcagcacctgctgagaagactggtgttcgacgtgcccctgctgaacgagcacgccaagatgcccctgaagctgctgaccaaccactacgagagatgctggaagtactactgcctgcccggcggctggggcaacttcggcgccgccagcgaggaggagctgcacctgagcagaaagctgttctggggcatcttcgacgccctgagccagaagaagtacgagcaggagctgttcaagctggccctgccctgcctgagcgccgtggccggcgccctgccccccgactacatggagagcaactacgtgagcatgatggagaagcagagcagcatggacagcgagggcaacttcaacccccagcccgtggacaccagcaacatcaccatccccgagaagctggagtacttcatcaacaagtacgccgagcacagccacgacaagtggagcatggacaagctggccaacggctggatctacggcgagatctacagcgacagcagcaaggtgcagcccctgatgaagccctacaagctgctgagcgagaaggagaaggagatctacagatggcccatcaaggagagcctgaagaccatgctggcctggggctggagaatcgagagaaccagagagggcgacagcatggccctgtacaacagaaccagaagaatcagccagaccagccaggtgagcgtggacgccgcccacggctacagccccagagccatcgacatgagcaacgtgaccctgagcagagacctgcacgccatggccgagatgatggccgagaactaccacaacatctgggccaagaagaagaagatggagctggagagcaagggcggcggcaaccaccccctgctggtgccctacgacaccctgaccgccaaggagaaggccaaggacagagagaaggcccaggacatcctgaagttcctgcagatcaacggctacgccgtgagcagaggcttcaaggacctggagctggacacccccagcatcgagaagagattcgcctacagcttcctgcagcagctgatcagatacgtggacgaggcccaccagtacatcctggagttcgacggcggcagcagaggcaagggcgagcacttcccctacgagcaggagatcaagttcttcgccaaggtggtgctgcccctgatcgaccagtacttcaagaaccacagactgtacttcctgagcgccgccagcagacccctgtgcagcggcggccacgccagcaacaaggagaaggagatggtgaccagcctgttctgcaagctgggcgtgctggtgagacacagaatcagcctgttcggcaacgacgccaccagcatcgtgaactgcctgcacatcctgggccagaccctggacgccagaaccgtgatgaagaccggcctggagagcgtgaagagcgccctgagagccttcctggacaacgccgccgaggacctggagaagaccatggagaacctgaagcagggccagttcacccacaccagaaaccagcccaagggcgtgacccagatcatcaactacaccaccgtggccctgctgcccatgctgagcagcctgttcgagcacatcggccagcaccagttcggcgaggacctgatcctggaggacgtgcaggtgagctgctacagaatcctgaccagcctgtacgccctgggcaccagcaagagcatctacgtggagagacagagaagcgccctgggcgagtgcctggccgccttcgccggcgccttccccgtggccttcctggagacccacctggacaagcacaacatctacagcatctacaacaccaagagcagcagagagagagccgccctgagcctgcccaccaacgtggaggacgtgtgccccaacatccccagcctggagaagctgatggaggagatcgtggagctggccgagagcggcatcagatacacccagatgccccacgtgatggaggtgatcctgcccatgctgtgcagctacatgagcagatggtgggagcacggccccgagaacaaccccgagagagccgagatgtgctgcaccgccctgaacagcgagcacatgaacaccctgctgggcaacatcctgaagatcatctacaacaacctgggcatcgacgagggcgcctggatgaagagactggccgtgttcagccagcccatcatcaacaaggtgaagccccagctgctgaagacccacttcctgcccctgatggagaagctgaagaagaaggccgccaccgtggtgagcgaggaggaccacctgaaggccgaggccagaggcgacatgagcgaggccgagctgctgatcctggacgagttcaccaccctggccagagacctgtacgccttctaccccctgctgatcagattcgtggactacaacagagccaagtggctgaaggagcccaaccccgaggccgaggagctgttcagaatggtggccgaggtgttcatctactggagcaagagccacaacttcaagagagaggagcagaacttcgtggtgcagaacgagatcaacaacatgagcttcctgatcaccgacaccaagagcaagatgagcaaggccgccgtgagcgaccaggagagaaagaagatgaagagaaagggcgacagatacagcatgcagaccagcctgatcgtggccgccctgaagagactgctgcccatcggcctgaacatctgcgcccccggcgaccaggagctgatcgccctggccaagaacagattcagcctgaaggacaccgaggacgaggtgagagacatcatcagaagcaacatccacctgcagggcaagctggaggaccccgccatcagatggcagatggccctgtacaaggacctgcccaacagaaccgacgacaccagcgaccccgagaagaccgtggagagagtgctggacatcgccaacgtgctgttccacctggagcagaagagcaagagagtgggcagaagacactactgcctggtggagcacccccagagaagcaagaaggccgtgtggcacaagctgctgagcaagcagagaaagagagccgtggtggcctgcttcagaatggcccccctgtacaacctgcccagacacagagccgtgaacctgttcctgcagggctacgagaagagctggatcgagaccgaggagcactacttcgaggacaagctgatcgaggacctggccaagcccggcgccgagccccccgaggaggacgagggcaccaagagagtggaccccctgcaccagctgatcctgctgttcagcagaaccgccctgaccgagaagtgcaagctggaggaggacttcctgtacatggcctacgccgacatcatggccaagagctgccacgacgaggaggacgacgacggcgaggaggaggtgaagagcttcgaggagaaggagatggagaagcagaagctgctgtaccagcaggccagactgcacgacagaggcgccgccgagatggtgctgcagaccatcagcgccagcaagggcgagaccggccccatggtggccgccaccctgaagctgggcatcgccatcctgaacggcggcaacagcaccgtgcagcagaagatgctggactacctgaaggagaagaaggacgtgggcttcttccagagcctggccggcctgatgcagagctgcagcgtgctggacctgaacgccttcgagagacagaacaaggccgagggcctgggcatggtgaccgaggagggcagcggcgagaaggtgctgcaggacgacgagttcacctgcgacctgttcagattcctgcagctgctgtgcgagggccacaacagcgacttccagaactacctgagaacccagaccggcaacaacaccaccgtgaacatcatcatcagcaccgtggactacctgctgagagtgcaggagagcatcagcgacttctactggtactacagcggcaaggacgtgatcgacgagcagggccagagaaacttcagcaaggccatccaggtggccaagcaggtgttcaacaccctgaccgagtacatccagggcccctgcaccggcaaccagcagagcctggcccacagcagactgtgggacgccgtggtgggcttcctgcacgtgttcgcccacatgcagatgaagctgagccaggacagcagccagatcgagctgctgaaggagctgatggacctgcagaaggacatggtggtgatgctgctgagcatgctggagggcaacgtggtgaacggcaccatcggcaagcagatggtggacatgctggtggagagcagcaacaacgtggagatgatcctgaagttcttcgacatgttcctgaagctgaaggacctgaccagcagcgacaccttcaaggagtacgaccccgacggcaagggcgtgatcagcaagagagacttccacaaggccatggagagccacaagcactacacccagagcgagaccgagttcctgctgagctgcgccgagaccgacgagaacgagaccctggactacgaggagttcgtgaagagattccacgagcccgccaaggacatcggcttcaacgtggccgtgctgctgaccaacctgagcgagcacatgcccaacgacaccagactgcagaccttcctggagctggccgagagcgtgctgaactacttccagcccttcctgggcagaatcgagatcatgggcagcgccaagagaatcgagagagtgtacttcgagatcagcgagagcagcagaacccagtgggagaagccccaggtgaaggagagcaagagacagttcatcttcgacgtggtgaacgagggcggcgagaaggagaagatggagctgttcgtgaacttctgcgaggacaccatcttcgagatgcagctggccgcccagatcagcgagagcgacctgaacgagagaagcgccaacaaggaggagagcgagaaggagagacccgaggagcagggccccagaatggccttcttcagcatcctgaccgtgagaagcgccctgttcgccctgagatacaacatcctgaccctgatgagaatgctgagcctgaagagcctgaagaagcagatgaagaaggtgaagaagatgaccgtgaaggacatggtgaccgccttcttcagcagctactggagcatcttcatgaccctgctgcacttcgtggccagcgtgttcagaggcttcttcagaatcatctgcagcctgctgctgggcggcagcctggtggagggcgccaagaagatcaaggtggccgagctgctggccaacatgcccgaccccacccaggacgaggtgagaggcgacggcgaggagggcgagagaaagcccctggaggccgccctgcccagcgaggacctgaccgacctgaaggagctgaccgaggagagcgacctgctgagcgacatcttcggcctggacctgaagagagagggcggccagtacaagctgatcccccacaaccccaacgccggcctgagcgacctgatgagcaaccccgtgcccatgcccgaggtgcaggagaagttccaggagcagaaggccaaggaggaggagaaggaggagaaggaggagaccaagagcgagcccgagaaggccgagggcgaggacggcgagaaggaggagaaggccaaggaggacaagggcaagcagaagctgagacagctgcacacccacagatacggcgagcccgaggtgcccgagagcgccttctggaagaagatcatcgcctaccagcagaagctgctgaactacttcgccagaaacttctacaacatgagaatgctggccctgttcgtggccttcgccatcaacttcatcctgctgttctacaaggtgagcaccagcagcgtggtggagggcaaggagctgcccaccagaagcagcagcgagaacgccaaggtgaccagcctggacagcagcagccacagaatcatcgccgtgcactacgtgctggaggagagcagcggctacatggagcccaccctgagaatcctggccatcctgcacaccgtgatcagcttcttctgcatcatcggctactactgcctgaaggtgcccctggtgatcttcaagagagagaaggaggtggccagaaagctggagttcgacggcctgtacatcaccgagcagcccagcgaggacgacatcaagggccagtgggacagactggtgatcaacacccagagcttccccaacaactactgggacaagttcgtgaagagaaaggtgatggacaagtacggcgagttctacggcagagacagaatcagcgagctgctgggcatggacaaggccgccctggacttcagcgacgccagagagaagaagaagcccaagaaggacagcagcctgagcgccgtgctgaacagcatcgacgtgaagtaccagatgtggaagctgggcgtggtgttcaccgacaacagcttcctgtacctggcctggtacatgaccatgagcgtgctgggccactacaacaacttcttcttcgccgcccacctgctggacatcgccatgggcttcaagaccctgagaaccatcctgagcagcgtgacccacaacggcaagcagctggtgctgaccgtgggcctgctggccgtggtggtgtacctgtacaccgtggtggccttcaacttcttcagaaagttctacaacaagagcgaggacggcgacacccccgacatgaagtgcgacgacatgctgacctgctacatgttccacatgtacgtgggcgtgagagccggcggcggcatcggcgacgagatcgaggaccccgccggcgacgagtacgagatctacagaatcatcttcgacatcaccttcttcttcttcgtgatcgtgatcctgctggccatcatccagggcctgatcatcgacgccttcggcgagctgagagaccagcaggagcaggtgaaggaggacatggagaccaagtgcttcatctgcggcatcggcaacgactacttcgacaccgtgccccacggcttcgagacccacaccctgcaggagcacaacctggccaactacctgttcttcctgatgtacctgatcaacaaggacgagaccgagcacaccggccaggagagctacgtgtggaagatgtaccaggagagatgctgggagttcttccccgccggcgactgcttcagaaagcagtacgaggaccagctgaactag

SEQ ID NO: 97913 - DNA, 987 bp, Artificial Sequence
  Description of Artificial Sequence: Synthetic coding sequence
atggagcccaccctgagaatcctggccatcctgcacaccgtgatcagcttcttctgcatcatcggctactactgcctgaaggtgcccctggtgatcttcaagagagagaaggaggtggccagaaagctggagttcgacggcctgtacatcaccgagcagcccagcgaggacgacatcaagggccagtgggacagactggtgatcaacacccagagcttccccaacaactactgggacaagttcgtgaagagaaaggtgatggacaagtacggcgagttctacggcagagacagaatcagcgagctgctgggcatggacaaggccgccctggacttcagcgacgccagagagaagaagaagcccaagaaggacagcagcctgagcgccgtgctgaacagcatcgacgtgaagtaccagatgtggaagctgggcgtggtgttcaccgacaacagcttcctgtacctggcctggtacatgaccatgagcgtgctgggccactacaacaacttcttcttcgccgcccacctgctggacatcgccatgggcttcaagaccctgagaaccatcctgagcagcgtgacccacaacggcaagcagctggtgctgaccgtgggcctgctggccgtggtggtgtacctgtacaccgtggtggccttcaacttcttcagaaagttctacaacaagagcgaggacggcgacacccccgacatgaagtgcgacgacatgctgacctgctacatgttccacatgtacgtgggcgtgagagccggcggcggcatcggcgacgagatcgaggaccccgccggcgacgagtacgagatctacagaatcatcttcgacatcaccttcttcttcttcgtgatcgtgatcctgctggccatcatccagggcctgatcatcgacgccttcggcgagctgagagaccagcaggagcaggtgaaggaggacatggaggtgttcagcgacgtgagctacaagcagagatag

SEQ ID NO: 97914 - DNA, 645 bp, Artificial Sequence
  Description of Artificial Sequence: Synthetic coding sequence
agcctgttctgcaagctgggcgtgctggtgagacacagaatcagcctgttcggcaacgacgccaccagcatcgtgaactgcctgcacatcctgggccagaccctggacgccagaaccgtgatgaagaccggcctggagagcgtgaagagcgccctgagagccttcctggacaacgccgccgaggacctggagaagaccatggagaacctgaagcagggccagttcacccacaccagaaaccagcccaagggcgtgacccagatcatcaactacaccaccgtggccctgctgcccatgctgagcagcctgttcgagcacatcggccagcaccagttcggcgaggacctgatcctggaggacgtgcaggtgagctgctacagaatcctgaccagcctgtacgccctgggcaccagcaagagcatctacgtggagagacagagaagcgccctgggcgagtgcctggccgccttcgccggcgccttccccgtggccttcctggagacccacctggacaagcacaacatctacagcatctacaacaccaagagcagcagagagagagccgccctgagcctgcccaccaacgtggaggacgtgtgccccaacatccccagcctggagaagctgatggaggagatcgtgtag

SEQ ID NO: 97915 - DNA, 4266 bp, Artificial Sequence
  Description of Artificial Sequence: Synthetic coding sequence
atgaagaccggcctggagagcgtgaagagcgccctgagagccttcctggacaacgccgccgaggacctggagaagaccatggagaacctgaagcagggccagttcacccacaccagaaaccagcccaagggcgtgacccagatcatcaactacaccaccgtggccctgctgcccatgctgagcagcctgttcgagcacatcggccagcaccagttcggcgaggacctgatcctggaggacgtgcaggtgagctgctacagaatcctgaccagcctgtacgccctgggcaccagcaagagcatctacgtggagagacagagaagcgccctgggcgagtgcctggccgccttcgccggcgccttccccgtggccttcctggagacccacctggacaagcacaacatctacagcatctacaacaccaagagcagcagagagagagccgccctgagcctgcccaccaacgtggaggacgtgtgccccaacatccccagcctggagaagctgatggaggagatcgtggagctggccgagagcggcatcagatacacccagatgccccacgtgatggaggtgatcctgcccatgctgtgcagctacatgagcagatggtgggagcacggccccgagaacaaccccgagagagccgagatgtgctgcaccgccctgaacagcgagcacatgaacaccctgctgggcaacatcctgaagatcatctacaacaacctgggcatcgacgagggcgcctggatgaagagactggccgtgttcagccagcccatcatcaacaaggtgaagccccagctgctgaagacccacttcctgcccctgatggagaagctgaagaagaaggccgccaccgtggtgagcgaggaggaccacctgaaggccgaggccagaggcgacatgagcgaggccgagctgctgatcctggacgagttcaccaccctggccagagacctgtacgccttctaccccctgctgatcagattcgtggactacaacagagccaagtggctgaaggagcccaaccccgaggccgaggagctgttcagaatggtggccgaggtgttcatctactggagcaagagccacaacttcaagagagaggagcagaacttcgtggtgcagaacgagatcaacaacatgagcttcctgatcaccgacaccaagagcaagatgagcaaggccgccgtgagcgaccaggagagaaagaagatgaagagaaagggcgacagatacagcatgcagaccagcctgatcgtggccgccctgaagagactgctgcccatcggcctgaacatctgcgcccccggcgaccaggagctgatcgccctggccaagaacagattcagcctgaaggacaccgaggacgaggtgagagacatcatcagaagcaacatccacctgcagggcaagctggaggaccccgccatcagatggcagatggccctgtacaaggacctgcccaacagaaccgacgacaccagcgaccccgagaagaccgtggagagagtgctggacatcgccaacgtgctgttccacctggagcagaagagcaagagagtgggcagaagacactactgcctggtggagcacccccagagaagcaagaaggccgtgtggcacaagctgctgagcaagcagagaaagagagccgtggtggcctgcttcagaatggcccccctgtacaacctgcccagacacagagccgtgaacctgttcctgcagggctacgagaagagctggatcgagaccgaggagcactacttcgaggacaagctgatcgaggacctggccaagcccggcgccgagccccccgaggaggacgagggcaccaagagagtggaccccctgcaccagctgatcctgctgttcagcagaaccgccctgaccgagaagtgcaagctggaggaggacttcctgtacatggcctacgccgacatcatggccaagagctgccacgacgaggaggacgacgacggcgaggaggaggtgaagagcttcgagcacgacatcatcaaggacctgagaaacaagttcgccagcctgggcgagaacagcctggagaaggagatggagaagcagaagctgctgtaccagcaggccagactgcacgacagaggcgccgccgagatggtgctgcagaccatcagcgccagcaagggcgagaccggccccatggtggccgccaccctgaagctgggcatcgccatcctgaacggcggcaacagcaccgtgcagcagaagatgctggactacctgaaggagaagaaggacgtgggcttcttccagagcctggccggcctgatgcagagctgcagcgtgctggacctgaacgccttcgagagacagaacaaggccgagggcctgggcatggtgaccgaggagggcagcggcgagaaggtgctgcaggacgacgagttcacctgcgacctgttcagattcctgcagctgctgtgcgagggccacaacagcgacttccagaactacctgagaacccagaccggcaacaacaccaccgtgaacatcatcatcagcaccgtggactacctgctgagagtgcaggagagcatcagcgacttctactggtactacagcggcaaggacgtgatcgacgagcagggccagagaaacttcagcaaggccatccaggtggccaagcaggtgttcaacaccctgaccgagtacatccagggcccctgcaccggcaaccagcagagcctggcccacagcagactgtgggacgccgtggtgggcttcctgcacgtgttcgcccacatgcagatgaagctgagccaggacagcagccagatcgagctgctgaaggagctgatggacctgcagaaggacatggtggtgatgctgctgagcatgctggagggcaacgtggtgaacggcaccatcggcaagcagatggtggacatgctggtggagagcagcaacaacgtggagatgatcctgaagttcttcgacatgttcctgaagctgaaggacctgaccagcagcgacaccttcaaggagtacgaccccgacggcaagggcgtgatcagcaagagagacttccacaaggccatggagagccacaagcactacacccagagcgagaccgagttcctgctgagctgcgccgagaccgacgagaacgagaccctggactacgaggagttcgtgaagagattccacgagcccgccaaggacatcggcttcaacgtggccgtgctgctgaccaacctgagcgagcacatgcccaacgacaccagactgcagaccttcctggagctggccgagagcgtgctgaactacttccagcccttcctgggcagaatcgagatcatgggcagcgccaagagaatcgagagagtgtacttcgagatcagcgagagcagcagaacccagtgggagaagccccaggtgaaggagagcaagagacagttcatcttcgacgtggtgaacgagggcggcgagaaggagaagatggagctgttcgtgaacttctgcgaggacaccatcttcgagatgcagctggccgcccagatcagcgagagcgacctgaacgagagaagcgccaacaaggaggagagcgagaaggagagacccgaggagcagggccccagaatggccttcttcagcatcctgaccgtgagaagcgccctgttcgccctgagatacaacatcctgaccctgatgagaatgctgagcctgaagagcctgaagaagcagatgaagaaggtgaagaagatgaccgtgaaggacatggtgaccgccttcttcagcagctactggagcatcttcatgaccctgctgcacttcgtggccagcgtgttcagaggcttcttcagaatcatctgcagcctgctgctgggcggcagcctggtggagggcgccaagaagatcaaggtggccgagctgctggccaacatgcccgaccccacccaggacgaggtgagaggcgacggcgaggagggcgagagaaagcccctggaggccgccctgcccagcgaggacctgaccgacctgaaggagctgaccgaggagagcgacctgctgagcgacatcttcggcctggacctgaagagagagggcggccagtacaagctgatcccccacaaccccaacgccggcctgagcgacctgatgagcaaccccgtgcccatgcccgaggtgcaggagaagttccaggagcagaaggccaaggaggaggagaaggaggagaaggaggagaccaagagcgagcccgagaaggccgagggcgaggacggctag

SEQ ID NO: 97916 - DNA, 14856 bp, Artificial Sequence
  Description of Artificial Sequence: Synthetic coding sequence
gacgacgaggtggtgctgcagtgcaccgccaccatccacaaggagcagcagaagctgtgcctggccgccgagggcttcggcaacagactgtgcttcctggagagcaccagcaacagcaagaacgtgccccccgacctgagcatctgcaccttcgtgctggagcagagcctgagcgtgagagccctgcaggagatgctggccaacaccgtggagaagagcgagggccaggtggacgtggagaagtggaagttcatgatgaagaccgcccagggcggcggccacagaaccctgctgtacggccacgccatcctgctgagacacagctacagcggcatgtacctgtgctgcctgagcaccagcagaagcagcaccgacaagctggccttcgacgtgggcctgcaggaggacaccaccggcgaggcctgctggtggaccatccaccccgccagcaagcagagaagcgagggcgagaaggtgagagtgggcgacgacctgatcctggtgagcgtgagcagcgagagatacctgcacctgagctacggcaacggcagcctgcacgtggacgccgccttccagcagaccctgtggagcgtggcccccatcagcagcggcagcgaggccgcccagggctacctgatcggcggcgacgtgctgagactgctgcacggccacatggacgagtgcctgaccgtgcccagcggcgagcacggcgaggagcagagaagaaccgtgcactacgagggcggcgccgtgagcgtgcacgccagaagcctgtggagactggagaccctgagagtggcctggagcggcagccacatcagatggggccagcccttcagactgagacacgtgaccaccggcaagtacctgagcctgatggaggacaagaacctgctgctgatggacaaggagaaggccgacgtgaagagcaccgccttcaccttcagaagcagcaaggagaagctggacgtgggcgtgagaaaggaggtggacggcatgggcaccagcgagatcaagtacggcgacagcgtgtgctacatccagcacgtggacaccggcctgtggctgacctaccagagcgtggacgtgaagagcgtgagaatgggcagcatccagagaaaggccatcatgcaccacgagggccacatggacgacggcatcagcctgagcagaagccagcacgaggagagcagaaccgccagagtgatcagaagcaccgtgttcctgttcaacagattcatcagaggcctggacgccctgagcaagaaggccaaggccagcaccgtggacctgcccatcgagagcgtgagcctgagcctgcaggacctgatcggctacttccacccccccgacgagcacctggagcacgaggacaagcagaacagactgagagccctgaagaacagacagaacctgttccaggaggagggcatgatcaacctggtgctggagtgcatcgacagactgcacgtgtacagcagcgccgcccacttcgccgacgtggccggcagagaggccggcgagagctggaagagcatcctgaacagcctgtacgagctgctggccgccctgatcagaggcaacagaaagaactgcgcccagttcagcggcagcctggactggctgatcagcagactggagagactggaggccagcagcggcatcctggaggtgctgcactgcgtgctggtggagagccccgaggccctgaacatcatcaaggagggccacatcaagagcatcatcagcctgctggacaagcacggcagaaaccacaaggtgctggacgtgctgtgcagcctgtgcgtgtgccacggcgtggccgtgagaagcaaccagcacctgatctgcgacaacctgctgcccggcagagacctgctgctgcagaccagactggtgaaccacgtgagcagcatgagacccaacatcttcctgggcgtgagcgagggcagcgcccagtacaagaagtggtactacgagctgatggtggaccacaccgagcccttcgtgaccgccgaggccacccacctgagagtgggctgggccagcaccgagggctacagcccctaccccggcggcggcgaggagtggggcggcaacggcgtgggcgacgacctgttcagctacggcttcgacggcctgcacctgtggagcggctgcatcgccagaaccgtgagcagccccaaccagcacctgctgagaaccgacgacgtgatcagctgctgcctggacctgagcgcccccagcatcagcttcagaatcaacggccagcccgtgcagggcatgttcgagaacttcaacatcgacggcctgttcttccccgtggtgagcttcagcgccggcatcaaggtgagattcctgctgggcggcagacacggcgagttcaagttcctgcccccccccggctacgccccctgctacgaggccgtgctgcccaaggagaagctgaaggtggagcacagcagagagtacaagcaggagagaacctacaccagagacctgctgggccccaccgtgagcctgacccaggccgccttcacccccatccccgtggacaccagccagatcgtgctgcccccccacctggagagaatcagagagaagctggccgagaacatccacgagctgtgggtgatgaacaagatcgagctgggctggcagtacggccccgtgagagacgacaacaagagacagcacccctgcctggtggagttcagcaagctgcccgagcaggagagaaactacaacctgcagatgagcctggagaccctgaagaccctgctggccctgggctgccacgtgggcatcagcgacgagcacgccgaggacaaggtgaagaagatgaagctgcccaagaactaccagctgaccagcggctacaagcccgcccccatggacctgagcttcatcaagctgacccccagccaggaggccatggtggacaagctggccgagaacgcccacaacgtgtgggccagagacagaatcagacagggctggacctacggcatccagcaggacgtgaagaacagaagaaaccccagactggtgccctacaccctgctggacgacagaaccaagaagagcaacaaggacagcctgagagaggccgtgagaaccctgctgggctacggctacaacctggaggcccccgaccaggaccacgccgccagagccgaggtgtgcagcggcaccggcgagagattcagaatcttcagagccgagaagacctacgccgtgaaggccggcagatggtacttcgagttcgagaccgtgaccgccggcgacatgagagtgggctggagcagacccggctgccagcccgaccaggagctgggcagcgacgagagagccttcgccttcgacggcttcaaggcccagagatggcaccagggcaacgagcactacggcagaagctggcaggccggcgacgtggtgggctgcatggtggacatgaacgagcacaccatgatgttcaccctgaacggcgagatcctgctggacgacagcggcagcgagctggccttcaaggacttcgacgtgggcgacggcttcatccccgtgtgcagcctgggcgtggcccaggtgggcagaatgaacttcggcaaggacgtgagcaccctgaagtacttcaccatctgcggcctgcaggagggctacgagcccttcgccgtgaacaccaacagagacatcaccatgtggctgagcaagagactgccccagttcctgcaggtgcccagcaaccacgagcacatcgaggtgaccagaatcgacggcaccatcgacagcagcccctgcctgaaggtgacccagaagagcttcggcagccagaacagcaacaccgacatcatgttctacagactgagcatgcccatcgagtgcgccgaggtgttcagcaagaccgtggccggcggcctgcccggcgccggcctgttcggccccaagaacgacctggaggactacgacgccgacagcgacttcgaggtgctgatgaagaccgcccacggccacctggtgcccgacagagtggacaaggacaaggaggccaccaagcccgagttcaacaaccacaaggactacgcccaggagaagcccagcagactgaagcagagattcctgctgagaagaaccaagcccgactacagcaccagccacagcgccagactgaccgaggacgtgctggccgacgacagagacgactacgacttcctgatgcagaccagcacctactactacagcgtgagaatcttccccggccaggagcccgccaacgtgtgggtgggctggatcaccagcgacttccaccagtacgacaccggcttcgacctggacagagtgagaaccgtgaccgtgaccctgggcgacgagaagggcaaggtgcacgagagcatcaagagaagcaactgctacatggtgtgcgccggcgagagcatgagccccggccagggcagaaacaacaacggcctggagatcggctgcgtggtggacgccgccagcggcctgctgaccttcatcgccaacggcaaggagctgagcacctactaccaggtggagcccagcaccaagctgttccccgccgtgttcgcccaggccaccagccccaacgtgttccagttcgagctgggcagaatcaagaacgtgatgcccctgagcgccggcctgttcaagagcgagcacaagaaccccgtgccccagtgcccccccagactgcacgtgcagttcctgagccacgtgctgtggagcagaatgcccaaccagttcctgaaggtggacgtgagcagaatcagcgagagacagggctggctggtgcagtgcctggaccccctgcagttcatgagcctgcacatccccgaggagaacagaagcgtggacatcctggagctgaccgagcaggaggagctgctgaagttccactaccacaccctgagactgtacagcgccgtgtgcgccctgggcaaccacagagtggcccacgccctgtgcagccacgtggacgagccccagctgctgtacgccatcgagaacaagtacatgcccggcctgctgagagccggctactacgacctgctgatcgacatccacctgagcagctacgccaccgccagactgatgatgaacaacgagtacatcgtgcccatgaccgaggagaccaagagcatcaccctgttccccgacgagaacaagaagcacggcctgcccggcatcggcctgagcaccagcctgagacccagaatgcagttcagcagccccagcttcgtgagcatcagcaacgagtgctaccagtacagccccgagttccccctggacatcctgaagagcaagaccatccagatgctgaccgaggccgtgaaggagggcagcctgcacgccagagaccccgtgggcggcaccaccgagttcctgttcgtgcccctgatcaagctgttctacaccctgctgatcatgggcatcttccacaacgaggacctgaagcacatcctgcagctgatcgagcccagcgtgttcaaggaggccgccacccccgaggaggagagcgacaccctggagaaggagctgagcgtggacgacgccaagctgcagggcgccggcgaggaggaggccaagggcggcaagagacccaaggagggcctgctgcagatgaagctgcccgagcccgtgaagctgcagatgtgcctgctgctgcagtacctgtgcgactgccaggtgagacacagaatcgaggccatcgtggccttcagcgacgacttcgtggccaagctgcaggacaaccagagattcagatacaacgaggtgatgcaggccctgaacatgagcgccgccctgaccgccagaaagaccaaggagttcagaagccccccccaggagcagatcaacatgctgctgaacttcaaggacgacaagagcgagtgcccctgccccgaggagatcagagaccagctgctggacttccacgaggacctgatgacccactgcggcatcgagctggacgaggacggcagcctggacggcaacagcgacctgaccatcagaggcagactgctgagcctggtggagaaggtgacctacctgaagaagaagcaggccgagaagcccgtggagagcgacagcaagaagagcagcaccctgcagcagctgatcagcgagaccatggtgagatgggcccaggagagcgtgatcgaggaccccgagctggtgagagccatgttcgtgctgctgcacagacagtacgacggcatcggcggcctggtgagagccctgcccaagacctacaccatcaacggcgtgagcgtggaggacaccatcaacctgctggccagcctgggccagatcagaagcctgctgagcgtgagaatgggcaaggaggaggagaagctgatgatcagaggcctgggcgacatcatgaacaacaaggtgttctaccagcaccccaacctgatgagagccctgggcatgcacgagaccgtgatggaggtgatggtgaacgtgctgggcggcggcgagagcaaggagatcaccttccccaagatggtggccaactgctgcagattcctgtgctacttctgcagaatcagcagacagaaccagaaggccatgttcgaccacctgagctacctgctggagaacagcagcgtgggcctggccagccccgccatgagaggcagcacccccctggacgtggccgccgccagcgtgatggacaacaacgagctggccctggccctgagagagcccgacctggagaaggtggtgagatacctggccggctgcggcctgcagagctgccagatgctggtgagcaagggctaccccgacatcggctggaaccccgtggagggcgagagatacctggacttcctgagattcgccgtgttctgcaacggcgagagcgtggaggagaacgccaacgtggtggtgagactgctgatcagaagacccgagtgcttcggccccgccctgagaggcgagggcggcaacggcctgctggccgccatggaggaggccatcaagatcgccgaggaccccagcagagacggccccagccccaacagcggcagcagcaagaccctggacaccgaggaggaggaggacgacaccatccacatgggcaacgccatcatgaccttctacagcgccctgatcgacctgctgggcagatgcgcccccgagatgcacctgatccacgccggcaagggcgaggccatcagaatcagaagcatcctgagaagcctgatccccctgggcgacctggtgggcgtgatcagcatcgccttccagatgcccaccatcgccaaggacggcaacgtggtggagcccgacatgagcgccggcttctgccccgaccacaaggccgccatggtgctgttcctggacagagtgtacggcatcgaggtgcaggacttcctgctgcacctgctggaggtgggcttcctgcccgacctgagagccgccgccagcctggacaccgccgccctgagcgccaccgacatggccctggccctgaacagatacctgtgcaccgccgtgctgcccctgctgaccagatgcgcccccctgttcgccggcaccgagcaccacgccagcctgatcgacagcctgctgcacaccgtgtacagactgagcaagggctgcagcctgaccaaggcccagagagacagcatcgaggtgtgcctgctgagcatctgcggccagctgagacccagcatgatgcagcacctgctgagaagactggtgttcgacgtgcccctgctgaacgagcacgccaagatgcccctgaagctgctgaccaaccactacgagagatgctggaagtactactgcctgcccggcggctggggcaacttcggcgccgccagcgaggaggagctgcacctgagcagaaagctgttctggggcatcttcgacgccctgagccagaagaagtacgagcaggagctgttcaagctggccctgccctgcctgagcgccgtggccggcgccctgccccccgactacatggagagcaactacgtgagcatgatggagaagcagagcagcatggacagcgagggcaacttcaacccccagcccgtggacaccagcaacatcaccatccccgagaagctggagtacttcatcaacaagtacgccgagcacagccacgacaagtggagcatggacaagctggccaacggctggatctacggcgagatctacagcgacagcagcaaggtgcagcccctgatgaagccctacaagctgctgagcgagaaggagaaggagatctacagatggcccatcaaggagagcctgaagaccatgctggcctggggctggagaatcgagagaaccagagagggcgacagcatggccctgtacaacagaaccagaagaatcagccagaccagccaggtgagcgtggacgccgcccacggctacagccccagagccatcgacatgagcaacgtgaccctgagcagagacctgcacgccatggccgagatgatggccgagaactaccacaacatctgggccaagaagaagaagatggagctggagagcaagggcggcggcaaccaccccctgctggtgccctacgacaccctgaccgccaaggagaaggccaaggacagagagaaggcccaggacatcctgaagttcctgcagatcaacggctacgccgtgagcagaggcttcaaggacctggagctggacacccccagcatcgagaagagattcgcctacagcttcctgcagcagctgatcagatacgtggacgaggcccaccagtacatcctggagttcgacggcggcagcagaggcaagggcgagcacttcccctacgagcaggagatcaagttcttcgccaaggtggtgctgcccctgatcgaccagtacttcaagaaccacagactgtacttcctgagcgccgccagcagacccctgtgcagcggcggccacgccagcaacaaggagaaggagatggtgaccagcctgttctgcaagctgggcgtgctggtgagacacagaatcagcctgttcggcaacgacgccaccagcatcgtgaactgcctgcacatcctgggccagaccctggacgccagaaccgtgatgaagaccggcctggagagcgtgaagagcgccctgagagccttcctggacaacgccgccgaggacctggagaagaccatggagaacctgaagcagggccagttcacccacaccagaaaccagcccaagggcgtgacccagatcatcaactacaccaccgtggccctgctgcccatgctgagcagcctgttcgagcacatcggccagcaccagttcggcgaggacctgatcctggaggacgtgcaggtgagctgctacagaatcctgaccagcctgtacgccctgggcaccagcaagagcatctacgtggagagacagagaagcgccctgggcgagtgcctggccgccttcgccggcgccttccccgtggccttcctggagacccacctggacaagcacaacatctacagcatctacaacaccaagagcagcagagagagagccgccctgagcctgcccaccaacgtggaggacgtgtgccccaacatccccagcctggagaagctgatggaggagatcgtggagctggccgagagcggcatcagatacacccagatgccccacgtgatggaggtgatcctgcccatgctgtgcagctacatgagcagatggtgggagcacggccccgagaacaaccccgagagagccgagatgtgctgcaccgccctgaacagcgagcacatgaacaccctgctgggcaacatcctgaagatcatctacaacaacctgggcatcgacgagggcgcctggatgaagagactggccgtgttcagccagcccatcatcaacaaggtgaagccccagctgctgaagacccacttcctgcccctgatggagaagctgaagaagaaggccgccaccgtggtgagcgaggaggaccacctgaaggccgaggccagaggcgacatgagcgaggccgagctgctgatcctggacgagttcaccaccctggccagagacctgtacgccttctaccccctgctgatcagattcgtggactacaacagagccaagtggctgaaggagcccaaccccgaggccgaggagctgttcagaatggtggccgaggtgttcatctactggagcaagagccacaacttcaagagagaggagcagaacttcgtggtgcagaacgagatcaacaacatgagcttcctgatcaccgacaccaagagcaagatgagcaaggccgccgtgagcgaccaggagagaaagaagatgaagagaaagggcgacagatacagcatgcagaccagcctgatcgtggccgccctgaagagactgctgcccatcggcctgaacatctgcgcccccggcgaccaggagctgatcgccctggccaagaacagattcagcctgaaggacaccgaggacgaggtgagagacatcatcagaagcaacatccacctgcagggcaagctggaggaccccgccatcagatggcagatggccctgtacaaggacctgcccaacagaaccgacgacaccagcgaccccgagaagaccgtggagagagtgctggacatcgccaacgtgctgttccacctggagcagaagagcaagagagtgggcagaagacactactgcctggtggagcacccccagagaagcaagaaggccgtgtggcacaagctgctgagcaagcagagaaagagagccgtggtggcctgcttcagaatggcccccctgtacaacctgcccagacacagagccgtgaacctgttcctgcagggctacgagaagagctggatcgagaccgaggagcactacttcgaggacaagctgatcgaggacctggccaagcccggcgccgagccccccgaggaggacgagggcaccaagagagtggaccccctgcaccagctgatcctgctgttcagcagaaccgccctgaccgagaagtgcaagctggaggaggacttcctgtacatggcctacgccgacatcatggccaagagctgccacgacgaggaggacgacgacggcgaggaggaggtgaagagcttcgaggagaaggagatggagaagcagaagctgctgtaccagcaggccagactgcacgacagaggcgccgccgagatggtgctgcagaccatcagcgccagcaagggcgagaccggccccatggtggccgccaccctgaagctgggcatcgccatcctgaacggcggcaacagcaccgtgcagcagaagatgctggactacctgaaggagaagaaggacgtgggcttcttccagagcctggccggcctgatgcagagctgcagcgtgctggacctgaacgccttcgagagacagaacaaggccgagggcctgggcatggtgaccgaggagggcagcggcgagaaggtgctgcaggacgacgagttcacctgcgacctgttcagattcctgcagctgctgtgcgagggccacaacagcgacttccagaactacctgagaacccagaccggcaacaacaccaccgtgaacatcatcatcagcaccgtggactacctgctgagagtgcaggagagcatcagcgacttctactggtactacagcggcaaggacgtgatcgacgagcagggccagagaaacttcagcaaggccatccaggtggccaagcaggtgttcaacaccctgaccgagtacatccagggcccctgcaccggcaaccagcagagcctggcccacagcagactgtgggacgccgtggtgggcttcctgcacgtgttcgcccacatgcagatgaagctgagccaggacagcagccagatcgagctgctgaaggagctgatggacctgcagaaggacatggtggtgatgctgctgagcatgctggagggcaacgtggtgaacggcaccatcggcaagcagatggtggacatgctggtggagagcagcaacaacgtggagatgatcctgaagttcttcgacatgttcctgaagctgaaggacctgaccagcagcgacaccttcaaggagtacgaccccgacggcaagggcgtgatcagcaagagagacttccacaaggccatggagagccacaagcactacacccagagcgagaccgagttcctgctgagctgcgccgagaccgacgagaacgagaccctggactacgaggagttcgtgaagagattccacgagcccgccaaggacatcggcttcaacgtggccgtgctgctgaccaacctgagcgagcacatgcccaacgacaccagactgcagaccttcctggagctggccgagagcgtgctgaactacttccagcccttcctgggcagaatcgagatcatgggcagcgccaagagaatcgagagagtgtacttcgagatcagcgagagcagcagaacccagtgggagaagccccaggtgaaggagagcaagagacagttcatcttcgacgtggtgaacgagggcggcgagaaggagaagatggagctgttcgtgaacttctgcgaggacaccatcttcgagatgcagctggccgcccagatcagcgagagcgacctgaacgagagaagcgccaacaaggaggagagcgagaaggagagacccgaggagcagggccccagaatggccttcttcagcatcctgaccgtgagaagcgccctgttcgccctgagatacaacatcctgaccctgatgagaatgctgagcctgaagagcctgaagaagcagatgaagaaggtgaagaagatgaccgtgaaggacatggtgaccgccttcttcagcagctactggagcatcttcatgaccctgctgcacttcgtggccagcgtgttcagaggcttcttcagaatcatctgcagcctgctgctgggcggcagcctggtggagggcgccaagaagatcaaggtggccgagctgctggccaacatgcccgaccccacccaggacgaggtgagaggcgacggcgaggagggcgagagaaagcccctggaggccgccctgcccagcgaggacctgaccgacctgaaggagctgaccgaggagagcgacctgctgagcgacatcttcggcctggacctgaagagagagggcggccagtacaagctgatcccccacaaccccaacgccggcctgagcgacctgatgagcaaccccgtgcccatgcccgaggtgcaggagaagttccaggagcagaaggccaaggaggaggagaaggaggagaaggaggagaccaagagcgagcccgagaaggccgagggcgaggacggcgagaaggaggagaaggccaaggaggacaagggcaagcagaagctgagacagctgcacacccacagatacggcgagcccgaggtgcccgagagcgccttctggaagaagatcatcgcctaccagcagaagctgctgaactacttcgccagaaacttctacaacatgagaatgctggccctgttcgtggccttcgccatcaacttcatcctgctgttctacaaggtgagcaccagcagcgtggtggagggcaaggagctgcccaccagaagcagcagcgagaacgccaaggtgaccagcctggacagcagcagccacagaatcatcgccgtgcactacgtgctggaggagagcagcggctacatggagcccaccctgagaatcctggccatcctgcacaccgtgatcagcttcttctgcatcatcggctactactgcctgaaggtgcccctggtgatcttcaagagagagaaggaggtggccagaaagctggagttcgacggcctgtacatcaccgagcagcccagcgaggacgacatcaagggccagtgggacagactggtgatcaacacccagagcttccccaacaactactgggacaagttcgtgaagagaaaggtgatggacaagtacggcgagttctacggcagagacagaatcagcgagctgctgggcatggacaaggccgccctggacttcagcgacgccagagagaagaagaagcccaagaaggacagcagcctgagcgccgtgctgaacagcatcgacgtgaagtaccagatgtggaagctgggcgtggtgttcaccgacaacagcttcctgtacctggcctggtacatgaccatgagcgtgctgggccactacaacaacttcttcttcgccgcccacctgctggacatcgccatgggcttcaagaccctgagaaccatcctgagcagcgtgacccacaacggcaagcagctggtgctgaccgtgggcctgctggccgtggtggtgtacctgtacaccgtggtggccttcaacttcttcagaaagttctacaacaagagcgaggacggcgacacccccgacatgaagtgcgacgacatgctgacctgctacatgttccacatgtacgtgggcgtgagagccggcggcggcatcggcgacgagatcgaggaccccgccggcgacgagtacgagatctacagaatcatcttcgacatcaccttcttcttcttcgtgatcgtgatcctgctggccatcatccagggcctgatcatcgacgccttcggcgagctgagagaccagcaggagcaggtgaaggaggacatggagaccaagtgcttcatctgcggcatcggcaacgactacttcgacaccgtgccccacggcttcgagacccacaccctgcaggagcacaacctggccaactacctgttcttcctgatgtacctgatcaacaaggacgagaccgagcacaccggccaggagagctacgtgtggaagatgtaccaggagagatgctgggagttcttccccgccggcgactgcttcagaaagcagtacgaggaccagctgaactag

SEQ ID NO: 97917 - DNA, 14601 bp, Artificial Sequence
  Description of Artificial Sequence: Synthetic coding sequence
atggccgagctgggcggcggcggcgaggaggacgccagatggtacagaaaggaggacgaggtggtgctgcagtgcatcgccaccatccacaaggagcagagaaagttctgcctggccgccgagggcctgggcaacagactgtgcttcctggagcccaccagcgaggccaagtacatcccccccgacctgtgcgtgtgcaacttcgtgctggagcagagcctgagcgtgagagccctgcaggagatgctggccaacaccggcgagaacggcggcgagggcgccgcccagggcggcggccacagaaccctgctgtacggccacgccgtgctgctgagacacagcttcagcggcatgtacctgacctgcctgaccaccagcagaagccagaccgacaagctggccttcgacgtgggcctgagagagcacgccaccggcgaggcctgctggtggaccatccaccccgccagcaagcagagaagcgagggcgagaaggtgagaatcggcgacgacctgatcctggtgagcgtgagcagcgagagatacctgcacctgagcgtgagcaacggcaacatccaggtggacgccagcttcatgcagaccctgtggaacgtgcaccccacctgcagcggcagcagcatcgaggagggctacctgctgggcggccacgtggtgagactgttccacggccacgacgagtgcctgaccatccccagcaccgaccagaacgacagccagcacagaagaatcttctacgaggccggcggcgccggcaccagagccagaagcctgtggagagtggagcccctgagaatcagctggagcggcagcaacatcagatggggccaggccttcagactgagacacctgaccaccggccactacctggccctgaccgaggaccagggcctgatcctgcaggacagagccaagagcgacaccaagagcaccgccttcagcttcagagccagcaaggagctgaaggagaagctggacagcagccacaagagagacatcgagggcatgggcgtgcccgagatcaagtacggcgacagcgtgtgcttcgtgcagcacatcgccagcggcctgtgggtgacctacaaggcccaggacgccaagaccagcagactgggccccctgaagagaaaggtgatcctgcaccaggagggccacatggacgacggcctgaccctgcagagatgccagagagaggagagccaggccgccagaatcatcagaaacaccaccgccctgttcagccagttcgtgagcggcaacaacagaaccgccgcccccatcaccctgcccatcgaggaggtgctgcagaccctgcaggacctgatcgcctacttccagccccccgaggaggagatgagacacgaggacaagcagaacaagctgagaagcctgaagaacagacagaacctgttcaaggaggagggcatgctggccctggtgctgaactgcatcgacagactgaacgtgtacaacagcgtggcccacttcgccggcatcgccagagaggagagcggcatggcctggaaggagatcctgaacctgctgtacaagctgctggccgccctgatcagaggcaacagaaacaactgcgcccagttcagcaacaacctggactggctgatcagcaagctggacagactggagagcagcagcggcatcctggaggtgctgcactgcatcctgaccgagagccccgaggccctgaacctgatcgccgagggccacatcaagagcatcatcagcctgctggacaagcacggcagaaaccacaaggtgctggacatcctgtgcagcctgtgcctgtgcaacggcgtggccgtgagagccaaccagaacctgatctgcgacaacctgctgcccagaagaaacctgctgctgcagaccagactgatcaacgacgtgaccagcatcagacccaacatcttcctgggcgtggccgagggcagcgcccagtacaagaagtggtacttcgagctgatcatcgaccaggtggaccccttcctgaccgccgagcccacccacctgagagtgggctgggccagcagcagcggctacgccccctaccccggcggcggcgagggctggggcggcaacggcgtgggcgacgacctgtacagctacggcttcgacggcctgcacctgtggagcggcagaatccccagagccgtggccagcatcaaccagcacctgctgagaagcgacgacgtggtgagctgctgcctggacctgggcgtgcccagcatcagcttcagaatcaacggccagcccgtgcagggcatgttcgagaacttcaacaccgacggcctgttcttccccgtgatgagcttcagcgccggcgtgaaggtgagattcctgatgggcggcagacacggcgagttcaagttcctgccccccagcggctacgccccctgctacgaggccctgctgcccaaggagaagatgagactggagcccgtgaaggagtacaagagagacgccgacggcatcagagacctgctgggcaccacccagttcctgagccaggccagcttcatcccctgccccgtggacaccagccaggtgatcctgcccccccacctggagaagatcagagacagactggccgagaacatccacgagctgtggggcatgaacaagatcgagctgggctggaccttcggcaagatcagagacgacaacaagagacagcacccctgcctggtggagttcagcaagctgcccgagaccgagaagaactacaacctgcagatgagcaccgagaccctgaagaccctgctggccctgggctgccacatcgcccacgtgaaccccgccgccgaggaggacctgaagaaggtgaagctgcccaagaactacatgatgagcaacggctacaagcccgcccccctggacctgagcgacgtgaagctgctgcccccccaggagatcctggtggacaagctggccgagaacgcccacaacgtgtgggccaaggacagaatcaagcagggctggacctacggcatccagcaggacctgaagaacaagagaaaccccagactggtgccctacgccctgctggacgagagaaccaagaagagcaacagagacagcctgagagaggccgtgagaaccttcgtgggctacggctacaacatcgagcccagcgaccaggagctggccgacagcgccgtggagaaggtgagcatcgacaagatcagattcttcagagtggagagaagctacgccgtgagaagcggcaagtggtacttcgagttcgaggtggtgaccggcggcgacatgagagtgggctgggccagacccggctgcagacccgacgtggagctgggcgccgacgaccaggccttcgtgttcgagggcaacagaggccagagatggcaccagggcagcggctacttcggcagaacctggcagcccggcgacgtggtgggctgcatgatcaacctggacgacgccagcatgatcttcaccctgaacggcgagctgctgatcaccaacaagggcagcgagctggccttcgccgactacgagatcgagaacggcttcgtgcccatctgctgcctgggcctgagccagatcggcagaatgaacctgggcaccgacgccagcaccttcaagttctacaccatgtgcggcctgcaggagggcttcgagcccttcgccgtgaacatgaacagagacgtggccatgtggttcagcaagagactgcccaccttcgtgaacgtgcccaaggaccacccccacatcgaggtgatgagaatcgacggcaccatggacagccccccctgcctgaaggtgacccacaagaccttcggcacccagaacagcaacgccgacatgatctactgcagactgagcatgcccgtggagtgccacagcagcttcagccacagcccctgcctggacagcgaggccttccagaagagaaagcagatgcaggagatcctgagccacaccaccacccagtgctactacgccatcagaatcttcgccggccaggaccccagctgcgtgtgggtgggctgggtgacccccgactaccacctgtacagcgagaagttcgacctgaacaagaactgcaccgtgaccgtgaccctgggcgacgagagaggcagagtgcacgagagcgtgaagagaagcaactgctacatggtgtggggcggcgacatcgtggccagcagccagagaagcaacagaagcaacgtggacctggagatcggctgcctggtggacctggccatgggcatgctgagcttcagcgccaacggcaaggagctgggcacctgctaccaggtggagcccaacaccaaggtgttccccgccgtgttcctgcagcccaccagcaccagcctgttccagttcgagctgggcaagctgaagaacgccatgcccctgagcgccgccatcttcagaagcgaggagaagaaccccgtgccccagtgcccccccagactggacgtgcagaccatccagcccgtgctgtggagcagaatgcccaacagcttcctgaaggtggagaccgagagagtgagcgagagacacggctgggtggtgcagtgcctggagcccctgcagatgatggccctgcacatccccgaggagaacagatgcgtggacatcctggagctgtgcgagcaggaggacctgatgagattccactaccacaccctgagactgtacagcgccgtgtgcgccctgggcaacagcagagtggcctacgccctgtgcagccacgtggacctgagccagctgttctacgccatcgacaacaagtacctgcccggcctgctgagaagcggcttctacgacctgctgatcagcatccacctggccagcgccaaggagagaaagctgatgatgaagaacgagtacatcatccccatcaccagcaccaccagaaacatcagactgttccccgacgagagcaagagacacggcctgcccggcgtgggcctgagaacctgcctgaagcccggcttcagattcagcaccccctgcttcgtggtgaccggcgaggaccaccagaagcagagccccgagatccccctggagagcctgagaaccaaggccctgagcatgctgaccgaggccgtgcagtgcagcggcgcccacatcagagaccccgtgggcggcagcgtggagttccagttcgtgcccgtgctgaagctgatcggcaccctgctggtgatgggcgtgttcgacgacgacgacgtgagacagatcctgctgctgatcgaccccagcgtgttcggcgagcacagcgccggcaccgaggagggcgccgagaaggaggaggtgacccaggtggaggagaaggccgtggaggccggcgagaaggccggcaaggaggcccccgtgaagggcctgctgcagaccagactgcccgagagcgtgaagctgcagatgtgcgagctgctgagctacctgtgcgactgcgagctgcagcacagagtggaggccatcgtggccttcggcgacatctacgtgagcaagctgcaggccaaccagaagttcagatacaacgagctgatgcaggccctgaacatgagcgccgccctgaccgccagaaagaccaaggagttcagaagccccccccaggagcagatcaacatgctgctgaacttccagctgggcgagaactgcccctgccccgaggagatcagagaggagctgtacgacttccacgaggacctgctgctgcactgcggcgtgcccctggaggaggaggaggaggaggaggaggacaccagctggaccggcaagctgtgcgccctggtgtacaagatcaagggcccccccaagcccgagaaggagcagcccaccgaggaggaggagagatgccccaccaccctgaaggagctgatcagccagaccatgatctgctgggcccaggaggaccagatccaggacagcgagctggtgagaatgatgttcaacctgctgagaagacagtacgacagcatcggcgagctgctgcaggccctgagaaagacctacaccatcagccacaccagcgtgagcgacaccatcaacctgctggccgccctgggccagatcagaagcctgctgagcgtgagaatgggcaaggaggaggagctgctgatgatcaacggcctgggcgacatcatgaacaacaaggtgttctaccagcaccccaacctgatgagagtgctgggcatgcacgagaccgtgatggaggtgatggtgaacgtgctgggcaccgagaagagccagatcgccttccccaagatggtggccagctgctgcagattcctgtgctacttctgcagaatcagcagacagaaccagaaggccatgttcgagcacctgagctacctgctggagaacagcagcgtgggcctggccagccccagcatgagaggcagcacccccctggacgtggccgccagcagcgtgatggacaacaacgagctggccctgagcctggaggagcccgacctggagaaggtggtgacctacctggccggctgcggcctgcagagctgccccatgctgctggccaagggctaccccgacgtgggctggaaccccatcgagggcgagagatacctgagcttcctgagattcgccgtgttcgtgaacagcgagagcgtggaggagaacgccagcgtggtggtgaagctgctgatcagaagacccgagtgcttcggccccgccctgagaggcgagggcggcaacggcctgctggccgccatgcagggcgccatcaagatcagcgagaaccccgccctggacctgcccagccagggctacaagagagaggtgagcaccggcgacgacgaggaggaggaggagatcgtgcacatgggcaacgccatcatgagcttctacagcgccctgatcgacctgctgggcagatgcgcccccgagatgcacctgatccagaccggcaagggcgaggccatcagaatcagaagcatcctgagaagcctggtgcccaccgaggacctggtgggcatcatcagcatccccctgaagctgcccagcctgaacaaggacggcagcgtgagcgagcccgacatggccgccaacttctgccccgaccacaaggcccccatggtgctgttcctggacagagtgtacggcatcaaggaccagaccttcctgctgcacctgctggaggtgggcttcctgcccgacctgagagccagcgccagcctggacaccgtgagcctgagcaccaccgaggccgccctggccctgaacagatacatctgcagcgccgtgctgcccctgctgaccagatgcgcccccctgttcgccggcaccgagcactgcaccagcctgatcgacagcaccctgcagaccatctacagactgagcaagggcagaagcctgaccaaggcccagagagacaccatcgaggagtgcctgctggccatctgcaaccacctgagacccagcatgctgcagcagctgctgagaagactggtgttcgacgtgccccagctgaacgagtactgcaagatgcccctgaagctgctgaccaaccactacgagcagtgctggaagtactactgcctgcccagcggctggggcagctacggcctggccgtggaggaggagctgcacctgaccgagaagctgttctggggcatcttcgacagcctgagccacaagaagtacgaccccgacctgttcagaatggccctgccctgcctgagcgccatcgccggcgccctgccccccgactacctggacaccagaatcaccgccaccctggagaagcagatcagcgtggacgccgacggcaacttcgaccccaagcccatcaacaccatgaacttcagcctgcccgagaagctggagtacatcgtgaccaagtacgccgagcacagccacgacaagtgggcctgcgacaagagccagagcggctggaagtacggcatcagcctggacgagaacgtgaagacccaccccctgatcagacccttcaagaccctgaccgagaaggagaaggagatctacagatggcccgccagagagagcctgaagaccatgctggccgtgggctggaccgtggagagaaccaaggagggcgaggccctggtgcagcagagagagaacgagaagctgagaagcgtgagccaggccaaccagggcaacagctacagccccgcccccctggacctgagcaacgtggtgctgagcagagagctgcagggcatggtggaggtggtggccgagaactaccacaacatctgggccaagaagaagaagctggagctggagagcaagggcggcggcagccaccccctgctggtgccctacgacaccctgaccgccaaggagaagttcaaggacagagagaaggcccaggacctgttcaagttcctgcaggtgaacggcatcatcgtgagcagaggcatgaaggacatggagctggacgccagcagcatggagaagagattcgcctacaagttcctgaagaagatcctgaagtacgtggacagcgcccaggagttcatcgcccacctggaggccatcgtgagcagcggcaagaccgagaagagccccagagaccaggagatcaagttcttcgccaaggtgctgctgcccctggtggaccagtacttcaccagccactgcctgtacttcctgagcagccccctgaagcccctgagcagcagcggctacgccagccacaaggagaaggagatggtggccggcctgttctgcaagctggccgccctggtgagacacagaatcagcctgttcggcagcgacagcaccaccatggtgagctgcctgcacatcctggcccagaccctggacaccagaaccgtgatgaagagcggcagcgagctggtgaaggccggcctgagagccttcttcgagaacgccgccgaggacctggagaagaccagcgagaacctgaagctgggcaagttcacccacagcagaacccagatcaagggcgtgagccagaacatcaactacaccaccgtggccctgctgcccatcctgaccagcatcttcgagcacgtgacccagcaccagttcggcatggacctgctgctgggcgacgtgcagatcagctgctaccacatcctgtgcagcctgtacagcctgggcaccggcaagaacatctacgtggagagacagagacccgccctgggcgagtgcctggccagcctggccgccgccatccccgtggccttcctggagcccaccctgaacagatacaaccccctgagcgtgttcaacaccaagacccccagagagagaagcatcctgggcatgcccgacaccgtggaggacatgtgccccgacatcccccagctggagggcctgatgaaggagatcaacgacctggccgagagcggcgccagatacaccgagatgccccacgtgatcgaggtgatcctgcccatgctgtgcaactacctgagctactggtgggagagaggccccgagaacctgccccccagcaccggcccctgctgcaccaaggtgaccagcgagcacctgagcctgatcctgggcaacatcctgaagatcatcaacaacaacctgggcatcgacgaggccagctggatgaagagaatcgccgtgtacgcccagcccatcatcagcaaggccagacccgacctgctgagaagccacttcatccccaccctggagaagctgaagaagaaggccgtgaagaccgtgcaggaggaggagcagctgaaggccgacggcaagggcgacacccaggaggccgagctgctgatcctggacgagttcgccgtgctgtgcagagacctgtacgccttctaccccatgctgatcagatacgtggacaacaacagaagcaactggctgaagagccccgacgccgacagcgaccagctgttcagaatggtggccgaggtgttcatcctgtggtgcaagagccacaacttcaagagagaggagcagaacttcgtgatccagaacgagatcaacaacctggccttcctgaccggcgacagcaagagcaagatgagcaagagcggcggccaggaccaggagagaaagaagaccaagagaagaggcgacctgtacagcatccagaccagcctgatcgtggccgccctgaagaagatgctgcccatcggcctgaacatgtgcacccccggcgaccaggagctgatcagcctggccaagagcagatacagccacagagacaccgacgaggaggtgagagagcacctgagaaacaacctgcacctgcaggagaagagcgacgaccccgccgtgaagtggcagctgaacctgtacaaggacgtgctgaagagcgaggagcccttcaaccccgagaagaccgtggagagagtgcagagaatcagcgccgccgtgttccacctggagcaggtggagcagcccctgagaagcaagaaggccgtgtggcacaagctgctgagcaagcagagaaagagagccgtggtggcctgcttcagaatggcccccctgtacaacctgcccagacacagaagcatcaacctgttcctgcacggctaccagagattctggatcgagaccgaggagtacagcttcgaggagaagctggtgcaggacctggccaagagccccaaggtggaggaggaggaggaggaggagaccgagaagcagcccgaccccctgcaccagatcatcctgtacttcagcagaaacgccctgaccgagagaagcaagctggaggacgaccccctgtacaccagctacagcagcatgatggccaagagctgccagagcggcgaggacgaggaggaggacgaggacaaggagaagaccttcgaggagaaggagatggagaagcagaagaccctgtaccagcaggccagactgcacgagagaggcgccgccgagatggtgctgcagatgatcagcgccagcaagggcgagatgagccccatggtggtggagaccctgaagctgggcatcgccatcctgaacggcggcaacgccggcgtgcagcagaagatgctggactacctgaaggagaagaaggacgccggcttcttccagagcctgagcggcctgatgcagagctgcagaagcgtgctggacctgaacgccttcgagagacagaacaaggccgagggcctgggcatggtgaccgaggagggcaccctgatcgtgagagagagaggcgagaaggtgctgcagaacgacgagttcaccagagacctgttcagattcctgcagctgctgtgcgagggccacaacagcgacttccagaacttcctgagaacccagatgggcaacaccaccaccgtgaacgtgatcatcagcaccgtggactacctgctgagactgcaggagagcatcagcgacttctactggtactacagcggcaaggacatcatcgacgagagcggccagcacaacttcagcaaggccctggccgtgaccaagcagatcttcaacagcctgaccgagtacatccagggcccctgcatcggcaaccagcagagcctggcccacagcagactgtgggacgccgtggtgggcttcctgcacgtgttcgccaacatgcagatgaagctgagccaggacagcagccagatcgagctgctgaaggagctgctggacctgctgcaggacatggtggtgatgctgctgagcctgctggagggcaacgtggtgaacggcaccatcggcaagcagatggtggacaccctggtggagagcagcaccaacgtggagatgatcctgaagttcttcgacatgttcctgaagctgaaggacctgaccagcagcgacaccttcaaggagtacgaccccgacggcaagggcatcatcagcaagaaggagttccagaaggccatggagggccagaagcagtacacccagagcgagatcgacttcctgctgagctgcgccgaggccgacgagaacgacatgttcaactacgtggacttcgtggacagattccacgagcccgccaaggacatcggcttcaacgtggccgtgctgctgaccaacctgagcgagcacatgcccaacgacagcagactgaagtgcctgctggaccccgccgagagcgtgctgaactacttcgagccctacctgggcagaatcgagatcatgggcggcgccaagaagatcgagagagtgtacttcgagatcagcgagagcagcagaacccagtgggagaagccccaggtgaaggagagcaagagacagttcatcttcgacgtggtgaacgagggcggcgagcaggagaagatggagctgttcgtgaacttctgcgaggacaccatcttcgagatgcagctggccagccagatcagcgagagcgacagcgccgacagacccgaggaggaggaggaggacgaggacagcagctacgtgctggagatcgccggcgaggaggaggaggacggcagcctggagcccgccagcgccttcgccatggcctgcgccagcgtgaagagaaacgtgaccgacttcctgaagagagccaccctgaagaacctgagaaagcagtacagaaacgtgaagaagatgaccgccaaggagctggtgaaggtgctgttcagcttcttctggatgctgttcgtgggcctgttccagctgctgttcaccatcctgggcggcatcttccagatcctgtggagcaccgtgttcggcggcggcctggtggagggcgccaagaacatcagagtgaccaagatcctgggcgacatgcccgaccccacccagttcggcatccacgacgacaccatggaggccgagagagccgaggtgatggagcccggcatcaccaccgagctggtgcacttcatcaagggcgagaagggcgacaccgacatcatgagcgacctgttcggcctgcaccccaagaaggagggcagcctgaagcacggccccgaggtgggcctgggcgacctgagcgagatcatcggcaaggacgagccccccaccctggagagcaccgtgcagaagaagagaaaggcccaggccgccgagatgaaggccgccaacgaggccgagggcaaggtggagagcgagaaggccgacatggaggacggcgagaaggaggacaaggacaaggaggaggagcaggccgagtacctgtggaccgaggtgaccaagaagaagaagagaagatgcggccagaaggtggagaagcccgaggccttcaccgccaacttcttcaagggcctggagatctaccagaccaagctgctgcactacctggccagaaacttctacaacctgagattcctggccctgttcgtggccttcgccatcaacttcatcctgctgttctacaaggtgaccgaggagcccctggaggaggagaccgaggacgtggccaacctgtggaacagcttcaacgacgaggaggaggaggaggccatggtgttcttcgtgctgcaggagagcaccggctacatggcccccaccctgagagccctggccatcatccacaccatcatcagcctggtgtgcgtggtgggctactactgcctgaaggtgcccctggtggtgttcaagagagagaaggagatcgccagaaagctggagttcgacggcctgtacatcaccgagcagcccagcgaggacgacatcaagggccagtgggacagactggtgatcaacacccccagcttccccaacaactactgggacaagttcgtgaagagaaaggtgatcaacaagtacggcgacctgtacggcgccgagagaatcgccgagctgctgggcctggacaagaacgccctggacttcagccccgtggaggagaccaaggccgaggccgccagcctggtgagctggctgagcagcatcgacatgaagtaccacatctggaagctgggcgtggtgttcaccgacaacagcttcctgtacctggcctggtacaccaccatgagcgtgctgggccactacaacaacttcttcttcgccgcccacctgctggacatcgccatgggcttcaagaccctgagaaccatcctgagcagcgtgacccacaacggcaagcagctggtgctgaccgtgggcctgctggccgtggtggtgtacctgtacaccgtggtggccttcaacttcttcagaaagttctacaacaagagcgaggacgacgacgagcccgacatgaagtgcgacgacatgatgacctgctacctgttccacatgtacgtgggcgtgagagccggcggcggcatcggcgacgagatcgaggaccccgccggcgacccctacgagatgtacagaatcgtgttcgacatcaccttcttcttcttcgtgatcgtgatcctgctggccatcatccagggcctgatcatcgacgccttcggcgagctgagagaccagcaggagcaggtgagagaggacatggagaccaagtgcttcatctgcggcatcggcaacgactacttcgacaccaccccccacggcttcgagacccacaccctgcaggagcacaacctggccaactacctgttcttcctgatgtacctgatcaacaaggacgagaccgagcacaccggccaggagagctacgtgtggaagatgtaccaggagagatgctgggacttcttccccgccggcgactgcttcagaaagcagtacgaggaccagctgggctag

SEQ ID NO: 97918 - DNA, 14613 bp, Artificial Sequence
  Description of Artificial Sequence: Synthetic coding sequence
atggccgagggcggcgagggcggcgaggacgagatccagttcctgagaaccgaggacgaggtggtgctgcagtgcatcgccaccatccacaaggagcagagaaagttctgcctggccgccgagggcctgggcaacagactgtgcttcctggagcccaccagcgaggccaagtacatcccccccgacctgtgcgtgtgcaacttcgtgctggagcagagcctgagcgtgagagccctgcaggagatgctggccaacaccggcgagaacggcggcgagggcgccgcccagggcggcggccacagaaccctgctgtacggccacgccgtgctgctgagacacagcttcagcggcatgtacctgacctgcctgaccaccagcagaagccagaccgacaagctggccttcgacgtgggcctgagagagcacgccaccggcgaggcctgctggtggaccatccaccccgccagcaagcagagaagcgagggcgagaaggtgagaatcggcgacgacctgatcctggtgagcgtgagcagcgagagatacctgcacctgagcgtgagcaacggcaacatccaggtggacgccagcttcatgcagaccctgtggaacgtgcaccccacctgcagcggcagcagcatcgaggagggctacctgctgggcggccacgtggtgagactgttccacggccacgacgagtgcctgaccatccccagcaccgaccagaacgacagccagcacagaagaatcttctacgaggccggcggcgccggcaccagagccagaagcctgtggagagtggagcccctgagaatcagctggagcggcagcaacatcagatggggccaggccttcagactgagacacctgaccaccggccactacctggccctgaccgaggaccagggcctgatcctgcaggacagagccaagagcgacaccaagagcaccgccttcagcttcagagccagcaaggagctgaaggagaagctggacagcagccacaagagagacatcgagggcatgggcgtgcccgagatcaagtacggcgacagcgtgtgcttcgtgcagcacatcgccagcggcctgtgggtgacctacaaggcccaggacgccaagaccagcagactgggccccctgaagagaaaggtgatcctgcaccaggagggccacatggacgacggcctgaccctgcagagatgccagagagaggagagccaggccgccagaatcatcagaaacaccaccgccctgttcagccagttcgtgagcggcaacaacagaaccgccgcccccatcaccctgcccatcgaggaggtgctgcagaccctgcaggacctgatcgcctacttccagccccccgaggaggagatgagacacgaggacaagcagaacaagctgagaagcctgaagaacagacagaacctgttcaaggaggagggcatgctggccctggtgctgaactgcatcgacagactgaacgtgtacaacagcgtggcccacttcgccggcatcgccagagaggagagcggcatggcctggaaggagatcctgaacctgctgtacaagctgctggccgccctgatcagaggcaacagaaacaactgcgcccagttcagcaacaacctggactggctgatcagcaagctggacagactggagagcagcagcggcatcctggaggtgctgcactgcatcctgaccgagagccccgaggccctgaacctgatcgccgagggccacatcaagagcatcatcagcctgctggacaagcacggcagaaaccacaaggtgctggacatcctgtgcagcctgtgcctgtgcaacggcgtggccgtgagagccaaccagaacctgatctgcgacaacctgctgcccagaagaaacctgctgctgcagaccagactgatcaacgacgtgaccagcatcagacccaacatcttcctgggcgtggccgagggcagcgcccagtacaagaagtggtacttcgagctgatcatcgaccaggtggaccccttcctgaccgccgagcccacccacctgagagtgggctgggccagcagcagcggctacgccccctaccccggcggcggcgagggctggggcggcaacggcgtgggcgacgacctgtacagctacggcttcgacggcctgcacctgtggagcggcagaatccccagagccgtggccagcatcaaccagcacctgctgagaagcgacgacgtggtgagctgctgcctggacctgggcgtgcccagcatcagcttcagaatcaacggccagcccgtgcagggcatgttcgagaacttcaacaccgacggcctgttcttccccgtgatgagcttcagcgccggcgtgaaggtgagattcctgatgggcggcagacacggcgagttcaagttcctgccccccagcggctacgccccctgctacgaggccctgctgcccaaggagaagatgagactggagcccgtgaaggagtacaagagagacgccgacggcatcagagacctgctgggcaccacccagttcctgagccaggccagcttcatcccctgccccgtggacaccagccaggtgatcctgcccccccacctggagaagatcagagacagactggccgagaacatccacgagctgtggggcatgaacaagatcgagctgggctggaccttcggcaagatcagagacgacaacaagagacagcacccctgcctggtggagttcagcaagctgcccgagaccgagaagaactacaacctgcagatgagcaccgagaccctgaagaccctgctggccctgggctgccacatcgcccacgtgaaccccgccgccgaggaggacctgaagaaggtgaagctgcccaagaactacatgatgagcaacggctacaagcccgcccccctggacctgagcgacgtgaagctgctgcccccccaggagatcctggtggacaagctggccgagaacgcccacaacgtgtgggccaaggacagaatcaagcagggctggacctacggcatccagcaggacctgaagaacaagagaaaccccagactggtgccctacgccctgctggacgagagaaccaagaagagcaacagagacagcctgagagaggccgtgagaaccttcgtgggctacggctacaacatcgagcccagcgaccaggagctggccgacagcgccgtggagaaggtgagcatcgacaagatcagattcttcagagtggagagaagctacgccgtgagaagcggcaagtggtacttcgagttcgaggtggtgaccggcggcgacatgagagtgggctgggccagacccggctgcagacccgacgtggagctgggcgccgacgaccaggccttcgtgttcgagggcaacagaggccagagatggcaccagggcagcggctacttcggcagaacctggcagcccggcgacgtggtgggctgcatgatcaacctggacgacgccagcatgatcttcaccctgaacggcgagctgctgatcaccaacaagggcagcgagctggccttcgccgactacgagatcgagaacggcttcgtgcccatctgctgcctgggcctgagccagatcggcagaatgaacctgggcaccgacgccagcaccttcaagttctacaccatgtgcggcctgcaggagggcttcgagcccttcgccgtgaacatgaacagagacgtggccatgtggttcagcaagagactgcccaccttcgtgaacgtgcccaaggaccacccccacatcgaggtgatgagaatcgacggcaccatggacagccccccctgcctgaaggtgacccacaagaccttcggcacccagaacagcaacgccgacatgatctactgcagactgagcatgcccgtggagtgccacagcagcttcagccacagcccctgcctggacagcgaggccttccagaagagaaagcagatgcaggagatcctgagccacaccaccacccagtgctactacgccatcagaatcttcgccggccaggaccccagctgcgtgtgggtgggctgggtgacccccgactaccacctgtacagcgagaagttcgacctgaacaagaactgcaccgtgaccgtgaccctgggcgacgagagaggcagagtgcacgagagcgtgaagagaagcaactgctacatggtgtggggcggcgacatcgtggccagcagccagagaagcaacagaagcaacgtggacctggagatcggctgcctggtggacctggccatgggcatgctgagcttcagcgccaacggcaaggagctgggcacctgctaccaggtggagcccaacaccaaggtgttccccgccgtgttcctgcagcccaccagcaccagcctgttccagttcgagctgggcaagctgaagaacgccatgcccctgagcgccgccatcttcagaagcgaggagaagaaccccgtgccccagtgcccccccagactggacgtgcagaccatccagcccgtgctgtggagcagaatgcccaacagcttcctgaaggtggagaccgagagagtgagcgagagacacggctgggtggtgcagtgcctggagcccctgcagatgatggccctgcacatccccgaggagaacagatgcgtggacatcctggagctgtgcgagcaggaggacctgatgagattccactaccacaccctgagactgtacagcgccgtgtgcgccctgggcaacagcagagtggcctacgccctgtgcagccacgtggacctgagccagctgttctacgccatcgacaacaagtacctgcccggcctgctgagaagcggcttctacgacctgctgatcagcatccacctggccagcgccaaggagagaaagctgatgatgaagaacgagtacatcatccccatcaccagcaccaccagaaacatcagactgttccccgacgagagcaagagacacggcctgcccggcgtgggcctgagaacctgcctgaagcccggcttcagattcagcaccccctgcttcgtggtgaccggcgaggaccaccagaagcagagccccgagatccccctggagagcctgagaaccaaggccctgagcatgctgaccgaggccgtgcagtgcagcggcgcccacatcagagaccccgtgggcggcagcgtggagttccagttcgtgcccgtgctgaagctgatcggcaccctgctggtgatgggcgtgttcgacgacgacgacgtgagacagatcctgctgctgatcgaccccagcgtgttcggcgagcacagcgccggcaccgaggagggcgccgagaaggaggaggtgacccaggtggaggagaaggccgtggaggccggcgagaaggccggcaaggaggcccccgtgaagggcctgctgcagaccagactgcccgagagcgtgaagctgcagatgtgcgagctgctgagctacctgtgcgactgcgagctgcagcacagagtggaggccatcgtggccttcggcgacatctacgtgagcaagctgcaggccaaccagaagttcagatacaacgagctgatgcaggccctgaacatgagcgccgccctgaccgccagaaagaccaaggagttcagaagccccccccaggagcagatcaacatgctgctgaacttccagctgggcgagaactgcccctgccccgaggagatcagagaggagctgtacgacttccacgaggacctgctgctgcactgcggcgtgcccctggaggaggaggaggaggaggaggaggacaccagctggaccggcaagctgtgcgccctggtgtacaagatcaagggcccccccaagcccgagaaggagcagcccaccgaggaggaggagagatgccccaccaccctgaaggagctgatcagccagaccatgatctgctgggcccaggaggaccagatccaggacagcgagctggtgagaatgatgttcaacctgctgagaagacagtacgacagcatcggcgagctgctgcaggccctgagaaagacctacaccatcagccacaccagcgtgagcgacaccatcaacctgctggccgccctgggccagatcagaagcctgctgagcgtgagaatgggcaaggaggaggagctgctgatgatcaacggcctgggcgacatcatgaacaacaaggtgttctaccagcaccccaacctgatgagagtgctgggcatgcacgagaccgtgatggaggtgatggtgaacgtgctgggcaccgagaagagccagatcgccttccccaagatggtggccagctgctgcagattcctgtgctacttctgcagaatcagcagacagaaccagaaggccatgttcgagcacctgagctacctgctggagaacagcagcgtgggcctggccagccccagcatgagaggcagcacccccctggacgtggccgccagcagcgtgatggacaacaacgagctggccctgagcctggaggagcccgacctggagaaggtggtgacctacctggccggctgcggcctgcagagctgccccatgctgctggccaagggctaccccgacgtgggctggaaccccatcgagggcgagagatacctgagcttcctgagattcgccgtgttcgtgaacagcgagagcgtggaggagaacgccagcgtggtggtgaagctgctgatcagaagacccgagtgcttcggccccgccctgagaggcgagggcggcaacggcctgctggccgccatgcagggcgccatcaagatcagcgagaaccccgccctggacctgcccagccagggctacaagagagaggtgagcaccggcgacgacgaggaggaggaggagatcgtgcacatgggcaacgccatcatgagcttctacagcgccctgatcgacctgctgggcagatgcgcccccgagatgcacctgatccagaccggcaagggcgaggccatcagaatcagaagcatcctgagaagcctggtgcccaccgaggacctggtgggcatcatcagcatccccctgaagctgcccagcctgaacaaggacggcagcgtgagcgagcccgacatggccgccaacttctgccccgaccacaaggcccccatggtgctgttcctggacagagtgtacggcatcaaggaccagaccttcctgctgcacctgctggaggtgggcttcctgcccgacctgagagccagcgccagcctggacaccgtgagcctgagcaccaccgaggccgccctggccctgaacagatacatctgcagcgccgtgctgcccctgctgaccagatgcgcccccctgttcgccggcaccgagcactgcaccagcctgatcgacagcaccctgcagaccatctacagactgagcaagggcagaagcctgaccaaggcccagagagacaccatcgaggagtgcctgctggccatctgcaaccacctgagacccagcatgctgcagcagctgctgagaagactggtgttcgacgtgccccagctgaacgagtactgcaagatgcccctgaagctgctgaccaaccactacgagcagtgctggaagtactactgcctgcccagcggctggggcagctacggcctggccgtggaggaggagctgcacctgaccgagaagctgttctggggcatcttcgacagcctgagccacaagaagtacgaccccgacctgttcagaatggccctgccctgcctgagcgccatcgccggcgccctgccccccgactacctggacaccagaatcaccgccaccctggagaagcagatcagcgtggacgccgacggcaacttcgaccccaagcccatcaacaccatgaacttcagcctgcccgagaagctggagtacatcgtgaccaagtacgccgagcacagccacgacaagtgggcctgcgacaagagccagagcggctggaagtacggcatcagcctggacgagaacgtgaagacccaccccctgatcagacccttcaagaccctgaccgagaaggagaaggagatctacagatggcccgccagagagagcctgaagaccatgctggccgtgggctggaccgtggagagaaccaaggagggcgaggccctggtgcagcagagagagaacgagaagctgagaagcgtgagccaggccaaccagggcaacagctacagccccgcccccctggacctgagcaacgtggtgctgagcagagagctgcagggcatggtggaggtggtggccgagaactaccacaacatctgggccaagaagaagaagctggagctggagagcaagggcggcggcagccaccccctgctggtgccctacgacaccctgaccgccaaggagaagttcaaggacagagagaaggcccaggacctgttcaagttcctgcaggtgaacggcatcatcgtgagcagaggcatgaaggacatggagctggacgccagcagcatggagaagagattcgcctacaagttcctgaagaagatcctgaagtacgtggacagcgcccaggagttcatcgcccacctggaggccatcgtgagcagcggcaagaccgagaagagccccagagaccaggagatcaagttcttcgccaaggtgctgctgcccctggtggaccagtacttcaccagccactgcctgtacttcctgagcagccccctgaagcccctgagcagcagcggctacgccagccacaaggagaaggagatggtggccggcctgttctgcaagctggccgccctggtgagacacagaatcagcctgttcggcagcgacagcaccaccatggtgagctgcctgcacatcctggcccagaccctggacaccagaaccgtgatgaagagcggcagcgagctggtgaaggccggcctgagagccttcttcgagaacgccgccgaggacctggagaagaccagcgagaacctgaagctgggcaagttcacccacagcagaacccagatcaagggcgtgagccagaacatcaactacaccaccgtggccctgctgcccatcctgaccagcatcttcgagcacgtgacccagcaccagttcggcatggacctgctgctgggcgacgtgcagatcagctgctaccacatcctgtgcagcctgtacagcctgggcaccggcaagaacatctacgtggagagacagagacccgccctgggcgagtgcctggccagcctggccgccgccatccccgtggccttcctggagcccaccctgaacagatacaaccccctgagcgtgttcaacaccaagacccccagagagagaagcatcctgggcatgcccgacaccgtggaggacatgtgccccgacatcccccagctggagggcctgatgaaggagatcaacgacctggccgagagcggcgccagatacaccgagatgccccacgtgatcgaggtgatcctgcccatgctgtgcaactacctgagctactggtgggagagaggccccgagaacctgccccccagcaccggcccctgctgcaccaaggtgaccagcgagcacctgagcctgatcctgggcaacatcctgaagatcatcaacaacaacctgggcatcgacgaggccagctggatgaagagaatcgccgtgtacgcccagcccatcatcagcaaggccagacccgacctgctgagaagccacttcatccccaccctggagaagctgaagaagaaggccgtgaagaccgtgcaggaggaggagcagctgaaggccgacggcaagggcgacacccaggaggccgagctgctgatcctggacgagttcgccgtgctgtgcagagacctgtacgccttctaccccatgctgatcagatacgtggacaacaacagaagcaactggctgaagagccccgacgccgacagcgaccagctgttcagaatggtggccgaggtgttcatcctgtggtgcaagagccacaacttcaagagagaggagcagaacttcgtgatccagaacgagatcaacaacctggccttcctgaccggcgacagcaagagcaagatgagcaaggccatgcaggtgaagagcggcggccaggaccaggagagaaagaagaccaagagaagaggcgacctgtacagcatccagaccagcctgatcgtggccgccctgaagaagatgctgcccatcggcctgaacatgtgcacccccggcgaccaggagctgatcagcctggccaagagcagatacagccacagagacaccgacgaggaggtgagagagcacctgagaaacaacctgcacctgcaggagaagagcgacgaccccgccgtgaagtggcagctgaacctgtacaaggacgtgctgaagagcgaggagcccttcaaccccgagaagaccgtggagagagtgcagagaatcagcgccgccgtgttccacctggagcaggtggagcagcccctgagaagcaagaaggccgtgtggcacaagctgctgagcaagcagagaaagagagccgtggtggcctgcttcagaatggcccccctgtacaacctgcccagacacagaagcatcaacctgttcctgcacggctaccagagattctggatcgagaccgaggagtacagcttcgaggagaagctggtgcaggacctggccaagagccccaaggtggaggaggaggaggaggaggagaccgagaagcagcccgaccccctgcaccagatcatcctgtacttcagcagaaacgccctgaccgagagaagcaagctggaggacgaccccctgtacaccagctacagcagcatgatggccaagagctgccagagcggcgaggacgaggaggaggacgaggacaaggagaagaccttcgaggagaaggagatggagaagcagaagaccctgtaccagcaggccagactgcacgagagaggcgccgccgagatggtgctgcagatgatcagcgccagcaagggcgagatgagccccatggtggtggagaccctgaagctgggcatcgccatcctgaacggcggcaacgccggcgtgcagcagaagatgctggactacctgaaggagaagaaggacgccggcttcttccagagcctgagcggcctgatgcagagctgcagcgtgctggacctgaacgccttcgagagacagaacaaggccgagggcctgggcatggtgaccgaggagggcaccctgatcgtgagagagagaggcgagaaggtgctgcagaacgacgagttcaccagagacctgttcagattcctgcagctgctgtgcgagggccacaacagcgacttccagaacttcctgagaacccagatgggcaacaccaccaccgtgaacgtgatcatcagcaccgtggactacctgctgagactgcaggagagcatcagcgacttctactggtactacagcggcaaggacatcatcgacgagagcggccagcacaacttcagcaaggccctggccgtgaccaagcagatcttcaacagcctgaccgagtacatccagggcccctgcatcggcaaccagcagagcctggcccacagcagactgtgggacgccgtggtgggcttcctgcacgtgttcgccaacatgcagatgaagctgagccaggacagcagccagatcgagctgctgaaggagctgctggacctgctgcaggacatggtggtgatgctgctgagcctgctggagggcaacgtggtgaacggcaccatcggcaagcagatggtggacaccctggtggagagcagcaccaacgtggagatgatcctgaagttcttcgacatgttcctgaagctgaaggacctgaccagcagcgacaccttcaaggagtacgaccccgacggcaagggcatcatcagcaagaaggagttccagaaggccatggagggccagaagcagtacacccagagcgagatcgacttcctgctgagctgcgccgaggccgacgagaacgacatgttcaactacgtggacttcgtggacagattccacgagcccgccaaggacatcggcttcaacgtggccgtgctgctgaccaacctgagcgagcacatgcccaacgacagcagactgaagtgcctgctggaccccgccgagagcgtgctgaactacttcgagccctacctgggcagaatcgagatcatgggcggcgccaagaagatcgagagagtgtacttcgagatcagcgagagcagcagaacccagtgggagaagccccaggtgaaggagagcaagagacagttcatcttcgacgtggtgaacgagggcggcgagcaggagaagatggagctgttcgtgaacttctgcgaggacaccatcttcgagatgcagctggccagccagatcagcgagagcgacagcgccgacagacccgaggaggaggaggaggacgaggacagcagctacgtgctggagatcgccggcgaggaggaggaggacggcagcctggagcccgccagcgccttcgccatggcctgcgccagcgtgaagagaaacgtgaccgacttcctgaagagagccaccctgaagaacctgagaaagcagtacagaaacgtgaagaagatgaccgccaaggagctggtgaaggtgctgttcagcttcttctggatgctgttcgtgggcctgttccagctgctgttcaccatcctgggcggcatcttccagatcctgtggagcaccgtgttcggcggcggcctggtggagggcgccaagaacatcagagtgaccaagatcctgggcgacatgcccgaccccacccagttcggcatccacgacgacaccatggaggccgagagagccgaggtgatggagcccggcatcaccaccgagctggtgcacttcatcaagggcgagaagggcgacaccgacatcatgagcgacctgttcggcctgcaccccaagaaggagggcagcctgaagcacggccccgaggtgggcctgggcgacctgagcgagatcatcggcaaggacgagccccccaccctggagagcaccgtgcagaagaagagaaaggcccaggccgccgagatgaaggccgccaacgaggccgagggcaaggtggagagcgagaaggccgacatggaggacggcgagaaggaggacaaggacaaggaggaggagcaggccgagtacctgtggaccgaggtgaccaagaagaagaagagaagatgcggccagaaggtggagaagcccgaggccttcaccgccaacttcttcaagggcctggagatctaccagaccaagctgctgcactacctggccagaaacttctacaacctgagattcctggccctgttcgtggccttcgccatcaacttcatcctgctgttctacaaggtgaccgaggagcccctggaggaggagaccgaggacgtggccaacctgtggaacagcttcaacgacgaggaggaggaggaggccatggtgttcttcgtgctgcaggagagcaccggctacatggcccccaccctgagagccctggccatcatccacaccatcatcagcctggtgtgcgtggtgggctactactgcctgaaggtgcccctggtggtgttcaagagagagaaggagatcgccagaaagctggagttcgacggcctgtacatcaccgagcagcccagcgaggacgacatcaagggccagtgggacagactggtgatcaacacccccagcttccccaacaactactgggacaagttcgtgaagagaaaggtgatcaacaagtacggcgacctgtacggcgccgagagaatcgccgagctgctgggcctggacaagaacgccctggacttcagccccgtggaggagaccaaggccgaggccgccagcctggtgagctggctgagcagcatcgacatgaagtaccacatctggaagctgggcgtggtgttcaccgacaacagcttcctgtacctggcctggtacaccaccatgagcgtgctgggccactacaacaacttcttcttcgccgcccacctgctggacatcgccatgggcttcaagaccctgagaaccatcctgagcagcgtgacccacaacggcaagcagctggtgctgaccgtgggcctgctggccgtggtggtgtacctgtacaccgtggtggccttcaacttcttcagaaagttctacaacaagagcgaggacgacgacgagcccgacatgaagtgcgacgacatgatgacctgctacctgttccacatgtacgtgggcgtgagagccggcggcggcatcggcgacgagatcgaggaccccgccggcgacccctacgagatgtacagaatcgtgttcgacatcaccttcttcttcttcgtgatcgtgatcctgctggccatcatccagggcctgatcatcgacgccttcggcgagctgagagaccagcaggagcaggtgagagaggacatggagaccaagtgcttcatctgcggcatcggcaacgactacttcgacaccaccccccacggcttcgagacccacaccctgcaggagcacaacctggccaactacctgttcttcctgatgtacctgatcaacaaggacgagaccgagcacaccggccaggagagctacgtgtggaagatgtaccaggagagatgctgggacttcttccccgccggcgactgcttcagaaagcagtacgaggaccagctgggctag

SEQ ID NO: 97919 - DNA, 14598 bp, Artificial Sequence
  Description of Artificial Sequence: Synthetic coding sequence
atggccgagggcggcgagggcggcgaggacgagatccagttcctgagaaccgaggacgaggtggtgctgcagtgcatcgccaccatccacaaggagcagagaaagttctgcctggccgccgagggcctgggcaacagactgtgcttcctggagcccaccagcgaggccaagtacatcccccccgacctgtgcgtgtgcaacttcgtgctggagcagagcctgagcgtgagagccctgcaggagatgctggccaacaccggcgagaacggcggcgagggcgccgcccagggcggcggccacagaaccctgctgtacggccacgccgtgctgctgagacacagcttcagcggcatgtacctgacctgcctgaccaccagcagaagccagaccgacaagctggccttcgacgtgggcctgagagagcacgccaccggcgaggcctgctggtggaccatccaccccgccagcaagcagagaagcgagggcgagaaggtgagaatcggcgacgacctgatcctggtgagcgtgagcagcgagagatacctgcacctgagcgtgagcaacggcaacatccaggtggacgccagcttcatgcagaccctgtggaacgtgcaccccacctgcagcggcagcagcatcgaggagggctacctgctgggcggccacgtggtgagactgttccacggccacgacgagtgcctgaccatccccagcaccgaccagaacgacagccagcacagaagaatcttctacgaggccggcggcgccggcaccagagccagaagcctgtggagagtggagcccctgagaatcagctggagcggcagcaacatcagatggggccaggccttcagactgagacacctgaccaccggccactacctggccctgaccgaggaccagggcctgatcctgcaggacagagccaagagcgacaccaagagcaccgccttcagcttcagagccagcaaggagctgaaggagaagctggacagcagccacaagagagacatcgagggcatgggcgtgcccgagatcaagtacggcgacagcgtgtgcttcgtgcagcacatcgccagcggcctgtgggtgacctacaaggcccaggacgccaagaccagcagactgggccccctgaagagaaaggtgatcctgcaccaggagggccacatggacgacggcctgaccctgcagagatgccagagagaggagagccaggccgccagaatcatcagaaacaccaccgccctgttcagccagttcgtgagcggcaacaacagaaccgccgcccccatcaccctgcccatcgaggaggtgctgcagaccctgcaggacctgatcgcctacttccagccccccgaggaggagatgagacacgaggacaagcagaacaagctgagaagcctgaagaacagacagaacctgttcaaggaggagggcatgctggccctggtgctgaactgcatcgacagactgaacgtgtacaacagcgtggcccacttcgccggcatcgccagagaggagagcggcatggcctggaaggagatcctgaacctgctgtacaagctgctggccgccctgatcagaggcaacagaaacaactgcgcccagttcagcaacaacctggactggctgatcagcaagctggacagactggagagcagcagcggcatcctggaggtgctgcactgcatcctgaccgagagccccgaggccctgaacctgatcgccgagggccacatcaagagcatcatcagcctgctggacaagcacggcagaaaccacaaggtgctggacatcctgtgcagcctgtgcctgtgcaacggcgtggccgtgagagccaaccagaacctgatctgcgacaacctgctgcccagaagaaacctgctgctgcagaccagactgatcaacgacgtgaccagcatcagacccaacatcttcctgggcgtggccgagggcagcgcccagtacaagaagtggtacttcgagctgatcatcgaccaggtggaccccttcctgaccgccgagcccacccacctgagagtgggctgggccagcagcagcggctacgccccctaccccggcggcggcgagggctggggcggcaacggcgtgggcgacgacctgtacagctacggcttcgacggcctgcacctgtggagcggcagaatccccagagccgtggccagcatcaaccagcacctgctgagaagcgacgacgtggtgagctgctgcctggacctgggcgtgcccagcatcagcttcagaatcaacggccagcccgtgcagggcatgttcgagaacttcaacaccgacggcctgttcttccccgtgatgagcttcagcgccggcgtgaaggtgagattcctgatgggcggcagacacggcgagttcaagttcctgccccccagcggctacgccccctgctacgaggccctgctgcccaaggagaagatgagactggagcccgtgaaggagtacaagagagacgccgacggcatcagagacctgctgggcaccacccagttcctgagccaggccagcttcatcccctgccccgtggacaccagccaggtgatcctgcccccccacctggagaagatcagagacagactggccgagaacatccacgagctgtggggcatgaacaagatcgagctgggctggaccttcggcaagatcagagacgacaacaagagacagcacccctgcctggtggagttcagcaagctgcccgagaccgagaagaactacaacctgcagatgagcaccgagaccctgaagaccctgctggccctgggctgccacatcgcccacgtgaaccccgccgccgaggaggacctgaagaaggtgaagctgcccaagaactacatgatgagcaacggctacaagcccgcccccctggacctgagcgacgtgaagctgctgcccccccaggagatcctggtggacaagctggccgagaacgcccacaacgtgtgggccaaggacagaatcaagcagggctggacctacggcatccagcaggacctgaagaacaagagaaaccccagactggtgccctacgccctgctggacgagagaaccaagaagagcaacagagacagcctgagagaggccgtgagaaccttcgtgggctacggctacaacatcgagcccagcgaccaggagctggccgacagcgccgtggagaaggtgagcatcgacaagatcagattcttcagagtggagagaagctacgccgtgagaagcggcaagtggtacttcgagttcgaggtggtgaccggcggcgacatgagagtgggctgggccagacccggctgcagacccgacgtggagctgggcgccgacgaccaggccttcgtgttcgagggcaacagaggccagagatggcaccagggcagcggctacttcggcagaacctggcagcccggcgacgtggtgggctgcatgatcaacctggacgacgccagcatgatcttcaccctgaacggcgagctgctgatcaccaacaagggcagcgagctggccttcgccgactacgagatcgagaacggcttcgtgcccatctgctgcctgggcctgagccagatcggcagaatgaacctgggcaccgacgccagcaccttcaagttctacaccatgtgcggcctgcaggagggcttcgagcccttcgccgtgaacatgaacagagacgtggccatgtggttcagcaagagactgcccaccttcgtgaacgtgcccaaggaccacccccacatcgaggtgatgagaatcgacggcaccatggacagccccccctgcctgaaggtgacccacaagaccttcggcacccagaacagcaacgccgacatgatctactgcagactgagcatgcccgtggagtgccacagcagcttcagccacagcccctgcctggacagcgaggccttccagaagagaaagcagatgcaggagatcctgagccacaccaccacccagtgctactacgccatcagaatcttcgccggccaggaccccagctgcgtgtgggtgggctgggtgacccccgactaccacctgtacagcgagaagttcgacctgaacaagaactgcaccgtgaccgtgaccctgggcgacgagagaggcagagtgcacgagagcgtgaagagaagcaactgctacatggtgtggggcggcgacatcgtggccagcagccagagaagcaacagaagcaacgtggacctggagatcggctgcctggtggacctggccatgggcatgctgagcttcagcgccaacggcaaggagctgggcacctgctaccaggtggagcccaacaccaaggtgttccccgccgtgttcctgcagcccaccagcaccagcctgttccagttcgagctgggcaagctgaagaacgccatgcccctgagcgccgccatcttcagaagcgaggagaagaaccccgtgccccagtgcccccccagactggacgtgcagaccatccagcccgtgctgtggagcagaatgcccaacagcttcctgaaggtggagaccgagagagtgagcgagagacacggctgggtggtgcagtgcctggagcccctgcagatgatggccctgcacatccccgaggagaacagatgcgtggacatcctggagctgtgcgagcaggaggacctgatgagattccactaccacaccctgagactgtacagcgccgtgtgcgccctgggcaacagcagagtggcctacgccctgtgcagccacgtggacctgagccagctgttctacgccatcgacaacaagtacctgcccggcctgctgagaagcggcttctacgacctgctgatcagcatccacctggccagcgccaaggagagaaagctgatgatgaagaacgagtacatcatccccatcaccagcaccaccagaaacatcagactgttccccgacgagagcaagagacacggcctgcccggcgtgggcctgagaacctgcctgaagcccggcttcagattcagcaccccctgcttcgtggtgaccggcgaggaccaccagaagcagagccccgagatccccctggagagcctgagaaccaaggccctgagcatgctgaccgaggccgtgcagtgcagcggcgcccacatcagagaccccgtgggcggcagcgtggagttccagttcgtgcccgtgctgaagctgatcggcaccctgctggtgatgggcgtgttcgacgacgacgacgtgagacagatcctgctgctgatcgaccccagcgtgttcggcgagcacagcgccggcaccgaggagggcgccgagaaggaggaggtgacccaggtggaggagaaggccgtggaggccggcgagaaggccggcaaggaggcccccgtgaagggcctgctgcagaccagactgcccgagagcgtgaagctgcagatgtgcgagctgctgagctacctgtgcgactgcgagctgcagcacagagtggaggccatcgtggccttcggcgacatctacgtgagcaagctgcaggccaaccagaagttcagatacaacgagctgatgcaggccctgaacatgagcgccgccctgaccgccagaaagaccaaggagttcagaagccccccccaggagcagatcaacatgctgctgaacttccagctgggcgagaactgcccctgccccgaggagatcagagaggagctgtacgacttccacgaggacctgctgctgcactgcggcgtgcccctggaggaggaggaggaggaggaggaggacaccagctggaccggcaagctgtgcgccctggtgtacaagatcaagggcccccccaagcccgagaaggagcagcccaccgaggaggaggagagatgccccaccaccctgaaggagctgatcagccagaccatgatctgctgggcccaggaggaccagatccaggacagcgagctggtgagaatgatgttcaacctgctgagaagacagtacgacagcatcggcgagctgctgcaggccctgagaaagacctacaccatcagccacaccagcgtgagcgacaccatcaacctgctggccgccctgggccagatcagaagcctgctgagcgtgagaatgggcaaggaggaggagctgctgatgatcaacggcctgggcgacatcatgaacaacaaggtgttctaccagcaccccaacctgatgagagtgctgggcatgcacgagaccgtgatggaggtgatggtgaacgtgctgggcaccgagaagagccagatcgccttccccaagatggtggccagctgctgcagattcctgtgctacttctgcagaatcagcagacagaaccagaaggccatgttcgagcacctgagctacctgctggagaacagcagcgtgggcctggccagccccagcatgagaggcagcacccccctggacgtggccgccagcagcgtgatggacaacaacgagctggccctgagcctggaggagcccgacctggagaaggtggtgacctacctggccggctgcggcctgcagagctgccccatgctgctggccaagggctaccccgacgtgggctggaaccccatcgagggcgagagatacctgagcttcctgagattcgccgtgttcgtgaacagcgagagcgtggaggagaacgccagcgtggtggtgaagctgctgatcagaagacccgagtgcttcggccccgccctgagaggcgagggcggcaacggcctgctggccgccatgcagggcgccatcaagatcagcgagaaccccgccctggacctgcccagccagggctacaagagagaggtgagcaccggcgacgacgaggaggaggaggagatcgtgcacatgggcaacgccatcatgagcttctacagcgccctgatcgacctgctgggcagatgcgcccccgagatgcacctgatccagaccggcaagggcgaggccatcagaatcagaagcatcctgagaagcctggtgcccaccgaggacctggtgggcatcatcagcatccccctgaagctgcccagcctgaacaaggacggcagcgtgagcgagcccgacatggccgccaacttctgccccgaccacaaggcccccatggtgctgttcctggacagagtgtacggcatcaaggaccagaccttcctgctgcacctgctggaggtgggcttcctgcccgacctgagagccagcgccagcctggacaccgtgagcctgagcaccaccgaggccgccctggccctgaacagatacatctgcagcgccgtgctgcccctgctgaccagatgcgcccccctgttcgccggcaccgagcactgcaccagcctgatcgacagcaccctgcagaccatctacagactgagcaagggcagaagcctgaccaaggcccagagagacaccatcgaggagtgcctgctggccatctgcaaccacctgagacccagcatgctgcagcagctgctgagaagactggtgttcgacgtgccccagctgaacgagtactgcaagatgcccctgaagctgctgaccaaccactacgagcagtgctggaagtactactgcctgcccagcggctggggcagctacggcctggccgtggaggaggagctgcacctgaccgagaagctgttctggggcatcttcgacagcctgagccacaagaagtacgaccccgacctgttcagaatggccctgccctgcctgagcgccatcgccggcgccctgccccccgactacctggacaccagaatcaccgccaccctggagaagcagatcagcgtggacgccgacggcaacttcgaccccaagcccatcaacaccatgaacttcagcctgcccgagaagctggagtacatcgtgaccaagtacgccgagcacagccacgacaagtgggcctgcgacaagagccagagcggctggaagtacggcatcagcctggacgagaacgtgaagacccaccccctgatcagacccttcaagaccctgaccgagaaggagaaggagatctacagatggcccgccagagagagcctgaagaccatgctggccgtgggctggaccgtggagagaaccaaggagggcgaggccctggtgcagcagagagagaacgagaagctgagaagcgtgagccaggccaaccagggcaacagctacagccccgcccccctggacctgagcaacgtggtgctgagcagagagctgcagggcatggtggaggtggtggccgagaactaccacaacatctgggccaagaagaagaagctggagctggagagcaagggcggcggcagccaccccctgctggtgccctacgacaccctgaccgccaaggagaagttcaaggacagagagaaggcccaggacctgttcaagttcctgcaggtgaacggcatcatcgtgagcagaggcatgaaggacatggagctggacgccagcagcatggagaagagattcgcctacaagttcctgaagaagatcctgaagtacgtggacagcgcccaggagttcatcgcccacctggaggccatcgtgagcagcggcaagaccgagaagagccccagagaccaggagatcaagttcttcgccaaggtgctgctgcccctggtggaccagtacttcaccagccactgcctgtacttcctgagcagccccctgaagcccctgagcagcagcggctacgccagccacaaggagaaggagatggtggccggcctgttctgcaagctggccgccctggtgagacacagaatcagcctgttcggcagcgacagcaccaccatggtgagctgcctgcacatcctggcccagaccctggacaccagaaccgtgatgaagagcggcagcgagctggtgaaggccggcctgagagccttcttcgagaacgccgccgaggacctggagaagaccagcgagaacctgaagctgggcaagttcacccacagcagaacccagatcaagggcgtgagccagaacatcaactacaccaccgtggccctgctgcccatcctgaccagcatcttcgagcacgtgacccagcaccagttcggcatggacctgctgctgggcgacgtgcagatcagctgctaccacatcctgtgcagcctgtacagcctgggcaccggcaagaacatctacgtggagagacagagacccgccctgggcgagtgcctggccagcctggccgccgccatccccgtggccttcctggagcccaccctgaacagatacaaccccctgagcgtgttcaacaccaagacccccagagagagaagcatcctgggcatgcccgacaccgtggaggacatgtgccccgacatcccccagctggagggcctgatgaaggagatcaacgacctggccgagagcggcgccagatacaccgagatgccccacgtgatcgaggtgatcctgcccatgctgtgcaactacctgagctactggtgggagagaggccccgagaacctgccccccagcaccggcccctgctgcaccaaggtgaccagcgagcacctgagcctgatcctgggcaacatcctgaagatcatcaacaacaacctgggcatcgacgaggccagctggatgaagagaatcgccgtgtacgcccagcccatcatcagcaaggccagacccgacctgctgagaagccacttcatccccaccctggagaagctgaagaagaaggccgtgaagaccgtgcaggaggaggagcagctgaaggccgacggcaagggcgacacccaggaggccgagctgctgatcctggacgagttcgccgtgctgtgcagagacctgtacgccttctaccccatgctgatcagatacgtggacaacaacagaagcaactggctgaagagccccgacgccgacagcgaccagctgttcagaatggtggccgaggtgttcatcctgtggtgcaagagccacaacttcaagagagaggagcagaacttcgtgatccagaacgagatcaacaacctggccttcctgaccggcgacagcaagagcaagatgagcaagagcggcggccaggaccaggagagaaagaagaccaagagaagaggcgacctgtacagcatccagaccagcctgatcgtggccgccctgaagaagatgctgcccatcggcctgaacatgtgcacccccggcgaccaggagctgatcagcctggccaagagcagatacagccacagagacaccgacgaggaggtgagagagcacctgagaaacaacctgcacctgcaggagaagagcgacgaccccgccgtgaagtggcagctgaacctgtacaaggacgtgctgaagagcgaggagcccttcaaccccgagaagaccgtggagagagtgcagagaatcagcgccgccgtgttccacctggagcaggtggagcagcccctgagaagcaagaaggccgtgtggcacaagctgctgagcaagcagagaaagagagccgtggtggcctgcttcagaatggcccccctgtacaacctgcccagacacagaagcatcaacctgttcctgcacggctaccagagattctggatcgagaccgaggagtacagcttcgaggagaagctggtgcaggacctggccaagagccccaaggtggaggaggaggaggaggaggagaccgagaagcagcccgaccccctgcaccagatcatcctgtacttcagcagaaacgccctgaccgagagaagcaagctggaggacgaccccctgtacaccagctacagcagcatgatggccaagagctgccagagcggcgaggacgaggaggaggacgaggacaaggagaagaccttcgaggagaaggagatggagaagcagaagaccctgtaccagcaggccagactgcacgagagaggcgccgccgagatggtgctgcagatgatcagcgccagcaagggcgagatgagccccatggtggtggagaccctgaagctgggcatcgccatcctgaacggcggcaacgccggcgtgcagcagaagatgctggactacctgaaggagaagaaggacgccggcttcttccagagcctgagcggcctgatgcagagctgcagcgtgctggacctgaacgccttcgagagacagaacaaggccgagggcctgggcatggtgaccgaggagggcaccctgatcgtgagagagagaggcgagaaggtgctgcagaacgacgagttcaccagagacctgttcagattcctgcagctgctgtgcgagggccacaacagcgacttccagaacttcctgagaacccagatgggcaacaccaccaccgtgaacgtgatcatcagcaccgtggactacctgctgagactgcaggagagcatcagcgacttctactggtactacagcggcaaggacatcatcgacgagagcggccagcacaacttcagcaaggccctggccgtgaccaagcagatcttcaacagcctgaccgagtacatccagggcccctgcatcggcaaccagcagagcctggcccacagcagactgtgggacgccgtggtgggcttcctgcacgtgttcgccaacatgcagatgaagctgagccaggacagcagccagatcgagctgctgaaggagctgctggacctgctgcaggacatggtggtgatgctgctgagcctgctggagggcaacgtggtgaacggcaccatcggcaagcagatggtggacaccctggtggagagcagcaccaacgtggagatgatcctgaagttcttcgacatgttcctgaagctgaaggacctgaccagcagcgacaccttcaaggagtacgaccccgacggcaagggcatcatcagcaagaaggagttccagaaggccatggagggccagaagcagtacacccagagcgagatcgacttcctgctgagctgcgccgaggccgacgagaacgacatgttcaactacgtggacttcgtggacagattccacgagcccgccaaggacatcggcttcaacgtggccgtgctgctgaccaacctgagcgagcacatgcccaacgacagcagactgaagtgcctgctggaccccgccgagagcgtgctgaactacttcgagccctacctgggcagaatcgagatcatgggcggcgccaagaagatcgagagagtgtacttcgagatcagcgagagcagcagaacccagtgggagaagccccaggtgaaggagagcaagagacagttcatcttcgacgtggtgaacgagggcggcgagcaggagaagatggagctgttcgtgaacttctgcgaggacaccatcttcgagatgcagctggccagccagatcagcgagagcgacagcgccgacagacccgaggaggaggaggaggacgaggacagcagctacgtgctggagatcgccggcgaggaggaggaggacggcagcctggagcccgccagcgccttcgccatggcctgcgccagcgtgaagagaaacgtgaccgacttcctgaagagagccaccctgaagaacctgagaaagcagtacagaaacgtgaagaagatgaccgccaaggagctggtgaaggtgctgttcagcttcttctggatgctgttcgtgggcctgttccagctgctgttcaccatcctgggcggcatcttccagatcctgtggagcaccgtgttcggcggcggcctggtggagggcgccaagaacatcagagtgaccaagatcctgggcgacatgcccgaccccacccagttcggcatccacgacgacaccatggaggccgagagagccgaggtgatggagcccggcatcaccaccgagctggtgcacttcatcaagggcgagaagggcgacaccgacatcatgagcgacctgttcggcctgcaccccaagaaggagggcagcctgaagcacggccccgaggtgggcctgggcgacctgagcgagatcatcggcaaggacgagccccccaccctggagagcaccgtgcagaagaagagaaaggcccaggccgccgagatgaaggccgccaacgaggccgagggcaaggtggagagcgagaaggccgacatggaggacggcgagaaggaggacaaggacaaggaggaggagcaggccgagtacctgtggaccgaggtgaccaagaagaagaagagaagatgcggccagaaggtggagaagcccgaggccttcaccgccaacttcttcaagggcctggagatctaccagaccaagctgctgcactacctggccagaaacttctacaacctgagattcctggccctgttcgtggccttcgccatcaacttcatcctgctgttctacaaggtgaccgaggagcccctggaggaggagaccgaggacgtggccaacctgtggaacagcttcaacgacgaggaggaggaggaggccatggtgttcttcgtgctgcaggagagcaccggctacatggcccccaccctgagagccctggccatcatccacaccatcatcagcctggtgtgcgtggtgggctactactgcctgaaggtgcccctggtggtgttcaagagagagaaggagatcgccagaaagctggagttcgacggcctgtacatcaccgagcagcccagcgaggacgacatcaagggccagtgggacagactggtgatcaacacccccagcttccccaacaactactgggacaagttcgtgaagagaaaggtgatcaacaagtacggcgacctgtacggcgccgagagaatcgccgagctgctgggcctggacaagaacgccctggacttcagccccgtggaggagaccaaggccgaggccgccagcctggtgagctggctgagcagcatcgacatgaagtaccacatctggaagctgggcgtggtgttcaccgacaacagcttcctgtacctggcctggtacaccaccatgagcgtgctgggccactacaacaacttcttcttcgccgcccacctgctggacatcgccatgggcttcaagaccctgagaaccatcctgagcagcgtgacccacaacggcaagcagctggtgctgaccgtgggcctgctggccgtggtggtgtacctgtacaccgtggtggccttcaacttcttcagaaagttctacaacaagagcgaggacgacgacgagcccgacatgaagtgcgacgacatgatgacctgctacctgttccacatgtacgtgggcgtgagagccggcggcggcatcggcgacgagatcgaggaccccgccggcgacccctacgagatgtacagaatcgtgttcgacatcaccttcttcttcttcgtgatcgtgatcctgctggccatcatccagggcctgatcatcgacgccttcggcgagctgagagaccagcaggagcaggtgagagaggacatggagaccaagtgcttcatctgcggcatcggcaacgactacttcgacaccaccccccacggcttcgagacccacaccctgcaggagcacaacctggccaactacctgttcttcctgatgtacctgatcaacaaggacgagaccgagcacaccggccaggagagctacgtgtggaagatgtaccaggagagatgctgggacttcttccccgccggcgactgcttcagaaagcagtacgaggaccagctgggctag

SEQ ID NO: 97920 - DNA, 285 bp, Artificial Sequence
  Description of Artificial Sequence: Synthetic coding sequence
atgggcagcgagctggagaccgccatggagaccctgatcaacgtgttccacgcccacagcggcaaggagggcgacaagtacaagctgagcaagaaggagctgaaggagctgctgcagaccgagctgagcggcttcctggacgcccagaaggacgtggacgccgtggacaaggtgatgaaggagctggacgagaacggcgacggcgaggtggacttccaggagtacgtggtgctggtggccgccctgaccgtggcctgcaacaacttcttctgggagaacagctag

SEQ ID NO: 97921 - DNA, 162 bp, Artificial Sequence
  Description of Artificial Sequence: Synthetic coding sequence
atgggcagcgagctggagaccgccatggagaccctgatcaacgtgttccacgcccacagcggcaaggagggcgacaagtacaagctgagcaagaaggagctgaaggagctgctgcagaccgagctgagcggcttcctggacgtgaaggagctgatgctgtag

SEQ ID NO: 97922 - DNA, 444 bp, Artificial Sequence
  Description of Artificial Sequence: Synthetic coding sequence
atggaggagccccagaccaagacccccagcgccgagttccccccctacagagcccagcccgcccagcccgccaccgcccccgccgccaccttcgccaccctggccatctgccccgagcccgcccccaccagcggccccggccagccctgcaccgccgccatgggcagcgagctggagaccgccatggagaccctgatcaacgtgttccacgcccacagcggcaaggagggcgacaagtacaagctgagcaagaaggagctgaaggagctgctgcagaccgagctgagcggcttcctggacgcccagaaggacgtggacgccgtggacaaggtgatgaaggagctggacgagaacggcgacggcgaggtggacttccaggagtacgtggtgctggtggccgccctgaccgtggcctgcaacaacttcttctgggagaacagctag

SEQ ID NO: 97923 - DNA, 105 bp, Artificial Sequence
  Description of Artificial Sequence: Synthetic coding sequence
atgggcagcgagctggagaccgccatggagaccctgatcaacgtgttccacgcccacagcggcaaggagggcgacaagtacaagctgagcaagaaggagctgtag

SEQ ID NO: 97924 - DNA, 294 bp, Artificial Sequence
  Description of Artificial Sequence: Synthetic coding sequence
atgcccagccagatggagcacgccatggagaccatgatgttcaccttccacaagttcgccggcgacaagggctacctgaccaaggaggacctgagagtgctgatggagaaggagttccccggcttcctggagaaccagaaggaccccctggccgtggacaagatcatgaaggacctggaccagtgcagagacggcaaggtgggcttccagagcttcttcagcctgatcgccggcctgaccatcgcctgcaacgactacttcgtggtgcacatgaagcagaagggcaagaagtag

SEQ ID NO: 97925 - DNA, 294 bp, Artificial Sequence; identical to SEQ ID NO: 97924
  Description of Artificial Sequence: Synthetic coding sequence

SEQ ID NO: 97926 - DNA, 318 bp, Artificial Sequence
  Description of Artificial Sequence: Synthetic coding sequence
atggccaagatcagcagccccaccgagaccgagagatgcatcgagagcctgatcgccgtgttccagaagtacgccggcaaggacggctacaactacaccctgagcaagaccgagttcctgagcttcatgaacaccgagctggccgccttcaccaagaaccagaaggaccccggcgtgctggacagaatgatgaagaagctggacaccaacagcgacggccagctggacttcagcgagttcctgaacctgatcggcggcctggccatggcctgccacgacagcttcctgaaggccgtgcccagccagaagagaacctag

SEQ ID NO: 97927 - DNA, 252 bp, Artificial Sequence
  Description of Artificial Sequence: Synthetic coding sequence
gccggcaagatgaccaagctggaggagcacctggagggcatcgtgaacatcttccaccagtacagcgtgagaaagggccacttcgacaccctgagcaagggcgagctgaagcagctgctgaccaaggagctggccaacaccatcaagagacccaagaagggcagcagcgtgatcgacgagatcttccagggcctggacgccaaccaggacgagcaggtggacttccaggagttcatcagcctggtggcctag

SEQ ID NO: 97928 - DNA, 279 bp, Artificial Sequence
  Description of Artificial Sequence: Synthetic coding sequence
atgaccaagctggaggagcacctggagggcatcgtgaacatcttccaccagtacagcgtgagaaagggccacttcgacaccctgagcaagggcgagctgaagcagctgctgaccaaggagctggccaacaccatcaagaacatcaaggacaaggccgtgatcgacgagatcttccagggcctggacgccaaccaggacgagcaggtggacttccaggagttcatcagcctggtggccatcgccctgaaggccgcccactaccacacccacaaggagtag

SEQ ID NO: 97929 - DNA, 297 bp, Artificial Sequence
  Description of Artificial Sequence: Synthetic coding sequence
atggccgccgagcccctgaccgagctggaggagagcatcgagaccgtggtgaccaccttcttcaccttcgccagacaggagggcagaaaggacagcctgagcgtgaacgagttcaaggagctggtgacccagcagctgccccacctgctgaaggacgtgggcagcctggacgagaagatgaagagcctggacgtgaaccaggacagcgagctgaagttcaacgagtactggagactgatcggcgagctggccaaggagatcagaaagaagaaggacctgaagatcagaaagaagtag

SEQ ID NO: 97930 - DNA, 297 bp, Artificial Sequence; identical to SEQ ID NO: 97929
  Description of Artificial Sequence: Synthetic coding sequence

SEQ ID NO: 97931 - DNA, 297 bp, Artificial Sequence; identical to SEQ ID NO: 97929
  Description of Artificial Sequence: Synthetic coding sequence

SEQ ID NO: 97932 - DNA, 297 bp, Artificial Sequence; identical to SEQ ID NO: 97929
  Description of Artificial Sequence: Synthetic coding sequence

SEQ ID NO: 97933 - DNA, 297 bp, Artificial Sequence; identical to SEQ ID NO: 97929
  Description of Artificial Sequence: Synthetic coding sequence

SEQ ID NO: 97934 - DNA, 315 bp, Artificial Sequence
  Description of Artificial Sequence: Synthetic coding sequence
atgggccagtgcagaagcgccaacgccgaggacgcccaggagttcagcgacgtggagagagccatcgagaccctgatcaagaacttccaccagtacagcgtggagggcggcaaggagaccctgacccccagcgagctgagagacctggtgacccagcagctgccccacctgatgcccagcaactgcggcctggaggagaagatcgccaacctgggcagctgcaacgacagcaagctggagttcagaagcttctgggagctgatcggcgaggccgccaagagcgtgaagctggagagacccgtgagaggccactag

SEQ ID NO: 97935 - DNA, 315 bp, Artificial Sequence; identical to SEQ ID NO: 97934
  Description of Artificial Sequence: Synthetic coding sequence

SEQ ID NO: 97936 - DNA, 315 bp, Artificial Sequence; identical to SEQ ID NO: 97934
  Description of Artificial Sequence: Synthetic coding sequence

SEQ ID NO: 97937 - DNA, 315 bp, Artificial Sequence; identical to SEQ ID NO: 97934
  Description of Artificial Sequence: Synthetic coding sequence

SEQ ID NO: 97938 - DNA, 417 bp, Artificial Sequence
  Description of Artificial Sequence: Synthetic coding sequence
atgtgcagcagcctggagcaggccctggccgtgctggtgaccaccttccacaagtacagctgccaggagggcgacaagttcaagctgagcaagggcgagatgaaggagctgctgcacaaggagctgcccagcttcgtgggccacagcagagagccctgcgccgtgagagccttcagagtgcacctgttcaaccccgtgatcggcgacctgagaaaccagagccccgagggcaagagcgactgccccaagatcacccagcactgggagaaggtggacgaggagggcctgaagaagctgatgggcagcctggacgagaacagcgaccagcaggtggacttccaggagtacgccgtgttcctggccctgatcaccgtgatgtgcaacgacttcttccagggctgccccgacagaccctag

SEQ ID NO: 97939 - DNA, 294 bp, Artificial Sequence
  Description of Artificial Sequence: Synthetic coding sequence
atgtgcagcagcctggagcaggccctggccgtgctggtgaccaccttccacaagtacagctgccaggagggcgacaagttcaagctgagcaagggcgagatgaaggagctgctgcacaaggagctgcccagcttcgtgggcgagaaggtggacgaggagggcctgaagaagctgatgggcagcctggacgagaacagcgaccagcaggtggacttccaggagtacgccgtgttcctggccctgatcaccgtgatgtgcaacgacttcttccagggctgccccgacagaccctag

SEQ ID NO: 97940 - DNA, 294 bp, Artificial Sequence; identical to SEQ ID NO: 97939
  Description of Artificial Sequence: Synthetic coding sequence

SEQ ID NO: 97941 - DNA, 294 bp, Artificial Sequence; identical to SEQ ID NO: 97939
  Description of Artificial Sequence: Synthetic coding sequence

SEQ ID NO: 97942 - DNA, 306 bp, Artificial Sequence
  Description of Artificial Sequence: Synthetic coding sequence
atggccagacccctggagcaggccgtggccgccatcgtgtgcaccttccaggagtacgccggcagatgcggcgacaagtacaagctgtgccaggccgagctgaaggagctgctgcagaaggagctggccacctggacccccaccgagttcagagagtgcgactacaacaagttcatgagcgtgctggacaccaacaaggactgcgaggtggacttcgtggagtacgtgagaagcctggcctgcctgtgcctgtactgccacgagtacttcaaggactgccccagcgagcccccctgcagccagtag

SEQ ID NO: 97943 - DNA, 306 bp, Artificial Sequence; identical to SEQ ID NO: 97942
  Description of Artificial Sequence: Synthetic coding sequence

SEQ ID NO: 97944 - DNA, 306 bp, Artificial Sequence
  Description of Artificial Sequence: Synthetic coding sequence
atggcctgccccctggagaaggccctggacgtgatggtgagcaccttccacaagtacagcggcaaggagggcgacaagttcaagctgaacaagagcgagctgaaggagctgctgaccagagagctgcccagcttcctgggcaagagaaccgacgaggccgccttccagaagctgatgagcaacctggacagcaacagagacaacgaggtggacttccaggagtactgcgtgttcctgagctgcatcgccatgatgtgcaacgagttcttcgagggcttccccgacaagcagcccagaaagaagtag

SEQ ID NO: 97945 - DNA, 306 bp, Artificial Sequence; identical to SEQ ID NO: 97944
  Description of Artificial Sequence: Synthetic coding sequence

SEQ ID NO: 97946 - DNA, 306 bp, Artificial Sequence; identical to SEQ ID NO: 97944
  Description of Artificial Sequence: Synthetic coding sequence

SEQ ID NO: 97947 - DNA, 306 bp, Artificial Sequence; identical to SEQ ID NO: 97944
  Description of Artificial Sequence: Synthetic coding sequence

SEQ ID NO: 97948 - DNA, 273 bp, Artificial Sequence
  Description of Artificial Sequence: Synthetic coding sequence
atggtgagcaccttccacaagtacagcggcaaggagggcgacaagttcaagctgaacaagagcgagctgaaggagctgctgaccagagagctgcccagcttcctgggcaagagaaccgacgaggccgccttccagaagctgatgagcaacctggacagcaacagagacaacgaggtggacttccaggagtactgcgtgttcctgagctgcatcgccatgatgtgcaacgagttcttcgagggcttccccgacaagcagcccagaaagaagtag

SEQ ID NO: 97949 - DNA, 333 bp, Artificial Sequence
  Description of Artificial Sequence: Synthetic coding sequence
atgcccgccgcctggatcctgtgggcccacagccacagcgagctgcacaccgtgatggagacccccctggagaaggccctgaccaccatggtgaccaccttccacaagtacagcggcagagagggcagcaagctgaccctgagcagaaaggagctgaaggagctgatcaagaaggagctgtgcctgggcgagatgaaggagagcagcatcgacgacctgatgaagagcctggacaagaacagcgaccaggagatcgacttcaaggagtacagcgtgttcctgaccatgctgtgcatggcctacaacgacttcttcctggaggacaacaagtag

SEQ ID NO: 97950 - DNA, 279 bp, Artificial Sequence
  Description of Artificial Sequence: Synthetic coding sequence
atggagacccccctggagaaggccctgaccaccatggtgaccaccttccacaagtacagcggcagagagggcagcaagctgaccctgagcagaaaggagctgaaggagctgatcaagaaggagctgtgcctgggcgagatgaaggagagcagcatcgacgacctgatgaagagcctggacaagaacagcgaccaggagatcgacttcaaggagtacagcgtgttcctgaccatgctgtgcatggcctacaacgacttcttcctggaggacaacaagtag

SEQ ID NO: 97951 - DNA, 279 bp, Artificial Sequence; identical to SEQ ID NO: 97950
  Description of Artificial Sequence: Synthetic coding sequence

SEQ ID NO: 97952 - DNA, 273 bp, Artificial Sequence
  Description of Artificial Sequence: Synthetic coding sequence
atggcctgccccctggaccaggccatcggcctgctggtggccatcttccacaagtacagcggcagagagggcgacaagcacaccctgagcaagaaggagctgaaggagctgatccagaaggagctgaccatcggcagcaagctgcaggacgccgagatcgccagactgatggaggacctggacagaaacaaggaccaggaggtgaacttccaggagtacgtgaccttcctgggcgccctggccctgatctacaacgaggccctgaagggctag

SEQ ID NO: 97953 - DNA, 273 bp, Artificial Sequence; identical to SEQ ID NO: 97952
  Description of Artificial Sequence: Synthetic coding sequence

SEQ ID NO: 97954 - DNA, 306 bp, Artificial Sequence
  Description of Artificial Sequence: Synthetic coding sequence
atgagcaacacccaggccgagagaagcatcatcggcatgatcgacatgttccacaagtacaccagaagagacgacaagatcgagaagcccagcctgctgaccatgatgaaggagaacttccccaacttcctgagcgcctgcgacaagaagggcaccaactacctggccgacgtgttcgagaagaaggacaagaacgaggacaagaagatcgacttcagcgagttcctgagcctgctgggcgacatcgccaccgactaccacaagcagagccacggcgccgccccctgcagcggcggcagccagtag

SEQ ID NO: 97955 - DNA, 306 bp, Artificial Sequence; identical to SEQ ID NO: 97954
  Description of Artificial Sequence: Synthetic coding sequence

SEQ ID NO: 97956 - DNA, 282 bp, Artificial Sequence
  Description of Artificial Sequence: Synthetic coding sequence
atgctgaccgagctggagaaggccctgaacagcatcatcgacgtgtaccacaagtacagcctgatcaagggcaacttccacgccgtgtacagagacgacctgaagaagctgctggagaccgagtgcccccagtacatcagaaagaagggcgccgacgtgtggttcaaggagctggacatcaacaccgacggcgccgtgaacttccaggagttcctgatcctggtgatcaagatgggcgtggccgcccacaagaagagccacgaggagagccacaaggagtag

SEQ ID NO: 97957 - DNA, 282 bp, Artificial Sequence; identical to SEQ ID NO: 97956
  Description of Artificial Sequence: Synthetic coding sequence

SEQ ID NO: 97958 - DNA, 345 bp, Artificial Sequence
  Description of Artificial Sequence: Synthetic coding sequence
atgacctgcaagatgagccagctggagagaaacatcgagaccatcatcaacaccttccaccagtacagcgtgaagctgggccaccccgacaccctgaaccagggcgagttcaaggagctggtgagaaaggacctgcagaacttcctgaagaaggagaacaagaacgagaaggtgatcgagcacatcatggaggacctggacaccaacgccgacaagcagctgagcttcgaggagttcatcatgctgatggccagactgacctgggccagccacgagaagatgcacgagggcgacgagggccccggccaccaccacaagcccggcctgggcgagggcaccccctag

SEQ ID NO: 97959 - DNA, 279 bp, Artificial Sequence
  Description of Artificial Sequence: Synthetic coding sequence
atgagcgagctggagaaggccatggtggccctgatcgacgtgttccaccagtacagcggcagagagggcgacaagcacaagctgaagaagagcgagctgaaggagctgatcaacaacgagctgagccacttcctggaggagatcaaggagcaggaggtggtggacaaggtgatggagaccctggacaacgacggcgacggcgagtgcgacttccaggagttcatggccttcgtggccatggtgaccaccgcctgccacgagttcttcgagcacgagtag

SEQ ID NO: 97960 - DNA, 279 bp, Artificial Sequence; identical to SEQ ID NO: 97959
  Description of Artificial Sequence: Synthetic coding sequence

SEQ ID NO: 97961 - DNA, 288 bp, Artificial Sequence
  Description of Artificial Sequence: Synthetic coding sequence
atgaccgagctggagaccgccatgggcatgatcatcgacgtgttcagcagatacagcggcagcgagggcagcacccagaccctgaccaagggcgagctgaaggtgctgatggagaaggagctgcccggcttcctgcagagcggcaaggacaaggacgccgtggacaagctgctgaaggacctggacgccaacggcgacgcccaggtggacttcagcgagttcatcgtgttcgtggccgccatcaccagcgcctgccacaagtacttcgagaaggccggcctgaagtag

SEQ ID NO: 97962 - DNA, 300 bp, Artificial Sequence
  Description of Artificial Sequence: Synthetic coding sequence
atgcccacccagctggagatggccatggacaccatgatcagaatcttccacagatacagcggcaaggagagaaagagattcaagctgagcaagggcgagctgaagctgctgctgcagagagagctgaccgagttcctgagctgccagaaggagacccagctggtggacaagatcgtgcaggacctggacgccaacaaggacaacgaggtggacttcaacgagttcgtggtgatggtggccgccctgaccgtggcctgcaacgactacttcgtggagcagctgaagaagaagggcaagtag

SEQ ID NO: 97963 - DNA, 300 bp, Artificial Sequence; identical to SEQ ID NO: 97962
  Description of Artificial Sequence: Synthetic coding sequence

SEQ ID NO: 97964 - DNA, 1029 bp, Artificial Sequence
  Description of Artificial Sequence: Synthetic coding sequence
atgatgtgcagcagagtgcccagcgagcagagcagcggcaccagcctgctgcccaaggacggcgcccccttcagctgggacagcctggacgaggacggcctggacgacagcctgctggagctgagcgagggcgaggaggacgacggcgacgtgaactacaccgaggaggagatcgacgccctgctgaaggaggacgaccccagctacgagcagagcagcggcgaggacgacggcggccacgtggagaagggcgagagaggcagccagatcctgctggacacccccagagagaagaacagcagctacagcctgggccccgtggccgagacccccgacctgttcaagctgccccagctgagcaccagcagcggccacggccccgcccacaccaagcccctgaacagaagaagcgtgctggagaagaacctgatcaaggtgaccgtggcccccttcaaccccaccgtgtgcgacgccctgctggacaaggacgagaccgacagcagcaaggacaccgagaagctgagcagcctgggcgaggagatgagagaggacggcctgagccccaacgagagcaagctgtgcaccgagagcgagggcatcagccccaacaacagcgcctggaacggcccccagctgagcagcagcaacaacaacttccagcagaccgtgagcgacaagaacatgcccgacagcgagaaccccaccagcgtgttcagcagaatcagcgaccacagcgagacccccaacatggagctgagctgcagaaacggcggcagccacaagagcagctgcgagatgagaagcctggtggtgagcaccagcagcaacaagcaggacgtgctgaacaaggacagcggcaagatgaagggccacgagagaagactgggcaaggtgatccccgtgctgcagaccaagaccagaaccaacgtgcccaccttcagccagagcaacctggagcagcagaagcagctgtacctgagaagcgtgatcgcccacatcgaggaccccgaggacaccaaccagggctag

SEQ ID NO: 97965 - DNA, 1227 bp, Artificial Sequence
  Description of Artificial Sequence: Synthetic coding sequence
atgatgtgcagcagagtgcccagcgagcagagcagcggcaccagcctgctgcccaaggacggcgcccccttcagctgggacagcctggacgaggacggcctggacgacagcctgctggagctgagcgagggcgaggaggacgacggcgacgtgaactacaccgaggaggagatcgacgccctgctgaaggaggacgaccccagctacgagcagagcagcggcgaggacgacggcggccacgtggagaagggcgagagaggcagccagatcctgctggacacccccagagagaagaacagcagctacagcctgggccccgtggccgagacccccgacctgttcaagctgccccagctgagcaccagcagcggccacggccccgcccacaccaagcccctgaacagaagaagcgtgctggagaagaacctgatcaaggtgaccgtggcccccttcaaccccaccgtgtgcgacgccctgctggacaaggacgagaccgacagcagcaaggacaccgagaagctgagcagcctgggcgaggagatgagagaggacggcctgagccccaacgagagcaagctgtgcaccgagagcgagggcatcagccccaacaacagcgcctggaacggcccccagctgagcagcagcaacaacaacttccagcagaccgtgagcgacaagaacatgcccgacagcgagaaccccaccagcgtgttcagcagaatcagcgaccacagcgagacccccaacatggagctgagctgcagaaacggcggcagccacaagagcagctgcgagatgagaagcctggtggtgagcaccagcagcaacaagcaggacgtgctgaacaaggacagcggcaagatgaagggccacgagagaagactgggcaaggtgatccccgtgctgcagaccaagaccagaaccaacgtgcccaccttcagccagagcaacctggagcagcagaagcagctgtacctgagaagcgtgatcgcccacatcgaggaccccgaggacaccaaccagggcatcagcggcgagctgtgcgccctgatggaccaggtgcaccacatgcagcacagcaagtggcagcaccccagcgacctgaccaccagaaactacgccagaagacagaagcacctgcagagatacagcctgacccagtgggtggacagaaacatgagaagccaccacagattccagagactgcccgacttcagctacagctag

SEQ ID NO: 97966 - DNA, 1227 bp, Artificial Sequence; identical to SEQ ID NO: 97965
  Description of Artificial Sequence: Synthetic coding sequence

SEQ ID NO: 97967 - DNA, 1026 bp, Artificial Sequence
  Description of Artificial Sequence: Synthetic coding sequence
atgatgtgcagcagagtgcccagcgagcagagcagcggcaccagcctgctgcccaaggacggcgcccccttcagctgggacagcctggacgaggacggcctggacgacagcctgctggagctgagcgagggcgaggaggacgacggcgacgtgaactacaccgaggaggagatcgacgccctgctgaaggaggacgaccccagctacgagcagagcagcggcgaggacgacggcggccacgtggagaagggcgagagaggcagccagatcctgctggacacccccagagagaagaacagcagctacagcctgggccccgtggccgagacccccgacctgttcaagctgccccagctgagcaccagcagcggccacggccccgcccacaccaagcccctgaacagaagaagcgtgctggagaagaacctgatcaaggtgaccgtggcccccttcaaccccaccgtgtgcgacgccctgctggacaaggacgagaccgacagcagcaaggacaccgagaagctgagcagcctgggcgaggagatgagagaggacggcctgagccccaacgagagcaagctgtgcaccgagagcgagggcatcagccccaacaacagcgcctggaacggcccccagctgagcagcagcaacaacaacttccagcagaccgtgagcgacaagaacatgcccgacagcgagaaccccaccagcgtgttcagcagaatcagcgaccacagcgagacccccaacatggagctgagctgcagaaacggcggcagccacaagagcagctgcgagatgagaagcctggtggtgagcaccagcagcaacaaggacgtgctgaacaaggacagcggcaagatgaagggccacgagagaagactgggcaaggtgatccccgtgctgcagaccaagaccagaaccaacgtgcccaccttcagccagagcaacctggagcagcagaagcagctgtacctgagaagcgtgatcgcccacatcgaggaccccgaggacaccaaccagggctag

SEQ ID NO: 97968 - DNA, 441 bp, Artificial Sequence
  Description of Artificial Sequence: Synthetic coding sequence
atgatgtgcagcagagtgcccagcgagcagagcagcggcaccagcctgctgcccaaggacggcgcccccttcagctgggacagcctggacgaggacggcctggacgacagcctgctggagctgagcgagggcgaggaggacgacggcgacgtgaactacaccgaggaggagatcgacgccctgctgaaggaggacgaccccagctacgagcagagcagcggcgaggacgacggcggccacgtggagaagggcgagagaggcagccagatcctgctggacacccccagagagaagaacagcagctacagcctgggccccgtggccgagacccccgacctgttcaagctgccccagctgagcaccagcagcggccacggccccgcccacaccaagcccctgaacagaagaagcgtgctggagaagaacctgatcaaggtgtag

SEQ ID NO: 97969 - DNA, 363 bp, Artificial Sequence
  Description of Artificial Sequence: Synthetic coding sequence
atgatgtgcagcagagtgcccagcgagcagagcagcggcaccagcctgctgcccaaggacggcgcccccttcagctgggacagcctggacgaggacggcctggacgacagcctgctggagctgagcgagggcgaggaggacgacggcgacgtgaactacaccgaggaggagatcgacgccctgctgaaggaggacgaccccagctacgagcagagcagcggcgaggacgacggcggccacgtggagaagggcgagagaggcagccagatcctgctggacacccccagagagaagaacagcagctacagcctgggccccgtggccgagacccccgacctgttcaagctgccccagctgagctag

SEQ ID NO: 97970 - DNA, 126 bp, Artificial Sequence
  Description of Artificial Sequence: Synthetic coding sequence
atgatgtgcagcagagtgcccagcgagcagagcagcggcaccagcctgctgcccaaggacggcgcccccttcagctgggacagcctggacgaggacggcctggacgacagcctgctggagctgtag

SEQ ID NO: 97971 - DNA, 18 bp, Artificial Sequence
  Description of Artificial Sequence: Synthetic coding sequence
atgatgtgcagcagatag

SEQ ID NO: 97972 - DNA, 393 bp, Artificial Sequence
  Description of Artificial Sequence: Synthetic coding sequence
atgatgtgcagcagagtgcccagcgagcagagcagcggcaccagcctgctgcccaaggacggcgcccccttcagctgggacagcctggacgaggacggcctggacgacagcctgctggagctgagcgagggcgaggaggacgacggcgacgtgaactacaccgaggaggagatcgacgccctgctgaaggaggacgaccccagctacgagcagagcagcggcgaggacgacggcggccacgtggagaagggcgagagaggcagccagatcctgctggacacccccagagagaagaacagcagctacagcctgggccccgtggccgagacccccgacctgttcaagctgccccagctgagcaccagcagcggccacggccccgcccacacctag

SEQ ID NO: 97973 - DNA, 1026 bp, Artificial Sequence; identical to SEQ ID NO: 97967
  Description of Artificial Sequence: Synthetic coding sequence

SEQ ID NO: 97974 - DNA, 516 bp, Artificial Sequence
  Description of Artificial Sequence: Synthetic coding sequence
atgatgtgcagcagagtgcccagcgagcagagcagcggcaccagcctgctgcccaaggacggcgcccccttcagctgggacagcctggacgaggacggcctggacgacagcctgctggagctgagcgagggcgaggaggacgacggcgacgtgaactacaccgaggaggagatcgacgccctgctgaaggaggacgaccccagctacgagcagagcagcggcgaggacgacggcggccacgtggagaagggcgagagaggcagccagatcctgctggacacccccagagagaagaacagcagctacagcctgggccccgtggccgagacccccgacctgttcaagctgccccagctgagcaccagcagcggccacggccccgcccacaccaagcccctgaacagaagaagcgtgctggagaagaacctgatcaaggtgaccgtggcccccttcaaccccaccgtgtgcgacgccctgctggacaaggacgagaccgacagcagcaaggacacctag

SEQ ID NO: 97975 - DNA, 1764 bp, Artificial Sequence
  Description of Artificial Sequence: Synthetic coding sequence
atggccaccgccgcctacgagcagctgaagctgcacatcacccccgagaagttctacgtggaggcctgcgacgacggcgccgacgacgtgctgaccatcgacagagtgagcaccgaggtgaccctggccgtgaagaaggacgtgccccccagcgccgtgaccagacccatcttcggcatcctgggcaccatccacctggtggccggcaactacctgatcgtgatcaccaagaagatcaaggtgggcgagttcttcagccacgtggtgtggaaggccaccgacttcgacgtgctgagctacaagaagaccatgctgcacctgaccgacatccagctgcaggacaacaagaccttcctggccatgctgaaccacgtgctgaacgtggacggcttctacttcagcaccacctacgacctgacccacaccctgcagagactgagcaacaccagccccgagttccaggagatgagcctgctggagagagccgaccagagattcgtgtggaacggccacctgctgagagagctgagcgcccagcccgaggtgcacagattcgccctgcccgtgctgcacggcttcatcaccatgcacagctgcagcatcaacggcaagtacttcgactggatcctgatcagcagaagaagctgcttcagagccggcgtgagatactacgtgagaggcatcgacagcgagggccacgccgccaacttcgtggagaccgagcagatcgtgcactacaacggcagcaaggccagcttcgtgcagaccagaggcagcatccccgtgttctggagccagagacccaacctgaagtacaagcccctgccccagatcagcaaggtggccaaccacatggacggcttccagagacacttcgacagccaggtgatcatctacggcaagcaggtgatcatcaacctgatcaaccagaagggcagcgagaagcccctggagcagaccttcgccaccatggtgagcagcctgggcagcggcatgatgagatacatcgccttcgacttccacaaggagtgcaagaacatgagatgggacagactgagcatcctgctggaccaggtggccgagatgcaggacgagctgagctacttcctggtggacagcgccggccaggtggtggccaaccaggagggcgtgttcagaagcaactgcatggactgcctggacagaaccaacgtgatccagagcctgctggccagaagaagcctgcaggcccagctgcagagactgggcgtgctgcacgtgggccagaagctggaggagcaggacgagttcgagaagatctacaagaacgcctgggccgacaacgccaacgcctgcgccaagcagtacgccggcaccggcgccctgaagaccgacttcaccagaaccggcaagagaacccacctgggcctgatcatggacggctggaacagcatgatcagatactacaagaacaacttcagcgacggcttcagacaggacagcatcgacctgttcctgggcaactacagcgtggacgagctggagagccacagccccctgagcgtgcccagagactggaagttcctggccctgcccatcatcatggtggtggccttcagcatgtgcatcatctgcctgctgatggccggcgacacctggaccgagaccctggcctacgtgctgttctggggcgtggccagcatcggcaccttcttcatcatcctgtacaacggcaaggacttcgtggacgcccccagactggtgcagaaggagaagatcgactag

SEQ ID NO: 97976 - DNA, 1581 bp, Artificial Sequence
  Description of Artificial Sequence: Synthetic coding sequence
atgtggaagctggtgatgatggagcagatgacctacctgcccctgaccgtgtgcccccagagactgcccctgcagagcagaaagatgttcctgctgcagctgagccaggaccagtacctggtgtactgggcccagagcatctggtggcagctgcaggacaacaagaccttcctggccatgctgaaccacgtgctgaacgtggacggcttctacttcagcaccacctacgacctgacccacaccctgcagagactgagcaacaccagccccgagttccaggagatgagcctgctggagagagccgaccagagattcgtgtggaacggccacctgctgagagagctgagcgcccagcccgaggtgcacagattcgccctgcccgtgctgcacggcttcatcaccatgcacagctgcagcatcaacggcaagtacttcgactggatcctgatcagcagaagaagctgcttcagagccggcgtgagatactacgtgagaggcatcgacagcgagggccacgccgccaacttcgtggagaccgagcagatcgtgcactacaacggcagcaaggccagcttcgtgcagaccagaggcagcatccccgtgttctggagccagagacccaacctgaagtacaagcccctgccccagatcagcaaggtggccaaccacatggacggcttccagagacacttcgacagccaggtgatcatctacggcaagcaggtgatcatcaacctgatcaaccagaagggcagcgagaagcccctggagcagaccttcgccaccatggtgagcagcctgggcagcggcatgatgagatacatcgccttcgacttccacaaggagtgcaagaacatgagatgggacagactgagcatcctgctggaccaggtggccgagatgcaggacgagctgagctacttcctggtggacagcgccggccaggtggtggccaaccaggagggcgtgttcagaagcaactgcatggactgcctggacagaaccaacgtgatccagagcctgctggccagaagaagcctgcaggcccagctgcagagactgggcgtgctgcacgtgggccagaagctggaggagcaggacgagttcgagaagatctacaagaacgcctgggccgacaacgccaacgcctgcgccaagcagtacgccggcaccggcgccctgaagaccgacttcaccagaaccggcaagagaacccacctgggcctgatcatggacggctggaacagcatgatcagatactacaagaacaacttcagcgacggcttcagacaggacagcatcgacctgttcctgggcaactacagcgtggacgagctggagagccacagccccctgagcgtgcccagagactggaagttcctggccctgcccatcatcatggtggtggccttcagcatgtgcatcatctgcctgctgatggccggcgacacctggaccgagaccctggcctacgtgctgttctggggcgtggccagcatcggcaccttcttcatcatcctgtacaacggcaaggacttcgtggacgcccccagactggtgcagaaggagaagatcgactag

SEQ ID NO: 97977 - DNA, 2901 bp, Artificial Sequence
  Description of Artificial Sequence: Synthetic coding sequence
atgttctggaagttcgacctgaacaccaccagccacgtggacaagctgctggacaaggagcacgtgaccctgcaggagctgatggacgaggacgacatcctgcaggagtgcaaggcccagaaccagaagctgctggacttcctgtgcagacagcagtgcatggaggagctggtgagcctgatcacccaggacccccccctggacatggaggagaaggtgagattcaagtaccccaacaccgcctgcgagctgctgacctgcgacgtgccccagatcagcgacagactgggcggcgacgagagcctgctgagcctgctgtacgacttcctggaccacgagccccccctgaaccccctgctggccagcttcttcagcaagaccatcggcaacctgatcgccagaaagaccgagcaggtgatcaccttcctgaagaagaaggacaagttcatcagcctggtgctgaagcacatcggcaccagcgccctgatggacctgctgctgagactggtgagctgcgtggagcccgccggcctgagacaggacgtgctgcactggctgaacgaggagaaggtgatccagagactggtggagctgatccaccccagccaggacgaggacagacagagcaacgccagccagaccctgtgcgacatcgtgagactgggcagagaccagggcagccagctgcaggaggccctggagcccgaccccctgctgaccgccctggagagccaggactgcgtggagcagctgctgaagaacatgttcgacggcgacagaaccgagagctgcctggtgagcggcacccaggtgctgctgaccctgctggagaccagaagagtgggcaccgagggcctggtggacagcttcagccagggcctggagagaagctacgccgtgagcagcagcgtgctgcacggcatcgagcccagactgaaggacttccaccagctgctgctgaacccccccaagaagaaggccatcctgaccaccatcggcgtgctggaggagcccctgggcaacgccagactgcacggcgccagactgatggccgccctgctgcacaccaacacccccagcatcaaccaggagctgtgcagactgaacaccatggacctgctgctggacctgttcttcaagtacacctggaacaacttcctgcacttccaggtggagctgtgcatcgccgccatcctgagccacgccgccagagaggagagaaccgaggccagcggcagcgagagcagagtggagcccccccacgagaacggcaacagaagcctggagaccccccagcccgccgccagcctgcccgacaacaccatggtgacccacctgttccagaagtgctgcctggtgcagagaatcctggaggcctgggaggccaacgaccacacccaggccgccggcggcatgagaagaggcaacatgggccacctgaccagaatcgccaacgccgtggtgcagaacctggagagaggccccgtgcagacccacatcagcgaggtgatcagaggcctgcccgccgactgcagaggcagatgggagagcttcgtggaggagaccctgaccgagaccaacagaagaaacaccgtggacctggtgagcacccaccacctgcacagcagcagcgaggacgaggacatcgagggcgccttccccaacgagctgagcctgcagcaggccttcagcgactaccagatccagcagatgaccgccaacttcgtggaccagttcggcttcaacgacgaggagttcgccgaccaggacgacaacatcaacgcccccttcgacagaatcgccgagatcaacttcaacatcgacgccgacgaggacagccccagcgccgccctgttcgaggcctgctgcagcgacagaatccagcccttcgacgacgacgaggacgaggacatctgggaggacagcgacaccagatgcgccgccagagtgatggccagacccagattcggcgccccccacgccagcgagagctgcagcaagaacggccccgagagaggcggccaggacggcaaggccagcctggaggcccacagagacgcccccggcgccggcgccccccccgcccccggcaagaaggaggccccccccgtggagggcgacagcgagggcgccatgtggaccgccgtgttcgacgagcccgccaacagcacccccaccgcccccggcgtggtgagagacgtgggcagcagcgtgtgggccgccggcaccagcgcccccgaggagaagggctgggccaagttcaccgacttccagcccttctgctgcagcgagagcggccccagatgcagcagccccgtggacaccgagtgcagccacgccgagggcagcagaagccagggccccgagaaggccagccaggccagctacttcgccgtgagccccgccagcccctgcgcctggaacgtgtgcgtgaccagaaaggcccccctgctggccagcgacagcagcagcagcggcggcagccacagcgaggacggcgaccagaaggccgccagcgccatggacgccgtgagcagaggccccggcagagaggccccccccctgcccaccgtggccagaaccgaggaggccgtgggcagagtgggctgcgccgacagcagactgctgagccccgcctgccccgcccccaaggaggtgaccgccgcccccgccgtggccgtgccccccgaggccaccgtggccatcaccaccgccctgagcaaggccggccccgccatccccacccccgccgtgagcagcgccctggccgtggccgtgcccctgggccccatcatggccgtgaccgccgcccccgccatggtggccaccctgggcaccgtgaccaaggacggcaagaccgacgccccccccgagggcgccgccctgaacggccccgtgtag

SEQ ID NO: 97978 - DNA, 2217 bp, Artificial Sequence
  Description of Artificial Sequence: Synthetic coding sequence
atgagcagaagaagccagagactgaccagatacagccagggcgacgacgacggcagcagcagcagcggcggcagcagcgtggccggcagccagagcaccctgttcaaggacagccccctgagaaccctgaagagaaagagcagcaacatgaagagactgagccccgccccccagctgggccccagcagcgacgcccacaccagctactacagcgagagcctggtgcacgagagctggttcccccccagaagcagcctggaggagctgcacggcgacgccaactggggcgaggacctgagagtgagaagaagaagaggcaccggcggcagcgagagcagcagagccagcggcctggtgggcagaaaggccaccgaggacttcctgggcagcagcagcggctacagcagcgaggacgactacgtggaggacagcgagggcagaggcagcaaggtgaccgagaccgagcccgtgagcagcttccccgccggctacagcgacgtggaccagcagagcagcagcagcagactgagaagcgccgtgagcagagccggcagcctgctgtggatggtggccaccagccccggcagactgttcagactgctgtactggtgggccggcaccacctggtacagactgaccaccgccgccagcctgctggacgtgttcgtgctgaccagaagattcagcagcctgaagaccttcctgtggttcctgctgcccctgctgctgctgacctgcctgacctacggcgcctggtacttctacccctacggcctgcagaccttccaccccgccctggtgagctggtgggccgccaaggacagcagaagacccgacgagggctgggaggccagagacagcagcccccacttccaggccgagcagagagtgatgagcagagtgcacagcctggagagaagactggaggccctggccgccgagttcagcagcaactggcagaaggaggccatgagactggagagactggagctgagacagggcgcccccggccagggcggcggcggcggcctgagccacgaggacaccctggccctgctggagggcctggtgagcagaagagaggccgccctgaaggaggacttcagaagagagaccgccgccagaatccaggaggagctgagcgccctgagagccgagcaccagcaggacagcgaggacctgttcaagaagatcgtgagagccagccaggagagcgaggccagaatccagcagctgaagagcgagtggcagagcatgacccaggagagcttccaggagagcagcgtgaaggagctgagaagactggaggaccagctggccggcctgcagcaggagctggccgccctggccctgaagcagagcagcgtggccgaggaggtgggcctgctgccccagcagatccaggccgtgagagacgacgtggagagccagttccccgcctggatcagccagttcctggccagaggcggcggcggcagagtgggcctgctgcagagagaggagatgcaggcccagctgagagagctggagagcaagatcctgacccacgtggccgagatgcagggcaagagcgccagagaggccgccgccagcctgagcctgaccctgcagaaggagggcgtgatcggcgtgaccgaggagcaggtgcaccacatcgtgaagcaggccctgcagagatacagcgaggacagaatcggcctggccgactacgccctggagagcggcggcgccagcgtgatcagcaccagatgcagcgagacctacgagaccaagaccgccctgctgagcctgttcggcatccccctgtggtaccacagccagagccccagagtgatcctgcagcccgacgtgcaccccggcaactgctgggccttccagggcccccagggcttcgccgtggtgagactgagcgccagaatcagacccaccgccgtgaccctggagcacgtgcccaaggccctgagccccaacagcaccatcagcagcgcccccaaggacttcgccatcttcggcttcgacgaggacctgcagcaggagggcaccctgctgggcaagttcacctacgaccaggacggcgagcccatccagaccttccacttccaggcccccaccatggccacctaccaggtggtggagctgagaatcctgaccaactggggccaccccgagtacacctgcatctacagattcagagtgcacggcgagcccgcccactag

SEQ ID NO: 97979 - DNA, 2154 bp, Artificial Sequence
  Description of Artificial Sequence: Synthetic coding sequence
atgagcagaagaagccagagactgaccagatacagccagggcgacgacgacggcagcagcagcagcggcggcagcagcgtggccggcagccagagcaccctgttcaaggacagccccctgagaaccctgaagagaaagagcagcaacatgaagagactgagccccgccccccagctgggccccagcagcgacgcccacaccagctactacagcgagagcctggtgcacgagagctggttcccccccagaagcagcctggaggagctgcacggcgacgccaactggggcgaggacctgagagtgagaagaagaagaggcaccggcggcagcgagagcagcagagccagcggcctggtgggcagaaaggccaccgaggacttcctgggcagcagcagcggctacagcagcgaggacgactacgtgggctacagcgacgtggaccagcagagcagcagcagcagactgagaagcgccgtgagcagagccggcagcctgctgtggatggtggccaccagccccggcagactgttcagactgctgtactggtgggccggcaccacctggtacagactgaccaccgccgccagcctgctggacgtgttcgtgctgaccagaagattcagcagcctgaagaccttcctgtggttcctgctgcccctgctgctgctgacctgcctgacctacggcgcctggtacttctacccctacggcctgcagaccttccaccccgccctggtgagctggtgggccgccaaggacagcagaagacccgacgagggctgggaggccagagacagcagcccccacttccaggccgagcagagagtgatgagcagagtgcacagcctggagagaagactggaggccctggccgccgagttcagcagcaactggcagaaggaggccatgagactggagagactggagctgagacagggcgcccccggccagggcggcggcggcggcctgagccacgaggacaccctggccctgctggagggcctggtgagcagaagagaggccgccctgaaggaggacttcagaagagagaccgccgccagaatccaggaggagctgagcgccctgagagccgagcaccagcaggacagcgaggacctgttcaagaagatcgtgagagccagccaggagagcgaggccagaatccagcagctgaagagcgagtggcagagcatgacccaggagagcttccaggagagcagcgtgaaggagctgagaagactggaggaccagctggccggcctgcagcaggagctggccgccctggccctgaagcagagcagcgtggccgaggaggtgggcctgctgccccagcagatccaggccgtgagagacgacgtggagagccagttccccgcctggatcagccagttcctggccagaggcggcggcggcagagtgggcctgctgcagagagaggagatgcaggcccagctgagagagctggagagcaagatcctgacccacgtggccgagatgcagggcaagagcgccagagaggccgccgccagcctgagcctgaccctgcagaaggagggcgtgatcggcgtgaccgaggagcaggtgcaccacatcgtgaagcaggccctgcagagatacagcgaggacagaatcggcctggccgactacgccctggagagcggcggcgccagcgtgatcagcaccagatgcagcgagacctacgagaccaagaccgccctgctgagcctgttcggcatccccctgtggtaccacagccagagccccagagtgatcctgcagcccgacgtgcaccccggcaactgctgggccttccagggcccccagggcttcgccgtggtgagactgagcgccagaatcagacccaccgccgtgaccctggagcacgtgcccaaggccctgagccccaacagcaccatcagcagcgcccccaaggacttcgccatcttcggcttcgacgaggacctgcagcaggagggcaccctgctgggcaagttcacctacgaccaggacggcgagcccatccagaccttccacttccaggcccccaccatggccacctaccaggtggtggagctgagaatcctgaccaactggggccaccccgagtacacctgcatctacagattcagagtgcacggcgagcccgcccactag

SEQ ID NO: 97980 - DNA, 2154 bp, Artificial Sequence; identical to SEQ ID NO: 97979
  Description of Artificial Sequence: Synthetic coding sequence

SEQ ID NO: 97981 - DNA, 2121 bp, Artificial Sequence
  Description of Artificial Sequence: Synthetic coding sequence
atggtgagcccccccagcgccggccagagactgagaggcgtgcccgtgtgggccgccggcgccttcagattcagcagcggcgaggagagcaccagccacctgatcatgagcagaagaagccagagactgaccagatacagccagggcgacgacgacggcagcagcagcagcggcggcagcagcgtggccggcagccagagcaccctgttcaaggacagccccctgagaaccctgaagagaaagagcagcaacatgaagagactgagccccgccccccagctgggccccagcagcgacgcccacaccagctactacagcgagagcctggtgcacgagagctggttcccccccagaagcagcctggaggagctgcacggcgacgccaactggggctacagcgacgtggaccagcagagcagcagcagcagactgagaagcgccgtgagcagagccggcagcctgctgtggatggtggccaccagccccggcagactgttcagactgctgtactggtgggccggcaccacctggtacagactgaccaccgccgccagcctgctggacgtgttcgtgctgaccagaagattcagcagcctgaagaccttcctgtggttcctgctgcccctgctgctgctgacctgcctgacctacggcgcctggtacttctacccctacggcctgcagaccttccaccccgccctggtgagctggtgggccgccaaggacagcagaagacccgacgagggctgggaggccagagacagcagcccccacttccaggccgagcagagagtgatgagcagagtgcacagcctggagagaagactggaggccctggccgccgagttcagcagcaactggcagaaggaggccatgagactggagagactggagctgagacagggcgcccccggccagggcggcggcggcggcctgagccacgaggacaccctggccctgctggagggcctggtgagcagaagagaggccgccctgaaggaggacttcagaagagagaccgccgccagaatccaggaggagctgagcgccctgagagccgagcaccagcaggacagcgaggacctgttcaagaagatcgtgagagccagccaggagagcgaggccagaatccagcagctgaagagcgagtggcagagcatgacccaggagagcttccaggagagcagcgtgaaggagctgagaagactggaggaccagctggccggcctgcagcaggagctggccgccctggccctgaagcagagcagcgtggccgaggaggtgggcctgctgccccagcagatccaggccgtgagagacgacgtggagagccagttccccgcctggatcagccagttcctggccagaggcggcggcggcagagtgggcctgctgcagagagaggagatgcaggcccagctgagagagctggagagcaagatcctgacccacgtggccgagatgcagggcaagagcgccagagaggccgccgccagcctgagcctgaccctgcagaaggagggcgtgatcggcgtgaccgaggagcaggtgcaccacatcgtgaagcaggccctgcagagatacagcgaggacagaatcggcctggccgactacgccctggagagcggcggcgccagcgtgatcagcaccagatgcagcgagacctacgagaccaagaccgccctgctgagcctgttcggcatccccctgtggtaccacagccagagccccagagtgatcctgcagcccgacgtgcaccccggcaactgctgggccttccagggcccccagggcttcgccgtggtgagactgagcgccagaatcagacccaccgccgtgaccctggagcacgtgcccaaggccctgagccccaacagcaccatcagcagcgcccccaaggacttcgccatcttcggcttcgacgaggacctgcagcaggagggcaccctgctgggcaagttcacctacgaccaggacggcgagcccatccagaccttccacttccaggcccccaccatggccacctaccaggtggtggagctgagaatcctgaccaactggggccaccccgagtacacctgcatctacagattcagagtgcacggcgagcccgcccactag

SEQ ID NO: 97982 - DNA, 375 bp, Artificial Sequence
  Description of Artificial Sequence: Synthetic coding sequence
atgagcagaagaagccagagactgaccagatacagccagggcgacgacgacggcagcagcagcagcggcggcagcagcgtggccggcagccagagcaccctgttcaaggacagccccctgagaaccctgaagagaaagagcagcaacatgaagagactgagccccgccccccagctgggccccagcagcgacgcccacaccagctactacagcgagagcctggtgcacgagagctggttcccccccagaagcagcctggaggagctgcacggcgacgccaactgggaccccaccttccagaagctgctggaggcccagaagagcccctggttcttccccgcccaggtgagaacctgcggctgcggcggcggctag

SEQ ID NO: 97983 - DNA, 384 bp, Artificial Sequence
  Description of Artificial Sequence: Synthetic coding sequence
atgagcagaagaagccagagactgaccagatacagccagggcgacgacgacggcagcagcagcagcggcggcagcagcgtggccggcagccagagcaccctgttcaaggacagccccctgagaaccctgaagagaaagagcagcaacatgaagagactgagccccgccccccagctgggccccagcagcgacgcccacaccagctactacagcgagagcctggtgcacgagagctggttcccccccagaagcagcctggaggagctgcacggcgacgccaactggggctacagcgacgtggaccagcagagcagcagcagcagactgagaagcgccgtgagcagagccggcagcctgctgtggatggtggccaccagcccctag

SEQ ID NO: 97984 - DNA, 333 bp, Artificial Sequence
  Description of Artificial Sequence: Synthetic coding sequence
atgagcagaagaagccagagactgaccagatacagccagggcgacgacgacggcagcagcagcagcggcggcagcagcgtggccggcagccagagcaccctgttcaaggacagccccctgagaaccctgaagagaaagagcagcaacatgaagagactgagccccgccccccagctgggccccagcagcgacgcccacaccagctactacagcgagagcctggtgcacgagagctggttcccccccagaagcagcctggaggagctgcacggcgacgccaactggggcgaggacctgagagtgagaagaagaagaggcaccggcggcagctag

SEQ ID NO: 97985 - DNA, 675 bp, Artificial Sequence
  Description of Artificial Sequence: Synthetic coding sequence
atgagcagaagaagccagagactgaccagatacagccagggcgacgacgacggcagcagcagcagcggcggcagcagcgtggccggcagccagagcaccctgttcaaggacagccccctgagaaccctgaagagaaagagcagcaacatgaagagactgagccccgccccccagctgggccccagcagcgacgcccacaccagctactacagcgagagcctggtgcacgagagctggttcccccccagaagcagcctggaggagctgcacggcgacgccaactggggctacagcgacgtggaccagcagagcagcagcagcagactgagaagcgccgtgagcagagccggcagcctgctgtggatggtggccaccagccccggcagactgttcagactgctgtactggtgggccggcaccacctggtacagactgaccaccgccgccagcctgctggacgtgttcgtgctgaccagaagattcagcagcctgaagaccttcctgtggttcctgctgcccctgctgctgctgacctgcctgacctacggcgcctggtacttctacccctacggcctgcagaccttccaccccgccctggtgagctggtgggccgccaaggacagcagaagacccgacgagggctgggaggccagagacagcagcccccacttctag

SEQ ID NO: 97986 - DNA, 306 bp, Artificial Sequence
  Description of Artificial Sequence: Synthetic coding sequence
atgagcagaagaagccagagactgaccagatacagccagggcgacgacgacggcagcagcagcagcggcggcagcagcgtggccggcagccagagcaccctgttcaaggacagccccctgagaaccctgaagagaaagagcagcaacatgaagagactgagccccgccccccagctgggccccagcagcgacgcccacaccagctactacagcgagagcctggtgcacgagagctggttcccccccagaagcagcctggaggagctgcacggcgacgccaactggggcgaggacctgagagtgtag

SEQ ID NO: 97987 - DNA, 435 bp, Artificial Sequence
  Description of Artificial Sequence: Synthetic coding sequence
atgagcagaagaagccagagactgaccagatacagccagggcgacgacgacggcagcagcagcagcggcggcagcagcgtggccggcagccagagcaccctgttcaaggacagccccctgagaaccctgaagagaaagagcagcaacatgaagagactgagccccgccccccagctgggccccagcagcgacgcccacaccagctactacagcgagagcctggtgcacgagagctggttcccccccagaagcagcctggaggagctgcacggcgacgccaactggggcgaggacctgagagtgagaagaagaagaggcaccggcggcagcgagagcagcagagccagcggcctggtgggcagaaaggccaccgaggacttcctgggcagcagcagcggctacagcagcgaggacgactacgtgggcagaagatag

SEQ ID NO: 97988 - DNA, 618 bp, Artificial Sequence
  Description of Artificial Sequence: Synthetic coding sequence
atgagcagaagaagccagagactgaccagatacagccagggcgacgacgacggcagcagcagcagcggcggcagcagcgtggccggcagccagagcaccctgttcaaggacagccccctgagaaccctgaagagaaagagcagcaacatgaagagactgagccccgccccccagctgggccccagcagcgacgcccacaccagctactacagcgagagcctggtgcacgagagctggttcccccccagaagcagcctggaggagctgcacggcgacgccaactggggcgaggacctgagagtgagaagaagaagaggcaccggcggcagcgagagcagcagagccagcggcctggtgggcagaaaggccaccgaggacttcctgggcagcagcagcggctacagcagcgaggacgactacgtgggctacagcgacgtggaccagcagagcagcagcagcagactgagaagcgccgtgagcagagccggcagcctgctgtggatggtggccaccagccccggcagactgttcagactgctgtactggtgggccggcaccacctggtacagactgaccaccgccgccagcctgctggacgtgttcgtgctgaccagatag

SEQ ID NO: 97989 - DNA, 1140 bp, Artificial Sequence
  Description of Artificial Sequence: Synthetic coding sequence
atgcccagaagcagcagaagccccggcgaccccggcgccctgctggaggacgtggcccacaaccccagacccagaagaatcgcccagagaggcagaaacaccagcagaatggccgaggacaccagccccaacatgaacgacaacatcctgctgcccgtgagaaacaacgaccaggccctgggcctgacccagtgcatgctgggctgcgtgagctggttcacctgcttcgcctgcagcctgagaacccaggcccagcaggtgctgttcaacacctgcagatgcaagctgctgtgccagaagctgatggagaagaccggcatcctgctgctgtgcgccttcggcttctggatgttcagcatccacctgcccagcaagatgaaggtgtggcaggacgacagcatcaacggccccctgcagagcctgagactgtaccaggagaaggtgagacaccacagcggcgagatccaggacctgagaggcagcatgaaccagctgatcgccaagctgcaggagatggaggccatgagcgacgagcagaagatggcccagaagatcatgaagatgatccacggcgactacatcgagaagcccgacttcgccctgaagagcatcggcgccagcatcgacttcgagcacaccagcgtgacctacaaccacgagaaggcccacagctactggaactggatccagctgtggaactacgcccagccccccgacgtgatcctggagcccaacgtgacccccggcaactgctgggccttcgagggcgacagaggccaggtgaccatccagctggcccagaaggtgtacctgagcaacctgaccctgcagcacatccccaagaccatcagcctgagcggcagcctggacaccgcccccaaggacttcgtgatctacggcatggagggcagccccaaggaggaggtgttcctgggcgccttccagttccagcccgagaacatcatccagatgttccccctgcagaaccagcccgccagagccttcagcgccgtgaaggtgaagatcagcagcaactggggcaaccccggcttcacctgcctgtacagagtgagagtgcacggcagcgtggccccccccagagagcagccccaccagaacccctaccccaagagagactag

SEQ ID NO: 97990 - DNA, 369 bp, Artificial Sequence
  Description of Artificial Sequence: Synthetic coding sequence
atgcccagaagcagcagaagccccggcgaccccggcgccctgctggaggacgtggcccacaaccccagacccagaagaatcgcccagagaggcagaaacaccagcagaatggccgaggacaccagccccaacatgaacgacaacatcctgctgcccgtgagaaacaacgaccaggccctgggcctgacccagtgcatgctgggctgcgtgtacgccagctgctgcgccagaagcagctggagaagacaggccttctgcagcagcgtgctgagcgtgtgccccagagccctgcccagccccagatggagatacccctgggccctggccctgatcatcggccactgggccagacactgcaccgccacctag

SEQ ID NO: 97991 - DNA, 1065 bp, Artificial Sequence
  Description of Artificial Sequence: Synthetic coding sequence
atgcccagaagcagcagaagccccggcgaccccggcgccctgctggaggacgtggcccacaaccccagacccagaagaatcgcccagagaggcagaaacaccagcagaatggccgaggacaccagccccaacatgacctggttcacctgcttcgcctgcagcctgagaacccaggcccagcaggtgctgttcaacacctgcagatgcaagctgctgtgccagaagctgatggagaagaccggcatcctgctgctgtgcgccttcggcttctggatgttcagcatccacctgcccagcaagatgaaggtgtggcaggacgacagcatcaacggccccctgcagagcctgagactgtaccaggagaaggtgagacaccacagcggcgagatccaggacctgagaggcagcatgaaccagctgatcgccaagctgcaggagatggaggccatgagcgacgagcagaagatggcccagaagatcatgaagatgatccacggcgactacatcgagaagcccgacttcgccctgaagagcatcggcgccagcatcgacttcgagcacaccagcgtgacctacaaccacgagaaggcccacagctactggaactggatccagctgtggaactacgcccagccccccgacgtgatcctggagcccaacgtgacccccggcaactgctgggccttcgagggcgacagaggccaggtgaccatccagctggcccagaaggtgtacctgagcaacctgaccctgcagcacatccccaagaccatcagcctgagcggcagcctggacaccgcccccaaggacttcgtgatctacggcatggagggcagccccaaggaggaggtgttcctgggcgccttccagttccagcccgagaacatcatccagatgttccccctgcagaaccagcccgccagagccttcagcgccgtgaaggtgaagatcagcagcaactggggcaaccccggcttcacctgcctgtacagagtgagagtgcacggcagcgtggccccccccagagagcagccccaccagaacccctaccccaagagagactag

SEQ ID NO: 97992 - DNA, 459 bp, Artificial Sequence
  Description of Artificial Sequence: Synthetic coding sequence
ggcgccctgctggaggacgtggcccacaaccccagacccagaagaatcgcccagagaggcagaaacaccagcagaatggccgaggacaccagccccaacatgaacgacaacatcctgctgcccgtgagaaacaacgaccaggccctgggcctgacccagtgcatgctgggctgcgtgagctggttcacctgcttcgcctgcagcctgagaacccaggcccagcaggtgctgttcaacacctgcagatgcaagctgctgtgccagaagctgatggagaagaccggcatcctgctgctgtgcgccttcggcgtgagccagggccccgcccagagccaggtggaggtgagcctgggccccggcaccgactacagaaccctgggcaagaccctgcactgccacgtgacccagttcccccacctgcccgacggctgctgctgcgagaactacgagatgaagtag

SEQ ID NO: 97993 - DNA, 387 bp, Artificial Sequence
  Description of Artificial Sequence: Synthetic coding sequence
atgagcgagggcggcggccaggtgagctgcatcttcgccgcccccaccagactgtgcagatggcccgccctgatcgagtgcggcgtgaacctgacccagcccctgtgcgagtggatgatccaggtggccagagacagaaccctgagcctggcctgggaggtggccagcctgctgaccctgagcagcagcgaggtgggcctggagggcgtgggcaccatctggcccagcagctacagcagcgaggagagcagcagaaacggcgccgagcagggcagacagctgagcatcgagggccccttccagggccagaactgccccagccaccccgccgccgccctgcccctgcccatgagaggcgagagccaggccaccagctgccaggtgtag

SEQ ID NO: 97994 - DNA, 3975 bp, Artificial Sequence
  Description of Artificial Sequence: Synthetic coding sequence
atgagcagaagaaagcaggccaagccccagcacttccagagcgaccccgaggtggccagcctgcccagaagagacggcgacaccgagaagggccagcccagcagacccaccaagagcaaggacgcccacgtgtgcggcagatgctgcgccgagttcttcgagctgagcgacctgctgctgcacaagaagaactgcaccaagaaccagctggtgctgatcgtgaacgagaaccccgccagcccccccgagaccttcagccccagccccccccccgacaaccccgacgagcagatgaacgacaccgtgaacaagaccgaccaggtggactgcagcgacctgagcgagcacaacggcctggacagagaggagagcatggaggtggaggcccccgtggccaacaagagcggcagcggcaccagcagcggcagccacagcagcaccgcccccagcagcagcagcagcagcagcagcagcagcggcggcggcggcagcagcagcaccggcaccagcgccatcaccaccagcctgccccagctgggcgacctgaccaccctgggcaacttcagcgtgatcaacagcaacgtgatcatcgagaacctgcagagcaccaaggtggccgtggcccagttcagccaggaggccagatgcggcggcgccagcggcggcaagctggccgtgcccgccctgatggagcagctgctggccctgcagcagcagcagatccaccagctgcagctgatcgagcagatcagacaccagatcctgctgctggccagccagaacgccgacctgcccaccagcagcagccccagccagggcaccctgagaaccagcgccaaccccctgagcaccctgagcagccacctgagccagcagctggccgccgccgccggcctggcccagagcctggccagccagagcgccagcatcagcggcgtgaagcagctgccccccatccagctgccccagagcagcagcggcaacaccatcatccccagcaacagcggcagcagccccaacatgaacatcctggccgccgccgtgaccacccccagcagcgagaaggtggccagcagcgccggcgccagccacgtgagcaaccccgccgtgagcagcagcagcagccccgccttcgccatcagcagcctgctgagccccgccagcaaccccctgctgccccagcaggccagcgccaacagcgtgttccccagccccctgcccaacatcggcaccaccgccgaggacctgaacagcctgagcgccctggcccagcagagaaagagcaagccccccaacgtgaccgccttcgaggccaagagcaccagcgacgaggccttcttcaagcacaagtgcagattctgcgccaaggtgttcggcagcgacagcgccctgcagatccacctgagaagccacaccggcgagagacccttcaagtgcaacatctgcggcaacagattcagcaccaagggcaacctgaaggtgcacttccagagacacaaggagaagtacccccacatccagatgaacccctaccccgtgcccgagcacctggacaacatccccaccagcaccggcatcccctacggcatgagcatcccccccgagaagcccgtgaccagctggctggacaccaagcccgtgctgcccaccctgaccaccagcgtgggcctgcccctgccccccaccctgcccagcctgatccccttcatcaagaccgaggagcccgcccccatccccatcagccacagcgccaccagcccccccggcagcgtgaagagcgacagcggcggccccgagagcgccaccagaaacctgggcggcctgcccgaggaggccgagggcagcaccctgccccccagcggcggcaagagcgaggagagcggcatggtgaccaacagcgtgcccaccgccagcagcagcgtgctgagcagccccgccgccgactgcggccccgccggcagcgccaccaccttcaccaaccccctgctgcccctgatgagcgagcagttcaaggccaagttccccttcggcggcctgctggacagcgcccaggccagcgagaccagcaagctgcagcagctggtggagaacatcgacaagaaggccaccgaccccaacgagtgcatcatctgccacagagtgctgagctgccagagcgccctgaagatgcactacagaacccacaccggcgagagacccttcaagtgcaagatctgcggcagagccttcaccaccaagggcaacctgaagacccactacagcgtgcacagagccatgccccccctgagagtgcagcacagctgccccatctgccagaagaagttcaccaacgccgtggtgctgcagcagcacatcagaatgcacatgggcggccagatccccaacacccccgtgcccgacagctacagcgagagcatggagagcgacaccggcagcttcgacgagaagaacttcgacgacctggacaacttcagcgacgagaacatggaggactgccccgagggcagcatccccgacacccccaagagcgccgacgccagccaggacagcctgagcagcagccccctgcccctggagatgagcagcatcgccgccctggagaaccagatgaagatgatcaacgccggcctggccgagcagctgcaggccagcctgaagagcgtggagaacggcagcatcgagggcgacgtgctgaccaacgacagcagcagcgtgggcggcgacatggagagccagagcgccggcagccccgccatcagcgagagcaccagcagcatgcaggccctgagccccagcaacagcacccaggagttccacaagagccccagcatcgaggagaagccccagagagccgtgcccagcgagttcgccaacggcctgagccccacccccgtgaacggcggcgccctggacctgaccagcagccacgccgagaagatcatcaaggaggacagcctgggcatcctgttccccttcagagacagaggcaagttcaagaacaccgcctgcgacatctgcggcaagaccttcgcctgccagagcgccctggacatccactacagaagccacaccaaggagagacccttcatctgcaccgtgtgcaacagaggcttcagcaccaagggcaacctgaagcagcacatgctgacccaccagatgagagacctgcccagccagctgttcgagcccagcagcaacctgggccccaaccagaacagcgccgtgatccccgccaacagcctgagcagcctgatcaagaccgaggtgaacggcttcgtgcacgtgagcccccaggacagcaaggacacccccaccagccacgtgcccagcggccccctgagcagcagcgccaccagccccgtgctgctgcccgccctgcccagaagaacccccaagcagcactactgcaacacctgcggcaagaccttcagcagcagcagcgccctgcagatccacgagagaacccacaccggcgagaagcccttcgcctgcaccatctgcggcagagccttcaccaccaagggcaacctgaaggtgcacatgggcacccacatgtggaacagcacccccgccagaagaggcagaagactgagcgtggacggccccatgaccttcctgggcggcaaccccgtgaagttccccgagatgttccagaaggacctggccgccagaagcggcagcggcgaccccagcagcttctggaaccagtacgccgccgccctgagcaacggcctggccatgaaggccaacgagatcagcgtgatccagaacggcggcatcccccccatccccggcagcctgggcagcggcaacagcagccccgtgagcggcctgaccggcaacctggagagactgcagaacagcgagcccaacgcccccctggccggcctggagaagatggccagcagcgagaacggcaccaacttcagattcaccagattcgtggaggacagcaaggagatcgtgaccagctag

SEQ ID NO: 97995 - DNA, 3684 bp, Artificial Sequence
  Description of Artificial Sequence: Synthetic coding sequence
atgaacgacaccgtgaacaagaccgaccaggtggactgcagcgacctgagcgagcacaacggcctggacagagaggagagcatggaggtggaggcccccgtggccaacaagagcggcagcggcaccagcagcggcagccacagcagcaccgcccccagcagcagcagcagcagcagcagcagcagcggcggcggcggcagcagcagcaccggcaccagcgccatcaccaccagcctgccccagctgggcgacctgaccaccctgggcaacttcagcgtgatcaacagcaacgtgatcatcgagaacctgcagagcaccaaggtggccgtggcccagttcagccaggaggccagatgcggcggcgccagcggcggcaagctggccgtgcccgccctgatggagcagctgctggccctgcagcagcagcagatccaccagctgcagctgatcgagcagatcagacaccagatcctgctgctggccagccagaacgccgacctgcccaccagcagcagccccagccagggcaccctgagaaccagcgccaaccccctgagcaccctgagcagccacctgagccagcagctggccgccgccgccggcctggcccagagcctggccagccagagcgccagcatcagcggcgtgaagcagctgccccccatccagctgccccagagcagcagcggcaacaccatcatccccagcaacagcggcagcagccccaacatgaacatcctggccgccgccgtgaccacccccagcagcgagaaggtggccagcagcgccggcgccagccacgtgagcaaccccgccgtgagcagcagcagcagccccgccttcgccatcagcagcctgctgagccccgccagcaaccccctgctgccccagcaggccagcgccaacagcgtgttccccagccccctgcccaacatcggcaccaccgccgaggacctgaacagcctgagcgccctggcccagcagagaaagagcaagccccccaacgtgaccgccttcgaggccaagagcaccagcgacgaggccttcttcaagcacaagtgcagattctgcgccaaggtgttcggcagcgacagcgccctgcagatccacctgagaagccacaccggcgagagacccttcaagtgcaacatctgcggcaacagattcagcaccaagggcaacctgaaggtgcacttccagagacacaaggagaagtacccccacatccagatgaacccctaccccgtgcccgagcacctggacaacatccccaccagcaccggcatcccctacggcatgagcatcccccccgagaagcccgtgaccagctggctggacaccaagcccgtgctgcccaccctgaccaccagcgtgggcctgcccctgccccccaccctgcccagcctgatccccttcatcaagaccgaggagcccgcccccatccccatcagccacagcgccaccagcccccccggcagcgtgaagagcgacagcggcggccccgagagcgccaccagaaacctgggcggcctgcccgaggaggccgagggcagcaccctgccccccagcggcggcaagagcgaggagagcggcatggtgaccaacagcgtgcccaccgccagcagcagcgtgctgagcagccccgccgccgactgcggccccgccggcagcgccaccaccttcaccaaccccctgctgcccctgatgagcgagcagttcaaggccaagttccccttcggcggcctgctggacagcgcccaggccagcgagaccagcaagctgcagcagctggtggagaacatcgacaagaaggccaccgaccccaacgagtgcatcatctgccacagagtgctgagctgccagagcgccctgaagatgcactacagaacccacaccggcgagagacccttcaagtgcaagatctgcggcagagccttcaccaccaagggcaacctgaagacccactacagcgtgcacagagccatgccccccctgagagtgcagcacagctgccccatctgccagaagaagttcaccaacgccgtggtgctgcagcagcacatcagaatgcacatgggcggccagatccccaacacccccgtgcccgacagctacagcgagagcatggagagcgacaccggcagcttcgacgagaagaacttcgacgacctggacaacttcagcgacgagaacatggaggactgccccgagggcagcatccccgacacccccaagagcgccgacgccagccaggacagcctgagcagcagccccctgcccctggagatgagcagcatcgccgccctggagaaccagatgaagatgatcaacgccggcctggccgagcagctgcaggccagcctgaagagcgtggagaacggcagcatcgagggcgacgtgctgaccaacgacagcagcagcgtgggcggcgacatggagagccagagcgccggcagccccgccatcagcgagagcaccagcagcatgcaggccctgagccccagcaacagcacccaggagttccacaagagccccagcatcgaggagaagccccagagagccgtgcccagcgagttcgccaacggcctgagccccacccccgtgaacggcggcgccctggacctgaccagcagccacgccgagaagatcatcaaggaggacagcctgggcatcctgttccccttcagagacagaggcaagttcaagaacaccgcctgcgacatctgcggcaagaccttcgcctgccagagcgccctggacatccactacagaagccacaccaaggagagacccttcatctgcaccgtgtgcaacagaggcttcagcaccaagggcaacctgaagcagcacatgctgacccaccagatgagagacctgcccagccagctgttcgagcccagcagcaacctgggccccaaccagaacagcgccgtgatccccgccaacagcctgagcagcctgatcaagaccgaggtgaacggcttcgtgcacgtgagcccccaggacagcaaggacacccccaccagccacgtgcccagcggccccctgagcagcagcgccaccagccccgtgctgctgcccgccctgcccagaagaacccccaagcagcactactgcaacacctgcggcaagaccttcagcagcagcagcgccctgcagatccacgagagaacccacaccggcgagaagcccttcgcctgcaccatctgcggcagagccttcaccaccaagggcaacctgaaggtgcacatgggcacccacatgtggaacagcacccccgccagaagaggcagaagactgagcgtggacggccccatgaccttcctgggcggcaaccccgtgaagttccccgagatgttccagaaggacctggccgccagaagcggcagcggcgaccccagcagcttctggaaccagtacgccgccgccctgagcaacggcctggccatgaaggccaacgagatcagcgtgatccagaacggcggcatcccccccatccccggcagcctgggcagcggcaacagcagccccgtgagcggcctgaccggcaacctggagagactgcagaacagcgagcccaacgcccccctggccggcctggagaagatggccagcagcgagaacggcaccaacttcagattcaccagattcgtggaggacagcaaggagatcgtgaccagctag

SEQ ID NO: 97996 - DNA, 3867 bp, Artificial Sequence
  Description of Artificial Sequence: Synthetic coding sequence
atgagcagaagaaagcaggccaagccccagcacttccagagcgaccccgaggtggccagcctgcccagaagagacggcgacaccgagaagggccagcccagcagacccaccaagagcaaggacgcccacgtgtgcggcagatgctgcgccgagttcttcgagctgagcgacctgctgctgcacaagaagaactgcaccaagaaccagctggtgctgatcgtgaacgagaaccccgccagcccccccgagaccttcagccccagccccccccccgacaaccccgacgagcagatgaacgacaccgtgaacaagaccggcagccacagcagcaccgcccccagcagcagcagcagcagcagcagcagcagcggcggcggcggcagcagcagcaccggcaccagcgccatcaccaccagcctgccccagctgggcgacctgaccaccctgggcaacttcagcgtgatcaacagcaacgtgatcatcgagaacctgcagagcaccaaggtggccgtggcccagttcagccaggaggccagatgcggcggcgccagcggcggcaagctggccgtgcccgccctgatggagcagctgctggccctgcagcagcagcagatccaccagctgcagctgatcgagcagatcagacaccagatcctgctgctggccagccagaacgccgacctgcccaccagcagcagccccagccagggcaccctgagaaccagcgccaaccccctgagcaccctgagcagccacctgagccagcagctggccgccgccgccggcctggcccagagcctggccagccagagcgccagcatcagcggcgtgaagcagctgccccccatccagctgccccagagcagcagcggcaacaccatcatccccagcaacagcggcagcagccccaacatgaacatcctggccgccgccgtgaccacccccagcagcgagaaggtggccagcagcgccggcgccagccacgtgagcaaccccgccgtgagcagcagcagcagccccgccttcgccatcagcagcctgctgagccccgccagcaaccccctgctgccccagcaggccagcgccaacagcgtgttccccagccccctgcccaacatcggcaccaccgccgaggacctgaacagcctgagcgccctggcccagcagagaaagagcaagccccccaacgtgaccgccttcgaggccaagagcaccagcgacgaggccttcttcaagcacaagtgcagattctgcgccaaggtgttcggcagcgacagcgccctgcagatccacctgagaagccacaccggcgagagacccttcaagtgcaacatctgcggcaacagattcagcaccaagggcaacctgaaggtgcacttccagagacacaaggagaagtacccccacatccagatgaacccctaccccgtgcccgagcacctggacaacatccccaccagcaccggcatcccctacggcatgagcatcccccccgagaagcccgtgaccagctggctggacaccaagcccgtgctgcccaccctgaccaccagcgtgggcctgcccctgccccccaccctgcccagcctgatccccttcatcaagaccgaggagcccgcccccatccccatcagccacagcgccaccagcccccccggcagcgtgaagagcgacagcggcggccccgagagcgccaccagaaacctgggcggcctgcccgaggaggccgagggcagcaccctgccccccagcggcggcaagagcgaggagagcggcatggtgaccaacagcgtgcccaccgccagcagcagcgtgctgagcagccccgccgccgactgcggccccgccggcagcgccaccaccttcaccaaccccctgctgcccctgatgagcgagcagttcaaggccaagttccccttcggcggcctgctggacagcgcccaggccagcgagaccagcaagctgcagcagctggtggagaacatcgacaagaaggccaccgaccccaacgagtgcatcatctgccacagagtgctgagctgccagagcgccctgaagatgcactacagaacccacaccggcgagagacccttcaagtgcaagatctgcggcagagccttcaccaccaagggcaacctgaagacccactacagcgtgcacagagccatgccccccctgagagtgcagcacagctgccccatctgccagaagaagttcaccaacgccgtggtgctgcagcagcacatcagaatgcacatgggcggccagatccccaacacccccgtgcccgacagctacagcgagagcatggagagcgacaccggcagcttcgacgagaagaacttcgacgacctggacaacttcagcgacgagaacatggaggactgccccgagggcagcatccccgacacccccaagagcgccgacgccagccaggacagcctgagcagcagccccctgcccctggagatgagcagcatcgccgccctggagaaccagatgaagatgatcaacgccggcctggccgagcagctgcaggccagcctgaagagcgtggagaacggcagcatcgagggcgacgtgctgaccaacgacagcagcagcgtgggcggcgacatggagagccagagcgccggcagccccgccatcagcgagagcaccagcagcatgcaggccctgagccccagcaacagcacccaggagttccacaagagccccagcatcgaggagaagccccagagagccgtgcccagcgagttcgccaacggcctgagccccacccccgtgaacggcggcgccctggacctgaccagcagccacgccgagaagatcatcaaggaggacagcctgggcatcctgttccccttcagagacagaggcaagttcaagaacaccgcctgcgacatctgcggcaagaccttcgcctgccagagcgccctggacatccactacagaagccacaccaaggagagacccttcatctgcaccgtgtgcaacagaggcttcagcaccaagggcaacctgaagcagcacatgctgacccaccagatgagagacctgcccagccagctgttcgagcccagcagcaacctgggccccaaccagaacagcgccgtgatccccgccaacagcctgagcagcctgatcaagaccgaggtgaacggcttcgtgcacgtgagcccccaggacagcaaggacacccccaccagccacgtgcccagcggccccctgagcagcagcgccaccagccccgtgctgctgcccgccctgcccagaagaacccccaagcagcactactgcaacacctgcggcaagaccttcagcagcagcagcgccctgcagatccacgagagaacccacaccggcgagaagcccttcgcctgcaccatctgcggcagagccttcaccaccaagggcaacctgaaggtgcacatgggcacccacatgtggaacagcacccccgccagaagaggcagaagactgagcgtggacggccccatgaccttcctgggcggcaaccccgtgaagttccccgagatgttccagaaggacctggccgccagaagcggcagcggcgaccccagcagcttctggaaccagtacgccgccgccctgagcaacggcctggccatgaaggccaacgagatcagcgtgatccagaacggcggcatcccccccatccccggcagcctgggcagcggcaacagcagccccgtgagcggcctgaccggcaacctggagagactgcagaacagcgagcccaacgcccccctggccggcctggagaagatggccagcagcgagaacggcaccaacttcagattcaccagattcgtggaggacagcaaggagatcgtgaccagctag

SEQ ID NO: 97997 - DNA, 444 bp, Artificial Sequence
  Description of Artificial Sequence: Synthetic coding sequence
atggtgcacatgggcacccacatgtggaacagcacccccgccagaagaggcagaagactgagcgtggacggccccatgaccttcctgggcggcaaccccgtgaagttccccgagatgttccagaaggacctggccgccagaagcggcagcggcgaccccagcagcttctggaaccagtacgccgccgccctgagcaacggcctggccatgaaggccaacgagatcagcgtgatccagaacggcggcatcccccccatccccggcagcctgggcagcggcaacagcagccccgtgagcggcctgaccggcaacctggagagactgcagaacagcgagcccaacgcccccctggccggcctggagaagatggccagcagcgagaacggcaccaacttcagattcaccagattcgtggaggacagcaaggagatcgtgaccagctag

SEQ ID NO: 97998 - DNA, 3024 bp, Artificial Sequence
  Description of Artificial Sequence: Synthetic coding sequence
atgagcagaagaaagcagagaaagccccagcagctgatcagcgactgcgagggccccagcgccagcgagaacggcgacgccagcgaggaggaccacccccaggtgtgcgccaagtgctgcgcccagttcaccgaccccaccgagttcctggcccaccagaacgcctgcagcaccgacccccccgtgatggtgatcatcggcggccaggagaaccccaacaacagcagcgccagcagcgagcccagacccgagggccacaacaacccccaggtgatggacaccgagcacagcaacccccccgacagcggcagcagcgtgcccaccgaccccacctggggccccgagagaagaggcgaggagagccccggccacttcctggtggccgccaccggcaccgccgccggcggcggcggcggcctgatcctggccagccccaagctgggcgccacccccctgccccccgagagcacccccgcccccccccccccccccccccccccccccccccccggcgtgggcagcggccacctgaacatccccctgatcctggaggagctgagagtgctgcagcagagacagatccaccagatgcagatgaccgagcagatctgcagacaggtgctgctgctgggcagcctgggccagaccgtgggcgcccccgccagccccagcgagctgcccggcaccggcaccgccagcagcaccaagcccctgctgcccctgttcagccccatcaagcccgtgcagaccagcaagaccctggccagcagcagcagcagcagcagcagcagcagcggcgccgagacccccaagcaggccttcttccacctgtaccaccccctgggcagccagcaccccttcagcgccggcggcgtgggcagaagccacaagcccacccccgcccccagccccgccctgcccggcagcaccgaccagctgatcgccagcccccacctggccttccccagcaccaccggcctgctggccgcccagtgcctgggcgccgccagaggcctggaggccaccgccagccccggcctgctgaagcccaagaacggcagcggcgagctgagctacggcgaggtgatgggccccctggagaagcccggcggcagacacaagtgcagattctgcgccaaggtgttcggcagcgacagcgccctgcagatccacctgagaagccacaccggcgagagaccctacaagtgcaacgtgtgcggcaacagattcaccaccagaggcaacctgaaggtgcacttccacagacacagagagaagtacccccacgtgcagatgaacccccaccccgtgcccgagcacctggactacgtgatcaccagcagcggcctgccctacggcatgagcgtgccccccgagaaggccgaggaggaggccgccacccccggcggcggcgtggagagaaagcccctggtggccagcaccaccgccctgagcgccaccgagagcctgaccctgctgagcaccagcgccggcaccgccaccgcccccggcctgcccgccttcaacaagttcgtgctgatgaaggccgtggagcccaagaacaaggccgacgagaacaccccccccggcagcgagggcagcgccatcagcggcgtggccgagagcagcaccgccaccagaatgcagctgagcaagctggtgaccagcctgcccagctgggccctgctgaccaaccacttcaagagcaccggcagcttccccttcccctacgtgctggagcccctgggcgccagccccagcgagaccagcaagctgcagcagctggtggagaagatcgacagacagggcgccgtggccgtgaccagcgccgccagcggcgcccccaccaccagcgcccccgcccccagcagcagcgccagcagcggccccaaccagtgcgtgatctgcctgagagtgctgagctgccccagagccctgagactgcactacggccagcacggcggcgagagacccttcaagtgcaaggtgtgcggcagagccttcagcaccagaggcaacctgagagcccacttcgtgggccacaaggccagccccgccgccagagcccagaacagctgccccatctgccagaagaagttcaccaacgccgtgaccctgcagcagcacgtgagaatgcacctgggcggccagatccccaacggcggcaccgccctgcccgagggcggcggcgccgcccaggagaacggcagcgagcagagcaccgtgagcggcgccggcagcttcccccagcagcagagccagcagcccagccccgaggaggagctgagcgaggaggaggaggaggaggacgaggaggaggaggaggacgtgaccgacgaggacagcctggccggcagaggcagcgagagcggcggcgagaaggccatcagcgtgagaggcgacagcgaggaggccagcggcgccgaggaggaggtgggcaccgtggccgccgccgccaccgccggcaaggagatggacagcaacgagaagaccacccagcagagcagcctgccccccccccccccccccgacagcctggaccagccccagcccatggagcagggcagcagcggcgtgctgggcggcaaggaggagggcggcaagcccgagagaagcagcagccccgccagcgccctgacccccgagggcgaggccaccagcgtgaccctggtggaggagctgagcctgcaggaggccatgagaaaggagcccggcgagagcagcagcagaaaggcctgcgaggtgtgcggccaggccttccccagccaggccgccctggaggagcaccagaagacccaccccaaggagggccccctgttcacctgcgtgttctgcagacagggcttcctggagagagccaccctgaagaagcacatgctgctggcccaccaccaggtgcagcccttcgccccccacggcccccagaacatcgccgccctgagcctggtgcccggctgcagccccagcatcaccagcaccggcctgagccccttccccagaaaggacgaccccaccatcccctag

SEQ ID NO: 97999 - DNA, 1827 bp, Artificial Sequence
  Description of Artificial Sequence: Synthetic coding sequence
atgagcagaagaaagcagagaaagccccagcagctgatcagcgactgcgagggccccagcgccagcgagaacggcgacgccagcgaggaggaccacccccaggtgtgcgccaagtgctgcgcccagttcaccgaccccaccgagttcctggcccaccagaacgcctgcagcaccgacccccccgtgatggtgatcatcggcggccaggagaaccccaacaacagcagcgccagcagcgagcccagacccgagggccacaacaacccccaggtgatggacaccgagcacagcaacccccccgacagcggcagcagcgtgcccaccgaccccacctggggccccgagagaagaggcgaggagagccccggccacttcctggtggccgccaccggcaccgccgccggcggcggcggcggcctgatcctggccagccccaagctgggcgccacccccctgccccccgagagcacccccgcccccccccccccccccccccccccccccccccccggcgtgggcagcggccacctgaacatccccctgatcctggaggagctgagagtgctgcagcagagacagatccaccagatgcagatgaccgagcagatctgcagacaggtgctgctgctgggcagcctgggccagaccgtgggcgcccccgccagccccagcgagctgcccggcaccggcaccgccagcagcaccaagcccctgctgcccctgttcagccccatcaagcccgtgcagaccagcaagaccctggccagcagcagcagcagcagcagcagcagcagcggcgccgagacccccaagcaggccttcttccacctgtaccaccccctgggcagccagcaccccttcagcgccggcggcgtgggcagaagccacaagcccacccccgcccccagccccgccctgcccggcagcaccgaccagctgatcgccagcccccacctggccttccccagcaccaccggcctgctggccgcccagtgcctgggcgccgccagaggcctggaggccaccgccagccccggcctgctgaagcccaagaacggcagcggcgagctgagctacggcgaggtgatgggccccctggagaagcccggcggcagacacaagtgcagattctgcgccaaggtgttcggcagcgacagcgccctgcagatccacctgagaagccacaccggcgagagaccctacaagtgcaacgtgtgcggcaacagattcaccaccagaggcaacctgaaggtgcacttccacagacacagagagaagtacccccacgtgcagatgaacccccaccccgtgcccgagcacctggactacgtgatcaccagcagcggcctgccctacggcatgagcgtgccccccgagaaggccgaggaggaggccgccacccccggcggcggcgtggagagaaagcccctggtggccagcaccaccgccctgagcgccaccgagagcctgaccctgctgagcaccagcgccggcaccgccaccgcccccggcctgcccgccttcaacaagttcgtgctgatgaaggccgtggagcccaagaacaaggccgacgagaacaccccccccggcagcgagggcagcgccatcagcggcgtggccgagagcagcaccgccaccagaatgcagctgagcaagctggtgaccagcctgcccagctgggccctgctgaccaaccacttcaagagcaccggcagcttccccttcccctacgtgcccgaggaggtgcaccagtgctgccacagcgccgccgcctgccccgacgcccccggcggccccgacccccagagatggtactgcaccccctag

SEQ ID NO: 98000 - DNA, 3687 bp, Artificial Sequence
  Description of Artificial Sequence: Synthetic coding sequence
atgagcagaagaaagcaggccaagccccagcacctgaagagcgacgaggagctgctgccccccgacggcgcccccgagcacgccgcccccggcgagggcgccgaggacgccgacagcggccccgagagcagaagcggcggcgaggagaccagcgtgtgcgagaagtgctgcgccgagttcttcaagtgggccgacttcctggagcaccagagaagctgcaccaagctgccccccgtgctgatcgtgcacgaggacgcccccgcccccccccccgaggacttccccgagcccagccccgccagcagccccagcgagagagccgagagcgaggccgccgaggaggccggcgccgagggcgccgagggcgaggccagacccgtggagaaggaggccgagcccatggacgccgagcccgccggcgacaccagagcccccagacccccccccgccgcccccgccccccccacccccgcctacggcgcccccagcaccaacgtgaccctggaggccctgctgagcaccaaggtggccgtggcccagttcagccagggcgccagagccgccggcggcagcggcgccggcggcggcgtggccgccgccgccgtgcccctgatcctggagcagctgatggccctgcagcagcagcagatccaccagctgcagctgatcgagcagatcagaagccaggtggccctgatgcagagacccccccccagacccagcctgagccccgccgccgcccccagcgcccccggccccgcccccagccagctgcccggcctggccgccctgcccctgagcgccggcgcccccgccgccgccatcgccggcagcggccccgccgcccccgccgccttcgagggcgcccagcccctgagcagacccgagagcggcgccagcacccccggcggccccgccgagcccagcgcccccgccgcccccagcgccgcccccgcccccgccgcccccgcccccgcccccgccccccagagcgccgccagcagccagccccagagcgccagcaccccccccgccctggcccccggcagcctgctgggcgccgcccccggcctgcccagccccctgctgccccagaccagcgccagcggcgtgatcttccccaaccccctggtgagcatcgccgccaccgccaacgccctggaccccctgagcgccctgatgaagcacagaaagggcaagccccccaacgtgagcgtgttcgagcccaaggccagcgccgaggaccccttcttcaagcacaagtgcagattctgcgccaaggtgttcggcagcgacagcgccctgcagatccacctgagaagccacaccggcgagagacccttcaagtgcaacatctgcggcaacagattcagcaccaagggcaacctgaaggtgcacttccagagacacaaggagaagtacccccacatccagatgaacccctaccccgtgcccgagtacctggacaacgtgcccacctgcagcggcatcccctacggcatgagcctgccccccgagaagcccgtgaccacctggctggacagcaagcccgtgctgcccaccgtgcccaccagcgtgggcctgcagctgccccccaccgtgcccggcgcccacggctacgccgacagccccagcgccacccccgccagcagaagcccccagagacccagccccgccagcagcgagtgcgccagcctgagccccggcctgaaccacgtggagagcggcgtgagcgccaccgccgagagcccccagagcctgctgggcggcccccccctgaccaaggccgagcccgtgagcctgccctgcaccaacgccagagccggcgacgcccccgtgggcgcccaggccagcgccgcccccaccagcgtggacggcgcccccaccagcctgggcagccccggcctgcccgccgtgagcgagcagttcaaggcccagttccccttcggcggcctgctggacagcatgcagaccagcgagaccagcaagctgcagcagctggtggagaacatcgacaagaagatgaccgaccccaaccagtgcgtgatctgccacagagtgctgagctgccagagcgccctgaagatgcactacagaacccacaccggcgagagacccttcaagtgcaagatctgcggcagagccttcaccaccaagggcaacctgaagacccacttcggcgtgcacagagccaagccccccctgagagtgcagcacagctgccccatctgccagaagaagttcaccaacgccgtggtgctgcagcagcacatcagaatgcacatgggcggccagatccccaacacccccctgcccgagggcttccaggacgccatggacagcgagctggcctacgacgacaagaacgccgagaccctgagcagctacgacgacgacatggacgagaacagcatggaggacgacgccgagctgaaggacgccgccaccgaccccgccaagcccctgctgagctacgccggcagctgcccccccagcccccccagcgtgatcagcagcatcgccgccctggagaaccagatgaagatgatcgacagcgtgatgagctgccagcagctgaccggcctgaagagcgtggagaacggcagcggcgagagcgacagactgagcaacgacagcagcagcgccgtgggcgacctggagagcagaagcgccggcagccccgccctgagcgagagcagcagcagccaggccctgagccccgcccccagcaacggcgagagcttcagaagcaagagccccggcctgggcgcccccgaggagccccaggagatccccctgaagaccgagagacccgacagccccgccgccgcccccggcagcggcggcgcccccggcagagccggcatcaaggaggaggcccccttcagcctgctgttcctgagcagagagagaggccccagccagagcacccccagcctgatcagcagcgccgcccccaccatgatcaagatggaggtgaacggccacggcaaggccatggccctgggcgagggcccccccctgcccgccggcgtgcaggtgcccgccggcccccagaccgtgatgggccccggcctggcccccatgctggcccccccccccagaagaacccccaagcagcacaactgccagagctgcggcaagaccttcagcagcgccagcgccctgcagatccacgagagaacccacaccggcgagaagcccttcggctgcaccatctgcggcagagccttcaccaccaagggcaacctgaaggtgcacatgggcacccacatgtggaacaacgcccccgccagaagaggcagaagactgagcgtggagaaccccatggccctgctgggcggcgacgccctgaagttcagcgagatgttccagaaggacctggccgccagagccatgaacgtggaccccagcttctggaaccagtacgccgccgccatcaccaacggcctggccatgaagaacaacgagatcagcgtgatccagaacggcggcatcccccagctgcccgtgagcctgggcggcagcgccctgccccccctgggcagcatggccagcggcatggacaaggccagaaccggcagcagcccccccatcgtgagcctggacaaggccagcagcgagaccgccgccagcagacccttcaccagattcatcgaggacaacaaggagatcggcatcaactag

SEQ ID NO: 98001 - DNA, 3903 bp, Artificial Sequence
  Description of Artificial Sequence: Synthetic coding sequence
atgagcagaagaaagcaggccaagccccagcacctgaagagcgacgaggagctgctgccccccgacggcgcccccgagcacgccgcccccggcgagggcgccgaggacgccgacagcggccccgagagcagaagcggcggcgaggagaccagcgtgtgcgagaagtgctgcgccgagttcttcaagtgggccgacttcctggagcaccagagaagctgcaccaagctgccccccgtgctgatcgtgcacgaggacgcccccgcccccccccccgaggacttccccgagcccagccccgccagcagccccagcgagagagccgagagcgaggccgccgaggaggccggcgccgagggcgccgagggcgaggccagacccgtggagaaggaggccgagcccatggacgccgagcccgccggcgacaccagagcccccagacccccccccgccgcccccgccccccccacccccgcctacggcgcccccagcaccaacgtgaccctggaggccctgctgagcaccaaggtggccgtggcccagttcagccagggcgccagagccgccggcggcagcggcgccggcggcggcgtggccgccgccgccgtgcccctgatcctggagcagctgatggccctgcagcagcagcagatccaccagctgcagctgatcgagcagatcagaagccaggtggccctgatgcagagacccccccccagacccagcctgagccccgccgccgcccccagcgcccccggccccgcccccagccagctgcccggcctggccgccctgcccctgagcgccggcgcccccgccgccgccatcgccggcagcggccccgccgcccccgccgccttcgagggcgcccagcccctgagcagacccgagagcggcgccagcacccccggcggccccgccgagcccagcgcccccgccgcccccagcgccgcccccgcccccgccgcccccgcccccgcccccgccccccagagcgccgccagcagccagccccagagcgccagcaccccccccgccctggcccccggcagcctgctgggcgccgcccccggcctgcccagccccctgctgccccagaccagcgccagcggcgtgatcttccccaaccccctggtgagcatcgccgccaccgccaacgccctggaccccctgagcgccctgatgaagcacagaaagggcaagccccccaacgtgagcgtgttcgagcccaaggccagcgccgaggaccccttcttcaagcacaagtgcagattctgcgccaaggtgttcggcagcgacagcgccctgcagatccacctgagaagccacaccggcgagagacccttcaagtgcaacatctgcggcaacagattcagcaccaagggcaacctgaaggtgcacttccagagacacaaggagaagtacccccacatccagatgaacccctaccccgtgcccgagtacctggacaacgtgcccacctgcagcggcatcccctacggcatgagcctgccccccgagaagcccgtgaccacctggctggacagcaagcccgtgctgcccaccgtgcccaccagcgtgggcctgcagctgccccccaccgtgcccggcgcccacggctacgccgacagccccagcgccacccccgccagcagaagcccccagagacccagccccgccagcagcgagtgcgccagcctgagccccggcctgaaccacgtggagagcggcgtgagcgccaccgccgagagcccccagagcctgctgggcggcccccccctgaccaaggccgagcccgtgagcctgccctgcaccaacgccagagccggcgacgcccccgtgggcgcccaggccagcgccgcccccaccagcgtggacggcgcccccaccagcctgggcagccccggcctgcccgccgtgagcgagcagttcaaggcccagttccccttcggcggcctgctggacagcatgcagaccagcgagaccagcaagctgcagcagctggtggagaacatcgacaagaagatgaccgaccccaaccagtgcgtgatctgccacagagtgctgagctgccagagcgccctgaagatgcactacagaacccacaccggcgagagacccttcaagtgcaagatctgcggcagagccttcaccaccaagggcaacctgaagacccacttcggcgtgcacagagccaagccccccctgagagtgcagcacagctgccccatctgccagaagaagttcaccaacgccgtggtgctgcagcagcacatcagaatgcacatgggcggccagatccccaacacccccctgcccgagggcttccaggacgccatggacagcgagctggcctacgacgacaagaacgccgagaccctgagcagctacgacgacgacatggacgagaacagcatggaggacgacgccgagctgaaggacgccgccaccgaccccgccaagcccctgctgagctacgccggcagctgcccccccagcccccccagcgtgatcagcagcatcgccgccctggagaaccagatgaagatgatcgacagcgtgatgagctgccagcagctgaccggcctgaagagcgtggagaacggcagcggcgagagcgacagactgagcaacgacagcagcagcgccgtgggcgacctggagagcagaagcgccggcagccccgccctgagcgagagcagcagcagccaggccctgagccccgcccccagcaacggcgagagcttcagaagcaagagccccggcctgggcgcccccgaggagccccaggagatccccctgaagaccgagagacccgacagccccgccgccgcccccggcagcggcggcgcccccggcagagccggcatcaaggaggaggcccccttcagcctgctgttcctgagcagagagagaggcaagtgccccagcaccgtgtgcggcgtgtgcggcaagcccttcgcctgcaagagcgccctggagatccactacagaagccacaccaaggagagacccttcgtgtgcgccctgtgcagaagaggctgcagcaccatgggcaacctgaagcagcacctgctgacccacagactgaaggagctgcccagccagctgttcgaccccaacttcgccctgggccccagccagagcacccccagcctgatcagcagcgccgcccccaccatgatcaagatggaggtgaacggccacggcaaggccatggccctgggcgagggcccccccctgcccgccggcgtgcaggtgcccgccggcccccagaccgtgatgggccccggcctggcccccatgctggcccccccccccagaagaacccccaagcagcacaactgccagagctgcggcaagaccttcagcagcgccagcgccctgcagatccacgagagaacccacaccggcgagaagcccttcggctgcaccatctgcggcagagccttcaccaccaagggcaacctgaaggtgcacatgggcacccacatgtggaacaacgcccccgccagaagaggcagaagactgagcgtggagaaccccatggccctgctgggcggcgacgccctgaagttcagcgagatgttccagaaggacctggccgccagagccatgaacgtggaccccagcttctggaaccagtacgccgccgccatcaccaacggcctggccatgaagaacaacgagatcagcgtgatccagaacggcggcatcccccagctgcccgtgagcctgggcggcagcgccctgccccccctgggcagcatggccagcggcatggacaaggccagaaccggcagcagcccccccatcgtgagcctggacaaggccagcagcgagaccgccgccagcagacccttcaccagattcatcgaggacaacaaggagatcggcatcaactag

SEQ ID NO: 98002 - DNA, 2883 bp, Artificial Sequence
  Description of Artificial Sequence: Synthetic coding sequence
atgagcagaagaaagcaggccaagccccagcacctgaagagcgacgaggagctgctgccccccgacggcgcccccgagcacgccgcccccggcgagggcgccgaggacgccgacagcggccccgagagcagaagcggcggcgaggagaccagcgtgtgcgagaagtgctgcgccgagttcttcaagtgggccgacttcctggagcaccagagaagctgcaccaagctgccccccgtgctgatcgtgcacgaggacgccccccccggcctgcccagccccctgctgccccagaccagcgccagcggcgtgatcttccccaaccccctggtgagcatcgccgccaccgccaacgccctggaccccctgagcgccctgatgaagcacagaaagggcaagccccccaacgtgagcgtgttcgagcccaaggccagcgccgaggaccccttcttcaagcacaagtgcagattctgcgccaaggtgttcggcagcgacagcgccctgcagatccacctgagaagccacaccggcgagagacccttcaagtgcaacatctgcggcaacagattcagcaccaagggcaacctgaaggtgcacttccagagacacaaggagaagtacccccacatccagatgaacccctaccccgtgcccgagtacctggacaacgtgcccacctgcagcggcatcccctacggcatgagcctgccccccgagaagcccgtgaccacctggctggacagcaagcccgtgctgcccaccgtgcccaccagcgtgggcctgcagctgccccccaccgtgcccggcgcccacggctacgccgacagccccagcgccacccccgccagcagaagcccccagagacccagccccgccagcagcgagtgcgccagcctgagccccggcctgaaccacgtggagagcggcgtgagcgccaccgccgagagcccccagagcctgctgggcggcccccccctgaccaaggccgagcccgtgagcctgccctgcaccaacgccagagccggcgacgcccccgtgggcgcccaggccagcgccgcccccaccagcgtggacggcgcccccaccagcctgggcagccccggcctgcccgccgtgagcgagcagttcaaggcccagttccccttcggcggcctgctggacagcatgcagaccagcgagaccagcaagctgcagcagctggtggagaacatcgacaagaagatgaccgaccccaaccagtgcgtgatctgccacagagtgctgagctgccagagcgccctgaagatgcactacagaacccacaccggcgagagacccttcaagtgcaagatctgcggcagagccttcaccaccaagggcaacctgaagacccacttcggcgtgcacagagccaagccccccctgagagtgcagcacagctgccccatctgccagaagaagttcaccaacgccgtggtgctgcagcagcacatcagaatgcacatgggcggccagatccccaacacccccctgcccgagggcttccaggacgccatggacagcgagctggcctacgacgacaagaacgccgagaccctgagcagctacgacgacgacatggacgagaacagcatggaggacgacgccgagctgaaggacgccgccaccgaccccgccaagcccctgctgagctacgccggcagctgcccccccagcccccccagcgtgatcagcagcatcgccgccctggagaaccagatgaagatgatcgacagcgtgatgagctgccagcagctgaccggcctgaagagcgtggagaacggcagcggcgagagcgacagactgagcaacgacagcagcagcgccgtgggcgacctggagagcagaagcgccggcagccccgccctgagcgagagcagcagcagccaggccctgagccccgcccccagcaacggcgagagcttcagaagcaagagccccggcctgggcgcccccgaggagccccaggagatccccctgaagaccgagagacccgacagccccgccgccgcccccggcagcggcggcgcccccggcagagccggcatcaaggaggaggcccccttcagcctgctgttcctgagcagagagagaggccccagccagagcacccccagcctgatcagcagcgccgcccccaccatgatcaagatggaggtgaacggccacggcaaggccatggccctgggcgagggcccccccctgcccgccggcgtgcaggtgcccgccggcccccagaccgtgatgggccccggcctggcccccatgctggcccccccccccagaagaacccccaagcagcacaactgccagagctgcggcaagaccttcagcagcgccagcgccctgcagatccacgagagaacccacaccggcgagaagcccttcggctgcaccatctgcggcagagccttcaccaccaagggcaacctgaaggtgcacatgggcacccacatgtggaacaacgcccccgccagaagaggcagaagactgagcgtggagaaccccatggccctgctgggcggcgacgccctgaagttcagcgagatgttccagaaggacctggccgccagagccatgaacgtggaccccagcttctggaaccagtacgccgccgccatcaccaacggcctggccatgaagaacaacgagatcagcgtgatccagaacggcggcatcccccagctgcccgtgagcctgggcggcagcgccctgccccccctgggcagcatggccagcggcatggacaaggccagaaccggcagcagcccccccatcgtgagcctggacaaggccagcagcgagaccgccgccagcagacccttcaccagattcatcgaggacaacaaggagatcggcatcaactag

SEQ ID NO: 98003 - DNA, 516 bp, Artificial Sequence
  Description of Artificial Sequence: Synthetic coding sequence
atggtgagaccccccgtggtgcccagaagaccccccgcccacatcagcagcgtgagacaggccagcacccaggtgcccagaaccgtgccccacacccagagagtggccaacatcggcacccagaccaccggccccagcggcgtgggctgctgcacccccggcagacccctgctgccctgcaagtgcagcagcgccgcccacagcacctacagagtgcaggagcccgccgtgcacatccccggccaggagcccctgaccgccagcatgctggccgccgcccccctgcacgagcagaagcagatgatcggcgagagactgtaccccctgatccacgacgtgcacacccagctggccggcaagatcaccggcatgctgctggagatcgacaacagcgagctgctgctgatgctggagagccccgagagcctgcacgccaagaagagaaagagcagcctgccctggctgcccaagggccagtgcttctggctgagcgccctgagaccctgcaagctgtag

SEQ ID NO: 98004 - DNA, 831 bp, Artificial Sequence
  Description of Artificial Sequence: Synthetic coding sequence
atgagcagaagaaagcaggccaagccccagcacatcaacagcgaggaggaccagggcgagcagcagccccagcagcagacccccgagttcgccgacgccgcccccgccgcccccgccgccggcgagctgggcagaagcagcctgcccagcaccttcatcagagccccccccacctacgtgaaggtggaggtgcccggcaccttcgtgggccccagcaccctgagccccggcatgacccccctgctggccgcccagcccagaagacaggccaagcagcacggctgcaccagatgcggcaagaacttcagcagcgccagcgccctgcagatccacgagagaacccacaccggcgagaagcccttcgtgtgcaacatctgcggcagagccttcaccaccaagggcaacctgaaggtgcactacatgacccacggcgccaacaacaacagcgccagaagaggcagaaagctggccatcgagaacaccatggccctgctgggcaccgacggcaagagagtgagcgagatcttccccaaggagatcctggcccccagcgtgaacgtggaccccgtggtgtggaaccagtacaccagcatgctgaacggcggcctggccgtgaagaccaacgagatcagcgtgatccagagcggcggcgtgcccaccctgcccgtgagcctgggcgccaccagcgtggtgaacaacgccaccgtgagcaagatggacggcagccagagcggcatcagcgccgacgtggagaagcccagcgccaccgacggcgtgcccaagcaccagttcccccacttcctggaggagaacaagatcgccgtgagctag

SEQ ID NO: 98005 - DNA, 1851 bp, Artificial Sequence
  Description of Artificial Sequence: Synthetic coding sequence
atgagcagaagaaagcaggccaagccccagcacatcaacagcgaggaggaccagggcgagcagcagccccagcagcagacccccgagttcgccgacgccgcccccgccgcccccgccgccggcgagctgggcgcccccgtgaaccaccccggcaacgacgaggtggccagcgaggacgaggccaccgtgaagagactgagaagagaggagacccacgtgtgcgagaagtgctgcgccgagttcttcagcatcagcgagttcctggagcacaagaagaactgcaccaagaacccccccgtgctgatcatgaacgacagcgagggccccgtgcccagcgaggacttcagcggcgccgtgctgagccaccagcccaccagccccggcagcaaggactgccacagagagaacggcggcagcagcgaggacatgaaggagaagcccgacgccgagagcgtggtgtacctgaagaccgagaccgccctgccccccaccccccaggacatcagctacctggccaagggcaaggtggccaacaccaacgtgaccctgcaggccctgagaggcaccaaggtggccgtgaaccagagaagcgccgacgccctgcccgcccccgtgcccggcgccaacagcatcccctgggtgctggagcagatcctgtgcctgcagcagcagcagctgcagcagatccagctgaccgagcagatcagaatccaggtgaacatgtgggccagccacgccctgcacagcagcggcgccggcgccgacaccctgaagaccctgggcagccacatgagccagcaggtgagcgccgccgtggccctgctgagccagaaggccggcagccagggcctgagcctggacgccctgaagcaggccaagctgccccacgccaacatccccagcgccaccagcagcctgagccccggcctggcccccttcaccctgaagcccgacggcaccagagtgctgcccaacgtgatgagcagactgcccagcgccctgctgccccaggcccccggcagcgtgctgttccagagccccttcagcaccgtggccctggacaccagcaagaagggcaagggcaagccccccaacatcagcgccgtggacgtgaagcccaaggacgaggccgccctgtacaagcacaagtgcagaagcagcctgcccagcaccttcatcagagccccccccacctacgtgaaggtggaggtgcccggcaccttcgtgggccccagcaccctgagccccggcatgacccccctgctggccgcccagcccagaagacaggccaagcagcacggctgcaccagatgcggcaagaacttcagcagcgccagcgccctgcagatccacgagagaacccacaccggcgagaagcccttcgtgtgcaacatctgcggcagagccttcaccaccaagggcaacctgaaggtgcactacatgacccacggcgccaacaacaacagcgccagaagaggcagaaagctggccatcgagaacaccatggccctgctgggcaccgacggcaagagagtgagcgagatcttccccaaggagatcctggcccccagcgtgaacgtggaccccgtggtgtggaaccagtacaccagcatgctgaacggcggcctggccgtgaagaccaacgagatcagcgtgatccagagcggcggcgtgcccaccctgcccgtgagcctgggcgccaccagcgtggtgaacaacgccaccgtgagcaagatggacggcagccagagcggcatcagcgccgacgtggagaagcccagcgccaccgacggcgtgcccaagcaccagttcccccacttcctggaggagaacaagatcgccgtgagctag

SEQ ID NO: 98006 - DNA, 2781 bp, Artificial Sequence
  Description of Artificial Sequence: Synthetic coding sequence
atggtgatggccgacggccccagacacctgcagagaggccccgtgagagtgggcttctacgacatcgagggcaccctgggcaagggcaacttcgccgtggtgaagctgggcagacacagaatcaccaagaccgaggtggccatcaagatcatcgacaagagccagctggacgccgtgaacctggagaagatctacagagaggtgcagatcatgaagatgctggaccacccccacatcatcaagctgtaccaggtgatggagaccaagagcatgctgtacctggtgaccgagtacgccaagaacggcgagatcttcgactacctggccaaccacggcagactgaacgagagcgaggccagaagaaagttctggcagatcctgagcgccgtggactactgccacggcagaaagatcgtgcacagagacctgaaggccgagaacctgctgctggacaacaacatgaacatcaagatcgccgacttcggcttcggcaacttcttcaagagcggcgagctgctggccacctggtgcggcagccccccctacgccgcccccgaggtgttcgagggccagcagtacgagggcccccagctggacatctggagcatgggcgtggtgctgtacgtgctggtgtgcggcgccctgcccttcgacggccccaccctgcccatcctgagacagagagtgctggagggcagattcagaatcccctacttcatgagcgaggactgcgagcacctgatcagaagaatgctggtgctggaccccagcaagagactgaccatcgcccagatcaaggagcacaagtggatgctgatcgaggtgcccgtgcagagacccgtgctgtacccccaggagcaggagaacgagcccagcatcggcgagttcaacgagcaggtgctgagactgatgcacagcctgggcatcgaccagcagaagaccatcgagagcctgcagaacaagagctacaaccacttcgccgccatctacttcctgctggtggagagactgaagagccacagaagcagcttccccgtggagcagagactggacggcagacagagaagacccagcaccatcgccgagcagaccgtggccaaggcccagaccgtgggcctgcccgtgaccatgcacagccccaacatgagactgctgagaagcgccctgctgccccaggccagcaacgtggaggccttcagcttccccgccagcggctgccaggccgaggccgccttcatggaggaggagtgcgtggacacccccaaggtgaacggctgcctgctggaccccgtgccccccgtgctggtgagaaagggctgccagagcctgcccagcaacatgatggagaccagcatcgacgagggcctggagaccgagggcgaggccgaggaggaccccgcccacgccttcgaggccttccagagcaccagaagcggccagagaagacacaccctgagcgaggtgaccaaccagctggtggtgatgcccggcgccggcaagatcttcagcatgaacgacagccccagcctggacagcgtggacagcgagtacgacatgggcagcgtgcagagagacctgaacttcctggaggacaaccccagcctgaaggacatcatgctggccaaccagcccagccccagaatgaccagccccttcatcagcctgagacccaccaaccccgccatgcaggccctgagcagccagaagagagaggtgcacaacagaagccccgtgagcttcagagagggcagaagagccagcgacaccagcctgacccagggcatcgtggccttcagacagcacctgcagaacctggccagaaccaagggcatcctggagctgaacaaggtgcagctgctgtacgagcagatcggccccgaggccgaccccaacctggcccccgccgccccccagctgcaggacctggccagcagctgcccccaggaggaggtgagccagcagcaggagagcgtgagcaccctgcccgccagcgtgcacccccagctgagccccagacagagcctggagacccagtacctgcagcacagactgcagaagcccagcctgctgagcaaggcccagaacacctgccagctgtactgcaaggagccccccagaagcctggagcagcagctgcaggagcacagactgcagcagaagagactgttcctgcagaagcagagccagctgcaggcctacttcaaccagatgcagatcgccgagagcagctacccccagcccagccagcagctgcccctgcccagacaggagacccccccccccagccagcaggccccccccttcagcctgacccagcccctgagccccgtgctggagcccagcagcgagcagatgcagtacagccccttcctgagccagtaccaggagatgcagctgcagcccctgcccagcaccagcggccccagagccgccccccccctgcccacccagctgcagcagcagcagccccccccccccccccccccccccccccccagacagcccggcgccgcccccgcccccctgcagttcagctaccagacctgcgagctgcccagcgccgccagccccgcccccgactaccccaccccctgccagtaccccgtggacggcgcccagcagagcgacctgaccggccccgactgccccagaagccccggcctgcaggaggcccccagcagctacgaccccctggccctgagcgagctgcccggcctgttcgactgcgagatgctggacgccgtggacccccagcacaacggctacgtgctggtgaactag

SEQ ID NO: 98007 - DNA, 1881 bp, Artificial Sequence
  Description of Artificial Sequence: Synthetic coding sequence
atgcagagagccgacagcgagcagcccagcaagagacccagatgcgacgacagccccagaacccccagcaacacccccagcgccgaggccgactggagccccggcctggagctgcaccccgactacaagacctggggccccgagcaggtgtgcagcttcctgagaagaggcggcttcgaggagcccgtgctgctgaagaacatcagagagaacgagatcaccggcgccctgctgccctgcctggacgagagcagattcgagaacctgggcgtgagcagcctgggcgagagaaagaagctgctgagctacatccagagactggtgcagatccacgtggacaccatgaaggtgatcaacgaccccatccacggccacatcgagctgcaccccctgctggtgagaatcatcgacaccccccagttccagagactgagatacatcaagcagctgggcggcggctactacgtgttccccggcgccagccacaacagattcgagcacagcctgggcgtgggctacctggccggctgcctggtgcacgccctgggcgagaagcagcccgagctgcagatcagcgagagagacgtgctgtgcgtgcagatcgccggcctgtgccacgacctgggccacggccccttcagccacatgttcgacggcagattcatccccctggccagacccgaggtgaagtggacccacgagcagggcagcgtgatgatgttcgagcacctgatcaacagcaacggcatcaagcccgtgatggagcagtacggcctgatccccgaggaggacatctgcttcatcaaggagcagatcgtgggccccctggagagccccgtggaggacagcctgtggccctacaagggcagacccgagaacaagagcttcctgtacgagatcgtgagcaacaagagaaacggcatcgacgtggacaagtgggactacttcgccagagactgccaccacctgggcatccagaacaacttcgactacaagagattcatcaagttcgccagagtgtgcgaggtggacaacgagctgagaatctgcgccagagacaaggaggtgggcaacctgtacgacatgttccacaccagaaacagcctgcacagaagagcctaccagcacaaggtgggcaacatcatcgacaccatgatcaccgacgccttcctgaaggccgacgactacatcgagatcaccggcgccggcggcaagaagtacagaatcagcaccgccatcgacgacatggaggcctacaccaagctgaccgacaacatcttcctggagatcctgtacagcaccgaccccaagctgaaggacgccagagagatcctgaagcagatcgagtacagaaacctgttcaagtacgtgggcgagacccagcccaccggccagatcaagatcaagagagaggactacgagagcctgcccaaggaggtggccagcgccaagcccaaggtgctgctggacgtgaagctgaaggccgaggacttcatcgtggacgtgatcaacatggactacggcatgcaggagaagaaccccatcgaccacgtgagcttctactgcaagaccgcccccaacagagccatcagaatcaccaagaaccaggtgagccagctgctgcccgagaagttcgccgagcagctgatcagagtgtactgcaagaaggtggacagaaagagcctgtacgccgccagacagtacttcgtgcagtggtgcgccgacagaaacttcaccaagccccaggacggcgacgtgatcgcccccctgatcaccccccagaagaaggagtggaacgacagcaccagcgtgcagaaccccaccagactgagagaggccagcaagagcagagtgcagctgttcaaggacgaccccatgtag

SEQ ID NO: 98008 - DNA, 513 bp, Artificial Sequence
  Description of Artificial Sequence: Synthetic coding sequence
atgttcgacggcagattcatccccctggccagacccgaggtgaagtggacccacgagcagggcagcgtgatgatgttcgagcacctgatcaacagcaacggcatcaagcccgtgatggagcagtacggcctgatccccgaggaggacatctgcttcatcaaggagcagatcgtgggccccctggagagccccgtggaggacagcctgtggccctacaagggcagacccgagaacaagagcttcctgtacgagatcgtgagcaacaagagaaacggcatcgacgtggacaagtgggactacttcgccagagactgccaccacctgggcatccagaacaacttcgactacaagagattcatcaagttcgccagagtgtgcgaggtggacaacgagctgagaatctgcgccagagacaaggaggtgggcaacctgtacgacatgttccacaccagaaacagcctgcacagaagagcctaccagcacaaggtgggcaacatcatcgacaccatgtag

SEQ ID NO: 98009 - DNA, 1326 bp, Artificial Sequence
  Description of Artificial Sequence: Synthetic coding sequence
atggagatcagactggacaccctgagcgccagcctgggcagaagcagcaccctgaacaactgcaacctggaggacaagctggcctggtacgagggcgaggcctacatgtggcaccactggaagcccttccccgagaaccccctgtggacctgcctggacttccagatcgcccaggtgggcccctgggaccactgcagcagctgcatcagacacaccagactgaagagcagctgcagcgacatggacctgctgcacagctggagaagcagcagcttcggcaacttcgacagattcagaaacaacagcctgagcaagcccgacgacagcaccgaggcccacgagggcgaccccaccaacggcagcggcgagcagagcaagaccagcaacaacggcggcggcctgggcaagaagatgagagccatcagctggaccatgaagaagaaggtgggcaagaagtacatcaaggccctgagcgaggagaaggacgaggaggacggcgagaacgcccacccctacagaaacagcgaccccgtgatcggcacccacaccgagaaggtgagcctgaaggccagcgacagcatggacagcctgtacagcggccagagcagcagcagcggcatcaccagctgcagcgacggcaccagcaacagagacagcttcagactggacgacgacggcccctacagcggccccttctgcggcagagccagagtgcacaccgacttcacccccagcccctacgacaccgacagcctgaagatcaagaagggcgacatcatcgacatcatctgcaagacccccatgggcatgtggaccggcatgctgaacaacaaggtgggcaacttcaagttcatctacgtggacgtgatcagcgaggaggaggccgcccccaagaagatcaaggccaacagaagaagcaacagcaagaagagcaagaccctgcaggagttcctggagagaatccacctgcaggagtacaccagcaccctgctgctgaacggctacgagaccctggaggacctgaaggacatcaaggagagccacctgatcgagctgaacatcgagaaccccgacgacagaagaagactgctgagcgccgccgagaacttcctggaggaggagatcatccaggagcaggagaacgagcccgagcccctgagcctgagcagcgacatcagcctgaacaagagccagctggacgactgccccagagacagcggctgctacatcagcagcggcaacagcgacaacggcaaggaggacctggagagcgagaacctgagcgacatggtgcacaagatcatcatcaccgagcccagcgactag

SEQ ID NO: 98010 - DNA, 618 bp, Artificial Sequence
  Description of Artificial Sequence: Synthetic coding sequence
atgctgaagagaaagcccagcaacgtgagcgagaaggagaagcaccagaagcccaagaagggcgacatcatcgacatcatctgcaagacccccatgggcatgtggaccggcatgctgaacaacaaggtgggcaacttcaagttcatctacgtggacgtgatcagcgaggaggaggccgcccccaagaagatcaaggccaacagaagaagcaacagcaagaagagcaagaccctgcaggagttcctggagagaatccacctgcaggagtacaccagcaccctgctgctgaacggctacgagaccctggaggacctgaaggacatcaaggagagccacctgatcgagctgaacatcgagaaccccgacgacagaagaagactgctgagcgccgccgagaacttcctggaggaggagatcatccaggagcaggagaacgagcccgagcccctgagcctgagcagcgacatcagcctgaacaagagccagctggacgactgccccagagacagcggctgctacatcagcagcggcaacagcgacaacggcaaggaggacctggagagcgagaacctgagcgacatggtgcacaagatcatcatcaccgagcccagcgactag

SEQ ID NO: 98011 - DNA, 1122 bp, Artificial Sequence
  Description of Artificial Sequence: Synthetic coding sequence
atgctgaagagaaagcccagcaacgtgagcgagaaggagaagcaccagaagcccaagagaagcagcagcttcggcaacttcgacagattcagaaacaacagcctgagcaagcccgacgacagcaccgaggcccacgagggcgaccccaccaacggcagcggcgagcagagcaagaccagcaacaacggcggcggcctgggcaagaagatgagagccatcagctggaccatgaagaagaaggtgggcaagaagtacatcaaggccctgagcgaggagaaggacgaggaggacggcgagaacgcccacccctacagaaacagcgaccccgtgatcggcacccacaccgagaaggtgagcctgaaggccagcgacagcatggacagcctgtacagcggccagagcagcagcagcggcatcaccagctgcagcgacggcaccagcaacagagacagcttcagactggacgacgacggcccctacagcggccccttctgcggcagagccagagtgcacaccgacttcacccccagcccctacgacaccgacagcctgaagatcaagaagggcgacatcatcgacatcatctgcaagacccccatgggcatgtggaccggcatgctgaacaacaaggtgggcaacttcaagttcatctacgtggacgtgatcagcgaggaggaggccgcccccaagaagatcaaggccaacagaagaagcaacagcaagaagagcaagaccctgcaggagttcctggagagaatccacctgcaggagtacaccagcaccctgctgctgaacggctacgagaccctggaggacctgaaggacatcaaggagagccacctgatcgagctgaacatcgagaaccccgacgacagaagaagactgctgagcgccgccgagaacttcctggaggaggagatcatccaggagcaggagaacgagcccgagcccctgagcctgagcagcgacatcagcctgaacaagagccagctggacgactgccccagagacagcggctgctacatcagcagcggcaacagcgacaacggcaaggaggacctggagagcgagaacctgagcgacatggtgcacaagatcatcatcaccgagcccagcgactag

SEQ ID NO: 98012 - DNA, 1008 bp, Artificial Sequence
  Description of Artificial Sequence: Synthetic coding sequence
atgggcagcgccagccccggcctgagcagcgtgagccccagccacctgctgctgccccccgacaccgtgagcagaaccggcctggagaaggccgccgccggcgccgtgggcctggagagaagagactggagccccagcccccccgccacccccgagcagggcctgagcgccttctacctgagctacttcgacatgctgtaccccgaggacagcagctgggccgccaaggcccccggcgccagcagcagagaggagccccccgaggagcccgagcagtgccccgtgatcgacagccaggcccccgccggcagcctggacctggtgcccggcggcctgaccctggaggagcacagcctggagcaggtgcagagcatggtggtgggcgaggtgctgaaggacatcgagaccgcctgcaagctgctgaacatcaccgccgaccccatggactggagccccagcaacgtgcagaagtggctgctgtggaccgagcaccagtacagactgccccccatgggcaaggccttccaggagctggccggcaaggagctgtgcgccatgagcgaggagcagttcagacagagaagccccctgggcggcgacgtgctgcacgcccacctggacatctggaagagcgccgcctggatgaaggagagaaccagccccggcgccatccactactgcgccagcaccagcgaggagagctggaccgacagcgaggtggacagcagctgcagcggccagcccatccacctgtggcagttcctgaaggagctgctgctgaagccccacagctacggcagattcatcagatggctgaacaaggagaagggcatcttcaagatcgaggacagcgcccaggtggccagactgtggggcatcagaaagaacagacccgccatgaactacgacaagctgagcagaagcatcagacagtactacaagaagggcatcatcagaaagcccgacatcagccagagactggtgtaccagttcgtgcaccccatctag

SEQ ID NO: 98013 - DNA, 960 bp, Artificial Sequence
  Description of Artificial Sequence: Synthetic coding sequence
atgggcagcgccagccccggcctgagcagcgtgagccccagccacctgctgctgccccccgacaccgtgagcagaaccggcctggagaaggccgccgccggcgccgtgggcctggagagaagagactggagccccagcccccccgccacccccgagcagggcctgagcgccttctacctgagctacttcgacatgctgtaccccgaggacagcagctgggccgccaaggcccccggcgccagcagcagagaggagccccccgaggagcccgagcagtgccccgtgatcgacagccaggcccccgccggcagcctggacctggtgcccggcggcctgaccctggaggagcacagcctggagcaggtgcagagcatggtggtgggcgaggtgctgaaggacatcgagaccgcctgcaagctgctgaacatcaccgccgaccccatggactggagccccagcaacgtgcagaagtggctgctgtggaccgagcaccagtacagactgccccccatgggcaaggccttccaggagctggccggcaaggagctgtgcgccatgagcgaggagcagttcagacagagaagccccctgggcggcgacgtgctgcacgcccacctggacatctggaagagcgccagcaccagcgaggagagctggaccgacagcgaggtggacagcagctgcagcggccagcccatccacctgtggcagttcctgaaggagctgctgctgaagccccacagctacggcagattcatcagatggctgaacaaggagaagggcatcttcaagatcgaggacagcgcccaggtggccagactgtggggcatcagaaagaacagacccgccatgaactacgacaagctgagcagaagcatcagacagtactacaagaagggcatcatcagaaagcccgacatcagccagagactggtgtaccagttcgtgcaccccatctag

SEQ ID NO: 98014 - DNA, 1218 bp, Artificial Sequence
  Description of Artificial Sequence: Synthetic coding sequence
atggccgccagcggcaagaccagcaagagcgagcccaaccacgtgatcttcaagaagatcagcagagacaagagcgtgaccatctacctgggcaacagagactacatcgaccacgtgagccaggtgcagcccgtggacggcgtggtgctggtggaccccgacctggtgaagggcaagaaggtgtacgtgaccctgacctgcgccttcagatacggccaggaggacatcgacgtgatcggcctgaccttcagaagagacctgtacttcagcagagtgcaggtgtacccccccgtgggcgccgccagcacccccaccaagctgcaggagagcctgctgaagaagctgggcagcaacacctaccccttcctgctgaccttccccgactacctgccctgcagcgtgatgctgcagcccgccccccaggacagcggcaagagctgcggcgtggacttcgaggtgaaggccttcgccaccgacagcaccgacgccgaggaggacaagatccccaagaagagcagcgtgagactgctgatcagaaaggtgcagcacgcccccctggagatgggcccccagcccagagccgaggccgcctggcagttcttcatgagcgacaagcccctgcacctggccgtgagcctgaacaaggagatctacttccacggcgagcccatccccgtgaccgtgaccgtgaccaacaacaccgagaagaccgtgaagaagatcaaggccttcgtggagcaggtggccaacgtggtgctgtacagcagcgactactacgtgaagcccgtggccatggaggaggcccaggagaaggtgccccccaacagcaccctgaccaagaccctgaccctgctgcccctgctggccaacaacagagagagaagaggcatcgccctggacggcaagatcaagcacgaggacaccaacctggccagcagcaccatcatcaaggagggcatcgacagaaccgtgctgggcatcctggtgagctaccagatcaaggtgaagctgaccgtgagcggcatgaccggcagacagaaggccagcgaggtggccaccgaggtgcccttcagactgatgcacccccagcccgaggaccccggccagttcagctaccaggacgccaacctggtgttcgaggagttcgccagacacaacctgaaggacgccggcgaggccgaggagggcaagagagacaagaacgacgtggacgagtag

SEQ ID NO: 98015 - DNA, 1218 bp, Artificial Sequence
  Description of Artificial Sequence: Synthetic coding sequence
atggccgccagcggcaagaccagcaagagcgagcccaaccacgtgatcttcaagaagatcagcagagacaagagcgtgaccatctacctgggcaacagagactacatcgaccacgtgagccaggtgcagcccgtggacggcgtggtgctggtggaccccgacctggtgaagggcaagaaggtgtacgtgaccctgacctgcgccttcagatacggccaggaggacatcgacgtgatcggcctgaccttcagaagagacctgtacttcagcagagtgcaggtgtacccccccgtgggcgccgccagcacccccaccaagctgcaggagagcctgctgaagaagctgggcagcaacacctaccccttcctgctgaccttccccgactacctgccctgcagcgtgatgctgcagcccgccccccaggacagcggcaagagctgcggcgtggacttcgaggtgaaggccttcgccaccgacagcaccgacgccgaggaggacaagatccccaagaagagcagcgtgagactgctgatcagaaaggtgcagcacgcccccctggagatgggcccccagcccagagccgaggccgcctggcagttcttcatgagcgacaagcccctgcacctggccgtgagcctgaacaaggagatctacttccacggcgagcccatccccgtgaccgtgaccgtgaccaacaacaccgagaagaccgtgaagaagatcaaggccttcgtggagcaggtggccaacgtggtgctgtacagcagcgactactacgtgaagcccgtggccatggaggaggcccaggagaaggtgccccccaacagcaccctgaccaagaccctgaccctgctgcccctgctggccaacaacagagagagaagaggcatcgccctggacggcaagatcaagcacgaggacaccaacctggccagcagcaccatcatcaaggagggcatcgacagaaccgtgctgggcatcctggtgagctaccagatcaaggtgaagctgaccgtgagcggcttcctgggcgagctgaccagcagcgaggtggccaccgaggtgcccttcagactgatgcacccccagcccgaggaccccgccaaggagagctaccaggacgccaacctggtgttcgaggagttcgccagacacaacctgaaggacgccggcgaggccgaggagggcaagagagacaagaacgacgtggacgagtag

SEQ ID NO: 98016 - DNA, 510 bp, Artificial Sequence
  Description of Artificial Sequence: Synthetic coding sequence
atggccgccagcggcaagaccagcaagagcgagcccaaccacgtgatcttcaagaagatcagcagagacaagagcgtgaccatctacctgggcaacagagactacatcgaccacgtgagccaggtgcagcccgtggacggcgtggtgctggtggaccccgacctggtgaagggcaagaaggtgtacgtgaccctgacctgcgccttcagatacggccaggaggacatcgacgtgatcggcctgaccttcagaagagacctgtacttcagcagagtgcaggtgtacccccccgtgggcgccgccagcacccccaccaagctgcaggagagcctgctgaagaagctgggcagcaacacctaccccttcctgctgaccttccccgactacctgccctgcagcgtgatgctgcagcccgccccccaggacagcggcaagagctgcggcgtggacttcgaggtgaaggccttcgccaccgacagcaccgacgccgaggaggacaagatcccctag

SEQ ID NO: 98017 - DNA, 708 bp, Artificial Sequence
  Description of Artificial Sequence: Synthetic coding sequence
atgctgcagcccgccccccaggacagcggcaagagctgcggcgtggacttcgaggtgaaggccttcgccaccgacagcaccgacgccgaggaggacaagatccccaagaagagcagcgtgagactgctgatcagaaaggtgcagcacgcccccctggagatgggcccccagcccagagccgaggccgcctggcagttcttcatgagcgacaagcccctgcacctggccgtgagcctgaacaaggagatctacttccacggcgagcccatccccgtgaccgtgaccgtgaccaacaacaccgagaagaccgtgaagaagatcaaggccttcgtggagcaggtggccaacgtggtgctgtacagcagcgactactacgtgaagcccgtggccatggaggaggcccaggagaaggtgccccccaacagcaccctgaccaagaccctgaccctgctgcccctgctggccaacaacagagagagaagaggcatcgccctggacggcaagatcaagcacgaggacaccaacctggccagcagcaccatcatcaaggagggcatcgacagaaccgtgctgggcatcctggtgagctaccagatcaaggtgaagctgaccgtgagcggcttcctgggcgagctgaccagcagcgaggtggccaccgaggtgcccttcagactgatgcacccccagcccgaggaccccggcaagtag

SEQ ID NO: 98018 - DNA, 204 bp, Artificial Sequence
  Description of Artificial Sequence: Synthetic coding sequence
atggccgccagcggcaagaccagcaagagcgagcccaaccacgtgatcttcaagaagatcagcagagacaagagcgtgagcggcgcccaggtgaccatctacctgggcaacagagactacatcgaccacgtgagccaggtgcagcccgtggacggcgtggtgctggtggaccccgacctggtgaagggcaagaaggtgagctag

SEQ ID NO: 98019 - DNA, 633 bp, Artificial Sequence
  Description of Artificial Sequence: Synthetic coding sequence
atggccaccgagaccgtggagctgcacaagctgaagctggccgagctgaagcaggagtgcctggccagaggcctggagaccaagggcatcaagcaggacctgatccacagactgcaggcctacctggaggagcacgccgaggaggaggccaacgaggaggacgtgctgggcgacgagaccgaggaggaggagaccaagcccatcgagctgcccgtgaaggaggaggagccccccgagaagaccgtggacgtggccgccgagaagaaggtggtgaagatcaccagcgagatcccccagaccgagagaatgcagaagagagccgagagattcaacgtgcccgtgagcctggagagcaagaaggccgccagagccgccagattcggcatcagcagcgtgcccaccaagggcctgagcagcgacaacaagcccatggtgaacctggacaagctgaaggagagagcccagagattcggcctgaacgtgagcagcatcagcagaaagagcgaggacgacgagaagctgaagaagagaaaggagagattcggcatcgtgaccagcagcgccggcaccggcaccaccgaggacaccgaggccaagaagagaaagagagccgagagattcggcatcgcctag

SEQ ID NO: 98020 - DNA, 453 bp, Artificial Sequence
  Description of Artificial Sequence: Synthetic coding sequence
atggaggaggagaccaagcccatcgagctgcccgtgaaggaggaggagccccccgagaagaccgtggacgtggccgccgagaagaaggtggtgaagatcaccagcgagatcccccagaccgagagaatgcagaagagagccgagagattcaacgtgcccgtgagcctggagagcaagaaggccgccagagccgccagattcggcatcagcagcgtgcccaccaagggcctgagcagcgacaacaagcccatggtgaacctggacaagctgaaggagagagcccagagattcggcctgaacgtgagcagcatcagcagaaagagcgaggacgacgagaagctgaagaagagaaaggagagattcggcatcgtgaccagcagcgccggcaccggcaccaccgaggacaccgaggccaagaagagaaagagagccgagagattcggcatcgcctag

SEQ ID NO: 98021 - DNA, 633 bp, Artificial Sequence; identical to SEQ ID NO: 98019
  Description of Artificial Sequence: Synthetic coding sequence

SEQ ID NO: 98022 - DNA, 879 bp, Artificial Sequence
  Description of Artificial Sequence: Synthetic coding sequence
atggccggcaagaagaacgtgctgagcagcctggccgtgtacgccgaggacagcgagcccgagagcgacggcgaggccggcatcgaggccgtgggcagcgccgccgaggagaagggcggcctggtgagcgacgcctacggcgaggacgacttcagcagactgggcggcgacgaggacggctacgaggaggaggaggacgagaacagcagacagagcgacaacaccgaggccgagaagagagacccccaggagctggtggccagcttcagcgagagagtgagaaacatgagccccgacgagatcaagatcccccccgagccccccggcagatgcagcaaccacctgcaggacaagatccagaagctgtacgagagaaagatcaaggagggcatggacatgaactacatcatccagagaaagaaggagttcagaaaccccagcatctacgagaagctgatccagttctgcgccatcgacgagctgggcaccaactaccccaaggacatgttcgacccccacggctggagcgaggacagctactacgaggccctggccaaggcccagaagatcgagatggacaagctggagaaggccaagaaggagagaaccaagatcgagttcgtgaccggcaccaagaagggcaccaccaccaacgccaccagcaccaccaccaccaccgccagcaccgccgtggccgacgcccagaagagaaagagcaagtgggacagcgccatccccgtgaccaccatcgcccagcccaccatcctgaccaccaccgccaccctgcccgccgtggtgaccgtgaccaccagcgccagcggcagcaagaccaccgtgatcagcgccgtgggcaccatcgtgaagaaggccaagcagtag

SEQ ID NO: 98023 - DNA, 927 bp, Artificial Sequence
  Description of Artificial Sequence: Synthetic coding sequence
atggccggcaagaagaacgtgctgagcagcctggccgtgtacgccgaggacagcgagcccgagagcgacggcgaggccggcatcgaggccgtgggcagcgccgccgaggagaagggcggcctggtgagcgacgcctacggcgaggacgacttcagcagactgggcggcgacgaggacggctacgaggaggaggaggacgagaacagcagacagagcgaggacgacgacagcgagaccgagaagcccgaggccgacgaccccaaggacaacaccgaggccgagaagagagacccccaggagctggtggccagcttcagcgagagagtgagaaacatgagccccgacgagatcaagatcccccccgagccccccggcagatgcagcaaccacctgcaggacaagatccagaagctgtacgagagaaagatcaaggagggcatggacatgaactacatcatccagagaaagaaggagttcagaaaccccagcatctacgagaagctgatccagttctgcgccatcgacgagctgggcaccaactaccccaaggacatgttcgacccccacggctggagcgaggacagctactacgaggccctggccaaggcccagaagatcgagatggacaagctggagaaggccaagaaggagagaaccaagatcgagttcgtgaccggcaccaagaagggcaccaccaccaacgccaccagcaccaccaccaccaccgccagcaccgccgtggccgacgcccagaagagaaagagcaagtgggacagcgccatccccgtgaccaccatcgcccagcccaccatcctgaccaccaccgccaccctgcccgccgtggtgaccgtgaccaccagcgccagcggcagcaagaccaccgtgatcagcgccgtgggcaccatcgtgaagaaggccaagcagtag

SEQ ID NO: 98024 - DNA, 507 bp, Artificial Sequence
  Description of Artificial Sequence: Synthetic coding sequence
atggccggcaagaagaacgtgctgagcagcctggccgtgtacgccgaggacagcgagcccgagagcgacggcgaggccggcatcgaggccgtgggcagcgccgccgaggagaagggcggcctggtgagcgacgcctacggcgaggacgacttcagcagactgggcggcgacgaggacggctacgaggaggaggaggacgagaacagcagacagagcgaggacgacgacagcgagaccgagaagcccgaggccgacgaccccaaggacaacaccgaggccgagaagagagacccccaggagctggtggccagcttcagcgagagagtgagaaacatgagccccgacgagatcaagatcccccccgagccccccggcagatgcagcaaccacctgcaggacaagatccagaagctgtacgagagaaagatcaaggagggcatggacatgaactacatcatccagagaaagaaggagttcagaaaccccagccagggccccgagaactag

SEQ ID NO: 98025 - DNA, 927 bp, Artificial Sequence; identical to SEQ ID NO: 98023
  Description of Artificial Sequence: Synthetic coding sequence

SEQ ID NO: 98026 - DNA, 366 bp, Artificial Sequence
  Description of Artificial Sequence: Synthetic coding sequence
atgagcttcatcttcgagtggatctacaacggcttcagcagcgtgctgcagttcctgggcctgtacaagaagagcggcaagctggtgttcctgggcctggacaacgccggcaagaccaccctgctgcacatgctgaaggacgacagactgggccagcacgtgcccaccctgcaccccaccagcgaggagctgaccatcgccggcatgaccttcaccaccttcgacctgggcggccacgagcaggccagaagagtgtggaagaactacctgcccgccatcaacggcatcgtgttcctggtggactgcgccgaccacagcagactggtggagagcaaggtggagctgaacgtgtgcttcgtgctgtag

SEQ ID NO: 98027 - DNA, 597 bp, Artificial Sequence
  Description of Artificial Sequence: Synthetic coding sequence
atgagcttcatcttcgagtggatctacaacggcttcagcagcgtgctgcagttcctgggcctgtacaagaagagcggcaagctggtgttcctgggcctggacaacgccggcaagaccaccctgctgcacatgctgaaggacgacagactgggccagcacgtgcccaccctgcaccccaccagcgaggagctgaccatcgccggcatgaccttcaccaccttcgacctgggcggccacgagcaggccagaagagtgtggaagaactacctgcccgccatcaacggcatcgtgttcctggtggactgcgccgaccacagcagactggtggagagcaaggtggagctgaacgccctgatgaccgacgagaccatcagcaacgtgcccatcctgatcctgggcaacaagatcgacagaaccgacgccatcagcgaggagaagctgagagagatcttcggcctgtacggccagaccaccggcaagggcaacgtgaccctgaaggagctgaacgccagacccatggaggtgttcatgtgcagcgtgctgaagagacagggctacggcgagggcttcagatggctgagccagtacatcgactag

SEQ ID NO: 98028 - DNA, 597 bp, Artificial Sequence; identical to SEQ ID NO: 98027
  Description of Artificial Sequence: Synthetic coding sequence

SEQ ID NO: 98029 - DNA, 597 bp, Artificial Sequence; identical to SEQ ID NO: 98027
  Description of Artificial Sequence: Synthetic coding sequence

SEQ ID NO: 98030 - DNA, 597 bp, Artificial Sequence; identical to SEQ ID NO: 98027
  Description of Artificial Sequence: Synthetic coding sequence

SEQ ID NO: 98031 - DNA, 354 bp, Artificial Sequence
  Description of Artificial Sequence: Synthetic coding sequence
atgggcctgagcttctggtggaccgtgcagatcatcctggccagctggaaccccaagctgagcctgatgatctactgcagcagcctgctgaccctggcccccaacgccctgatgaccgacgagaccatcagcaacgtgcccatcctgatcctgggcaacaagatcgacagaaccgacgccatcagcgaggagaagctgagagagatcttcggcctgtacggccagaccaccggcaagggcaacgtgaccctgaaggagctgaacgccagacccatggaggtgttcatgtgcagcgtgctgaagagacagggctacggcgagggcttcagatggctgagccagtacatcgactag

SEQ ID NO: 98032 - DNA, 597 bp, Artificial Sequence; identical to SEQ ID NO: 98027
  Description of Artificial Sequence: Synthetic coding sequence

SEQ ID NO: 98033 - DNA, 348 bp, Artificial Sequence
  Description of Artificial Sequence: Synthetic coding sequence
tgaagcttctggtggaccgtgcagatcatcctggccagctggaaccccaagctgagcctgatgatctactgcagcagcctgctgaccctggcccccaacgccctgatgaccgacgagaccatcagcaacgtgcccatcctgatcctgggcaacaagatcgacagaaccgacgccatcagcgaggagaagctgagagagatcttcggcctgtacggccagaccaccggcaagggcaacgtgaccctgaaggagctgaacgccagacccatggaggtgttcatgtgcagcgtgctgaagagacagggctacggcgagggcttcagatggctgagccagtacatcgactag

SEQ ID NO: 98034 - DNA, 468 bp, Artificial Sequence
  Description of Artificial Sequence: Synthetic coding sequence
atgctgaaggacgacagactgggccagcacgtgcccaccctgcaccccaccagcgaggagctgaccatcgccggcatgaccttcaccaccttcgacctgggcggccacgagcaggccagaagagtgtggaagaactacctgcccgccatcaacggcatcgtgttcctggtggactgcgccgaccacagcagactggtggagagcaaggtggagctgaacgccctgatgaccgacgagaccatcagcaacgtgcccatcctgatcctgggcaacaagatcgacagaaccgacgccatcagcgaggagaagctgagagagatcttcggcctgtacggccagaccaccggcaagggcaacgtgaccctgaaggagctgaacgccagacccatggaggtgttcatgtgcagcgtgctgaagagacagggctacggcgagggcttcagatggctgagccagtacatcgactag

SEQ ID NO: 98035 - DNA, 393 bp, Artificial Sequence
  Description of Artificial Sequence: Synthetic coding sequence
atgaccttcaccaccttcgacctgggcggccacgtgcaggccagaagagtgtggaagaactacctgcccgccatcaacggcatcgtgttcctggtggactgcgccgaccacgagagactgctggagagcaaggaggagctggacagcctgatgaccgacgagaccatcgccaacgtgcccatcctgatcctgggcaacaagatcgacagacccgaggccatcagcgaggagagactgagagagatgttcggcctgtacggccagaccaccggcaagggcagcatcagcctgaaggagctgaacgccagacccctggaggtgttcatgtgcagcgtgctgaagagacagggctacggcgagggcttcagatggatggcccagtacatcgactag

SEQ ID NO: 98036 - DNA, 597 bp, Artificial Sequence
  Description of Artificial Sequence: Synthetic coding sequence
atgagcttcatcttcgactggatctacagcggcttcagcagcgtgctgcagttcctgggcctgtacaagaagaccggcaagctggtgttcctgggcctggacaacgccggcaagaccaccctgctgcacatgctgaaggacgacagactgggccagcacgtgcccaccctgcaccccaccagcgaggagctgaccatcgccggcatgaccttcaccaccttcgacctgggcggccacgtgcaggccagaagagtgtggaagaactacctgcccgccatcaacggcatcgtgttcctggtggactgcgccgaccacgagagactgctggagagcaaggaggagctggacagcctgatgaccgacgagaccatcgccaacgtgcccatcctgatcctgggcaacaagatcgacagacccgaggccatcagcgaggagagactgagagagatgttcggcctgtacggccagaccaccggcaagggcagcatcagcctgaaggagctgaacgccagacccctggaggtgttcatgtgcagcgtgctgaagagacagggctacggcgagggcttcagatggatggcccagtacatcgactag

SEQ ID NO: 98037 - DNA, 597 bp, Artificial Sequence; identical to SEQ ID NO: 98036
  Description of Artificial Sequence: Synthetic coding sequence

SEQ ID NO: 98038 - DNA, 312 bp, Artificial Sequence
  Description of Artificial Sequence: Synthetic coding sequence
atgagcttcatcttcgactggatctacagcggcttcagcagcgtgctgcagttcctgggcctgtacaagaagaccggcaagctggtgttcctgggcctggacaacgccggcaagaccaccctgctgcacatgctgaaggacgacagactgggccagcacgtgcccaccctgcaccccaccagcgaggagctgaccatcgccggcatgaccttcaccaccttcgacctgggcggccacgtgcaggccagaagagtgtggaagaactacctgcccgccatcaacggcatcgtgttcctggtggactgcgcctag

SEQ ID NO: 98039 - DNA, 393 bp, Artificial Sequence; identical to SEQ ID NO: 98035
  Description of Artificial Sequence: Synthetic coding sequence

SEQ ID NO: 98040 - DNA, 513 bp, Artificial Sequence
  Description of Artificial Sequence: Synthetic coding sequence
atgagcttcatcttcgactggatctacagcggcttcagcagcgtgctgcagttcctgggcctgtacaagaagaccggcaagctggtgttcctgggcctggacaacgccggcaagaccaccctgctgcacatgctgaaggacgacagactgggccagcacgtgcccaccctgcaccccaccagcgaggagctgaccatcgccggcatgaccttcaccaccttcgacctgggcggccacgtgcaggccagaagagtgtggaagaactacctgcccgccatcaacggcatcgtgttcctggtggactgcgccgaccacgagagactgctggagagcaaggaggagctggacagcctgatgaccgacgagaccatcgccaacgtgcccatcctgatcctgggcaacaagatcgacagacccgaggccatcagcgaggagagactgagagagatgttcggcctgtacggccagaccaccggcaagggcagcatcagcctgaaggagctgaacgcctag

SEQ ID NO: 98041 - DNA, 393 bp, Artificial Sequence; identical to SEQ ID NO: 98035
  Description of Artificial Sequence: Synthetic coding sequence

SEQ ID NO: 98042 - DNA, 393 bp, Artificial Sequence; identical to SEQ ID NO: 98035
  Description of Artificial Sequence: Synthetic coding sequence

SEQ ID NO: 98043 - DNA, 2796 bp, Artificial Sequence
  Description of Artificial Sequence: Synthetic coding sequence
atgagagccctggtgctgctgggctgcctgctggccagcctgctgttcagcggccaggccgagctgcaggtgagcgccagcggcggcaccgaggacgtgggcaacctgctggagaaccacttcagcgccggcgacgccagcctggaggagaaggagagagccctgtacgccgacaccgccccccaggacaagaagctgctgctgcactaccccgacggcagagaggccgagagccccaagaagacccccgccagcgccgccagcgccggccccgaccccgaggccagcctgagcaacgccagcgccaccgagagccccccccccggcgagagagacgacagagacgccgccggccccggcgaggagaagaacggcccccccgtggccagcgccctgccccccggcggcgccaagggccccgtggaggaggagtggcccgagcccagcagcggcgagggccagggcgaggaggagaccggcttcggcctgcccaccgagggcaccgccagcggcgaggccggcggccaggccggcggccacgagctgcccgaggaggtgcaggaggtgcagggcgacagcctggtgcagggcgccgtggccggcaccgccgagcccaaggccgagggcgccagcccccacagcgagggcgacggcgtgggccccctgaacgccgaggccgagggcagccccggccccggcgaggagcccgccgtgcccgagggcgcccccgacgtggccgccgtgggcggcgagagcgagcccgacatcgacacccaggccagcgagggcaccgaggaccagggcgagcccggccccgccgccgaggccagcgccgagcccggcggcgcccagagcgtgaaggccggcgacaccgaggagaaccagagccccgagatgaccgaggaggacgccgacgaggccagcagcgaggaggagagcggcgacggcagcggcagcgaggaggagggcggcgtgcccagcgaggaggagagcgaggaggacagcggcgacggcgccagcagcgaggaggccgagggcgccagcgaggaggccaccgagccccaggaggccggcgagccccaggaggccagagagccccaggagggcggcgacctgcaggaggccgaggagagccaggagggcggcgacccccaggaggccgaggagccccaggagggcggcgccccccaggagggcggcgagccccaggagggcggcgacccccaggaggccagagagccccaggaggccagagagccccaggagggcgccgagctgcccgaggccaccggcaccaccagccacagagacagaggcgcccagcccggccccgaggagctgaacaccgagagcatgggcagcgagaccctggacatgaaggccgaggagcccgaggagggccaccagagagagagccccatcatcgtggcccaggaggagaccgaggacgccaacgaggaggcccccctgagagacagaagccacatcgagaagaccctgatgctgaacgaggacaagcccagcgacgactacagcgccgtgctgcagagactgagaaagatctaccacagcagcatcaagcccctggagcagagctacaagtacaacgagctgagacagcacgagatcaccgacggcgagatcaccagcaagcccatggtgctgttcctgggcccctggagcgtgggcaagagcaccatgatcaactacctgctgggcctggagaacaccagataccagctgtacaccggcgccgagcccaccaccagcgagttcaccgtgctgatgcacggccccaagctgaagaccatcgagggcatcgtgatggccgccgacagcgccagaagcttcagccccctggagaagttcggccagaacttcctggagaagctgatcggcatcgaggtgccccacaagctgctggagagagtgaccttcgtggacacccccggcatcatcgagaacagaaagcagcaggagagaggctaccccttcaacgacgtgtgccagtggttcatcgacagagccgacctgatcttcgtggtgttcgaccccaccaagctggacgtgggcctggagctggagatgctgttcagacagctgaagggcagagagagccagatcagaatcatcctgaacaaggccgacaacctggccacccagatgctgatgagagtgtacggcgccctgttctggagcctggcccccctgatcaacgtgaccgagccccccagagtgtacgtgagcagcttctggccccaggagtacaagcccgacacccaccaggagctgttcctgcaggaggagatcagcctgctggaggacctgaaccaggtgatcgagaacagactggagaacaagatcgccttcatcagacagcacgccatcagagtgagaatccacgccctgctggtggacagatacctgcagacctacaaggacaagatgaccttcttcagcgacggcgagctggtgttcaaggacatcgtggaggaccccgacaagttctacatcttcaagaccatcctggccaagaccaacgtgagcaagttcgacctgcccaacagagaggcctacaaggacttcttcggcatcaaccccatcagcagcttcaagctgctgagccagcagtgcagctacatgggcggctgcttcctggagaagatcgagagagccatcacccaggagctgcccggcctgctgggcagcctgggcctgggcaagaaccccggcgccctgaactgcgacaagaccggctgcagcgagacccccaagaacagatacagaaagcactag

SEQ ID NO: 98044 - DNA, 1422 bp, Artificial Sequence
  Description of Artificial Sequence: Synthetic coding sequence
atgagagccctggtgctgctgggctgcctgctggccagcctgctgttcagcggccaggccgaggagaccgaggacgccaacgaggaggcccccctgagagacagaagccacatcgagaagaccctgatgctgaacgaggacaagcccagcgacgactacagcgccgtgctgcagagactgagaaagatctaccacagcagcatcaagcccctggagcagagctacaagtacaacgagctgagacagcacgagatcaccgacggcgagatcaccagcaagcccatggtgctgttcctgggcccctggagcgtgggcaagagcaccatgatcaactacctgctgggcctggagaacaccagataccagctgtacaccggcgccgagcccaccaccagcgagttcaccgtgctgatgcacggccccaagctgaagaccatcgagggcatcgtgatggccgccgacagcgccagaagcttcagccccctggagaagttcggccagaacttcctggagaagctgatcggcatcgaggtgccccacaagctgctggagagagtgaccttcgtggacacccccggcatcatcgagaacagaaagcagcaggagagaggctaccccttcaacgacgtgtgccagtggttcatcgacagagccgacctgatcttcgtggtgttcgaccccaccaagctggacgtgggcctggagctggagatgctgttcagacagctgaagggcagagagagccagatcagaatcatcctgaacaaggccgacaacctggccacccagatgctgatgagagtgtacggcgccctgttctggagcctggcccccctgatcaacgtgaccgagccccccagagtgtacgtgagcagcttctggccccaggagtacaagcccgacacccaccaggagctgttcctgcaggaggagatcagcctgctggaggacctgaaccaggtgatcgagaacagactggagaacaagatcgccttcatcagacagcacgccatcagagtgagaatccacgccctgctggtggacagatacctgcagacctacaaggacaagatgaccttcttcagcgacggcgagctggtgttcaaggacatcgtggaggaccccgacaagttctacatcttcaagaccatcctggccaagaccaacgtgagcaagttcgacctgcccaacagagaggcctacaaggacttcttcggcatcaaccccatcagcagcttcaagctgctgagccagcagtgcagctacatgggcggctgcttcctggagaagatcgagagagccatcacccaggagctgcccggcctgctgggcagcctgggcctgggcaagaaccccggcgccctgaactgcgacaagaccggctgcagcgagacccccaagaacagatacagaaagcactag

SEQ ID NO: 98045 - DNA, 1296 bp, Artificial Sequence
  Description of Artificial Sequence: Synthetic coding sequence
atgctgaacgaggacaagcccagcgacgactacagcgccgtgctgcagagactgagaaagatctaccacagcagcatcaagcccctggagcagagctacaagtacaacgagctgagacagcacgagatcaccgacggcgagatcaccagcaagcccatggtgctgttcctgggcccctggagcgtgggcaagagcaccatgatcaactacctgctgggcctggagaacaccagataccagctgtacaccggcgccgagcccaccaccagcgagttcaccgtgctgatgcacggccccaagctgaagaccatcgagggcatcgtgatggccgccgacagcgccagaagcttcagccccctggagaagttcggccagaacttcctggagaagctgatcggcatcgaggtgccccacaagctgctggagagagtgaccttcgtggacacccccggcatcatcgagaacagaaagcagcaggagagaggctaccccttcaacgacgtgtgccagtggttcatcgacagagccgacctgatcttcgtggtgttcgaccccaccaagctggacgtgggcctggagctggagatgctgttcagacagctgaagggcagagagagccagatcagaatcatcctgaacaaggccgacaacctggccacccagatgctgatgagagtgtacggcgccctgttctggagcctggcccccctgatcaacgtgaccgagccccccagagtgtacgtgagcagcttctggccccaggagtacaagcccgacacccaccaggagctgttcctgcaggaggagatcagcctgctggaggacctgaaccaggtgatcgagaacagactggagaacaagatcgccttcatcagacagcacgccatcagagtgagaatccacgccctgctggtggacagatacctgcagacctacaaggacaagatgaccttcttcagcgacggcgagctggtgttcaaggacatcgtggaggaccccgacaagttctacatcttcaagaccatcctggccaagaccaacgtgagcaagttcgacctgcccaacagagaggcctacaaggacttcttcggcatcaaccccatcagcagcttcaagctgctgagccagcagtgcagctacatgggcggctgcttcctggagaagatcgagagagccatcacccaggagctgcccggcctgctgggcagcctgggcctgggcaagaaccccggcgccctgaactgcgacaagaccggctgcagcgagacccccaagaacagatacagaaagcactag

SEQ ID NO: 98046 - DNA, 1164 bp, Artificial Sequence
  Description of Artificial Sequence: Synthetic coding sequence
atggccgagaccctgttctggacccccctgctggtggtgctgctggccggcctgggcgacaccgaggcccagcagaccaccctgcaccccctggtgggcagagtgttcgtgcacaccctggaccacgagaccttcctgagcctgcccgagcacgtggccgtgccccccgccgtgcacatcacctaccacgcccacctgcagggccaccccgacctgcccagatggctgagatacacccagagaagcccccaccaccccggcttcctgtacggcagcgccacccccgaggacagaggcctgcaggtgatcgaggtgaccgcctacaacagagacagcttcgacaccaccagacagagactggtgctggagatcggcgaccccgagggccccctgctgccctaccaggccgagttcctggtgagaagccacgacgccgaggaggtgctgcccagcacccccgccagcagattcctgagcgccctgggcggcctgtgggagcccggcgagctgcagctgctgaacgtgaccagcgccctggacagaggcggcagagtgcccctgcccatcgagggcagaaaggagggcgtgtacatcaaggtgggcagcgccagccccttcagcacctgcctgaagatggtggccagccccgacagccacgccagatgcgcccagggccagccccccctgctgagctgctacgacaccctggccccccacttcagagtggactggtgcaacgtgaccctggtggacaagagcgtgcccgagcccgccgacgaggtgcccacccccggcgacggcatcctggagcacgaccccttcttctgcccccccaccgaggcccccgacagagacttcctggtggacgccctggtgaccctgctggtgcccctgctggtggccctgctgctgaccctgctgctggcctacgtgatgtgctgcagaagagagggcagactgaagagagacctggccaccagcgacatccagatggtgcaccactgcaccatccacggcaacaccgaggagctgagacagatggccgccagcagagaggtgcccagacccctgagcaccctgcccatgttcaacgtgcacaccggcgagagactgccccccagagtggacagcgcccaggtgcccctgatcctggaccagcactag

SEQ ID NO: 98047 - DNA, 792 bp, Artificial Sequence
  Description of Artificial Sequence: Synthetic coding sequence
atggccgagaccctgttctggacccccctgctggtggtgctgctggccggcctgggcgacaccgaggcccagcagaccaccctgcaccccctggtgggcagagtgttcgtgcacaccctggaccacgagaccttcctgagcctgcccgagcacgtggccgtgccccccgccgtgcacatcacctaccacgcccacctgcagggccaccccgacctgcccagatggctgagatacacccagagaagcccccaccaccccggcttcctgtacggcagcgccacccccgaggacagaggcctgcaggtgatcgaggtgaccgcctacaacagagacagcttcgacaccaccagacagagactggtgctggagatcggcgaccccgagggccccctgctgccctaccaggccgagttcctggtgagaagccacgacgccgaggaggtgctgcccagcacccccgccagcagattcctgagcgccctgggcggcctgtgggagcccggcgagctgcagctgctgaacgtgaccagcgccctggacagaggcggcagagtgcccctgcccatcgagggcagaaaggagggcctgaagagagacctggccaccagcgacatccagatggtgcaccactgcaccatccacggcaacaccgaggagctgagacagatggccgccagcagagaggtgcccagacccctgagcaccctgcccatgttcaacgtgcacaccggcgagagactgccccccagagtggacagcgcccaggtgcccctgatcctggaccagcactag

SEQ ID NO: 98048 - DNA, 537 bp, Artificial Sequence
  Description of Artificial Sequence: Synthetic coding sequence
atgagcgtgaccgcctacaacagagacagcttcgacaccaccagacagagactggtgctggagatcggcgaccccgagggccccctgctgccctaccaggccgagttcctggtgagaagccacgacgccgaggaggtgctgcccagcacccccgccagcagattcctgagcgccctgggcggcctgtgggagcccggcgagctgcagctgctgaacgtgaccagcgccctggacagaggcggcagagtgcccctgcccatcgagggcagaaaggagggcgtgtacatcaaggtgggcagcgccagccccttcagcacctgcctgaagatggtggccagccccgacagccacgccagatgcgcccagggccagccccccctgctgagctgctacgacaccctggccccccacttcagagtggactggtgcaacgtgaccctggtgagaagagaccccggcagcggcggcggcgtgggccacggcccccaccccagcccccccagcctgccctgctgcttcctgagccccagcctgtag

SEQ ID NO: 98049 - DNA, 792 bp, Artificial Sequence
  Description of Artificial Sequence: Synthetic coding sequence
atggccgagaccctgttctggacccccctgctggtggtgctgctggccggcctgggcgacaccgaggcccagcagaccaccctgcaccccctggtgggcagagtgttcgtgcacaccctggaccacgagaccttcctgagcctgcccgagcacgtggccgtgccccccgccgtgcacatcacctaccacgcccacctgcagggccaccccgacctgcccagatggctgagatacacccagagaagcccccaccaccccggcttcctgtacggcagcgccacccccgaggacagaggcctgcaggtgatcgaggtgaccgcctacaacagagacagcttcgacaccaccagacagagactggtgctggagatcggcgaccccgagggccccctgctgccctaccaggccgagttcctggtgagaagccacgacgccgaggaggtgctgcccagcacccccgccagcagattcctgagcgccctgggcggcctgtgggagcccggcgagctgcagctgctgaacgtgaccagcgccctggacagaggcggcagagtgcccctgcccatcgagggcagaaaggaggtgctgctgagacacctgggcacccccctgatccagatggtgcaccactgcaccatccacggcaacaccgaggagctgagacagatggccgccagcagagaggtgcccagacccctgagcaccctgcccatgttcaacgtgcacaccggcgagagactgccccccagagtggacagcgcccaggtgcccctgatcctggaccagcactag

SEQ ID NO: 98050 - DNA, 957 bp, Artificial Sequence
  Description of Artificial Sequence: Synthetic coding sequence
atggccgccgccgccgccgccgccgccgagcagcagagcagcaacggccccgtgaagaagagcatgagagagaaggccgtggagagaagaagcgtgaacaaggagcacaacagcaacttcaaggccggctacatccccatcgacgaggacagactgcacaagaccggcctgagaggcagaaagggcaacctggccatctgcgtgatcatcctgctgttcatcctggccgtgatcaacctgatcatcaccctggtgatctgggccgtgatcagaatcggccccaacggctgcgacagcatggagttccacgagagcggcctgctgagattcaagcaggtgagcgacatgggcgtgatccaccccctgtacaagagcaccgtgggcggcagaagaaacgagaacctggtgatcaccggcaacaaccagcccatcgtgttccagcagggcaccaccaagctgagcgtggagaacaacaagaccagcatcaccagcgacatcggcatgcagttcttcgaccccagaacccagaacatcctgttcagcaccgactacgagacccacgagttccacctgcccagcggcgtgaagagcctgaacgtgcagaaggccagcaccgagagaatcaccagcaacgccaccagcgacctgaacatcaaggtggacggcagagccatcgtgagaggcaacgagggcgtgttcatcatgggcaagaccatcgagttccacatgggcggcaacatggagctgaaggccgagaacagcatcatcctgaacggcagcgtgatggtgagcaccaccagactgcccagcagcagcagcggcgaccagctgggcagcggcgactgggtgagatacaagctgtgcatgtgcgccgacggcaccctgttcaaggtgcaggtgaccagccagaacatgggctgccagatcagcgacaacccctgcggcaacacccactag

SEQ ID NO: 98051 - DNA, 747 bp, Artificial Sequence
  Description of Artificial Sequence: Synthetic coding sequence
atggccgccgccgccgccgccgccgccgagcagatcaccctggtgatctgggccgtgatcagaatcggccccaacggctgcgacagcatggagttccacgagagcggcctgctgagattcaagcaggtgagcgacatgggcgtgatccaccccctgtacaagagcaccgtgggcggcagaagaaacgagaacctggtgatcaccggcaacaaccagcccatcgtgttccagcagggcaccaccaagctgagcgtggagaacaacaagaccagcatcaccagcgacatcggcatgcagttcttcgaccccagaacccagaacatcctgttcagcaccgactacgagacccacgagttccacctgcccagcggcgtgaagagcctgaacgtgcagaaggccagcaccgagagaatcaccagcaacgccaccagcgacctgaacatcaaggtggacggcagagccatcgtgagaggcaacgagggcgtgttcatcatgggcaagaccatcgagttccacatgggcggcaacatggagctgaaggccgagaacagcatcatcctgaacggcagcgtgatggtgagcaccaccagactgcccagcagcagcagcggcgaccagctgggcagcggcgactgggtgagatacaagctgtgcatgtgcgccgacggcaccctgttcaaggtgcaggtgaccagccagaacatgggctgccagatcagcgacaacccctgcggcaacacccactag

SEQ ID NO: 98052 - DNA, 873 bp, Artificial Sequence
  Description of Artificial Sequence: Synthetic coding sequence
atgatgccccaggagcagtacacccaccacagaagcaccatgcccggcagcgtgggcccccaggtgtacaaggtgggcatctacggctggagaaagagatgcctgtacttcttcgtgctgctgctgatgatcctgatcctggtgaacctggccatgaccatctggatcctgaaggtgatgaacttcaccatcgacggcatgggcaacctgagaatcaccgagaagggcctgaagctggagggcgacagcgagttcctgcagcccctgtacgccaaggagatccagagcagacccggcaacgccctgtacttcaagagcgccagaaacgtgaccgtgaacatcctgaacgaccagaccaaggtgctgacccagctgatcaccggccccaaggccgtggaggcctacggcaagaagttcgaggtgaagaccgtgagcggcaagctgctgttcagcgccgacaacaacgaggtggtggtgggcgccgagagactgagagtgctgggcgccgagggcaccgtgttccccaagagcatcgagacccccaacgtgagagccgaccccttcaaggagctgagactggagagccccaccagaagcctggtgatggaggcccccaagggcgtggagatcaacgccgaggccggcaacatggaggccacctgcagaaccgagctgagactggagagcaaggacggcgagatcaagctggacgccgccaagatcagactgcccagactgccccacggcagctacacccccaccggcaccagacagaaggtgttcgagatctgcgtgtgcgccaacggcagactgttcctgagccaggccggcgccggcagcacctgccagatcaacaccagcgtgtgcctgtag

SEQ ID NO: 98053 - DNA, 870 bp, Artificial Sequence
  Description of Artificial Sequence: Synthetic coding sequence
atgccccaggagcagtacacccaccacagaagcaccatgcccggcagcgtgggcccccaggtgtacaaggtgggcatctacggctggagaaagagatgcctgtacttcttcgtgctgctgctgatgatcctgatcctggtgaacctggccatgaccatctggatcctgaaggtgatgaacttcaccatcgacggcatgggcaacctgagaatcaccgagaagggcctgaagctggagggcgacagcgagttcctgcagcccctgtacgccaaggagatccagagcagacccggcaacgccctgtacttcaagagcgccagaaacgtgaccgtgaacatcctgaacgaccagaccaaggtgctgacccagctgatcaccggccccaaggccgtggaggcctacggcaagaagttcgaggtgaagaccgtgagcggcaagctgctgttcagcgccgacaacaacgaggtggtggtgggcgccgagagactgagagtgctgggcgccgagggcaccgtgttccccaagagcatcgagacccccaacgtgagagccgaccccttcaaggagctgagactggagagccccaccagaagcctggtgatggaggcccccaagggcgtggagatcaacgccgaggccggcaacatggaggccacctgcagaaccgagctgagactggagagcaaggacggcgagatcaagctggacgccgccaagatcagactgcccagactgccccacggcagctacacccccaccggcaccagacagaaggtgttcgagatctgcgtgtgcgccaacggcagactgttcctgagccaggccggcgccggcagcacctgccagatcaacaccagcgtgtgcctgtag

SEQ ID NO: 98054 - DNA, 771 bp, Artificial Sequence
  Description of Artificial Sequence: Synthetic coding sequence
atgatgccccaggagcagtacacccaccacagaagcaccatgcccggcagcgtgggcccccaggtgtacaaggtgggcatctacggctggagaaagagatgcctgtacttcttcgtgctgctgctgatgatcctgatcctggtgaacctggccatgaccatctggatcctgaaggtgatgaacttcaccatcgacggcatgggcaacctgagaatcaccgagaagggcctgaagctggagggcgacagcgagttcctgcagcccctgtacgccaaggagatccagagcagacccggcaacgccctgtacttcaagagcgccagaaacgtgaccgtgaacatcctgaacgaccagaccaaggtgctgacccagctgatcaccggccccaaggccgtggaggcctacggcaagaagttcgaggtgaagaccgtgagcggcaagctgctgttcagcgccgacaacaacgaggtggtggtgggcgccgagagactgagagtgctgggcgccgagggcaccgtgttccccaagagcatcgagacccccaacgtgagagccgaccccttcaaggagctgagactggagagccccaccagaagcctggtgatggaggcccccaagggcgtggagatcaacgccgaggccggcaacatggaggccacctgcagaaccgagctgagactggagagcaaggacggcgaggtgagagacgagaaggacagaagcagcaagagctacagcttcaacagacccaccctgcccatcaccggctag

SEQ ID NO: 98055 - DNA, 771 bp, Artificial Sequence; identical to SEQ ID NO: 98054
  Description of Artificial Sequence: Synthetic coding sequence

SEQ ID NO: 98056 - DNA, 1314 bp, Artificial Sequence
  Description of Artificial Sequence: Synthetic coding sequence
atgcagctgcccagatggtgggagctgggcgacccctgcgcctggaccggccagggcagaggcaccagaagaatgagccccgccaccaccggcaccttcctgctgaccgtgtacagcatcttcagcaaggtgcacagcgacagaaacgtgtaccccagcgccggcgtgctgttcgtgcacgtgctggagagagagtacttcaagggcgagttccccccctaccccaagcccggcgagatcagcaacgaccccatcaccttcaacaccaacctgatgggctaccccgacagacccggctggctgagatacatccagagaaccccctacagcgacggcgtgctgtacggcagccccaccgccgagaacgtgggcaagcccaccatcatcgagatcaccgcctacaacagaagaaccttcgagaccgccagacacaacctgatcatcaacatcatgagcgccgaggacttccccctgccctaccaggccgagttcttcatcaagaacatgaacgtggaggagatgctggccagcgaggtgctgggcgacttcctgggcgccgtgaagaacgtgtggcagcccgagagactgaacgccatcaacatcaccagcgccctggacagaggcggcagagtgcccctgcccatcaacgacctgaaggagggcgtgtacgtgatggtgggcgccgacgtgcccttcagcagctgcctgagagaggtggagaacccccagaaccagctgagatgcagccaggagatggagcccgtgatcacctgcgacaagaagttcagaacccagttctacatcgactggtgcaagatcagcctggtggacaagaccaagcaggtgagcacctaccaggaggtgatcagaggcgagggcatcctgcccgacggcggcgagtacaagccccccagcgacagcctgaagagcagagactactacaccgacttcctgatcaccctggccgtgcccagcgccgtggccctggtgctgttcctgatcctggcctacatcatgtgctgcagaagagagggcgtggagaagagaaacatgcagacccccgacatccagctggtgcaccacagcgccatccagaagagcaccaaggagctgagagacatgagcaagaacagagagatcgcctggcccctgagcaccctgcccgtgttccaccccgtgaccggcgagatcatcccccccctgcacaccgacaactacgacagcaccaacatgcccctgatgcagacccagcagaacctgccccaccagacccagatcccccagcagcagaccaccggcaagtggtacccctag

SEQ ID NO: 98057 - DNA, 1416 bp, Artificial Sequence
  Description of Artificial Sequence: Synthetic coding sequence
atgcagctgcccagatggtgggagctgggcgacccctgcgcctggaccggccagggcagaggcaccagaagaatgagccccgccaccaccggcaccttcctgctgaccgccttcctgctgagctgcgccgacggcatcaacggcaccgtgaactggaagaccagacaggccaacaacttcatcatcagcagaaagatggccgccggcatgaaggacgtgtacagcatcttcagcaaggtgcacagcgacagaaacgtgtaccccagcgccggcgtgctgttcgtgcacgtgctggagagagagtacttcaagggcgagttccccccctaccccaagcccggcgagatcagcaacgaccccatcaccttcaacaccaacctgatgggctaccccgacagacccggctggctgagatacatccagagaaccccctacagcgacggcgtgctgtacggcagccccaccgccgagaacgtgggcaagcccaccatcatcgagatcaccgcctacaacagaagaaccttcgagaccgccagacacaacctgatcatcaacatcatgagcgccgaggacttccccctgccctaccaggccgagttcttcatcaagaacatgaacgtggaggagatgctggccagcgaggtgctgggcgacttcctgggcgccgtgaagaacgtgtggcagcccgagagactgaacgccatcaacatcaccagcgccctggacagaggcggcagagtgcccctgcccatcaacgacctgaaggagggcgtgtacgtgatggtgggcgccgacgtgcccttcagcagctgcctgagagaggtggagaacccccagaaccagctgagatgcagccaggagatggagcccgtgatcacctgcgacaagaagttcagaacccagttctacatcgactggtgcaagatcagcctggtggacaagaccaagcaggtgagcacctaccaggaggtgatcagaggcgagggcatcctgcccgacggcggcgagtacaagccccccagcgacagcctgaagagcagagactactacaccgacttcctgatcaccctggccgtgcccagcgccgtggccctggtgctgttcctgatcctggcctacatcatgtgctgcagaagagagggcgtggagaagagaaacatgcagacccccgacatccagctggtgcaccacagcgccatccagaagagcaccaaggagctgagagacatgagcaagaacagagagatcgcctggcccctgagcaccctgcccgtgttccaccccgtgaccggcgagatcatcccccccctgcacaccgacaactacgacagcaccaacatgcccctgatgcagacccagcagaacctgccccaccagacccagatcccccagcagcagaccaccggcgagtgctag

SEQ ID NO: 98058 - DNA, 1356 bp, Artificial Sequence
  Description of Artificial Sequence: Synthetic coding sequence
atgcagctgcccagatggtgggagctgggcgacccctgcgcctggaccggccagggcagaggcaccagaagaatgagccccgccaccaccggcaccttcctgctgaccgtgtacagcatcttcagcaaggtgcacagcgacagaaacgtgtaccccagcgccggcgtgctgttcgtgcacgtgctggagagagagtacttcaagggcgagttccccccctaccccaagcccggcgagatcagcaacgaccccatcaccttcaacaccaacctgatgggctaccccgacagacccggctggctgagatacatccagagaaccccctacagcgacggcgtgctgtacggcagccccaccgccgagaacgtgggcaagcccaccatcatcgagatcaccgcctacaacagaagaaccttcgagaccgccagacacaacctgatcatcaacatcatgagcgccgaggacttccccctgccctaccaggccgagttcttcatcaagaacatgaacgtggaggagatgctggccagcgaggtgctgggcgacttcctgggcgccgtgaagaacgtgtggcagcccgagagactgaacgccatcaacatcaccagcgccctggacagaggcggcagagtgcccctgcccatcaacgacctgaaggagggcgtgtacgtgatggtgggcgccgacgtgcccttcagcagctgcctgagagaggtggagaacccccagaaccagctgagatgcagccaggagatggagcccgtgatcacctgcgacaagaagttcagaacccagttctacatcgactggtgcaagatcagcctggtggacaagaccaagcaggtgagcacctaccaggaggtgatcagaggcgagggcatcctgcccgacggcggcgagtacaagccccccagcgacagcctgaagagcagagactactacaccgacttcctgatcaccctggccgtgcccagcgccgtggccctggtgctgttcctgatcctggcctacatcatgtgctgcagaagagagggcgtgatccagctggtgcaccacagcgccatccagaagagcaccaaggagctgagagacatgagcaagaacagagagatcgcctggcccctgagcaccctgcccgtgttccaccccgtgaccggcgagatcatcccccccctgcacaccgacaactacgacagcaccaacatgcccctgatgcagacccagcagaacctgccccaccagacccagatcccccagcagcagaccaccggcgacttcagactgaccaccttccagagattcgaggtgaacggcatccccgaggagagaaagctgaccgaggccatgaacctgtag

SEQ ID NO: 98059 - DNA, 1389 bp, Artificial Sequence
  Description of Artificial Sequence: Synthetic coding sequence
atgcagctgcccagatggtgggagctgggcgacccctgcgcctggaccggccagggcagaggcaccagaagaatgagccccgccaccaccggcaccttcctgctgaccgtgtacagcatcttcagcaaggtgcacagcgacagaaacgtgtaccccagcgccggcgtgctgttcgtgcacgtgctggagagagagtacttcaagggcgagttccccccctaccccaagcccggcgagatcagcaacgaccccatcaccttcaacaccaacctgatgggctaccccgacagacccggctggctgagatacatccagagaaccccctacagcgacggcgtgctgtacggcagccccaccgccgagaacgtgggcaagcccaccatcatcgagatcaccgcctacaacagaagaaccttcgagaccgccagacacaacctgatcatcaacatcatgagcgccgaggacttccccctgccctaccaggccgagttcttcatcaagaacatgaacgtggaggagatgctggccagcgaggtgctgggcgacttcctgggcgccgtgaagaacgtgtggcagcccgagagactgaacgccatcaacatcaccagcgccctggacagaggcggcagagtgcccctgcccatcaacgacctgaaggagggcgtgtacgtgatggtgggcgccgacgtgcccttcagcagctgcctgagagaggtggagaacccccagaaccagctgagatgcagccaggagatggagcccgtgatcacctgcgacaagaagttcagaacccagttctacatcgactggtgcaagatcagcctggtggacaagaccaagcaggtgagcacctaccaggaggtgatcagaggcgagggcatcctgcccgacggcggcgagtacaagccccccagcgacagcctgaagagcagagactactacaccgacttcctgatcaccctggccgtgcccagcgccgtggccctggtgctgttcctgatcctggcctacatcatgtgctgcagaagagagggcgtggagaagagaaacatgcagacccccgacatccagctggtgcaccacagcgccatccagaagagcaccaaggagctgagagacatgagcaagaacagagagatcgcctggcccctgagcaccctgcccgtgttccaccccgtgaccggcgagatcatcccccccctgcacaccgacaactacgacagcaccaacatgcccctgatgcagacccagcagtggagcttcgcccccgtggcccaggccggcgtgcagtggagcgacctgggcagcctgcagccccccccccccagaaacctgccccaccagacccagatcccccagcagcagaccaccggcaagtggtacccctag

SEQ ID NO: 98060 - DNA, 2118 bp, Artificial Sequence
  Description of Artificial Sequence: Synthetic coding sequence
atgaccgacaacagcaacaaccagctggtggtgagagccaagttcaacttccagcagaccaacgaggacgagctgagcttcagcaagggcgacgtgatccacgtgaccagagtggaggagggcggctggtgggagggcaccctgaacggcagaaccggctggttccccagcaactacgtgagagaggtgaaggccagcgagaagcccgtgagccccaagagcggcaccctgaagagcccccccaagggcttcgacaccaccgccatcaacaagagctactacaacgtggtgctgcagaacatcctggagaccgagaacgagtacagcaaggagctgcagaccgtgctgagcacctacctgagacccctgcagaccagcgagaagctgagcagcgccaacatcagctacctgatgggcaacctggaggagatctgcagcttccagcagatgctggtgcagagcctggaggagtgcaccaagctgcccgaggcccagcagagagtgggcggctgcttcctgaacctgatgccccagatgaagaccctgtacctgacctactgcgccaaccaccccagcgccgtgaacgtgctgaccgagcacagcgaggagctgggcgagttcatggagaccaagggcgccagcagccccggcatcctggtgctgaccaccggcctgagcaagcccttcatgagactggacaagtaccccaccctgctgaaggagctggagagacacatggaggactaccacaccgacagacaggacatccagaagagcatggccgccttcaagaacctgagcgcccagtgccaggaggtgagaaagagaaaggagctggagctgcagatcctgaccgaggccatcagaaactgggagggcgacgacatcaagaccctgggcaacgtgacctacatgagccaggtgctgatccagtgcgccggcagcgaggagaagaacgagagatacctgctgctgttccccaacgtgctgctgatgctgagcgccagccccagaatgagcggcttcatctaccagggcaagctgcccaccaccggcatgaccatcaccaagctggaggacagcgagaaccacagaaacgccttcgagatcagcggcagcatgatcgagagaatcctggtgagctgcaacaaccagcaggacctgcaggagtgggtggagcacctgcagaagcagaccaaggtgaccagcgtgggcaaccccaccatcaagccccacagcgtgcccagccacaccctgcccagccaccccgtgacccccagcagcaagcacgccgacagcaagcccgcccccctgacccccgcctaccacaccctgccccaccccagccaccacggcaccccccacaccaccatcaactggggccccctggagccccccaagacccccaagccctggagcctgagctgcctgagacccgccccccccctgagacccagcgccgccctgtgctacaaggaggacctgagcaagagccccaagaccatgaagaagctgctgcccaagagaaagcccgagagaaagcccagcgacgaggagttcgccagcagaaagagcaccgccgccctggaggaggacgcccagatcctgaaggtgatcgaggcctactgcaccagcgccaagaccagacagaccctgaacagcacctggcagggcaccgacctgatgcacaaccacgtgctggccgacgacgaccagcccagcctggacagcctgggcagaagaagcagcctgagcagactggagcccagcgacctgagcgaggacagcgactacgacagcatctggaccgcccacagctacagaatgggcagcaccagcagaagcagaaaggagagcgccccccaggtgctgctgcccgaggaggagaagatcatcgtggaggagaccaagagcaacggccagaccgtgatcgaggagaagagcctggtggacaccgtgtacgccctgaaggacgaggtgcaggagctgagacaggacaacaagaagatgaagaagagcctggaggaggagcagagagccagaaaggacctggagaagctggtgagaaaggtgctgaagaacatgaacgaccccgcctgggacgagaccaacctgtag

SEQ ID NO: 98061 - DNA, 876 bp, Artificial Sequence
  Description of Artificial Sequence: Synthetic coding sequence
atggtgagagagcagtacaccaccgccaccgagggcatctgcatcgagagacccgagaaccagtacgtgtacaagatcggcatctacggctggagaaagagatgcctgtacctgttcgtgctgctgctgctgatcatcctggtggtgaacctggccctgaccatctggatcctgaaggtgatgtggttcagccccgccggcatgggccacctgtgcgtgaccaaggacggcctgagactggagggcgagagcgagttcctgttccccctgtacgccaaggagatccacagcagagtggacagcagcctgctgctgcagagcacccagaacgtgaccgtgaacgccagaaacagcgagggcgaggtgaccggcagactgaaggtgggccccaagatggtggaggtgcagaaccagcagttccagatcaacagcaacgacggcaagcccctgttcaccgtggacgagaaggaggtggtggtgggcaccgacaagctgagagtgaccggccccgagggcgccctgttcgagcacagcgtggagacccccctggtgagagccgaccccttccaggacctgagactggagagccccaccagaagcctgagcatggacgcccccagaggcgtgcacatccaggcccacgccggcaagatcgaggccctgagccagatggacatcctgttccacagcagcgacggcatgctggtgctggacgccgagaccgtgtgcctgcccaagctggtgcagggcacctggggccccagcggcagcagccagagcctgtacgagatctgcgtgtgccccgacggcaagctgtacctgagcgtggccggcgtgagcaccacctgccaggagcacaaccacatctgcctgtag

SEQ ID NO: 98062 - DNA, 876 bp, Artificial Sequence; identical to SEQ ID NO: 98061
  Description of Artificial Sequence: Synthetic coding sequence

SEQ ID NO: 98063 - DNA, 96 bp, Artificial Sequence
  Description of Artificial Sequence: Synthetic coding sequence
atgggcatcaacaccagagagctgttcctgaacttcaccatcgtgctgatcaccgtgatcctgatgtggctgctggtgagaagctaccagtactag

SEQ ID NO: 98064 - DNA, 96 bp, Artificial Sequence; identical to SEQ ID NO: 98063
  Description of Artificial Sequence: Synthetic coding sequence

SEQ ID NO: 98065 - DNA, 96 bp, Artificial Sequence; identical to SEQ ID NO: 98063
  Description of Artificial Sequence: Synthetic coding sequence

SEQ ID NO: 98066 - DNA, 732 bp, Artificial Sequence
  Description of Artificial Sequence: Synthetic coding sequence
atgggcaagaacaagcagcccagaggccagcagagacagggcggcccccccgccgccgacgccgccggccccgacgacatggagcccaagaagggcaccggcgcccccaaggagtgcggcgaggaggagcccagaacctgctgcggctgcagattccccctgctgctggccctgctgcagctggccctgggcatcgccgtgaccgtggtgggcttcctgatggccagcatcagcagcagcctgctggtgagagacacccccttctgggccggcatcatcgtgtgcctggtggcctacctgggcctgttcatgctgtgcgtgagctaccaggtggacgagagaacctgcatccagttcagcatgaagctgctgtacttcctgctgagcgccctgggcctgaccgtgtgcgtgctggccgtggccttcgccgcccaccactacagccagctgacccagttcacctgcgagaccaccctggacagctgccagtgcaagctgcccagcagcgagcccctgagcagaaccttcgtgtacagagacgtgaccgactgcaccagcgtgaccggcaccttcaagctgttcctgctgatccagatgatcctgaacctggtgtgcggcctggtgtgcctgctggcctgcttcgtgatgtggaagcacagataccaggtgttctacgtgggcgtgagaatctgcagcctgaccgccagcgagggcccccagcagaagatctag

SEQ ID NO: 98067 - DNA, 423 bp, Artificial Sequence
  Description of Artificial Sequence: Synthetic coding sequence
atgctgtgcgtgagctaccaggtggacgagagaacctgcatccagttcagcatgaagctgctgtacttcctgctgagcgccctgggcctgaccgtgtgcgtgctggccgtggccttcgccgcccaccactacagccagctgacccagttcacctgcgagaccaccctggacagctgccagtgcaagctgcccagcagcgagcccctgagcagaaccttcgtgtacagagacgtgaccgactgcaccagcgtgaccggcaccttcaagctgttcctgctgatccagatgatcctgaacctggtgtgcggcctggtgtgcctgctggcctgcttcgtgatgtggaagcacagataccaggtgttctacgtgggcgtgagaatctgcagcctgaccgccagcgagggcccccagcagaagatctag

SEQ ID NO: 98068 - DNA, 654 bp, Artificial Sequence
  Description of Artificial Sequence: Synthetic coding sequence
atggagcccaagaagggcaccggcgcccccaaggagtgcggcgaggaggagcccagaacctgctgcggctgcagattccccctgctgctggccctgctgcagctggccctgggcatcgccgtgaccgtggtgggcttcctgatggccagcatcagcagcagcctgctggtgagagacacccccttctgggccggcatcatcgtgtgcctggtggcctacctgggcctgttcatgctgtgcgtgagctaccaggtggacgagagaacctgcatccagttcagcatgaagctgctgtacttcctgctgagcgccctgggcctgaccgtgtgcgtgctggccgtggccttcgccgcccaccactacagccagctgacccagttcacctgcgagaccaccctggacagctgccagtgcaagctgcccagcagcgagcccctgagcagaaccttcgtgtacagagacgtgaccgactgcaccagcgtgaccggcaccttcaagctgttcctgctgatccagatgatcctgaacctggtgtgcggcctggtgtgcctgctggcctgcttcgtgatgtggaagcacagataccaggtgttctacgtgggcgtgagaatctgcagcctgaccgccagcgagggcccccagcagaagatctag

SEQ ID NO: 98069 - DNA, 387 bp, Artificial Sequence
  Description of Artificial Sequence: Synthetic coding sequence
atgggcaagaacaagcagcccagaggccagcagagacagggcggcccccccgccgccgacgccgccggccccgacgacatggagcccaagaagggcaccggcgcccccaaggagtgcggcgaggaggagcccagaacctgctgcggctgcagattccccctgctgctggccctgctgcagctggccctgggcatcgccgtgaccgtggtgggcttcctgatggccagcatcagcagcagcctgctggtgagagacacccccttctgggccggcatcatcgtgtgcctggtggcctacctgggcctgttcatgctgtgcgtgagctaccaggtggacgagagaacctgcatccagttcagcatgaagatccactgccacgacttctag

SEQ ID NO: 98070 - DNA, 363 bp, Artificial Sequence
  Description of Artificial Sequence: Synthetic coding sequence
atgctgtgcgtgagctaccaggtggacgagagaacctgcatccagttcagcatgaagctgctgtacttcctgctgagcgccctgggcctgaccgtgtgcgtgctggccgtggccttcgccgcccaccactacagccagctgacccagttcacctgcgagaccaccctggacagctgccagtgcaagctgcccagcagcgagcccctgagcagaaccttcgtgtacagagacgtgaccgactgcaccagcgtgaccggcaccttcaagctgttcctgctgatccagatgatcctgaacctggtgtgcggcctggtgtgcctgctggcctgcttcgtgatgtggaagcacagataccaggtgtag

SEQ ID NO: 98071 - DNA, 423 bp, Artificial Sequence; identical to SEQ ID NO: 98067
  Description of Artificial Sequence: Synthetic coding sequence

SEQ ID NO: 98072 - DNA, 2292 bp, Artificial Sequence
  Description of Artificial Sequence: Synthetic coding sequence
atggaccacctgaacgaggccacccagggcaaggagcacagcgagatgagcaacaacgtgagcgaccccaagggcccccccgccaagatcgccagactggagcagaacggcagccccctgggcagaggcagactgggcagcaccggcgccaagatgcagggcgtgcccctgaagcacagcggccacctgatgaagaccaacctgagaaagggcaccatgctgcccgtgttctgcgtggtggagcactacgagaacgccatcgagtacgactgcaaggaggagcacgccgagttcgtgctggtgagaaaggacatgctgttcaaccagctgatcgagatggccctgctgagcctgggctacagccacagcagcgccgcccaggccaagggcctgatccaggtgggcaagtggaaccccgtgcccctgagctacgtgaccgacgcccccgacgccaccgtggccgacatgctgcaggacgtgtaccacgtggtgaccctgaagatccagctgcacagctgccccaagctggaggacctgccccccgagcagtggagccacaccaccgtgagaaacgccctgaaggacctgctgaaggacatgaaccagagcagcctggccaaggagtgccccctgagccagagcatgatcagcagcatcgtgaacagcacctactacgccaacgtgagcgccgccaagtgccaggagttcggcagatggtacaagcacttcaagaagaccaaggacatgatggtggagatggacagcctgagcgagctgagccagcagggcgccaaccacgtgaacttcggccagcagcccgtgcccggcaacaccgccgagcagccccccagccccgcccagctgagccacggcagccagcccagcgtgagaacccccctgcccaacctgcaccccggcctggtgagcacccccatcagcccccagctggtgaaccagcagctggtgatggcccagctgctgaaccagcagtacgccgtgaacagactgctggcccagcagagcctgaaccagcagtacctgaaccaccccccccccgtgagcagaagcatgaacaagcccctggagcagcaggtgagcaccaacaccgaggtgagcagcgagatctaccagtgggtgagagacgagctgaagagagccggcatcagccaggccgtgttcgccagagtggccttcaacagaacccagggcctgctgagcgagatcctgagaaaggaggaggaccccaagaccgccagccagagcctgctggtgaacctgagagccatgcagaacttcctgcagctgcccgaggccgagagagacagaatctaccaggacgagagagagagaagcctgaacgccgccagcgccatgggccccgcccccctgatcagcaccccccccagcagacccccccaggtgaagaccgccaccatcgccaccgagagaaacggcaagcccgagaacaacaccatgaacatcaacgccagcatctacgacgagatccagcaggagatgaagagagccaaggtgagccaggccctgttcgccaaggtggccgccaccaagagccagggctggctgtgcgagctgctgagatggaaggaggaccccagccccgagaacagaaccctgtgggagaacctgagcatgatcagaagattcctgagcctgccccagcccgagagagacgccatctacgagcaggagagcaacgccgtgcaccaccacggcgacagacccccccacatcatccacgtgcccgccgagcagatccagcagcagcagcagcagcagcagcagcagcagcagcagcagcaggcccccccccccccccagccccagcagcagccccagaccggccccagactgccccccagacagcccaccgtggccagccccgccgagagcgacgaggagaacagacagaagaccagacccagaaccaagatcagcgtggaggccctgggcatcctgcagagcttcatccaggacgtgggcctgtaccccgacgaggaggccatccagaccctgagcgcccagctggacctgcccaagtacaccatcatcaagttcttccagaaccagagatactacctgaagcaccacggcaagctgaaggacaacagcggcctggaggtggacgtggccgagtacaaggaggaggagctgctgaaggacctggaggagagcgtgcaggacaagaacaccaacaccctgttcagcgtgaagctggaggaggagctgagcgtggagggcaacaccgacatcaacaccgacctgaaggactag

SEQ ID NO: 98073 - DNA, 351 bp, Artificial Sequence
  Description of Artificial Sequence: Synthetic coding sequence
atggaccacctgaacgaggccacccagggcaaggagcacagcgagatgagcaacaacgtgagcgaccccaagggcccccccgccaagatcgccagactggagcagaacggcagccccctgggcagaggcagactgggcagcaccggcgccaagatgcagggcgtgcccctgaagcacagcggccacctgatgaagaccaacctgagaaagggcaccatgctgcccgtgttctgcgtggtggagcactacgagaacgccatcgagtacgactgcaaggaggagcacgccgagttcgtgctggtgagaaaggacatgctgttcaaccagctgatcgagatggccctgctgtag

SEQ ID NO: 98074 - DNA, 675 bp, Artificial Sequence
  Description of Artificial Sequence: Synthetic coding sequence
atggaccacctgaacgaggccacccagggcaaggagcacagcgagatgagcaacaacgtgagcgaccccaagggcccccccgccaagatcgccagactggagcagaacggcagccccctgggcagaggcagactgggcagcaccggcgccaagatgcagggcgtgcccctgaagcacagcggccacctgatgaagaccaacctgagaaagggcaccatgctgcccgtgttctgcgtggtggagcactacgagaacgccatcgagtacgactgcaaggaggagcacgccgagttcgtgctggtgagaaaggacatgctgttcaaccagctgatcgagatggccctgctgagcctgggctacagccacagcagcgccgcccaggccaagggcctgatccaggtgggcaagtggaaccccgtgcccctgagctacgtgaccgacgcccccgacgccaccgtggccgacatgctgcaggacgtgtaccacgtggtgaccctgaagatccagctgcacagctgccccaagctggaggacctgccccccgagcagtggagccacaccaccgtgagaaacgccctgaaggacctgctgaaggacatgaaccagagcagcctggccaaggagtgccccctgagccagagcatgatcagcagcatcgtgaacagcacctactag

SEQ ID NO: 98075 - DNA, 216 bp, Artificial Sequence
  Description of Artificial Sequence: Synthetic coding sequence
atggaccacctgaacgaggccacccagggcaaggagcacagcgagatgagcaacaacgtgagcgaccccaagggcccccccgccaagatcgccagactggagcagaacggcagccccctgggcagaggcagactgggcagcaccggcgccaagatgcagggcgtgcccctgaagcacagcggccacctgatgaagaccaacctgagaaagggctag

SEQ ID NO: 98076 - DNA, 27 bp, Artificial Sequence
  Description of Artificial Sequence: Synthetic coding sequence
atggaccacctgaacgaggccacctag

SEQ ID NO: 98077 - DNA, 519 bp, Artificial Sequence
  Description of Artificial Sequence: Synthetic coding sequence
atggaccacctgaacgaggccacccagggcaaggagcacagcgagatgagcaacaacgtgagcgaccccaagggcccccccgccaagatcgccagactggagcagaacggcagccccctgggcagaggcagactgggcagcaccggcgccaagatgcagggcgtgcccctgaagcacagcggccacctgatgaagaccaacctgagaaagggcaccatgctgcccgtgttctgcgtggtggagcactacgagaacgccatcgagtacgactgcaaggaggagcacgccgagttcgtgctggtgagaaaggacatgctgttcaaccagctgatcgagatggccctgctgagcctgggctacagccacagcagcgccgcccaggccaagggcctgatccaggtgggcaagtggaaccccgtgcccctgagctacgtgaccgacgcccccgacgccaccgtggccgacatgctgcaggacgtgtaccacgtggtgaccctgaagatccagctgcacagatag

SEQ ID NO: 98078 - DNA, 2292 bp, Artificial Sequence; identical to SEQ ID NO: 98072
  Description of Artificial Sequence: Synthetic coding sequence

SEQ ID NO: 98079 - DNA, 393 bp, Artificial Sequence
  Description of Artificial Sequence: Synthetic coding sequence
atggaccacctgaacgaggccacccagggcaaggagcacagcgagatgagcaacaacgtgagcgaccccaagggcccccccgccaagatcgccagactggagcagaacggcagccccctgggcagaggcagactgggcagcaccggcgccaagatgcagggcgtgcccctgaagcacagcggccacctgatgaagaccaacctgagaaagggcaccatgctgcccgtgttctgcgtggtggagcactacgagaacgccatcgagtacgactgcaaggaggagcacgccgagttcgtgctggtgagaaaggacatgctgttcaaccagctgatcgagatggccctgctgagcctgggctacagccacagcagcgccgcccaggccaagggctag

SEQ ID NO: 98080 - DNA, 2388 bp, Artificial Sequence
  Description of Artificial Sequence: Synthetic coding sequence
atggaccacctgaacgaggccacccagggcaaggagcacagcgagatgagcaacaacgtgagcgaccccaagggcccccccgccaagatcgccagactggagcagaacggcagccccctgggcagaggcagactgggcagcaccggcgccaagatgcagggcgtgcccctgaagcacagcggccacctgatgaagaccaacctgagaaagggcaccatgctgcccgtgttctgcgtggtggagcactacgagaacgccatcgagtacgactgcaaggaggagcacgccgagttcgtgctggtgagaaaggacatgctgttcaaccagctgatcgagatggccctgctgagcctgggctacagccacagcagcgccgcccaggccaagggcctgatccaggtgggcaagtggaaccccgtgcccctgagctacgtgaccgacgcccccgacgccaccgtggccgacatgctgcaggacgtgtaccacgtggtgaccctgaagatccagctgcacagctgccccaagctggaggacctgccccccgagcagtggagccacaccaccgtgagaaacgccctgaaggacctgctgaaggacatgaaccagagcagcctggccaaggagtgccccctgagccagagcatgatcagcagcatcgtgaacagcacctactacgccaacgtgagcgccgccaagtgccaggagttcggcagatggtacaagcacttcaagaagaccaaggacatgatggtggagatggacagcctgagcgagctgagccagcagggcgccaaccacgtgaacttcggccagcagcccgtgcccggcaacaccgccgagcagccccccagccccgcccagctgagccacggcagccagcccagcgtgagaacccccctgcccaacctgcaccccggcctggtgagcacccccatcagcccccagctggtgaaccagcagctggtgatggcccagctgctgaaccagcagtacgccgtgaacagactgctggcccagcagagcctgaaccagcagtacctgaaccaccccccccccgtgagcagaagcatgaacaagcccctggagcagcaggtgagcaccaacaccgaggtgagcagcgagatctaccagtgggtgagagacgagctgaagagagccggcatcagccaggccgtgttcgccagagtggccttcaacagaacccagggcctgctgagcgagatcctgagaaaggaggaggaccccaagaccgccagccagagcctgctggtgaacctgagagccatgcagaacttcctgcagctgcccgaggccgagagagacagaatctaccaggacgagagagagagaagcctgaacgccgccagcgccatgggccccgcccccctgatcagcaccccccccagcagacccccccaggtgaagaccgccaccatcgccaccgagagaaacggcaagcccgagaacaacaccatgaacatcaacgccagcatctacgacgagatccagcaggagatgaagagagccaaggtgagccaggccctgttcgccaaggtggccgccaccaagagccagggctggctgtgcgagctgctgagatggaaggaggaccccagccccgagaacagaaccctgtgggagaacctgagcatgatcagaagattcctgagcctgccccagcccgagagagacgccatctacgagcaggagagcaacgccgtgcaccaccacggcgacagacccccccacatcatccacgtgcccgccgagcagatccagagccccagccccaccaccctgggcaagggcgagagcagaggcgtgttcctgcccggcctgcccacccccgccccctggctgggcgccgccccccagcagcagcagcagcagcagcagcagcagcagcagcagcagcaggcccccccccccccccagccccagcagcagccccagaccggccccagactgccccccagacagcccaccgtggccagccccgccgagagcgacgaggagaacagacagaagaccagacccagaaccaagatcagcgtggaggccctgggcatcctgcagagcttcatccaggacgtgggcctgtaccccgacgaggaggccatccagaccctgagcgcccagctggacctgcccaagtacaccatcatcaagttcttccagaaccagagatactacctgaagcaccacggcaagctgaaggacaacagcggcctggaggtggacgtggccgagtacaaggaggaggagctgctgaaggacctggaggagagcgtgcaggacaagaacaccaacaccctgttcagcgtgaagctggaggaggagctgagcgtggagggcaacaccgacatcaacaccgacctgaaggactag

SEQ ID NO: 98081 - DNA, 2202 bp, Artificial Sequence
  Description of Artificial Sequence: Synthetic coding sequence
atggagagaagaagcgagagcccctgcctgagagacagccccgacagaagaagcggcagccccgacgtgaagggccccccccccgtgaaggtggccagactggagcagaacggcagccccatgggcgccagaggcagacccaacggcgccgtggccaaggccgtgggcggcctgatgatccccgtgttctgcgtggtggagcagctggacggcagcctggagtacgacaacagagaggagcacgccgagttcgtgctggtgagaaaggacgtgctgttcagccagctggtggagaccgccctgctggccctgggctacagccacagcagcgccgcccaggcccagggcatcatcaagctgggcagatggaaccccctgcccctgagctacgtgaccgacgcccccgacgccaccgtggccgacatgctgcaggacgtgtaccacgtggtgaccctgaagatccagctgcagagctgcagcaagctggaggacctgcccgccgagcagtggaaccacgccaccgtgagaaacgccctgaaggagctgctgaaggagatgaaccagagcaccctggccaaggagtgccccctgagccagagcatgatcagcagcatcgtgaacagcacctactacgccaacgtgagcgccaccaagtgccaggagttcggcagatggtacaagaagtacaagaagatcaaggtggagagagtggagagagagaacctgagcgactactgcgtgctgggccagagacccatgcacctgcccaacatgaaccagctggccagcctgggcaagaccaacgagcagagcccccacagccagatccaccacagcacccccatcagaaaccaggtgcccgccctgcagcccatcatgagccccggcctgctgagcccccagctgagcccccagctggtgagacagcagatcgccatggcccacctgatcaaccagcagatcgccgtgagcagactgctggcccaccagcacccccaggccatcaaccagcagttcctgaaccacccccccatccccagagccgtgaagcccgagcccaccaacagcagcgtggaggtgagccccgacatctaccagcaggtgagagacgagctgaagagagccagcgtgagccaggccgtgttcgccagagtggccttcaacagaacccagggcctgctgagcgagatcctgagaaaggaggaggaccccagaaccgccagccagagcctgctggtgaacctgagagccatgcagaacttcctgaacctgcccgaggtggagagagacagaatctaccaggacgagagagagagaagcatgaaccccaacgtgagcatggtgagcagcgccagcagcagccccagcagcagcagaaccccccaggccaagaccagcacccccaccaccgacctgcccatcaaggtggacggcgccaacatcaacatcaccgccgccatctacgacgagatccagcaggagatgaagagagccaaggtgagccaggccctgttcgccaaggtggccgccaacaagagccagggctggctgtgcgagctgctgagatggaaggagaaccccagccccgagaacagaaccctgtgggagaacctgtgcaccatcagaagattcctgaacctgccccagcacgagagagacgtgatctacgaggaggagagcagacaccaccacagcgagagaatgcagcacgtggtgcagctgccccccgagcccgtgcaggtgctgcacagacagcagagccagcccgccaaggagagcagcccccccagagaggaggccccccccccccccccccccaccgaggacagctgcgccaagaagcccagaagcagaaccaagatcagcctggaggccctgggcatcctgcagagcttcatccacgacgtgggcctgtaccccgaccaggaggccatccacaccctgagcgcccagctggacctgcccaagcacaccatcatcaagttcttccagaaccagagataccacgtgaagcaccacggcaagctgaaggagcacctgggcagcgccgtggacgtggccgagtacaaggacgaggagctgctgaccgagagcgaggagaacgacagcgaggagggcagcgaggagatgtacaaggtggaggccgaggaggagaacgccgacaagagcaaggccgcccccgccgagatcgaccagagatag

SEQ ID NO: 98082 - DNA, 2202 bp, Artificial Sequence; identical to SEQ ID NO: 98081
  Description of Artificial Sequence: Synthetic coding sequence

SEQ ID NO: 98083 - DNA, 1848 bp, Artificial Sequence
  Description of Artificial Sequence: Synthetic coding sequence
atggagagaagaagcgagagcccctgcctgagagacagccccgacagaagaagcggcagccccgacgtgaagggccccccccccgtgaaggtggccagactggagcagaacggcagccccatgggcgccagaggcagacccaacggcgccgtggccaaggccgtgggcggcctgatgatccccgtgttctgcgtggtggagcagctggacggcagcctggagtacgacaacagagaggagcacgccgagttcgtgctggtgagaaaggacgtgctgttcagccagctggtggagaccgccctgctggccctgggctacagccacagcagcgccgcccaggcccaggtggagagagtggagagagagaacctgagcgactactgcgtgctgggccagagacccatgcacctgcccaacatgaaccagctggccagcctgggcaagaccaacgagcagagcccccacagccagatccaccacagcacccccatcagaaaccaggtgcccgccctgcagcccatcatgagccccggcctgctgagcccccagctgagcccccagctggtgagacagcagatcgccatggcccacctgatcaaccagcagatcgccgtgagcagactgctggcccaccagcacccccaggccatcaaccagcagttcctgaaccacccccccatccccagagccgtgaagcccgagcccaccaacagcagcgtggaggtgagccccgacatctaccagcaggtgagagacgagctgaagagagccagcgtgagccaggccgtgttcgccagagtggccttcaacagaacccagggcctgctgagcgagatcctgagaaaggaggaggaccccagaaccgccagccagagcctgctggtgaacctgagagccatgcagaacttcctgaacctgcccgaggtggagagagacagaatctaccaggacgagagagagagaagcatgaaccccaacgtgagcatggtgagcagcgccagcagcagccccagcagcagcagaaccccccaggccaagaccagcacccccaccaccgacctgcccatcaaggtggacggcgccaacatcaacatcaccgccgccatctacgacgagatccagcaggagatgaagagagccaaggtgagccaggccctgttcgccaaggtggccgccaacaagagccagggctggctgtgcgagctgctgagatggaaggagaaccccagccccgagaacagaaccctgtgggagaacctgtgcaccatcagaagattcctgaacctgccccagcacgagagagacgtgatctacgaggaggagagcagacaccaccacagcgagagaatgcagcacgtggtgcagctgccccccgagcccgtgcaggtgctgcacagacagcagagccagcccgccaaggagagcagcccccccagagaggaggccccccccccccccccccccaccgaggacagctgcgccaagaagcccagaagcagaaccaagatcagcctggaggccctgggcatcctgcagagcttcatccacgacgtgggcctgtaccccgaccaggaggccatccacaccctgagcgcccagctggacctgcccaagcacaccatcatcaagttcttccagaaccagagataccacgtgaagcaccacggcaagctgaaggagcacctgggcagcgccgtggacgtggccgagtacaaggacgaggagctgctgaccgagagcgaggagaacgacagcgaggagggcagcgaggagatgtacaaggtggaggccgaggaggagaacgccgacaagagcaaggccgcccccgccgagatcgaccagagatag

SEQ ID NO: 98084 - DNA, 2202 bp, Artificial Sequence; identical to SEQ ID NO: 98081
  Description of Artificial Sequence: Synthetic coding sequence

SEQ ID NO: 98085 - DNA, 2748 bp, Artificial Sequence
  Description of Artificial Sequence: Synthetic coding sequence
atggccgagaccctgagcggcctgggcgacagcggcgccgccggcgccgccgccctgagcagcgccagcagcgagaccggcaccagaagactgagcgacctgagagtgatcgacctgagagccgagctgagaaagagaaacgtggacagcagcggcaacaagagcgtgctgatggagagactgaagaaggccatcgaggacgagggcggcaaccccgacgagatcgagatcaccagcgagggcaacaagaagaccagcaagagaagcagcaagggcagaaagcccgaggaggagggcgtggaggacaacggcctggaggagaacagcggcgacggccaggaggacgtggagaccagcctggagaacctgcaggacatcgacatcatggacatcagcgtgctggacgaggccgagatcgacaacggcagcgtggccgactgcgtggaggacgacgacgccgacaacctgcaggagagcctgagcgacagcagagagctggtggagggcgagatgaaggagctgcccgagcagctgcaggagcacgccatcgaggacaaggagaccatcaacaacctggacaccagcagcagcgacttcaccatcctgcaggagatcgaggagcccagcctggagcccgagaacgagaagatcctggacatcctgggcgagacctgcaagagcgagcccgtgaaggaggagagcagcgagctggagcagcccttcgcccaggacaccagcagcgtgggccccgacagaaagctggccgaggaggaggacctgttcgacagcgcccaccccgaggagggcgacctggacctggccagcgagagcaccgcccacgcccagagcagcaaggccgacagcctgctggccgtggtgaagagagagcccgccgagcagcccggcgacggcgagagaaccgactgcgagcccgtgggcctggagcccgccgtggagcagagcagcgccgccagcgagctggccgaggccagcagcgaggagctggccgaggcccccaccgaggcccccagccccgaggccagagacagcaaggaggacggcagaaagttcgacttcgacgcctgcaacgaggtgccccccgcccccaaggagagcagcaccagcgagggcgccgaccagaagatgagcagccccgaggacgacagcgacaccaagagactgagcaaggaggagaagggcagaagcagctgcggcagaaacttctgggtgagcggcctgagcagcaccaccagagccaccgacctgaagaacctgttcagcaagtacggcaaggtggtgggcgccaaggtggtgaccaacgccagaagccccggcgccagatgctacggcttcgtgaccatgagcaccgccgaggaggccaccaagtgcatcaaccacctgcacaagaccgagctgcacggcaagatgatcagcgtggagaaggccaagaacgagcccgtgggcaagaagaccagcgacaagagagacagcgacggcaagaaggagaagagcagcaacagcgacagaagcaccaacctgaagagagacgacaagtgcgacagaaaggacgacgccaagaagggcgacgacggcagcggcgagaagagcaaggaccaggacgaccagaagcccggccccagcgagagaagcagagccaccaagagcggcagcagaggcaccgagagaaccgtggtgatggacaagagcaagggcgtgcccgtgatcagcgtgaagaccagcggcagcaaggagagagccagcaagagccaggacagaaagagcgccagcagagagaagagaagcgtggtgagcttcgacaaggtgaaggagcccagaaagagcagagacagcgagagccacagcagagtgagagagagaagcgagagagagcagagaatgcaggcccagtgggagagagaggagagagagagactggagatcgccagagagagactggccttccagagacagagactggagagagagagaatggagagagagagactggagagagagagaatgcacgtggagcacgagagaagaagagagcaggagagaatccacagagagagagaggagctgagaagacagcaggagctgagatacgagcaggagagaagacccgccgtgagaagaccctacgacctggacagaagagacgacgcctactggcccgaggccaagagagccgccctggacgagagataccacagcgacttcaacagacaggacagattccacgacttcgaccacagagacagaggcagataccccgaccacagcgtggacagaagagagggcagcagaagcatgatgggcgagagagagggccagcactaccccgagagacacggcggccccgagagacacggcagagacagcagagacggctggggcggctacggcagcgacaagagaatgagcgagggcagaggcctgccccccccccccagaagagactggggcgaccacggcagaagagaggacgacagaagctggcagggcaccgccgacggcggcatgatggacagagaccacaagagatggcagggcggcgagagaagcatgagcggccacagcggccccggccacatgatgaacagaggcggcatgagcggcagaggcagcttcgcccccggcggcgccagcagaggccaccccatcccccacggcggcatgcagggcggcttcggcggccagagcagaggcagcagacccagcgacgccagattcaccagaagatactag

SEQ ID NO: 98086 - DNA, 2244 bp, Artificial Sequence
  Description of Artificial Sequence: Synthetic coding sequence
atgaaggagctgcccgagcagctgcaggagcacgccatcgaggacaaggagaccatcaacaacctggacaccagcagcagcgacttcaccatcctgcaggagatcgaggagcccagcctggagcccgagaacgagaagatcctggacatcctgggcgagacctgcaagagcgagcccgtgaaggaggagagcagcgagctggagcagcccttcgcccaggacaccagcagcgtgggccccgacagaaagctggccgaggaggaggacctgttcgacagcgcccaccccgaggagggcgacctggacctggccagcgagagcaccgcccacgcccagagcagcaaggccgacagcctgctggccgtggtgaagagagagcccgccgagcagcccggcgacggcgagagaaccgactgcgagcccgtgggcctggagcccgccgtggagcagagcagcgccgccagcgagctggccgaggccagcagcgaggagctggccgaggcccccaccgaggcccccagccccgaggccagagacagcaaggaggacggcagaaagttcgacttcgacgcctgcaacgaggtgccccccgcccccaaggagagcagcaccagcgagggcgccgaccagaagatgagcagccccgaggacgacagcgacaccaagagactgagcaaggaggagaagggcagaagcagctgcggcagaaacttctgggtgagcggcctgagcagcaccaccagagccaccgacctgaagaacctgttcagcaagtacggcaaggtggtgggcgccaaggtggtgaccaacgccagaagccccggcgccagatgctacggcttcgtgaccatgagcaccgccgaggaggccaccaagtgcatcaaccacctgcacaagaccgagctgcacggcaagatgatcagcgtggagaaggccaagaacgagcccgtgggcaagaagaccagcgacaagagagacagcgacggcaagaaggagaagagcagcaacagcgacagaagcaccaacctgaagagagacgacaagtgcgacagaaaggacgacgccaagaagggcgacgacggcagcggcgagaagagcaaggaccaggacgaccagaagcccggccccagcgagagaagcagagccaccaagagcggcagcagaggcaccgagagaaccgtggtgatggacaagagcaagggcgtgcccgtgatcagcgtgaagaccagcggcagcaaggagagagccagcaagagccaggacagaaagagcgccagcagagagaagagaagcgtggtgagcttcgacaaggtgaaggagcccagaaagagcagagacagcgagagccacagcagagtgagagagagaagcgagagagagcagagaatgcaggcccagtgggagagagaggagagagagagactggagatcgccagagagagactggccttccagagacagagactggagagagagagaatggagagagagagactggagagagagagaatgcacgtggagcacgagagaagaagagagcaggagagaatccacagagagagagaggagctgagaagacagcaggagctgagatacgagcaggagagaagacccgccgtgagaagaccctacgacctggacagaagagacgacgcctactggcccgaggccaagagagccgccctggacgagagataccacagcgacttcaacagacaggacagattccacgacttcgaccacagagacagaggcagataccccgaccacagcgtggacagaagagagggcagcagaagcatgatgggcgagagagagggccagcactaccccgagagacacggcggccccgagagacacggcagagacagcagagacggctggggcggctacggcagcgacaagagaatgagcgagggcagaggcctgccccccccccccagaggcagaagagactggggcgaccacggcagaagagaggacgacagaagctggcagggcaccgccgacggcggcatgatggacagagaccacaagagatggcagggcggcgagagaagcatgagcggccacagcggccccggccacatgatgaacagaggcggcatgagcggcagaggcagcttcgcccccggcggcgccagcagaggccaccccatcccccacggcggcatgcagggcggcttcggcggccagagcagaggcagcagacccagcgacgccagattcaccagaagatactag

SEQ ID NO: 98087 - DNA, 2547 bp, Artificial Sequence
  Description of Artificial Sequence: Synthetic coding sequence
atggccgagaccctgagcggcctgggcgacagcggcgccgccggcgccgccgccctgagcagcgccagcagcgagaccggcaccagaagactgagcgacctgagagtgatcgacctgagagccgagctgagaaagagaaacgtggacagcagcggcaacaagagcgtgctgatggagagactgaagaaggccatcgaggacgagggcggcaaccccgacgagatcgagatcaccagcgagggcaacaagaagaccagcaagagaagcagcaagggcagaaagcccgaggaggagggcgtggaggacaacggcctggaggagaacagcggcgacggccagatcgaggacaaggagaccatcaacaacctggacaccagcagcagcgacttcaccatcctgcaggagatcgaggagcccagcctggagcccgagaacgagaagatcctggacatcctgggcgagacctgcaagagcgagcccgtgaaggaggagagcagcgagctggagcagcccttcgcccaggacaccagcagcgtgggccccgacagaaagctggccgaggaggaggacctgttcgacagcgcccaccccgaggagggcgacctggacctggccagcgagagcaccgcccacgcccagagcagcaaggccgacagcctgctggccgtggtgaagagagagcccgccgagcagcccggcgacggcgagagaaccgactgcgagcccgtgggcctggagcccgccgtggagcagagcagcgccgccagcgagctggccgaggccagcagcgaggagctggccgaggcccccaccgaggcccccagccccgaggccagagacagcaaggaggacggcagaaagttcgacttcgacgcctgcaacgaggtgccccccgcccccaaggagagcagcaccagcgagggcgccgaccagaagatgagcagccccgaggacgacagcgacaccaagagactgagcaaggaggagaagggcagaagcagctgcggcagaaacttctgggtgagcggcctgagcagcaccaccagagccaccgacctgaagaacctgttcagcaagtacggcaaggtggtgggcgccaaggtggtgaccaacgccagaagccccggcgccagatgctacggcttcgtgaccatgagcaccgccgaggaggccaccaagtgcatcaaccacctgcacaagaccgagctgcacggcaagatgatcagcgtggagaaggccaagaacgagcccgtgggcaagaagaccagcgacaagagagacagcgacggcaagaaggagaagagcagcaacagcgacagaagcaccaacctgaagagagacgacaagtgcgacagaaaggacgacgccaagaagggcgacgacggcagcggcgagaagagcaaggaccaggacgaccagaagcccggccccagcgagagaagcagagccaccaagagcggcagcagaggcaccgagagaaccgtggtgatggacaagagcaagggcgtgcccgtgatcagcgtgaagaccagcggcagcaaggagagagccagcaagagccaggacagaaagagcgccagcagagagaagagaagcgtggtgagcttcgacaaggtgaaggagcccagaaagagcagagacagcgagagccacagcagagtgagagagagaagcgagagagagcagagaatgcaggcccagtgggagagagaggagagagagagactggagatcgccagagagagactggccttccagagacagagactggagagagagagaatggagagagagagactggagagagagagaatgcacgtggagcacgagagaagaagagagcaggagagaatccacagagagagagaggagctgagaagacagcaggagctgagatacgagcaggagagaagacccgccgtgagaagaccctacgacctggacagaagagacgacgcctactggcccgaggccaagagagccgccctggacgagagataccacagcgacttcaacagacaggacagattccacgacttcgaccacagagacagaggcagataccccgaccacagcgtggacagaagagagggcagcagaagcatgatgggcgagagagagggccagcactaccccgagagacacggcggccccgagagacacggcagagacagcagagacggctggggcggctacggcagcgacaagagaatgagcgagggcagaggcctgccccccccccccagaggcagaagagactggggcgaccacggcagaagagaggacgacagaagctggcagggcaccgccgacggcggcatgatggacagagaccacaagagatggcagggcggcgagagaagcatgagcggccacagcggccccggccacatgatgaacagaggcggcatgagcggcagaggcagcttcgcccccggcggcgccagcagaggccaccccatcccccacggcggcatgcagggcggcttcggcggccagagcagaggcagcagacccagcgacgccagattcaccagaagatactag

SEQ ID NO: 98088 - DNA, 2280 bp, Artificial Sequence
  Description of Artificial Sequence: Synthetic coding sequence
atgaaggtggtgatcctgaccaagctgaagctgccccccagagagaccagaaagcaccagagaggcctggccaagatcgaggacaaggagaccatcaacaacctggacaccagcagcagcgacttcaccatcctgcaggagatcgaggagcccagcctggagcccgagaacgagaagatcctggacatcctgggcgagacctgcaagagcgagcccgtgaaggaggagagcagcgagctggagcagcccttcgcccaggacaccagcagcgtgggccccgacagaaagctggccgaggaggaggacctgttcgacagcgcccaccccgaggagggcgacctggacctggccagcgagagcaccgcccacgcccagagcagcaaggccgacagcctgctggccgtggtgaagagagagcccgccgagcagcccggcgacggcgagagaaccgactgcgagcccgtgggcctggagcccgccgtggagcagagcagcgccgccagcgagctggccgaggccagcagcgaggagctggccgaggcccccaccgaggcccccagccccgaggccagagacagcaaggaggacggcagaaagttcgacttcgacgcctgcaacgaggtgccccccgcccccaaggagagcagcaccagcgagggcgccgaccagaagatgagcagccccgaggacgacagcgacaccaagagactgagcaaggaggagaagggcagaagcagctgcggcagaaacttctgggtgagcggcctgagcagcaccaccagagccaccgacctgaagaacctgttcagcaagtacggcaaggtggtgggcgccaaggtggtgaccaacgccagaagccccggcgccagatgctacggcttcgtgaccatgagcaccgccgaggaggccaccaagtgcatcaaccacctgcacaagaccgagctgcacggcaagatgatcagcgtggagaaggccaagaacgagcccgtgggcaagaagaccagcgacaagagagacagcgacggcaagaaggagaagagcagcaacagcgacagaagcaccaacctgaagagagacgacaagtgcgacagaaaggacgacgccaagaagggcgacgacggcagcggcgagaagagcaaggaccaggacgaccagaagcccggccccagcgagagaagcagagccaccaagagcggcagcagaggcaccgagagaaccgtggtgatggacaagagcaagggcgtgcccgtgatcagcgtgaagaccagcggcagcaaggagagagccagcaagagccaggacagaaagagcgccagcagagagaagagaagcgtggtgagcttcgacaaggtgaaggagcccagaaagagcagagacagcgagagccacagagtgagagagagaagcgagagagagcagagaatgcaggcccagtgggagagagaggagagagagagactggagatcgccagagagagactggccttccagagacagagactggagagagagagaatggagagagagagactggagagagagagaatgcacgtggagcacgagagaagaagagagcaggagagaatccacagagagagagaggagctgagaagacagcaggagctgagatacgagcaggagagaagacccgccgtgagaagaccctacgacctggacagaagagacgacgcctactggcccgaggccaagagagccgccctggacgagagataccacagcgacttcaacagacaggacagattccacgacttcgaccacagagacagaggcagataccccgaccacagcgtggacagaagagagggcagcagaagcatgatgggcgagagagagggccagcactaccccgagagacacggcggccccgagagacacggcagagacagcagagacggctggggcggctacggcagcgacaagagaatgagcgagggcagaggcctgccccccccccccagaggcagaagagactggggcgaccacggcagaagagaggacgacagaagctggcagggcaccgccgacggcggcatgatggacagagaccacaagagatggcagggcggcgagagaagcatgagcggccacagcggccccggccacatgatgaacagaggcggcatgagcggcagaggcagcttcgcccccggcggcgccagcagaggccaccccatcccccacggcggcatgcagggcggcttcggcggccagagcagaggcagcagacccagcgacgccagattcaccagaagatactag

SEQ ID NO: 98089 - DNA, 2439 bp, Artificial Sequence
  Description of Artificial Sequence: Synthetic coding sequence
atggccgagaccctgagcggcctgggcgacagcggcgccgccggcgccgccgccctgagcagcgccagcagcgagaccggcaccagaagactgagcgacctgagagtgatcgacctgagagccgagctgagaaagagaaacgtggacagcagcggcaacaagagcgtgctgatggagagactgaagaaggccatcgaggacgagggcggcaaccccgacgagatcgagatcaccagcgagggcaacaagaagaccagcaagagaagcagcaagggcagaaagcccgaggaggagggcgtggaggacaacggcctggagcccgagaacgagaagatcctggacatcctgggcgagacctgcaagagcgagcccgtgaaggaggagagcagcgagctggagcagcccttcgcccaggacaccagcagcgtgggccccgacagaaagctggccgaggaggaggacctgttcgacagcgcccaccccgaggagggcgacctggacctggccagcgagagcaccgcccacgcccagagcagcaaggccgacagcctgctggccgtggtgaagagagagcccgccgagcagcccggcgacggcgagagaaccgactgcgagcccgtgggcctggagcccgccgtggagcagagcagcgccgccagcgagctggccgaggccagcagcgaggagctggccgaggcccccaccgaggcccccagccccgaggccagagacagcaaggaggacggcagaaagttcgacttcgacgcctgcaacgaggtgccccccgcccccaaggagagcagcaccagcgagggcgccgaccagaagatgagcagccccgaggacgacagcgacaccaagagactgagcaaggaggagaagggcagaagcagctgcggcagaaacttctgggtgagcggcctgagcagcaccaccagagccaccgacctgaagaacctgttcagcaagtacggcaaggtggtgggcgccaaggtggtgaccaacgccagaagccccggcgccagatgctacggcttcgtgaccatgagcaccgccgaggaggccaccaagtgcatcaaccacctgcacaagaccgagctgcacggcaagatgatcagcgtggagaaggccaagaacgagcccgtgggcaagaagaccagcgacaagagagacagcgacggcaagaaggagaagagcagcaacagcgacagaagcaccaacctgaagagagacgacaagtgcgacagaaaggacgacgccaagaagggcgacgacggcagcggcgagaagagcaaggaccaggacgaccagaagcccggccccagcgagagaagcagagccaccaagagcggcagcagaggcaccgagagaaccgtggtgatggacaagagcaagggcgtgcccgtgatcagcgtgaagaccagcggcagcaaggagagagccagcaagagccaggacagaaagagcgccagcagagagaagagaagcgtggtgagcttcgacaaggtgaaggagcccagaaagagcagagacagcgagagccacagcagagtgagagagagaagcgagagagagcagagaatgcaggcccagtgggagagagaggagagagagagactggagatcgccagagagagactggccttccagagacagagactggagagagagagaatggagagagagagactggagagagagagaatgcacgtggagcacgagagaagaagagagcaggagagaatccacagagagagagaggagctgagaagacagcaggagctgagatacgagcaggagagaagacccgccgtgagaagaccctacgacctggacagaagagacgacgcctactggcccgaggccaagagagccgccctggacgagagataccacagcgacttcaacagacaggacagattccacgacttcgaccacagagacagaggcagataccccgaccacagcgtggacagaagagagggcagcagaagcatgatgggcgagagagagggccagcactaccccgagagacacggcggccccgagagacacggcagagacagcagagacggctggggcggctacggcagcgacaagagaatgagcgagggcagaggcctgccccccccccccagaggcagaagagactggggcgaccacggcagaagagaggacgacagaagctggcagggcaccgccgacggcggcatgatggacagagaccacaagagatggcagggcggcgagagaagcatgagcggccacagcggccccggccacatgatgaacagaggcggcatgagcggcagaggcagcttcgcccccggcggcgccagcagaggccaccccatcccccacggcggcatgcagggcggcttcggcggccagagcagaggcagcagacccagcgacgccagattcaccagaagatactag

SEQ ID NO: 98090 - DNA, 2862 bp, Artificial Sequence
  Description of Artificial Sequence: Synthetic coding sequence
atggccgagaccctgcccggcagcggcgacagcggccccggcaccgccagcctgggccccggcgtggccgagaccggcaccagaagactgagcgagctgagagtgatcgacctgagagccgagctgaagaagagaaacctggacaccggcggcaacaagagcgtgctgatggagagactgaagaaggccgtgaaggaggagggccaggaccccgacgagatcggcatcgagctggaggccaccagcaagaagagcgccaagagatgcgtgaagggcctgaagatggaggaggagggcaccgaggacaacggcctggaggacgacagcagagacggccaggaggacatggaggccagcctggagaacctgcagaacatgggcatgatggacatgagcgtgctggacgagaccgaggtggccaacagcagcgcccccgacttcggcgaggacggcaccgacggcctgctggacagcttctgcgacagcaaggagtacgtggccgcccagctgagacagctgcccgcccagccccccgagcacgccgtggacggcgagggcttcaagaacaccctggagaccagcagcctgaacttcaaggtgacccccgacatcgaggagagcctgctggagcccgagaacgagaagatcctggacatcctgggcgagacctgcaagagcgagcccgtgaaggaggagagcagcgagctggagcagcccttcgcccaggacaccagcagcgtgggccccgacagaaagctggccgaggaggaggacctgttcgacagcgcccaccccgaggagggcgacctggacctggccagcgagagcaccgcccacgcccagagcagcaaggccgacagcctgctggccgtggtgaagagagagcccgccgagcagcccggcgacggcgagagaaccgactgcgagcccgtgggcctggagcccgccgtggagcagagcagcgccgccagcgagctggccgaggccagcagcgaggagctggccgaggcccccaccgaggcccccagccccgaggccagagacagcaaggaggacggcagaaagttcgacttcgacgcctgcaacgaggtgccccccgcccccaaggagagcagcaccagcgagggcgccgaccagaagatgagcagcttcaaggaggagaaggacatcaagcccatcatcaaggacgagaagggcagagtgggcagcggcagcggcagaaacctgtgggtgagcggcctgagcagcaccaccagagccaccgacctgaagaacctgttcagcaagtacggcaaggtggtgggcgccaaggtggtgaccaacgccagaagccccggcgccagatgctacggcttcgtgaccatgagcaccagcgacgaggccaccaagtgcatcagccacctgcacagaaccgagctgcacggcagaatgatcagcgtggagaaggccaagaacgagcccgccggcaagaagctgagcgacagaaaggagtgcgaggtgaagaaggagaagctgagcagcgtggacagacaccacagcgtggagatcaagatcgagaagaccgtgatcaagaaggaggagaagatcgagaagaaggaggagaagaagcccgaggacatcaagaaggaggagaaggaccaggacgagctgaagcccggccccaccaacagaagcagagtgaccaagagcggcagcagaggcatggagagaaccgtggtgatggacaagagcaagggcgagcccgtgatcagcgtgaagaccaccagcagaagcaaggagagaagcagcaagagccaggacagaaagagcgagagcaaggagaagagagacatcctgagcttcgacaagatcaaggagcagagagagagagagagacagagacagagagagagagagatcagagagaccgagagaagaagagagagagagcagagagagagagagcagagactggaggccttccacgagagaaaggagaaggccagactgcagagagagagactgcagctggagtgccagagacagagactggagagagagagaatggagagagagagactggagagagagagaatgagagtggagagagagagaagaaaggagcaggagagaatccacagagagagagaggagctgagaagacagcaggagcagctgagatacgagcaggagagaagacccggcagaagaccctacgacctggacagaagagacgacgcctactggcccgagggcaagagagtggccatggaggacagatacagagccgacttccccagacccgaccacagattccacgacttcgaccacagagacagaggccagtaccaggaccacgccatcgacagaagagagggcagcagacccatgatgggcgaccacagagacggccagcactacggcgacgacagacacggccacggcggcccccccgagagacacggcagagacagcagagacggctggggcggctacggcagcgacaagagactgagcgagggcagaggcctgccccccccccccagaggcggcagagactggggcgagcacaaccagagactggaggagcaccaggccagagcctggcagggcgccatggacgccggcgccgccagcagagagcacgccagatggcagggcggcgagagaggcctgagcggccccagcggccccggccacatggccagcagaggcggcgtggccggcagaggcggcttcgcccagggcggccacagccagggccacgtggtgcccggcggcggcctggagggcggcggcgtggccagccaggacagaggcagcagagtgccccacccccacccccacccccccccctacccccacttcaccagaagatactag

SEQ ID NO: 98091 - DNA, 1533 bp, Artificial Sequence
  Description of Artificial Sequence: Synthetic coding sequence
atggccgagaccctgcccggcagcggcgacagcggccccggcaccgccagcctgggccccggcgtggccgagaccggcaccagaagactgagcgagctgagagtgatcgacctgagagccgagctgaagaagagaaacctggacaccggcggcaacaagagcgtgctgatggagagactgaagaaggccgtgaaggaggagggccaggaccccgacgagatcggcatcgagctggaggccaccagcaagaagagcgccaagagatgcgtgaagggcctgaagatggaggaggagggcaccgaggacaacggcctggaggacgacagcagagacggccaggaggacatggaggccagcctggagaacctgcagaacatgggcatgatggacatgagcgtgctggacgagaccgaggtggccaacagcagcgcccccgacttcggcgaggacggcaccgacggcctgctggacagcttctgcgacagcaaggagtacgtggccgcccagctgagacagctgcccgcccagccccccgagcacgccgtgggcaacctggagaccagacaggacgtgcccaccagcagcagcctgagagtgagcgtggccgccgtgcccgtgccccacctgagcgtggagaacgagaagatcctggacatcctgggcgagacctgcaagagcgagcccgtgaaggaggagagcagcgagctggagcagcccttcgcccaggacaccagcagcgtgggccccgacagaaagctggccgaggaggaggacctgttcgacagcgcccaccccgaggagggcgacctggacctggccagcgagagcaccgcccacgcccagagcagcaaggccgacagcctgctggccgtggtgaagagagagcccgccgagcagcccggcgacggcgagagaaccgactgcgagcccgtgggcctggagcccgccgtggagcagagcagcgccgccagcgagctggccgaggccagcagcgaggagctggccgaggcccccaccgaggcccccagccccgaggccagagacagcaaggaggacggcagaaagttcgacttcgacgcctgcaacgaggtgccccccgcccccaaggagagcagcaccagcgagggcgccgaccagaagatgagcagcttcaaggaggagaaggacatcaagcccatcatcaaggacgagaagggcagagtgggcagcggcagcggcagaaacctgtgggtgagcggcctgagcagcaccaccagagccaccgacctgaagaacctgttcagcaagtacggcaaggtggtgggcgccaaggtggtgaccaacgccagaagccccggcgccagatgctacggcttcgtgaccatgagcaccagcgacgaggccaccaagtgcatcagccacctgcacagaaccgagctgcacggcagaatgatcagcgtggagaaggccaagaacgagcccgccggcaagaagctgagcgacagaaaggagtgcgaggtgaagaaggagaagctgagcagcgtggacagatag

SEQ ID NO: 98092 - DNA, 786 bp, Artificial Sequence
  Description of Artificial Sequence: Synthetic coding sequence
atggccgagaccctgcccggcagcggcgacagcggccccggcaccgccagcctgggccccggcgtggccgagaccggcaccagaagactgagcgagctgagagtgatcgacctgagagccgagctgaagaagagaaacctggacaccggcggcaacaagagcgtgctgatggagagactgaagaaggccgtgaaggaggagggccaggaccccgacgagatcggcatcgagctggaggccaccagcaagaagagcgccaagagatgcgtgaaggcccccagccccgaggccagagacagcaaggaggacggcagaaagttcgacttcgacgcctgcaacgaggtgccccccgcccccaaggagagcagcaccagcgagggcgccgaccagaagatgagcagcttcaaggaggagaaggacatcaagcccatcatcaaggacgagaagggcagagtgggcagcggcagcggcagaaacctgtgggtgagcggcctgagcagcaccaccagagccaccgacctgaagaacctgttcagcaagtacggcaaggtggtgggcgccaaggtggtgaccaacgccagaagccccggcgccagatgctacggcttcgtgaccatgagcaccagcgacgaggccaccaagtgcatcagccacctgcacagaaccgagctgcacggcagaatgatcagcgtggagaaggccaagaacgagcccgccggcaagaagctgagcgacagaaaggagtgcgaggtgaagaaggagaagctgagcagcgtggacagatag

SEQ ID NO: 98093 - DNA, 1221 bp, Artificial Sequence
  Description of Artificial Sequence: Synthetic coding sequence
atggccgagaccctgcccggcagcggcgacagcggccccggcaccgccagcctgggccccggcgtggccgagaccggcaccagaagactgagcgagctgagagtgatcgacctgagagccgagctgaagaagagaaacctggacaccggcggcaacaagagcgtgctgatggagagactgaagaaggccgtgaaggaggagggccaggaccccgacgagatcggcatcgagctggaggccaccagcaagaagagcgccaagagatgcgtgaagggcctgaagatggaggaggagggcaccgaggacaacggcctggaggtggagaacgagaagatcctggacatcctgggcgagacctgcaagagcgagcccgtgaaggaggagagcagcgagctggagcagcccttcgcccaggacaccagcagcgtgggccccgacagaaagctggccgaggaggaggacctgttcgacagcgcccaccccgaggagggcgacctggacctggccagcgagagcaccgcccacgcccagagcagcaaggccgacagcctgctggccgtggtgaagagagagcccgccgagcagcccggcgacggcgagagaaccgactgcgagcccgtgggcctggagcccgccgtggagcagagcagcgccgccagcgagctggccgaggccagcagcgaggagctggccgaggcccccaccgaggcccccagccccgaggccagagacagcaaggaggacggcagaaagttcgacttcgacgcctgcaacgaggtgccccccgcccccaaggagagcagcaccagcgagggcgccgaccagaagatgagcagcttcaaggaggagaaggacatcaagcccatcatcaaggacgagaagggcagagtgggcagcggcagcggcagaaacctgtgggtgagcggcctgagcagcaccaccagagccaccgacctgaagaacctgttcagcaagtacggcaaggtggtgggcgccaaggtggtgaccaacgccagaagccccggcgccagatgctacggcttcgtgaccatgagcaccagcgacgaggccaccaagtgcatcagccacctgcacagaaccgagctgcacggcagaatgatcagcgtggagaaggccaagaacgagcccgccggcaagaagctgagcgacagaaaggagtgcgaggtgaagaaggagaagctgagcagcgtggacagatag

SEQ ID NO: 98094 - DNA, 606 bp, Artificial Sequence
  Description of Artificial Sequence: Synthetic coding sequence
atggccgagaccggcaccagaagactgagcgagctgagagtgatcgacctgagagccgagctgaagaagagaaacctggacaccggcggcaacaagagcgtgctgatggagagactgaagaaggccgtgaaggaggagggccaggaccccgacgagatcggcatcgagctggaggccaccagcaagaagagcgccaagagatgcgtgaagggcctgaagatggaggaggagggcaccgaggacaacggcctggaggacgacagcagagacggccaggaggacatggaggccagcctggagaacctgcagaacatgggcatgatggacatgagcgtgctggacgagaccgaggtggccaacagcagcgcccccgacttcggcgaggacggcaccgacggcctgctggacagcttctgcgacagcaaggagtacgtggccgcccagctgagacagctgcccgcccagccccccgagcacgccgtggacggcgagggcttcaagaacaccctggagaccagcagcctgaacttcaaggtgacccccgacatcgaggagagcctgctggagcccggcaccgacaagagaaacaccaccgtgatggtgtag

SEQ ID NO: 98095 - DNA, 1821 bp, Artificial Sequence
  Description of Artificial Sequence: Synthetic coding sequence
atgaaggtgagaagcgccggcggcgacggcgacgccctgtgcgtgaccgaggaggacctggccggcgacgacgaggacatgcccaccttcccctgcacccagaagggcagacccggccccagatgcagcagatgccagaagaacctgagcctgcacaccagcgtgagaatcctgtacctgttcctggccctgctgctggtggccgtggccgtgctggccagcctggtgttcagaaaggtggacagcctgagcgaggacatcagcctgacccagagcatctacgacaagaagctggtgctgatgcagaagaacctgcagggcctggaccccaaggccctgaacaactgcagcttctgccacgaggccggccagctgggccccgagatcagaaagctgcaggaggagctggagggcatccagaagctgctgctggcccaggaggtgcagctggaccagaccctgcaggcccaggaggtgctgagcaccaccagcagacagatcagccaggagatgggcagctgcagcttcagcatccaccaggtgaaccagagcctgggcctgttcctggcccaggtgagaggctggcaggccaccaccgccggcctggacctgagcctgaaggacctgacccaggagtgctacgacgtgaaggccgccgtgcaccagatcaacttcaccgtgggccagaccagcgagtggatccacggcatccagagaaagaccgacgaggagaccctgaccctgcagaagatcgtgaccgactggcagaactacaccagactgttcagcggcctgagaaccaccagcaccaagaccggcgaggccgtgaagaacatccaggccaccctgggcgccagcagccagagaatcagccagaacagcgagagcatgcacgacctggtgctgcaggtgatgggcctgcagctgcagctggacaacatcagcagcttcctggacgaccacgaggagaacatgcacgacctgcagtaccacacccactacgcccagaacagaaccgtggagagattcgagagcctggagggcagaatggccagccacgagatcgagatcggcaccatcttcaccaacatcaacgccaccgacaaccacgtgcacagcatgctgaagtacctggacgacgtgagactgagctgcaccctgggcttccacacccacgccgaggagctgtactacctgaacaagagcgtgagcatcatgctgggcaccaccgacctgctgagagagagattcagcctgctgagcgccagactggacctgaacgtgagaaacctgagcatgatcgtggaggagatgaaggccgtggacacccagcacggcgagatcctgagaaacgtgaccatcctgagaggcgcccccggcccccccggccccagaggcttcaagggcgacatgggcgtgaagggccccgtgggcggcagaggccccaagggcgaccccggcagcctgggccccctgggcccccagggcccccagggccagcccggcgaggccggccccgtgggcgagagaggccccgtgggccccagaggcttccccggcctgaagggcagcaagggcagcttcggcaccggcggccccagaggccagcccggccccaagggcgacatcggcccccccggccccgagggcccccccggcagccccggccccagcggcccccagggcaagcccggcatcgccggcaagaccggcagccccggccagagaggcgccatgggccccaagggcgagcccggcatccagggcccccccggcctgcccggcccccccggcccccccggcagccagagcttctactag

SEQ ID NO: 98096 - DNA, 1401 bp, Artificial Sequence
  Description of Artificial Sequence: Synthetic coding sequence
atgaaggtgagaagcgccggcggcgacggcgacgccctgtgcgtgaccgaggaggacctggccggcgacgacgaggacatgcccaccttcccctgcacccagaagggcagacccggccccagatgcagcagatgccagaagaacctgagcctgcacaccagcgtgagaatcctgtacctgttcctggccctgctgctggtggccgtggccgtgctggccagcctggtgttcagaaaggtggacagcctgagcgaggacatcagcctgacccagagcatctacgacaagaagctggtgctgatgcagaagaacctgcagggcctggaccccaaggccctgaacaactgcagcttctgccacgaggccggccagctgggccccgagatcagaaagctgcaggaggagctggagggcatccagaagctgctgctggcccaggaggtgcagctggaccagaccctgcaggcccaggaggtgctgagcaccaccagcagacagatcagccaggagatgggcagctgcagcttcagcatccaccaggtgaaccagagcctgggcctgttcctggcccaggtgagaggctggcaggccaccaccgccggcctggacctgagcctgaaggacctgacccaggagtgctacgacgtgaaggccgccgtgcaccagatcaacttcaccgtgggccagaccagcgagtggatccacggcatccagagaaagaccgacgaggagaccctgaccctgcagaagatcgtgaccgactggcagaactacaccagactgttcagcggcctgagaaccaccagcaccaagaccggcgaggccgtgaagaacatccaggccaccctgggcgccagcagccagagaatcagccagaacagcgagagcatgcacgacctggtgctgcaggtgatgggcctgcagctgcagctggacaacatcagcagcttcctggacgaccacgaggagaacatgcacgacctgcagtaccacacccactacgcccagaacagaaccgtggagagattcgagagcctggagggcagaatggccagccacgagatcgagatcggcaccatcttcaccaacatcaacgccaccgacaaccacgtgcacagcatgctgaagtacctggacgacgtgagactgagctgcaccctgggcttccacacccacgccgaggagctgtactacctgaacaagagcgtgagcatcatgctgggcaccaccgacctgctgagagagagattcagcctgctgagcgccagactggacctgaacgtgagaaacctgagcatgatcgtggaggagatgaaggccgtggacacccagcacggcgagatcctgagaaacgtgaccatcctgagaggccacaccctgttcagccacaacagaatctag

SEQ ID NO: 98097 - DNA, 1008 bp, Artificial Sequence
  Description of Artificial Sequence: Synthetic coding sequence
atgggcagatgctgcttctacaccgccggcaccctgagcctgctgctgctggtgaccagcgtgaccctgctggtggccagagtgttccagaaggccgtggaccagagcatcgagaagaagatcgtgctgagaaacggcaccgaggccttcgacagctgggagaagccccccctgcccgtgtacacccagttctacttcttcaacgtgaccaaccccgaggagatcctgagaggcgagacccccagagtggaggaggtgggcccctacacctacagaagcctggactggtggatcaccgacaagtgcaacatgatcaacggcaccgacggcgacagcttccaccccctgatcaccaaggacgaggtgctgtacgtgttccccagcgacttctgcagaagcgtgtacatcaccttcagcgactacgagagcgtgcagggcctgcccgccttcagatacaaggtgcccgccgagatcctggccaacaccagcgacaacgccggcttctgcatccccgagggcaactgcctgggcagcggcgtgctgaacgtgagcatctgcaagaacggcgcccccatcatcatgagcttcccccacttctaccaggccgacgagagattcgtgagcgccatcgagggcatgcaccccaaccaggaggaccacgagaccttcgtggacatcaaccccctgaccggcatcatcctgaaggccgccaagagattccagatcaacatctacgtgaagaagctggacgacttcgtggagaccggcgacatcagaaccatggtgttccccgtgatgtacctgaacgagagcgtgcacatcgacaaggagaccgccagcagactgaagagcatgatcaacaccaccctgatcatcaccaacatcccctacatcatcatggccctgggcgtgttcttcggcctggtgttcacctggctggcctgcaagggccagggcagcatggacgagggcaccgccgacgagagagcccccctgatcagaacctag

SEQ ID NO: 98098 - DNA, 1530 bp, Artificial Sequence
  Description of Artificial Sequence: Synthetic coding sequence
atgggctgcagcgccaaggccagatgggccgccggcgccctgggcgtggccggcctgctgtgcgccgtgctgggcgccgtgatgatcgtgatggtgcccagcctgatcaagcagcaggtgctgaagaacgtgagaatcgaccccagcagcctgagcttcaacatgtggaaggagatccccatccccttctacctgagcgtgtacttcttcgacgtgatgaaccccagcgagatcctgaagggcgagaagccccaggtgagagagagaggcccctacgtgtacagagagttcagacacaagagcaacatcaccttcaacaacaacgacaccgtgagcttcctggagtacagaaccttccagttccagcccagcaagagccacggcagcgagagcgactacatcgtgatgcccaacatcctggtgctgggcgccgccgtgatgatggagaacaagcccatgaccctgaagctgatcatgaccctggccttcaccaccctgggcgagagagccttcatgaacagaaccgtgggcgagatcatgtggggctacaaggaccccctggtgaacctgatcaacaagtacttccccggcatgttccccttcaaggacaagttcggcctgttcgccgagctgaacaacagcgacagcggcctgttcaccgtgttcaccggcgtgcagaacatcagcagaatccacctggtggacaagtggaacggcctgagcaaggtggacttctggcacagcgaccagtgcaacatgatcaacggcaccagcggccagatgtggccccccttcatgacccccgagagcagcctggagttctacagccccgaggcctgcagaagcatgaagctgatgtacaaggagagcggcgtgttcgagggcatccccacctacagattcgtggcccccaagaccctgttcgccaacggcagcatctacccccccaacgagggcttctgcccctgcctggagagcggcatccagaacgtgagcacctgcagattcagcgcccccctgttcctgagccacccccacttcctgaacgccgaccccgtgctggccgaggccgtgaccggcctgcaccccaaccaggaggcccacagcctgttcctggacatccaccccgtgaccggcatccccatgaactgcagcgtgaagctgcagctgagcctgtacatgaagagcgtggccggcatcggccagaccggcaagatcgagcccgtggtgctgcccctgctgtggttcgccgagagcggcgccatggagggcgagaccctgcacaccttctacacccagctggtgctgatgcccaaggtgatgcactacgcccagtacgtgctgctggccctgggctgcgtgctgctgctggtgcccgtgatctgccagatcagaagccaggagaagtgctacctgttctggagcagcagcaagaagggcagcaaggacaaggaggccatccaggcctacagcgagagcctgatgaccagcgcccccaagggcagcgtgctgcaggaggccaagctgtag

SEQ ID NO: 98099 - DNA, 1521 bp, Artificial Sequence
  Description of Artificial Sequence: Synthetic coding sequence
atgggctgcagcgccaaggccagatgggccgccggcgccctgggcgtggccggcctgctgtgcgccgtgctgggcgccgtgatgatcgtgatggtgcccagcctgatcaagcagcaggtgctgaagaacgtgagaatcgaccccagcagcctgagcttcaacatgtggaaggagatccccatccccttctacctgagcgtgtacttcttcgacgtgatgaaccccagcgagatcctgaagggcgagaagccccaggtgagagagagaggcccctacgtgtacagagagttcagacacaagagcaacatcaccttcaacaacaacgacaccgtgagcttcctggagtacagaaccttccagttccagcccagcaagagccacggcagcgagagcgactacatcgtgatgcccaacatcctggtgctgggcgccgccgtgatgatggagaacaagcccatgaccctgaagctgatcatgaccctggccttcaccaccctgggcgagagagccttcatgaacagaaccgtgggcgagatcatgtggggctacaaggaccccctggtgaacctgatcaacaagtacttccccggcatgttccccttcaaggacaagttcggcctgttcgccgagctgaacaacagcgacagcggcctgttcaccgtgttcaccggcgtgcagaacatcagcagaatccacctggtggacaagtggaacggcctgagcaaggtggacttctggcacagcgaccagtgcaacatgatcaacggcaccagcggccagatgtggccccccttcatgacccccgagagcagcctggagttctacagccccgaggcctgcagaagcatgaagctgatgtacaaggagagcggcgtgttcgagggcatccccacctacagattcgtggcccccaagaccctgttcgccaacggcagcatctacccccccaacgagggcttctgcccctgcctggagagcggcatccagaacgtgagcacctgcagattcagcgcccccctgttcctgagccacccccacttcctgaacgccgaccccgtgctggccgaggccgtgaccggcctgcaccccaaccaggaggcccacagcctgttcctggacatccaccccgtgaccggcatccccatgaactgcagcgtgaagctgcagctgagcctgtacatgaagagcgtggccggcatcggccagaccggcaagatcgagcccgtggtgctgcccctgctgtggttcgccgagagcggcgccatggagggcgagaccctgcacaccttctacacccagctggtgctgatgcccaaggtgatgcactacgcccagtacgtgctgctggccctgggctgcgtgctgctgctggtgcccgtgatctgccagatcagaagccagggccccgaggacaccgtgagccagcccggcctggccgccggccccgacagaccccccagcccctacacccccctgctgcccgacagccccagcggccagccccccagccccaccgcctag

SEQ ID NO: 98100 - DNA, 1230 bp, Artificial Sequence
  Description of Artificial Sequence: Synthetic coding sequence
atgggctgcagcgccaaggccagatgggccgccggcgccctgggcgtggccggcctgctgtgcgccgtgctgggcgccgtgatgatcgtgatggtgcccagcctgatcaagcagcaggtgctgaagggcgccgccgtgatgatggagaacaagcccatgaccctgaagctgatcatgaccctggccttcaccaccctgggcgagagagccttcatgaacagaaccgtgggcgagatcatgtggggctacaaggaccccctggtgaacctgatcaacaagtacttccccggcatgttccccttcaaggacaagttcggcctgttcgccgagctgaacaacagcgacagcggcctgttcaccgtgttcaccggcgtgcagaacatcagcagaatccacctggtggacaagtggaacggcctgagcaaggtggacttctggcacagcgaccagtgcaacatgatcaacggcaccagcggccagatgtggccccccttcatgacccccgagagcagcctggagttctacagccccgaggcctgcagaagcatgaagctgatgtacaaggagagcggcgtgttcgagggcatccccacctacagattcgtggcccccaagaccctgttcgccaacggcagcatctacccccccaacgagggcttctgcccctgcctggagagcggcatccagaacgtgagcacctgcagattcagcgcccccctgttcctgagccacccccacttcctgaacgccgaccccgtgctggccgaggccgtgaccggcctgcaccccaaccaggaggcccacagcctgttcctggacatccaccccgtgaccggcatccccatgaactgcagcgtgaagctgcagctgagcctgtacatgaagagcgtggccggcatcggccagaccggcaagatcgagcccgtggtgctgcccctgctgtggttcgccgagagcggcgccatggagggcgagaccctgcacaccttctacacccagctggtgctgatgcccaaggtgatgcactacgcccagtacgtgctgctggccctgggctgcgtgctgctgctggtgcccgtgatctgccagatcagaagccaggagaagtgctacctgttctggagcagcagcaagaagggcagcaaggacaaggaggccatccaggcctacagcgagagcctgatgaccagcgcccccaagggcagcgtgctgcaggaggccaagctgtag

SEQ ID NO: 98101 - DNA, 1659 bp, Artificial Sequence
  Description of Artificial Sequence: Synthetic coding sequence
atgggctgcagcgccaaggccagatgggccgccggcgccctgggcgtggccggcctgctgtgcgccgtgctgggcgccgtgatgatcgtgatggtgcccagcctgatcaagcagcaggtgctgaagaacgtgagaatcgaccccagcagcctgagcttcaacatgtggaaggagatccccatccccttctacctgagcgtgtacttcttcgacgtgatgaaccccagcgagatcctgaagggcgagaagccccaggtgagagagagaggcccctacgtgtacagagagttcagacacaagagcaacatcaccttcaacaacaacgacaccgtgagcttcctggagtacagaaccttccagttccagcccagcaagagccacggcagcgagagcgactacatcgtgatgcccaacatcctggtgctgggcgccgccgtgatgatggagaacaagcccatgaccctgaagctgatcatgaccctggccttcaccaccctgggcgagagagccttcatgaacagaaccgtgggcgagatcatgtggggctacaaggaccccctggtgaacctgatcaacaagtacttccccggcatgttccccttcaaggacaagttcggcctgttcgccgagctgaacaacagcgacagcggcctgttcaccgtgttcaccggcgtgcagaacatcagcagaatccacctggtggacaagtggaacggcctgagcaaggtggacttctggcacagcgaccagtgcaacatgatcaacggcaccagcggccagatgtggccccccttcatgacccccgagagcagcctggagttctacagccccgaggcctgcagaagcatgaagctgatgtacaaggagagcggcgtgttcgagggcatccccacctacagattcgtggcccccaagaccctgttcgccaacggcagcatctacccccccaacgagggcttctgcccctgcctggagagcggcatccagaacgtgagcacctgcagattcagcgcccccctgttcctgagccacccccacttcctgaacgccgaccccgtgctggccgaggccgtgaccggcctgcaccccaaccaggaggcccacagcctgttcctggacatccaccccgtgaccggcatccccatgaactgcagcgtgaagctgcagctgagcctgtacatgaagagcgtggccggcatcggccagaccggcaagatcgagcccgtggtgctgcccctgctgtggttcgccgagagcggcgccatggagggcgagaccctgcacaccttctacacccagctggtgctgatgcccaaggtgatgcactacgcccagtacgtgctgctggccctgggctgcgtgctgctgctggtgcccgtgatctgccagatcagaagccaggtgggcgccggccagagagccgccagagccgacagccacagcctggcctgctggggcaagggcgccagcgacagaaccctgtggcccaccgccgcctggagccccccccccgccgccgtgctgagactgtgcagaagcggcagcggccactgctggggcctgagaagcaccctggccagcttcgcctgcagagtggccaccaccctgcccgtgctggagggcctgggccccagcctgggcggcggcaccggcagctag

SEQ ID NO: 98102 - DNA, 1551 bp, Artificial Sequence
  Description of Artificial Sequence: Synthetic coding sequence
atgtgcgccgtgggcaacgtgagaatcgaccccagcagcctgagcttcaacatgtggaaggagatccccatccccttctacctgagcgtgtacttcttcgacgtgatgaaccccagcgagatcctgaagggcgagaagccccaggtgagagagagaggcccctacgtgtacagagagttcagacacaagagcaacatcaccttcaacaacaacgacaccgtgagcttcctggagtacagaaccttccagttccagcccagcaagagccacggcagcgagagcgactacatcgtgatgcccaacatcctggtgctgggcgccgccgtgatgatggagaacaagcccatgaccctgaagctgatcatgaccctggccttcaccaccctgggcgagagagccttcatgaacagaaccgtgggcgagatcatgtggggctacaaggaccccctggtgaacctgatcaacaagtacttccccggcatgttccccttcaaggacaagttcggcctgttcgccgagctgaacaacagcgacagcggcctgttcaccgtgttcaccggcgtgcagaacatcagcagaatccacctggtggacaagtggaacggcctgagcaaggtggacttctggcacagcgaccagtgcaacatgatcaacggcaccagcggccagatgtggccccccttcatgacccccgagagcagcctggagttctacagccccgaggcctgcagaagcatgaagctgatgtacaaggagagcggcgtgttcgagggcatccccacctacagattcgtggcccccaagaccctgttcgccaacggcagcatctacccccccaacgagggcttctgcccctgcctggagagcggcatccagaacgtgagcacctgcagattcagcgcccccctgttcctgagccacccccacttcctgaacgccgaccccgtgctggccgaggccgtgaccggcctgcaccccaaccaggaggcccacagcctgttcctggacatccaccccgtgaccggcatccccatgaactgcagcgtgaagctgcagctgagcctgtacatgaagagcgtggccggcatcggccagaccggcaagatcgagcccgtggtgctgcccctgctgtggttcgccgagagcggcgccatggagggcgagaccctgcacaccttctacacccagctggtgctgatgcccaaggtgatgcactacgcccagtacgtgctgctggccctgggctgcgtgctgctgctggtgcccgtgatctgccagatcagaagccaggtgggcgccggccagagagccgccagagccgacagccacagcctggcctgctggggcaagggcgccagcgacagaaccctgtggcccaccgccgcctggagccccccccccgccgccgtgctgagactgtgcagaagcggcagcggccactgctggggcctgagaagcaccctggccagcttcgcctgcagagtggccaccaccctgcccgtgctggagggcctgggccccagcctgggcggcggcaccggcggcctgtag

SEQ ID NO: 98103 - DNA, 1539 bp, Artificial Sequence
  Description of Artificial Sequence: Synthetic coding sequence
atgaacgtgagaatcgaccccagcagcctgagcttcaacatgtggaaggagatccccatccccttctacctgagcgtgtacttcttcgacgtgatgaaccccagcgagatcctgaagggcgagaagccccaggtgagagagagaggcccctacgtgtacagagagttcagacacaagagcaacatcaccttcaacaacaacgacaccgtgagcttcctggagtacagaaccttccagttccagcccagcaagagccacggcagcgagagcgactacatcgtgatgcccaacatcctggtgctgggcgccgccgtgatgatggagaacaagcccatgaccctgaagctgatcatgaccctggccttcaccaccctgggcgagagagccttcatgaacagaaccgtgggcgagatcatgtggggctacaaggaccccctggtgaacctgatcaacaagtacttccccggcatgttccccttcaaggacaagttcggcctgttcgccgagctgaacaacagcgacagcggcctgttcaccgtgttcaccggcgtgcagaacatcagcagaatccacctggtggacaagtggaacggcctgagcaaggtggacttctggcacagcgaccagtgcaacatgatcaacggcaccagcggccagatgtggccccccttcatgacccccgagagcagcctggagttctacagccccgaggcctgcagaagcatgaagctgatgtacaaggagagcggcgtgttcgagggcatccccacctacagattcgtggcccccaagaccctgttcgccaacggcagcatctacccccccaacgagggcttctgcccctgcctggagagcggcatccagaacgtgagcacctgcagattcagcgcccccctgttcctgagccacccccacttcctgaacgccgaccccgtgctggccgaggccgtgaccggcctgcaccccaaccaggaggcccacagcctgttcctggacatccaccccgtgaccggcatccccatgaactgcagcgtgaagctgcagctgagcctgtacatgaagagcgtggccggcatcggccagaccggcaagatcgagcccgtggtgctgcccctgctgtggttcgccgagagcggcgccatggagggcgagaccctgcacaccttctacacccagctggtgctgatgcccaaggtgatgcactacgcccagtacgtgctgctggccctgggctgcgtgctgctgctggtgcccgtgatctgccagatcagaagccaggtgggcgccggccagagagccgccagagccgacagccacagcctggcctgctggggcaagggcgccagcgacagaaccctgtggcccaccgccgcctggagccccccccccgccgccgtgctgagactgtgcagaagcggcagcggccactgctggggcctgagaagcaccctggccagcttcgcctgcagagtggccaccaccctgcccgtgctggagggcctgggccccagcctgggcggcggcaccggcggcctgtag

SEQ ID NO: 98104 - DNA, 441 bp, Artificial Sequence
  Description of Artificial Sequence: Synthetic coding sequence
atgggctgcagcgccaaggccagatgggccgccggcgccctgggcgtggccggcctgctgtgcgccgtgctgggcgccgtgatgatcgtgatggtgcccagcctgatcaagcagcaggtgctgaagaacgtgagaatcgaccccagcagcctgagcttcaacatgtggaaggagatccccatccccttctacctgagcgtgtacttcttcgacgtgatgaaccccagcgagatcctgaagggcgagaagccccaggtgagagagagaggcccctacgtgtacagagagttcagacacaagagcaacatcaccttcaacaacaacgacaccgtgagcttcctggagtacagaaccttccagttccagcccagcaagagccacggcagcgagagcgactacatcgtgatgcccaacatcctggtgctggtgagactgccctag

SEQ ID NO: 98105 - DNA, 1446 bp, Artificial Sequence
  Description of Artificial Sequence: Synthetic coding sequence
atgggctgcagcgccaaggccagatgggccgccggcgccctgggcgtggccggcctgctgtgcgccgtgctgggcgccgtgatgatcgtgatggtgcccagcctgatcaagcagcaggtgctgaagaacgtgagaatcgaccccagcagcctgagcttcaacatgtggaaggagatccccatccccttctacctgagcgtgtacttcttcgacgtgatgaaccccagcgagatcctgaagggcgagaagccccaggtgagagagagaggcccctacgtgtacagagagttcagacacaagagcaacatcaccttcaacaacaacgacaccgtgagcttcctggagtacagaaccttccagttccagcccagcaagagccacggcagcgagagcgactacatcgtgatgcccaacatcctggtgctgggcgccgccgtgatgatggagaacaagcccatgaccctgaagctgatcatgaccctggccttcaccaccctgggcgagagagccttcatgaacagaaccgtgggcgagatcatgtggggctacaaggaccccctggtgaacctgatcaacaagtacttccccggcatgttccccttcaaggacaagttcggcctgttcgccgagctgaacaacagcgacagcggcctgttcaccgtgttcaccggcgtgcagaacatcagcagaatccacctggtggacaagtggaacggcctgagcaaggtggacttctggcacagcgaccagtgcaacatgatcaacggcaccagcggccagatgtggccccccttcatgacccccgagagcagcctggagttctacagccccgaggcctgcagaagcatgaagctgatgtacaaggagagcggcgtgttcgagggcatccccacctacagattcgtggcccccaagaccctgttcgccaacggcagcatctacccccccaacgagggcttctgcccctgcctggagagcggcatccagaacgtgagcacctgcagattcagcgcccccctgttcctgagccacccccacttcctgaacgccgaccccgtgctggccgaggccgtgaccggcctgcaccccaaccaggaggcccacagcctgttcctggacatccaccccgtgaccggcatccccatgaactgcagcgtgaagctgcagctgagcctgtacatgaagagcgtggccggcatcggccagaccggcaagatcgagcccgtggtgctgcccctgctgtggttcgccgagagcggcgccatggagggcgagaccctgcacaccttctacacccagctggtgctgatgcccaaggagaagtgctacctgttctggagcagcagcaagaagggcagcaaggacaaggaggccatccaggcctacagcgagagcctgatgaccagcgcccccaagggcagcgtgctgcaggaggccaagctgtag

SEQ ID NO: 98106 - DNA, 1437 bp, Artificial Sequence
  Description of Artificial Sequence: Synthetic coding sequence
atgggcagatgctgcttctacaccgccggcaccctgagcctgctgctgctggtgaccagcgtgaccctgctggtggccagagtgttccagaaggccgtggaccagagcatcgagaagaagatcgtgctgagaaacggcaccgaggccttcgacagctgggagaagccccccctgcccgtgtacacccagttctacttcttcaacgtgaccaaccccgaggagatcctgagaggcgagacccccagagtggaggaggtgggcccctacacctacagagagctgagaaacaaggccaacatccagttcggcgacaacggcaccaccatcagcgccgtgagcaacaaggcctacgtgttcgagagagaccagagcgtgggcgaccccaagatcgacctgatcagaaccctgaacatccccgtgctgaccgtgatcgagtggagccaggtgcacttcctgagagagatcatcgaggccatgctgaaggcctaccagcagaagctgttcgtgacccacaccgtggacgagctgctgtggggctacaaggacgagatcctgagcctgatccacgtgttcagacccgacatcagcccctacttcggcctgttctacgagaagaacggcaccaacgacggcgactacgtgttcctgaccggcgaggacagctacctgaacttcaccaagatcgtggagtggaacggcaagaccagcctggactggtggatcaccgacaagtgcaacatgatcaacggcaccgacggcgacagcttccaccccctgatcaccaaggacgaggtgctgtacgtgttccccagcgacttctgcagaagcgtgtacatcaccttcagcgactacgagagcgtgcagggcctgcccgccttcagatacaaggtgcccgccgagatcctggccaacaccagcgacaacgccggcttctgcatccccgagggcaactgcctgggcagcggcgtgctgaacgtgagcatctgcaagaacggcgcccccatcatcatgagcttcccccacttctaccaggccgacgagagattcgtgagcgccatcgagggcatgcaccccaaccaggaggaccacgagaccttcgtggacatcaaccccctgaccggcatcatcctgaaggccgccaagagattccagatcaacatctacgtgaagaagctggacgacttcgtggagaccggcgacatcagaaccatggtgttccccgtgatgtacctgaacgagagcgtgcacatcgacaaggagaccgccagcagactgaagagcatgatcaacaccaccctgatcatcaccaacatcccctacatcatcatggccctgggcgtgttcttcggcctggtgttcacctggctggcctgcaagggccagggcagcatggacgagggcaccgccgacgagagagcccccctgatcagaacctag

SEQ ID NO: 98107 - DNA, 1710 bp, Artificial Sequence
  Description of Artificial Sequence: Synthetic coding sequence
atgggcctgggcctgctgctgcccctgctgctgctgtggaccagaggcacccagggcagcgagctggaccccaagggccagcacgtgtgcgtggccagcagccccagcgccgagctgcagtgctgcgccggctggagacagaaggaccaggagtgcaccatccccatctgcgagggccccgacgcctgccagaaggacgaggtgtgcgtgaagcccggcctgtgcagatgcaagcccggcttcttcggcgcccactgcagcagcagatgccccggccagtactggggccccgactgcagagagagctgcccctgccacccccacggccagtgcgagcccgccaccggcgcctgccagtgccaggccgacagatggggcgccagatgcgagttcccctgcgcctgcggcccccacggcagatgcgaccccgccaccggcgtgtgccactgcgagcccggctggtggagcagcacctgcagaagaccctgccagtgcaacaccgccgccgccagatgcgagcaggccaccggcgcctgcgtgtgcaagcccggctggtggggcagaagatgcagcttcagatgcaactgccacggcagcccctgcgagcaggacagcggcagatgcgcctgcagacccggctggtggggccccgagtgccagcagcagtgcgagtgcgtgagaggcagatgcagcgccgccagcggcgagtgcacctgcccccccggcttcagaggcgccagatgcgagctgccctgccccgccggcagccacggcgtgcagtgcgcccacagctgcggcagatgcaagcacaacgagccctgcagccccgacaccggcagctgcgagagctgcgagcccggctggaacggcacccagtgccagcagccctgcctgcccggcaccttcggcgagagctgcgagcagcagtgcccccactgcagacacggcgaggcctgcgagcccgacaccggccactgccagagatgcgaccccggctggctgggccccagatgcgaggacccctgccccaccggcaccttcggcgaggactgcggcagcacctgccccacctgcgtgcagggcagctgcgacaccgtgaccggcgactgcgtgtgcagcgccggctactggggccccagctgcaacgccagctgccccgccggcttccacggcaacaactgcagcgtgccctgcgagtgccccgagggcctgtgccaccccgtgagcggcagctgccagcccggcagcggcagcagagacaccgccctgatcgccggcagcctggtgcccctgctgctgctgttcctgggcctggcctgctgcgcctgctgctgctgggcccccagaagcgacctgaaggacagacccgccagagacggcgccaccgtgagcagaatgaagctgcaggtgtggggcaccctgaccagcctgggcagcaccctgccctgcagaagcctgagcagccacaagctgccctgggtgaccgccagcagcagcagacccctgcccgccggccccctgatgacccccagccaccccatcctgagcctggagagacagatgagattcctgcccaccgtgtgccaccccaagaagggctggagcctgtggcccagacagggcagacagagacccgcctggctgcaggtgctgagcagacccctgagaaccccccccagacacagccccagcagagccccccccgcctag

SEQ ID NO: 98108 - DNA, 2613 bp, Artificial Sequence
  Description of Artificial Sequence: Synthetic coding sequence
atggagggcgccggccccagaggcgccggccccgccagaagaagaggcgccggcggcccccccagccccctgctgcccagcctgctgctgctgctgctgctgtggatgctgcccgacaccgtggccccccaggagctgaaccccagaggcagaaacgtgtgcagagcccccggcagccaggtgcccacctgctgcgccggctggagacagcagggcgacgagtgcggcatcgccgtgtgcgagggcaacagcacctgcagcgagaacgaggtgtgcgtgagacccggcgagtgcagatgcagacacggctacttcggcgccaactgcgacaccaagtgccccagacagttctggggccccgactgcaaggagctgtgcagctgccacccccacggccagtgcgaggacgtgaccggccagtgcacctgccacgccagaagatggggcgccagatgcgagcacgcctgccagtgccagcacggcacctgccaccccagaagcggcgcctgcagatgcgagcccggctggtggggcgcccagtgcgccagcgcctgctactgcagcgccaccagcagatgcgacccccagaccggcgcctgcctgtgccacgccggctggtggggcagaagctgcaacaaccagtgcgcctgcaacagcagcccctgcgagcagcagagcggcagatgccagtgcagagagagaaccttcggcgccagatgcgacagatactgccagtgcttcagaggcagatgccaccccgtggacggcacctgcgcctgcgagcccggctacagaggcaagtactgcagagagccctgccccgccggcttctacggcctgggctgcagaagaagatgcggccagtgcaagggccagcagccctgcaccgtggccgagggcagatgcctgacctgcgagcccggctggaacggcaccaagtgcgaccagccctgcgccaccggcttctacggcgagggctgcagccacagatgccccccctgcagagacggccacgcctgcaaccacgtgaccggcaagtgcaccagatgcaacgccggctggatcggcgacagatgcgagaccaagtgcagcaacggcacctacggcgaggactgcgccttcgtgtgcgccgactgcggcagcggccactgcgacttccagagcggcagatgcctgtgcagccccggcgtgcacggcccccactgcaacgtgacctgcccccccggcctgcacggcgccgactgcgcccaggcctgcagctgccacgaggacacctgcgaccccgtgaccggcgcctgccacctggagaccaaccagagaaagggcgtgatgggcgccggcgccctgctggtgctgctggtgtgcctgctgctgagcctgctgggctgctgctgcgcctgcagaggcaaggaccccaccagaagacccagacccagaagagagctgagcctgggcagaaagaaggccccccacagactgtgcggcagattcagcagaatcagcatgaagctgcccagaatccccctgagaagacagaagctgcccaaggtggtggtggcccaccacgacctggacaacaccctgaactgcagcttcctggagccccccagcggcctggagcagcccagccccagctggagcagcagagccagcttcagcagcttcgacaccaccgacgagggccccgtgtactgcgtgccccacgaggaggcccccgccgagagcagagaccccgaggtgcccaccgtgcccgccgaggcccccgcccccagccccgtgcccctgaccacccccgccagcgccgaggaggccatccccctgcccgccagcagcgacagcgagagaagcgccagcagcgtggagggccccggcggcgccctgtacgccagagtggccagaagagaggccagacccgccagagccagaggcgagatcggcggcctgagcctgagccccagccccgagagaagaaagccccccccccccgaccccgccaccaagcccaaggtgagctggatccacggcaagcacagcgccgccgccgccggcagagcccccagcccccccccccccggcagcgaggccgcccccagccccagcaagagaaagagaacccccagcgacaagagcgcccacaccgtggagcacggcagccccagaaccagagaccccacccccagaccccccggcctgcccgaggaggccaccgccctggccgcccccagcccccccagagccagagccagagccgcccccagacccctgggcgcccacggcagaagaagaagccccgccaagagagccgaggccgccagcatgctggccgccgacgtgagaggcaagaccagaagcctgggcagagccgaggtggccctgggcgcccagggccccagagagaagcccgcccccccccagaaggccaagagaagcgtgccccccgccagccccgccagagccccccccgccaccgagacccccggccccgagaaggccgccaccgacctgcccgcccccgagacccccagaaagaagacccccatccagaagccccccagaaagaagagcagagaggccgccggcgagctgggcagagccggcgcccccaccctgtag

SEQ ID NO: 98109 - DNA, 2493 bp, Artificial Sequence
  Description of Artificial Sequence: Synthetic coding sequence
atgggcctgggcctgctgctgcccctgctgctgctgtggaccagaggcacccagggcagcgagctggaccccaagggccagcacgtgtgcgtggccagcagccccagcgccgagctgcagtgctgcgccggctggagacagaaggaccaggagtgcaccatccccatctgcgagggccccgacgcctgccagaaggacgaggtgtgcgtgaagcccggcctgtgcagatgcaagcccggcttcttcggcgcccactgcagcagcagatgccccggccagtactggggccccgactgcagagagagctgcccctgccacccccacggccagtgcgagcccgccaccggcgcctgccagtgccaggccgacagatggggcgccagatgcgagttcccctgcgcctgcggcccccacggcagatgcgaccccgccaccggcgtgtgccactgcgagcccggctggtggagcagcacctgcagaagaccctgccagtgcaacaccgccgccgccagatgcgagcaggccaccggcgcctgcgtgtgcaagcccggctggtggggcagaagatgcagcttcagatgcaactgccacggcagcccctgcgagcaggacagcggcagatgcgcctgcagacccggctggtggggccccgagtgccagcagcagtgcgagtgcgtgagaggcagatgcagcgccgccagcggcgagtgcacctgcccccccggcttcagaggcgccagatgcgagctgccctgccccgccggcagccacggcgtgcagtgcgcccacagctgcggcagatgcaagcacaacgagccctgcagccccgacaccggcagctgcgagagctgcgagcccggctggaacggcacccagtgccagcagccctgcctgcccggcaccttcggcgagagctgcgagcagcagtgcccccactgcagacacggcgaggcctgcgagcccgacaccggccactgccagagatgcgaccccggctggctgggccccagatgcgaggacccctgccccaccggcaccttcggcgaggactgcggcagcacctgccccacctgcgtgcagggcagctgcgacaccgtgaccggcgactgcgtgtgcagcgccggctactggggccccagctgcaacgccagctgccccgccggcttccacggcaacaactgcagcgtgccctgcgagtgccccgagggcctgtgccaccccgtgagcggcagctgccagcccggcagcggcagcagagacaccgccctgatcgccggcagcctggtgcccctgctgctgctgttcctgggcctggcctgctgcgcctgctgctgctgggcccccagaagcgacctgaaggacagacccgccagagacggcgccaccgtgagcagaatgaagctgcaggtgtggggcaccctgaccagcctgggcagcaccctgccctgcagaagcctgagcagccacaagctgccctgggtgaccgtgagccaccacgaccccgaggtgcccttcaaccacagcttcatcgagccccccagcgccggctgggccaccgacgacagcttcagcagcgaccccgagagcggcgaggccgacgaggtgcccgcctactgcgtgcccccccaggagggcatggtgcccgtggcccaggccggcagcagcgaggccagcctggccgccggcgccttccccccccccgaggacgccagcacccccttcgccatccccagaaccagcagcctggccagagccaagagacccagcgtgagcttcgccgagggcaccaagttcgccccccagagcagaagaagcagcggcgagctgagcagccccctgagaaagcccaagagactgagcagaggcgcccagagcggccccgagggcagagaggccgaggagagcaccggccccgaggaggccgaggcccccgagagcttccccgccgccgccagccccggcgacagcgccaccggccacagaagaccccccctgggcggcagaaccgtggccgagcacgtggaggccatcgagggcagcgtgcaggagagcagcggccccgtgaccaccatctacatgctggccggcaagcccagaggcagcgagggccccgtgagaagcgtgttcagacacttcggcagcttccagaagggccaggccgaggccaaggtgaagagagccatccccaagccccccagacaggccctgaacagaaagaagggcagccccggcctggccagcggcagcgtgggccagagccccaacagcgcccccaaggccggcctgcccggcgccaccggccccatggccgtgagacccgaggaggccgtgagaggcctgggcgccggcaccgagagcagcagaagagcccaggagcccgtgagcggctgcggcagccccgagcaggacccccagaagcaggccgaggaggagagacaggaggagcccgagtacgagaacgtggtgcccatcagcagaccccccgagccctag

SEQ ID NO: 98110 - DNA, 2235 bp, Artificial Sequence
  Description of Artificial Sequence: Synthetic coding sequence
atgggcctgggcctgctgctgcccctgctgctgctgtggaccagaggcacccagggcagcgagctggaccccaagggccagcacgtgtgcgtggccagcagccccagcgccgagctgcagtgctgcgccggctggagacagaaggaccaggagtgcaccatccccatctgcgagggccccgacgcctgccagaaggacgaggtgtgcgtgaagcccggcctgtgcagatgcaagcccggcttcttcggcgcccactgcagcagcagatgccccggccagtactggggccccgactgcagagagagctgcccctgccacccccacggccagtgcgagcccgccaccggcgcctgccagtgccaggccgacagatggggcgccagatgcgagttcccctgcgcctgcggcccccacggcagatgcgaccccgccaccggcgtgtgccactgcgagcccggctggtggagcagcacctgcagaagaccctgccagtgcaacaccgccgccgccagatgcgagcaggccaccggcgcctgcgtgtgcaagcccggctggtggggcagaagatgcagcttcagatgcaactgccacggcagcccctgcgagcaggacagcggcagatgcgcctgcagacccggctggtggggccccgagtgccagcagcagtgcgagtgcgtgagaggcagatgcagcgccgccagcggcgagtgcacctgcccccccggcttcagaggcgccagatgcgagctgccctgccccgccggcagccacggcgtgcagtgcgcccacagctgcggcagatgcaagcacaacgagccctgcagccccgacaccggcagctgcgagagctgcgagcccggctggaacggcacccagtgccagcagccctgcctgcccggcaccttcggcgagagctgcgagcagcagtgcccccactgcagacacggcgaggcctgcgagcccgacaccggccactgccagagatgcagcggcagcagagacaccgccctgatcgccggcagcctggtgcccctgctgctgctgttcctgggcctggcctgctgcgcctgctgctgctgggcccccagaagcgacctgaaggacagacccgccagagacggcgccaccgtgagcagaatgaagctgcaggtgtggggcaccctgaccagcctgggcagcaccctgccctgcagaagcctgagcagccacaagctgccctgggtgaccgtgagccaccacgaccccgaggtgcccttcaaccacagcttcatcgagccccccagcgccggctgggccaccgacgacagcttcagcagcgaccccgagagcggcgaggccgacgaggtgcccgcctactgcgtgcccccccaggagggcatggtgcccgtggcccaggccggcagcagcgaggccagcctggccgccggcgccttccccccccccgaggacgccagcacccccttcgccatccccagaaccagcagcctggccagagccaagagacccagcgtgagcttcgccgagggcaccaagttcgccccccagagcagaagaagcagcggcgagctgagcagccccctgagaaagcccaagagactgagcagaggcgcccagagcggccccgagggcagagaggccgaggagagcaccggccccgaggaggccgaggcccccgagagcttccccgccgccgccagccccggcgacagcgccaccggccacagaagaccccccctgggcggcagaaccgtggccgagcacgtggaggccatcgagggcagcgtgcaggagagcagcggccccgtgaccaccatctacatgctggccggcaagcccagaggcagcgagggccccgtgagaagcgtgttcagacacttcggcagcttccagaagggccaggccgaggccaaggtgaagagagccatccccaagccccccagacaggccctgaacagaaagaagggcagccccggcctggccagcggcagcgtgggccagagccccaacagcgcccccaaggccggcctgcccggcgccaccggccccatggccgtgagacccgaggaggccgtgagaggcctgggcgccggcaccgagagcagcagaagagcccaggagcccgtgagcggctgcggcagccccgagcaggacccccagaagcaggccgaggaggagagacaggaggagcccgagtacgagaacgtggtgcccatcagcagaccccccgagccctag

SEQ ID NO: 98111 - DNA, 1710 bp, Artificial Sequence; identical to SEQ ID NO: 98107
  Description of Artificial Sequence: Synthetic coding sequence

SEQ ID NO: 98112 - DNA, 2595 bp, Artificial Sequence
  Description of Artificial Sequence: Synthetic coding sequence
atggagggcgccggccccagaggcgccggccccgccagaagaagaggcgccggcggcccccccagccccctgctgcccagcctgctgctgctgctgctgctgtggatgctgcccgacaccgtggccccccaggagctgaaccccagaggcagaaacgtgtgcagagcccccggcagccaggtgcccacctgctgcgccggctggagacagcagggcgacgagtgcggcatcgccgtgtgcgagggcaacagcacctgcagcgagaacgaggtgtgcgtgagacccggcgagtgcagatgcagacacggctacttcggcgccaactgcgacaccaagtgccccagacagttctggggccccgactgcaaggagctgtgcagctgccacccccacggccagtgcgaggacgtgaccggccagtgcacctgccacgccagaagatggggcgccagatgcgagcacgcctgccagtgccagcacggcacctgccaccccagaagcggcgcctgcagatgcgagcccggctggtggggcgcccagtgcgccagcgcctgctactgcagcgccaccagcagatgcgacccccagaccggcgcctgcctgtgccacgccggctggtggggcagaagctgcaacaaccagtgcgcctgcaacagcagcccctgcgagcagcagagcggcagatgccagtgcagagagagaaccttcggcgccagatgcgacagatactgccagtgcttcagaggcagatgccaccccgtggacggcacctgcgcctgcgagcccggctacagaggcaagtactgcagagagccctgccccgccggcttctacggcctgggctgcagaagaagatgcggccagtgcaagggccagcagccctgcaccgtggccgagggcagatgcctgacctgcgagcccggctggaacggcaccaagtgcgaccagccctgcgccaccggcttctacggcgagggctgcagccacagatgccccccctgcagagacggccacgcctgcaaccacgtgaccggcaagtgcaccagatgcaacgccggctggatcggcgacagatgcgagaccaagtgcagcaacggcacctacggcgaggactgcgccttcgtgtgcgccgactgcggcagcggccactgcgacttccagagcggcagatgcctgtgcagccccggcgtgcacggcccccactgcaacgtgacctgcccccccggcctgcacggcgccgactgcgcccaggcctgcagctgccacgaggacacctgcgaccccgtgaccggcgcctgccacctggagaccaaccagagaaagggcgtgatgggcgccggcgccctgctggtgctgctggtgtgcctgctgctgagcctgctgggctgctgctgcgcctgcagaggcaaggaccccaccagaagagagctgagcctgggcagaaagaaggccccccacagactgtgcggcagattcagcagaatcagcatgaagctgcccagaatccccctgagaagacagaagctgcccaaggtggtggtggcccaccacgacctggacaacaccctgaactgcagcttcctggagccccccagcggcctggagcagcccagccccagctggagcagcagagccagcttcagcagcttcgacaccaccgacgagggccccgtgtactgcgtgccccacgaggaggcccccgccgagagcagagaccccgaggtgcccaccgtgcccgccgaggcccccgcccccagccccgtgcccctgaccacccccgccagcgccgaggaggccatccccctgcccgccagcagcgacagcgagagaagcgccagcagcgtggagggccccggcggcgccctgtacgccagagtggccagaagagaggccagacccgccagagccagaggcgagatcggcggcctgagcctgagccccagccccgagagaagaaagccccccccccccgaccccgccaccaagcccaaggtgagctggatccacggcaagcacagcgccgccgccgccggcagagcccccagcccccccccccccggcagcgaggccgcccccagccccagcaagagaaagagaacccccagcgacaagagcgcccacaccgtggagcacggcagccccagaaccagagaccccacccccagaccccccggcctgcccgaggaggccaccgccctggccgcccccagcccccccagagccagagccagagccagacccggcctgctggagcccaccgacgccggcggcccccccagaagcgcccccgccgccagcatgctggccgccgacgtgagaggcaagaccagaagcctgggcagagccgaggtggccctgggcgcccagggccccagagagaagcccgcccccccccagaaggccaagagaagcgtgccccccgccagccccgccagagccccccccgccaccgagacccccggccccgagaaggccgccaccgacctgcccgcccccgagacccccagaaagaagacccccatccagaagccccccagaaagaagagcagagaggccgccggcgagctgggcagagccggcgcccccaccctgtag

SEQ ID NO: 98113 - DNA, 2598 bp, Artificial Sequence
  Description of Artificial Sequence: Synthetic coding sequence
atggagggcgccggccccagaggcgccggccccgccagaagaagaggcgccggcggcccccccagccccctgctgcccagcctgctgctgctgctgctgctgtggatgctgcccgacaccgtggccccccaggagctgaaccccagaggcagaaacgtgtgcagagcccccggcagccaggtgcccacctgctgcgccggctggagacagcagggcgacgagtgcggcatcgccgtgtgcgagggcaacagcacctgcagcgagaacgaggtgtgcgtgagacccggcgagtgcagatgcagacacggctacttcggcgccaactgcgacaccaagtgccccagacagttctggggccccgactgcaaggagctgtgcagctgccacccccacggccagtgcgaggacgtgaccggccagtgcacctgccacgccagaagatggggcgccagatgcgagcacgcctgccagtgccagcacggcacctgccaccccagaagcggcgcctgcagatgcgagcccggctggtggggcgcccagtgcgccagcgcctgctactgcagcgccaccagcagatgcgacccccagaccggcgcctgcctgtgccacgccggctggtggggcagaagctgcaacaaccagtgcgcctgcaacagcagcccctgcgagcagcagagcggcagatgccagtgcagagagagaaccttcggcgccagatgcgacagatactgccagtgcttcagaggcagatgccaccccgtggacggcacctgcgcctgcgagcccggctacagaggcaagtactgcagagagccctgccccgccggcttctacggcctgggctgcagaagaagatgcggccagtgcaagggccagcagccctgcaccgtggccgagggcagatgcctgacctgcgagcccggctggaacggcaccaagtgcgaccagccctgcgccaccggcttctacggcgagggctgcagccacagatgccccccctgcagagacggccacgcctgcaaccacgtgaccggcaagtgcaccagatgcaacgccggctggatcggcgacagatgcgagaccaagtgcagcaacggcacctacggcgaggactgcgccttcgtgtgcgccgactgcggcagcggccactgcgacttccagagcggcagatgcctgtgcagccccggcgtgcacggcccccactgcaacgtgacctgcccccccggcctgcacggcgccgactgcgcccaggcctgcagctgccacgaggacacctgcgaccccgtgaccggcgcctgccacctggagaccaaccagagaaagggcgtgatgggcgccggcgccctgctggtgctgctggtgtgcctgctgctgagcctgctgggctgctgctgcgcctgcagaggcaaggaccccaccagaagagagctgagcctgggcagaaagaaggccccccacagactgtgcggcagattcagcagaatcagcatgaagctgcccagaatccccctgagaagacagaagctgcccaaggtggtggtggcccaccacgacctggacaacaccctgaactgcagcttcctggagccccccagcggcctggagcagcccagccccagctggagcagcagagccagcttcagcagcttcgacaccaccgacgagggccccgtgtactgcgtgccccacgaggaggcccccgccgagagcagagaccccgaggtgcccaccgtgcccgccgaggcccccgcccccagccccgtgcccctgaccacccccgccagcgccgaggaggccatccccctgcccgccagcagcgacagcgagagaagcgccagcagcgtggagggccccggcggcgccctgtacgccagagtggccagaagagaggccagacccgccagagccagaggcgagatcggcggcctgagcctgagccccagccccgagagaagaaagccccccccccccgaccccgccaccaagcccaaggtgagctggatccacggcaagcacagcgccgccgccgccggcagagcccccagcccccccccccccggcagcgaggccgcccccagccccagcaagagaaagagaacccccagcgacaagagcgcccacaccgtggagcacggcagccccagaaccagagaccccacccccagaccccccggcctgcccgaggaggccaccgccctggccgcccccagcccccccagagccagagccagagccgcccccagacccctgggcgcccacggcagaagaagaagccccgccaagagagccgaggccgccagcatgctggccgccgacgtgagaggcaagaccagaagcctgggcagagccgaggtggccctgggcgcccagggccccagagagaagcccgcccccccccagaaggccaagagaagcgtgccccccgccagccccgccagagccccccccgccaccgagacccccggccccgagaaggccgccaccgacctgcccgcccccgagacccccagaaagaagacccccatccagaagccccccagaaagaagagcagagaggccgccggcgagctgggcagagccggcgcccccaccctgtag

SEQ ID NO: 98114 - DNA, 1728 bp, Artificial Sequence
  Description of Artificial Sequence: Synthetic coding sequence
atgcacaaggaggccgagatgctgatcggcccccagctggacgagaagagatggggctggagactgggcgacggcagcgccgccccccccttcctgccccaggccctgagcttcctgctgctgctgcccctggccagcgccctgcagcccacccccctgcccttccaggagctgagactggtgggcggccccagcagatgcagaggcagactggaggtgatgcacggcggcagctggggcagcgtgtgcgacgacgactgggacgtggtggacgccaacgtggtgtgcagacagctgggctgcggcctggccctgcccgtgcccagacccctggccttcggccagggcagaggccccatcctgctggacaacgtggagtgcagaggccaggaggccgccctgagcgagtgcggcagcagaggctggggcgtgcacaactgcttccactacgaggacgtggccgtgctgtgcgacgagttcctgcccacccagccccccaccagaaagatgctgaccagcagagccccccccaccaccctgcccaacggcaagagcgagggcagcgtgagactggtgggcggcgccaacctgtgccagggcagagtggagatcctgcacagcggcctgtggggcaccgtgtgcgacgacgactggggcctgcccgacgccgccgtggtgtgcagacagctgggctgcggcgccgccatggccgccaccaccaacgccttcttcggctacggcaccggccacatcctgctggacaacgtgcactgcgagggcggcgagcccagactggccgcctgccagagcctgggctggggcgtgcacaactgcggccaccacgaggacgccggcgccctgtgcgccggcctgggcccccccaccctgaccgccctgcccagcagcgccaccagagaggactgggcctggcagaccgaccccagcgccaccggcgtgggcccccagcccagcagagagaccgccctgctgaccaccgccgcctgggccgccggcaagaagagcggcagactgagactggtgggcggccccggcccctgcagaggcagagtggaggtgctgcacgccggcggctggggcaccgtgtgcgacgacgactgggacttcgccgacgccagagtggcctgcagagaggccggctgcggccccgccctgggcgccaccggcctgggccacttcggctacggcagaggccccgtgctgctggacaacgtgggctgcgccggcaccgaggccagactgagcgactgcttccacctgggctggggccagcacaactgcggccaccacgaggacgccggcgccctgtgcgccggccccgaggagctgggcctgcaggtgcagcaggacggcagcgagaccaccagagtgcccacccccagacccagagacggccacctgagactggtgaacggcgcccacagatgcgagggcagagtggagctgtacctgggccagagatggggcaccgtgtgcgacgacgcctgggacctgagagccgccggcgtgctgtgcagacagctgggctgcggccaggccctggccgcccccggcgaggcccacttcggccccggcagaggccccatcctgctggacaacgtgaagtgcagaggcgaggagagcgccctgctgctgtgcagccacatcagatgggacgcccacaactgcgaccacagcgaggacgccagcgtgctgtgccagcccagctag

SEQ ID NO: 98115 - DNA, 849 bp, Artificial Sequence
  Description of Artificial Sequence: Synthetic coding sequence
atgagcaacgtgaccctgagaaagatgagccccaccggcaacgagatgaagagcaccacccagggcaccaccagaaagcagcaggacttccacgaggtgaacaagagaagaaccttcctgcaggacaacagctggatcaagaagagacccgaggaggagaaggacgagaactacggcagagtggtgctgaacagacacaacagccacgacgccctggacagaaaggtgaacgagagagacgtgcccaaggccaccatcagcagatacagcagcgacgacaccctggacagaagcatgagcatgttcagaagcctggaggtgaccaagctgcagcccggcggcagcctgaacgccaacaccagcaacaccatcgccagcaccagcgccaccacccccgtgaagaagaagagacagagctggttccccccccccccccccggctacaacgccagcagcagcaccggcaccagaagaagagagcccggcgtgcacccccccatcccccccaagcccagcagccccgtgagcagccccaaccagctgagacaggacaacagacagatccacccccccaagcccggcgtgtacaccgagaccaacagaagcgccgagagaaacatcagcgaggagctggacaacctgatcaagatgaacaagagcctgaacagaaaccagggcctggacagcctgttcagagccaaccccaaggtggaggagagagagaagagagccaagagcctggagagcctgatctacatgagcaccagaaccgacaaggacggcaagggcatccagagcctgggcagccccatcaaggtgaaccagagaaccgacaagaacgagaagtag

SEQ ID NO: 98116 - DNA, 2067 bp, Artificial Sequence
  Description of Artificial Sequence: Synthetic coding sequence
atgagcaacgtgaccctgagaaagatgagccccaccggcaacgagatgaagagcaccacccagggcaccaccagaaagcagcaggacttccacgaggtgaacaagagaagaaccttcctgcaggacaacagctggatcaagaagagacccgaggaggagaaggacgagaactacggcagagtggtgctgaacagacacaacagccacgacgccctggacagaaaggtgaacgagagagacgtgcccaaggccaccatcagcagatacagcagcgacgacaccctggacagaatcagcgacagaaacgacgccgccaagacctacaaggccaacaccctggacaaccagctgaccaacagaagcatgagcatgttcagaagcctggaggtgaccaagctgcagcccggcggcagcctgaacgccaacaccagcaacaccatcgccagcaccagcgccaccacccccgtgaagaagaagagacagagctggttccccccccccccccccggctacaacgccagcagcagcaccggcaccagaagaagagagcccggcgtgcacccccccatcccccccaagcccagcagccccgtgagcagccccaaccagctgagacaggacaacagacagatccacccccccaagcccggcgtgtacaccgagaccaacagaagcgccgagagaaacatcagaagccaggacctggacaacatcgtgaaggtggccaccagcctgcagagaagcgacaagggcgaggagctggacaacctgatcaagatgaacaagagcctgaacagaaaccagggcctggacagcctgttcagagccaaccccaaggtggaggagagagagaagagagccaagagcctggagagcctgatctacatgagcaccagaaccgacaaggacggcaagggcatccagagcctgggcagccccatcaaggtgaaccagagaaccgacaagaacgagaagggcagacagaacctggagagcgtggccaaggtgaacgccagaatgaacaagaccagcagaagaagcgaggacctggacaacgccaccgaggtgaaccccaagggccacgagaacaccaccggcaagaaggacctggacggcctgatcaaggtggaccccgagaccaacaagaacatcaccagaggccagagcctggacaacctgatcaaggtgacccccgaggtgaagagaagcaaccagggcagcaaggacctgaacaacttcatcaaggtgtaccccggcaccgagaagagcaccgagggcggccagagcctggacagcctgatcaaggtgacccccgagagaaacagaaccaaccagggcaaccaggacctggagaacctgatcaaggtgatccccagcgccaacaagagcagcgagcagggcctggacgagcacatcaacgtgagccccaaggccgtgaagaacaccgacggcaagcaggacctggacaagctgatcaaggtgaaccccgagatcttcaccaacaaccagagaaaccaggacctggccaacctgatcaaggtgaaccccgccgtgatcagaaacaaccagagccaggacctggacaacctgatcaaggtgaagcccagcgccctgagaaacaccaacagagaccagaacctggagaacctgatcgaggtgaacagccacgtgagcgagaacaagaacggcagcagcaacaccggcgccaagcaggccggcccccaggacaccgtggtgtacaccagaacctacgtggagaacagcaagagccccaaggacggctaccaggagaacatcagcggcaagtacatccagaccgtgtacagcaccagcgacagaagcgtgatcgagagagacatgtgcacctactgcagaaagcccctgggcgtggagaccaagatgatcctggacgagctgcagatctgctgccacagcacctgcttcaagtgcgagatctgcaagcagcccctggagaacctgcaggccggcgacagcatctggatctacagacagaccatccactgcgagccctgctacagcaagatcatggccaagtggatcccctag

SEQ ID NO: 98117 - DNA, 2007 bp, Artificial Sequence
  Description of Artificial Sequence: Synthetic coding sequence
atgagcaacgtgaccctgagaaagatgagccccaccggcaacgagatgaagagcaccacccagggcaccaccagaaagcagcaggacttccacgaggtgaacaagagaagaaccttcctgcaggacaacagctggatcaagaagagacccgaggaggagaaggacgagaactacggcagagtggtgctgaacagacacaacagccacgacgccctggacagaaaggtgaacgagagagacgtgcccaaggccaccatcagcagatacagcagcgacgacaccctggacagaatcagcgacagaaacgacgccgccaagacctacaaggccaacaccctggacaaccagctgaccaacagaagcatgagcatgttcagaagcctggaggtgaccaagctgcagcccggcggcagcctgaacgccaacaccagcaacaccatcgccagcaccagcgccaccacccccgtgaagaagaagagacagagctggttccccccccccccccccggctacaacgccagcagcagcaccggcaccagaagaagagagcccggcgtgcacccccccatcccccccaagcccagcagccccgtgagcagccccaaccagctgagacaggacaacagacagatccacccccccaagcccggcgtgtacaccgagaccaacagaagcgccgagagaaacatcagcgaggagctggacaacctgatcaagatgaacaagagcctgaacagaaaccagggcctggacagcctgttcagagccaaccccaaggtggaggagagagagaagagagccaagagcctggagagcctgatctacatgagcaccagaaccgacaaggacggcaagggcatccagagcctgggcagccccatcaaggtgaaccagagaaccgacaagaacgagaagggcagacagaacctggagagcgtggccaaggtgaacgccagaatgaacaagaccagcagaagaagcgaggacctggacaacgccaccgaggtgaaccccaagggccacgagaacaccaccggcaagaaggacctggacggcctgatcaaggtggaccccgagaccaacaagaacatcaccagaggccagagcctggacaacctgatcaaggtgacccccgaggtgaagagaagcaaccagggcagcaaggacctgaacaacttcatcaaggtgtaccccggcaccgagaagagcaccgagggcggccagagcctggacagcctgatcaaggtgacccccgagagaaacagaaccaaccagggcaaccaggacctggagaacctgatcaaggtgatccccagcgccaacaagagcagcgagcagggcctggacgagcacatcaacgtgagccccaaggccgtgaagaacaccgacggcaagcaggacctggacaagctgatcaaggtgaaccccgagatcttcaccaacaaccagagaaaccaggacctggccaacctgatcaaggtgaaccccgccgtgatcagaaacaaccagagccaggacctggacaacctgatcaaggtgaagcccagcgccctgagaaacaccaacagagaccagaacctggagaacctgatcgaggtgaacagccacgtgagcgagaacaagaacggcagcagcaacaccggcgccaagcaggccggcccccaggacaccgtggtgtacaccagaacctacgtggagaacagcaagagccccaaggacggctaccaggagaacatcagcggcaagtacatccagaccgtgtacagcaccagcgacagaagcgtgatcgagagagacatgtgcacctactgcagaaagcccctgggcgtggagaccaagatgatcctggacgagctgcagatctgctgccacagcacctgcttcaagtgcgagatctgcaagcagcccctggagaacctgcaggccggcgacagcatctggatctacagacagaccatccactgcgagccctgctacagcaagatcatggccaagtggatcccctag

SEQ ID NO: 98118 - DNA, 1941 bp, Artificial Sequence
  Description of Artificial Sequence: Synthetic coding sequence
atgagcaacgtgaccctgagaaagatgagccccaccggcaacgagatgaagagcaccacccagggcaccaccagaaagcagcaggacttccacgaggtgaacaagagaagaaccttcctgcaggacaacagctggatcaagaagagacccgaggaggagaaggacgagaactacggcagagtggtgctgaacagacacaacagccacgacgccctggacagaaaggtgaacgagagagacgtgcccaaggccaccatcagcagatacagcagcgacgacaccctggacagaatcagcgacagaaacgacgccgccaagacctacaaggccaacaccctggacaaccagctgaccaacagaagcatgagcatgttcagaagcctggaggtgaccaagctgcagcccggcggcagcctgaacgccaacaccagcaacaccatcgccagcaccagcgccaccacccccgtgaagaagaagagagagcccggcgtgcacccccccatcccccccaagcccagcagccccgtgagcagccccaaccagctgagacaggacaacagacagatccacccccccaagcccggcgtgtacaccgagaccaacagaagcgccgagagaaacatcagaagccaggacctggacaacatcgtgaaggtggccaccagcctgcagagaagcgacaagggcgaggagctggacaacctgatcaagatgaacaagagcctgaacagaaaccagggcctggacagcctgttcagagccaaccccaaggtggaggagagagagaagagagccaagagcctggagagcctgatctacatgagcaccagaaccgacaaggacggcaagggcatccagagcctgggcagccccatcaaggtgaaccagagaaccgacaagaacgagaagggcagacagaacctggagagcgtggccaaggtgaacgccagaatgaacaagaccagcagaagaagcgaggacctggacaacgccaccgaggtgaaccccaagggccacgagaacaccaccggcggccagagcctggacaacctgatcaaggtgacccccgaggtgaagagaagcaaccagggcagcaaggacctgaacaacttcatcaaggtgtaccccggcaccgagaagagcaccgagggcggccagagcctggacagcctgatcaaggtgacccccgagagaaacagaaccaaccagggcaaccaggacctggagaacctgatcaaggtgatccccagcgccaacaagagcagcgagcagggcctggacgagcacatcaacgtgagccccaaggccgtgaagaacaccgacggcaagcaggacctggacaagctgatcaaggtgaaccccgagatcttcaccaacaaccagagaaaccaggacctggccaacctgatcaaggtgaaccccgccgtgatcagaaacaaccagagccaggacctggacaacctgatcaaggtgaagcccagcgccctgagaaacaccaacagagaccagaacctggagaacctgatcgaggtgaacagccacgtgagcgagaacaagaacggcagcagcaacaccggcgccaagcaggccggcccccaggacaccgtggtgtacaccagaacctacgtggagaacagcaagagccccaaggacggctaccaggagaacatcagcggcaagtacatccagaccgtgtacagcaccagcgacagaagcgtgatcgagagagacatgtgcacctactgcagaaagcccctgggcgtggagaccaagatgatcctggacgagctgcagatctgctgccacagcacctgcttcaagtgcgagatctgcaagcagcccctggagaacctgcaggccggcgacagcatctggatctacagacagaccatccactgcgagccctgctacagcaagatcatggccaagtggatcccctag

SEQ ID NO: 98119 - DNA, 2148 bp, Artificial Sequence
  Description of Artificial Sequence: Synthetic coding sequence
atggccagagagctgtaccacgaggagttcgccagagccggcaagcaggccggcctgcaggtgtggagaatcgagaagctggagctggtgcccgtgccccagagcgcccacggcgacttctacgtgggcgacgcctacctggtgctgcacaccgccaagaccagcagaggcttcacctaccacctgcacttctggctgggcaaggagtgcagccaggacgagagcaccgccgccgccatcttcaccgtgcagatggacgactacctgggcggcaagcccgtgcagaacagagagctgcagggctacgagagcaacgacttcgtgagctacttcaagggcggcctgaagtacaaggccggcggcgtggccagcggcctgaaccacgtgctgaccaacgacctgaccgccaagagactgctgcacgtgaagggcagaagagtggtgagagccaccgaggtgcccctgagctgggacagcttcaacaagggcgactgcttcatcatcgacctgggcaccgagatctaccagtggtgcggcagcagctgcaacaagtacgagagactgaaggccaaccaggtggccaccggcatcagatacaacgagagaaagggcagaagcgagctgatcgtggtggaggagggcagcgagcccagcgagctgatcaaggtgctgggcgagaagcccgagctgcccgacggcggcgacgacgacgacatcatcgccgacatcagcaacagaaagatggccaagctgtacatggtgagcgacgccagcggcagcatgagagtgaccgtggtggccgaggagaaccccttcagcatggccatgctgctgagcgaggagtgcttcatcctggaccacggcgccgccaagcagatcttcgtgtggaagggcaaggacgccaacccccaggagagaaaggccgccatgaagaccgccgaggagttcctgcagcagatgaactacagcaagaacacccagatccaggtgctgcccgagggcggcgagacccccatcttcaagcagttcttcaaggactggagagacaaggaccagagcgacggcttcggcaaggtgtacgtgaccgagaaggtggcccagatcaagcagatccccttcgacgccagcaagctgcacagcagcccccagatggccgcccagcacaacatggtggacgacggcagcggcaaggtggagatctggagagtggagaacaacggcagaatccaggtggaccagaacagctacggcgagttctacggcggcgactgctacatcatcctgtacacctaccccagaggccagatcatctacacctggcagggcgccaacgccaccagagacgagctgaccaccagcgccttcctgaccgtgcagctggacagaagcctgggcggccaggccgtgcagatcagagtgagccagggcaaggagcccgtgcacctgctgagcctgttcaaggacaagcccctgatcatctacaagaacggcaccagcaagaagggcggccaggcccccgccccccccaccagactgttccaggtgagaagaaacctggccagcatcaccagaatcgtggaggtggacgtggacgccaacagcctgaacagcaacgacgtgttcgtgctgaagctgccccagaacagcggctacatctgggtgggcaagggcgccagccaggaggaggagaagggcgccgagtacgtggccagcgtgctgaagtgcaagaccctgagaatccaggagggcgaggagcccgaggagttctggaacagcctgggcggcaagaaggactaccagaccagccccctgctggagacccaggccgaggaccacccccccagactgtacggctgcagcaacaagaccggcagattcgtgatcgaggagatccccggcgagttcacccaggacgacctggccgaggacgacgtgatgctgctggacgcctgggagcagatcttcatctggatcggcaaggacgccaacgaggtggagaagaaggagagcctgaagagcgccaagatgtacctggagaccgaccccagcggcagagacaagagaacccccatcgtgatcatcaagcagggccacgagccccccaccttcaccggctggttcctgggctgggacagcagcaagtggtag

SEQ ID NO: 98120 - DNA, 1407 bp, Artificial Sequence
  Description of Artificial Sequence: Synthetic coding sequence
atggccaagctgtacatggtgagcgacgccagcggcagcatgagagtgaccgtggtggccgaggagaaccccttcagcatggccatgctgctgagcgaggagtgcttcatcctggaccacggcgccgccaagcagatcttcgtgtggaagggcaaggacgccaacccccaggagagaaaggccgccatgaagaccgccgaggagttcctgcagcagatgaactacagcaagaacacccagatccaggtgctgcccgagggcggcgagacccccatcttcaagcagttcttcaaggactggagagacaaggaccagagcgacggcttcggcaaggtgtacgtgaccgagaaggtggcccagatcaagcagatccccttcgacgccagcaagctgcacagcagcccccagatggccgcccagcacaacatggtggacgacggcagcggcaaggtggagatctggagagtggagaacaacggcagaatccaggtggaccagaacagctacggcgagttctacggcggcgactgctacatcatcctgtacacctaccccagaggccagatcatctacacctggcagggcgccaacgccaccagagacgagctgaccaccagcgccttcctgaccgtgcagctggacagaagcctgggcggccaggccgtgcagatcagagtgagccagggcaaggagcccgtgcacctgctgagcctgttcaaggacaagcccctgatcatctacaagaacggcaccagcaagaagggcggccaggcccccgccccccccaccagactgttccaggtgagaagaaacctggccagcatcaccagaatcgtggaggtggacgtggacgccaacagcctgaacagcaacgacgtgttcgtgctgaagctgccccagaacagcggctacatctgggtgggcaagggcgccagccaggaggaggagaagggcgccgagtacgtggccagcgtgctgaagtgcaagaccctgagaatccaggagggcgaggagcccgaggagttctggaacagcctgggcggcaagaaggactaccagaccagccccctgctggagacccaggccgaggaccacccccccagactgtacggctgcagcaacaagaccggcagattcgtgatcgaggagatccccggcgagttcacccaggacgacctggccgaggacgacgtgatgctgctggacgcctgggagcagatcttcatctggatcggcaaggacgccaacgaggtggagaagaaggagagcctgaagagcgccaagatgtacctggagaccgaccccagcggcagagacaagagaacccccatcgtgatcatcaagcagggccacgagccccccaccttcaccggctggttcctgggctgggacagcagcaagtggtag

SEQ ID NO: 98121 - DNA, 1407 bp, Artificial Sequence; identical to SEQ ID NO: 98120
  Description of Artificial Sequence: Synthetic coding sequence

SEQ ID NO: 98122 - DNA, 3864 bp, Artificial Sequence
  Description of Artificial Sequence: Synthetic coding sequence
atggagcccatctaccccttcgccagaccccagatgaacaccagattccccagcagcagaatggtgcccttccacttcccccccagcaagtgcgccctgtggaaccccacccccaccggcgacttcatctacctgcacctgagctactacagaaaccccaagctggtggtgaccgagaagaccatcagactggcctacagacacgccaagcagaacaagaagaacagcagctgcttcctgctgggcagcctgaccgccgacgaggacgaggagggcgtgaccctgaccgtggacagattcgaccccggcagagaggtgcccgagtgcctggagatcacccccaccgccagcctgcccggcgacttcctgatcccctgcaaggtgcacacccaggagctgtgcagcagagagatgatcgtgcacagcgtggacgacttcagcagcgccctgaaggccctgcagtgccacatctgcagcaaggacagcctggactgcggcaagctgctgagcctgagagtgcacatcaccagcagagagagcctggacagcgtggagttcgacctgcactgggccgccgtgaccctggccaacaacttcaagtgcacccccgtgaagcccatccccatcatccccaccgccctggccagaaacctgagcagcaacctgaacatcagccaggtgcagggcacctacaagtacggctacctgaccatggacgagaccagaaagctgctgctgctgctggagagcgaccccaaggtgtacagcctgcccctggtgggcatctggctgagcggcatcacccacatctacagcccccaggtgtgggcctgctgcctgagatacatcttcaacagcagcgtgcaggagagagtgttcagcgagagcggcaacttcatcatcgtgctgtacagcatgacccacaaggagcccgagttctacgagtgcttcccctgcgacggcaagatccccgacttcagattccagctgctgaccagcaaggagaccctgcacctgttcaagaacgtggagccccccgacaagaaccccatcagatgcgagctgagcgccgagagccagaacgccgagaccgagttcttcagcaaggccagcaagaacttcagcatcaagagaagcagccagaagctgagcagcggcaagatgcccatccacgaccacgacagcggcgtggaggacgaggacttcagccccagacccatccccagcccccaccccgtgagccagaagatcagcaagatccagcccagcgtgcccgagctgagcctggtgctggacggcaacttcatcgagagcaaccccctgcccacccccctggagatggtgaacaacgagaacccccccctgatcaaccacctggagcacctgaagcccctgcagccccagctgtacgacgagaagcacagccccgaggtggaggccggcgagcccagcctgagaggcatccccaaccagctgaaccaggacaagcccgccctgctgagacactgcaaggtgagacagccccccgcctacaagaagggcaacccccacaccagaaacagcatcaagcccagcagccacaacggccccagccacgacatcttcgagaagctgcagaccgtgagcgccggcaacgtgcagaacgaggagtaccccatcagacccagcaccctgaacagcagacagagcagcctggccccccagagccagccccacgacttcgtgttcagcccccacaacagcggcagacccatggagctgcagatccccaccccccccctgcccagctactgcagcaccaacgtgtgcagatgctgccagcaccacagccacatccagtacagccccctgaacagctggcagggcgccaacaccgtgggcagcatccaggacgtgcagagcgaggccctgcagaagcacagcctgttccaccccagcggctgccccgccctgtactgcaacgccttctgcagcagcagcagccccatcgccctgagaccccagggcgacatgggcagctgcagcccccacagcaacatcgagcccagccccgtggccagaccccccagccacatggacctgtgcaacccccagccctgcaccgtgtgcatgcacacccccaagaccgagagcgacaacggcatgatgggcctgagccccgacgcctacagattcctgaccgagcaggacagacagctgagactgctgcaggcccagatccagagactgctggaggcccagagcctgatgccctgcagccccaagaccaccgccgtggaggacaccgtgcaggccggcagacagatggagctggtgagcgtggaggcccagagcagccccggcctgcacatgagaaagggcgtgagcatcgccgtgagcaccggcgccagcctgttctggaacgccgccggcgaggaccaggagcccgacagccagatgaagcaggacgacaccaagatcagcagcgaggacatgaacttcagcgtggacatcaacaacgaggtgaccagcctgcccggcagcgccagcagcctgaaggccgtggacatccccagcttcgaggagagcaacatcgccgtggaggaggagttcaaccagcccctgagcgtgagcaacagcagcctggtggtgagaaaggagcccgacgtgcccgtgttcttccccagcggccagctggccgagagcgtgagcatgtgcctgcagaccggccccaccggcggcgccagcaacaacagcgagaccagcgaggagcccaagatcgagcacgtgatgcagcccctgctgcaccagcccagcgacaaccagaagatctaccaggacctgctgggccaggtgaaccacctgctgaacagcagcagcaaggagaccgagcagcccagcaccaaggccgtgatcatcagccacgagtgcaccagaacccagaacgtgtaccacaccaagaagaagacccaccacagcagactggtggacaaggactgcgtgctgaacgccaccctgaagcagctgagaagcctgggcgtgaagatcgacagccccaccaaggtgaagaagaacgcccacaacgtggaccacgccagcgtgctggcctgcatcagccccgaggccgtgatcagcggcctgaactgcatgagcttcgccaacgtgggcatgagcggcctgagccccaacggcgtggacctgagcatggaggccaacgccatcgccctgaagtacctgaacgagaaccagctgagccagctgagcgtgaccagaagcaaccagaacaactgcgaccccttcagcctgctgcacatcaacaccgacagaagcaccgtgggcctgagcctgatcagccccaacaacatgagcttcgccaccaagaagtacatgaagagatacggcctgctgcagagcagcgacaacagcgaggacgaggaggagccccccgacaacgccgacagcaagagcgagtacctgctgaaccagaacctgagaagcatccccgagcagctgggcggccagaaggagcccagcaagaacgaccacgagatcatcaactgcagcaactgcgagagcgtgggcaccaacgccgacacccccgtgctgagaaacatcaccaacgaggtgctgcagaccaaggccaagcagcagctgaccgagaagcccgccttcctggtgaagaacctgaagcccagccccgccgtgaacctgagaaccggcaaggccgagttcacccagcaccccgagaaggagaacgagggcgacatcaccatcttccccgagagcctgcagcccagcgagaccctgaagcagatgaacagcatgaacagcgtgggcaccttcctggacgtgaagagactgagacagctgcccaagctgttctag

SEQ ID NO: 98123 - DNA, 3864 bp, Artificial Sequence; identical to SEQ ID NO: 98122
  Description of Artificial Sequence: Synthetic coding sequence

SEQ ID NO: 98124 - DNA, 3864 bp, Artificial Sequence; identical to SEQ ID NO: 98122
  Description of Artificial Sequence: Synthetic coding sequence

SEQ ID NO: 98125 - DNA, 633 bp, Artificial Sequence
  Description of Artificial Sequence: Synthetic coding sequence
cagctgtacgacgagaagcacagccccgaggtggaggccggcgagcccagcctgagaggcatccccaaccagctgaaccaggacaagcccgccctgctgagacactgcaagccctgcaccgtgtgcatgcacacccccaagaccgagagcgacaacggcatgatgggcctgagccccgacgcctacagattcctgaccgagcaggacagacagctgagactgctgcaggcccagatccagagactgctggaggcccagagcctgatgccctgcagccccaagaccaccgccgtggaggacaccgtgcaggccggcagacagatggagctggtgagcgtggaggcccagagcagccccggcctgcacatgagaaagggcgtgagcatcgccgtgagcaccggcgccagcctgttctggaacgccgccggcgaggaccaggagcccgacagccagatgaagcaggacgacaccaagatcagcagcgaggacatgaacttcagcgtggacatcaacaacgaggtgaccagcctgcccggcagcgccagcagcctgaaggccgtggacatccccagcttcgaggagagcaacatcgccgtggaggaggagttcaaccagcccctgagcgtgagctag

SEQ ID NO: 98126 - DNA, 3867 bp, Artificial Sequence
  Description of Artificial Sequence: Synthetic coding sequence
atggagcccatctaccccttcgccagaccccagatgaacaccagattccccagcagcagaatggtgcccttccacttcccccccagcaagtgcgccctgtggaaccccacccccaccggcgacttcatctacctgcacctgagctactacagaaaccccaagctggtggtgaccgagaagaccatcagactggcctacagacacgccaagcagaacaagaagaacagcagctgcttcctgctgggcagcctgaccgccgacgaggacgaggagggcgtgaccctgaccgtggacagattcgaccccggcagagaggtgcccgagtgcctggagatcacccccaccgccagcctgcccggcgacttcctgatcccctgcaaggtgcacacccaggagctgtgcagcagagagatgatcgtgcacagcgtggacgacttcagcagcgccctgaaggccctgcagtgccacatctgcagcaaggacagcctggactgcggcaagctgctgagcctgagagtgcacatcaccagcagagagagcctggacagcgtggagttcgacctgcactgggccgccgtgaccctggccaacaacttcaagtgcacccccgtgaagcccatccccatcatccccaccgccctggccagaaacctgagcagcaacctgaacatcagccaggtgcagggcacctacaagtacggctacctgaccatggacgagaccagaaagctgctgctgctgctggagagcgaccccaaggtgtacagcctgcccctggtgggcatctggctgagcggcatcacccacatctacagcccccaggtgtgggcctgctgcctgagatacatcttcaacagcagcgtgcaggagagagtgttcagcgagagcggcaacttcatcatcgtgctgtacagcatgacccacaaggagcccgagttctacgagtgcttcccctgcgacggcaagatccccgacttcagattccagctgctgaccagcaaggagaccctgcacctgttcaagaacgtggagccccccgacaagaaccccatcagatgcgagctgagcgccgagagccagaacgccgagaccgagttcttcagcaaggccagcaagaacttcagcatcaagagaagcagccagaagctgagcagcggcaagatgcccatccacgaccacgacagcggcgtggaggacgaggacttcagccccagacccatccccagcccccaccccgtgagccagaagatcagcaagatccagcccagcgtgcccgagctgagcctggtgctggacggcaacttcatcgagagcaaccccctgcccacccccctggagatggtgaacaacgagaacccccccctgatcaaccacctggagcacctgaagcccctgcagccccagctgtacgacgagaagcacagccccgaggtggaggccggcgagcccagcctgagaggcatccccaaccagctgaaccaggacaagcccgccctgctgagacactgcaaggtgagacagccccccgcctacaagaagggcaacccccacaccagaaacagcatcaagcccagcagccacaacggccccagccacgacatcttcgagaagctgcagaccgtgagcgccggcaacgtgcagaacgaggagtaccccatcagacccagcaccctgaacagcagacagagcagcctggccccccagagccagccccacgacttcgtgttcagcccccacaacagcggcagacccatggagctgcagatccccaccccccccctgcccagctactgcagcaccaacgtgtgcagatgctgccagcaccacagccacatccagtacagccccctgaacagctggcagggcgccaacaccgtgggcagcatccaggacgtgcagagcgaggccctgcagaagcacagcctgttccaccccagcggctgccccgccctgtactgcaacgccttctgcagcagcagcagccccatcgccctgagaccccagggcgacatgggcagctgcagcccccacagcaacatcgagcccagccccgtggccagaccccccagccacatggacctgtgcaacccccagccctgcaccgtgtgcatgcacacccccaagaccgagagcgacaacggcatgatgggcctgagccccgacgcctacagattcctgaccgagcaggacagacagctgagactgctgcaggcccagatccagagactgctggaggcccagagcctgatgccctgcagccccaagaccaccgccgtggaggacaccgtgcaggccggcagacagatggagctggtgagcgtggaggcccagagcagccccggcctgcacatgagaaagggcgtgagcatcgccgtgagcaccggcgccagcctgttctggaacgccgccggcgaggaccaggagcccgacagccagatgaagcaggacgacaccaagatcagcagcgaggacatgaacttcagcgtggacatcaacaacgaggtgaccagcctgcccggcagcgccagcagcctgaaggccgtggacatccccagcttcgaggagagcaacatcgccgtggaggaggagttcaaccagcccctgagcgtgagcaacagcagcagcctggtggtgagaaaggagcccgacgtgcccgtgttcttccccagcggccagctggccgagagcgtgagcatgtgcctgcagaccggccccaccggcggcgccagcaacaacagcgagaccagcgaggagcccaagatcgagcacgtgatgcagcccctgctgcaccagcccagcgacaaccagaagatctaccaggacctgctgggccaggtgaaccacctgctgaacagcagcagcaaggagaccgagcagcccagcaccaaggccgtgatcatcagccacgagtgcaccagaacccagaacgtgtaccacaccaagaagaagacccaccacagcagactggtggacaaggactgcgtgctgaacgccaccctgaagcagctgagaagcctgggcgtgaagatcgacagccccaccaaggtgaagaagaacgcccacaacgtggaccacgccagcgtgctggcctgcatcagccccgaggccgtgatcagcggcctgaactgcatgagcttcgccaacgtgggcatgagcggcctgagccccaacggcgtggacctgagcatggaggccaacgccatcgccctgaagtacctgaacgagaaccagctgagccagctgagcgtgaccagaagcaaccagaacaactgcgaccccttcagcctgctgcacatcaacaccgacagaagcaccgtgggcctgagcctgatcagccccaacaacatgagcttcgccaccaagaagtacatgaagagatacggcctgctgcagagcagcgacaacagcgaggacgaggaggagccccccgacaacgccgacagcaagagcgagtacctgctgaaccagaacctgagaagcatccccgagcagctgggcggccagaaggagcccagcaagaacgaccacgagatcatcaactgcagcaactgcgagagcgtgggcaccaacgccgacacccccgtgctgagaaacatcaccaacgaggtgctgcagaccaaggccaagcagcagctgaccgagaagcccgccttcctggtgaagaacctgaagcccagccccgccgtgaacctgagaaccggcaaggccgagttcacccagcaccccgagaaggagaacgagggcgacatcaccatcttccccgagagcctgcagcccagcgagaccctgaagcagatgaacagcatgaacagcgtgggcaccttcctggacgtgaagagactgagacagctgcccaagctgttctag

SEQ ID NO: 98127 - DNA, 606 bp, Artificial Sequence
  Description of Artificial Sequence: Synthetic coding sequence
atgagcttcgccaccctgagacccgccccccccggcagatacctgtaccccgaggtgagccccctgagcgaggacgaggacagaggcagcgacagcagcggcagcgacgagaagccctgcagagtgcacgccgccagatgcggcctgcagggcgccagaagaagagccggcggcagaagagccggcggcggcggccccggcggcagacccggcagagagcccagacagagacacaccgccaacgccagagagagagacagaaccaacagcgtgaacaccgccttcaccgccctgagaaccctgatccccaccgagcccgccgacagaaagctgagcaagatcgagaccctgagactggccagcagctacatcagccacctgggcaacgtgctgctggccggcgaggcctgcggcgacggccagccctgccacagcggccccgccttcttccacgccgccagagccggcagccccccccccccccccccccccccccccgccagagacggcgagaacacccagcccaagcagatctgcaccttctgcctgagcaaccagagaaagctgagcaaggacagagacagaaagaccgccatcagaagctag

SEQ ID NO: 98128 - DNA, 642 bp, Artificial Sequence
  Description of Artificial Sequence: Synthetic coding sequence
atgcagctgcccctggccctgtgcctggtgtgcctgctggtgcacaccgccttcagagtggtggagggccagggctggcaggccttcaagaacgacgccaccgagatcatccccgagctgggcgagtaccccgagcccccccccgagctggagaacaacaagaccatgaacagagccgagaacggcggcagacccccccaccaccccttcgagaccaaggacgtgagcgagtacagctgcagagagctgcacttcaccagatacgtgaccgacggcccctgcagaagcgccaagcccgtgaccgagctggtgtgcagcggccagtgcggccccgccagactgctgcccaacgccatcggcagaggcaagtggtggagacccagcggccccgacttcagatgcatccccgacagatacagagcccagagagtgcagctgctgtgccccggcggcgaggcccccagagccagaaaggtgagactggtggccagctgcaagtgcaagagactgaccagattccacaaccagagcgagctgaaggacttcggcaccgaggccgccagaccccagaagggcagaaagcccagacccagagccagaagcgccaaggccaaccaggccgagctggagaacgcctactag

SEQ ID NO: 98129 - DNA, 906 bp, Artificial Sequence
  Description of Artificial Sequence: Synthetic coding sequence
atggccatgctggtgctggtgcccggcagagtgatgagacccctgggcggccagctgtggagattcctgcccagaggcctggagttctggggccccgccgagggcaccgccagagtgctgctgagacagttctgcgccagacaggccgaggcctggagagccagcggcagacccggctactgcctgggcaccagacccctgagcaccgccagacccccccccccctggagccagaagggccccggcgacagcaccagacccagcaagcccggccccgtgagctggaagagcctggccatcaccttcgccatcggcggcgccctgctggccggcatgaagcacgtgaagaaggagaaggccgagaagctggagaaggagagacagagacacatcggcaagcccctgctgggcggccccttcagcctgaccacccacaccggcgagagaaagaccgacaaggactacctgggccagtggctgctgatctacttcggcttcacccactgccccgacgtgtgccccgaggagctggagaagatgatccaggtggtggacgagatcgacagcatcaccaccctgcccgacctgacccccctgttcatcagcatcgaccccgagagagacaccaaggaggccatcgccaactacgtgaaggagttcagccccaagctggtgggcctgaccggcaccagagaggaggtggaccaggtggccagagcctacagagtgtactacagccccggccccaaggacgaggacgaggactacatcgtggaccacaccatcatcatgtacctgatcggccccgacggcgagttcctggactacttcggccagaacaagagaaagggcgagatcgccgccagcatcgccacccacatgagaccctacagaaagaagagctag

SEQ ID NO: 98130 - DNA, 813 bp, Artificial Sequence
  Description of Artificial Sequence: Synthetic coding sequence
atggccatgctggtgctggtgcccggcagagtgatgagacccctgggcggccagctgtggagattcctgcccagaggcctggagttctggggccccgccgagggcaccgccagagtgctgctgagacagttctgcgccagacaggccgaggcctggagagccagcggcagacccggctactgcctgggcaccagacccctgagcaccgccagacccccccccccctggagccagaagggccccggcgacagcaccagacccagcaagcccggccccgtgagctggaagagcctggccatcaccttcgccatcggcggcgccctgctggccggcatgaagcacgtgaagaaggagaaggccgagaagctggagaaggagagacagagacacatcggcaagcccctgctgggcggccccttcagcctgaccacccacaccggcgagagaaagaccgacaaggactacctggacagcatcaccaccctgcccgacctgacccccctgttcatcagcatcgaccccgagagagacaccaaggaggccatcgccaactacgtgaaggagttcagccccaagctggtgggcctgaccggcaccagagaggaggtggaccaggtggccagagcctacagagtgtactacagccccggccccaaggacgaggacgaggactacatcgtggaccacaccatcatcatgtacctgatcggccccgacggcgagttcctggactacttcggccagaacaagagaaagggcgagatcgccgccagcatcgccacccacatgagaccctacagaaagaagagctag

SEQ ID NO: 98131 - DNA, 801 bp, Artificial Sequence
  Description of Artificial Sequence: Synthetic coding sequence
atgctgctgctgaccagaagccccaccgcctggcacagactgagccagctgaagcccagagtgctgcccggcaccctgggcggccaggccctgcacctgagaagctggctgctgagcagacagggccccgccgagaccggcggccagggccagccccagggccccggcctgagaaccagactgctgatcaccggcctgttcggcgccggcctgggcggcgcctggctggccctgagagccgagaaggagagactgcagcagcagaagagaaccgaggccctgagacaggccgccgtgggccagggcgacttccacctgctggaccacagaggcagagccagatgcaaggccgacttcagaggccagtgggtgctgatgtacttcggcttcacccactgccccgacatctgccccgacgagctggagaagctggtgcaggtggtgagacagctggaggccgagcccggcctgccccccgtgcagcccgtgttcatcaccgtggaccccgagagagacgacgtggaggccatggccagatacgtgcaggacttccaccccagactgctgggcctgaccggcagcaccaagcaggtggcccaggccagccacagctacagagtgtactacaacgccggccccaaggacgaggaccaggactacatcgtggaccacagcatcgccatctacctgctgaaccccgacggcctgttcaccgactactacggcagaagcagaagcgccgagcagatcagcgacagcgtgagaagacacatggccgccttcagaagcgtgctgagctag

SEQ ID NO: 98132 - DNA, 801 bp, Artificial Sequence; identical to SEQ ID NO: 98131
  Description of Artificial Sequence: Synthetic coding sequence

SEQ ID NO: 98133 - DNA, 411 bp, Artificial Sequence
  Description of Artificial Sequence: Synthetic coding sequence
atgctgctgctgaccagaagccccaccgcctggcacagactgagccagctgaagcccagagtgctgcccggcaccctgggcggccaggccctgcacctgagaagctggctgctgagcagacagggccccgccgagaccggcggccagggccagccccagggccccggcctgagaaccagactgctgatcaccggcctgttcggcgccggcctgggcggcgcctggctggccctgagagccgagaaggagagactgcagcagcagaagagaaccgaggccctgagacaggccgccgtgggccagggcgacttccacctgctggaccacagaggcagagccagatgcaaggccgacttcagaggccagtgggtgctgatgtacttcggcttcacccactgccccgacatctag

SEQ ID NO: 98134 - DNA, 411 bp, Artificial Sequence; identical to SEQ ID NO: 98133
  Description of Artificial Sequence: Synthetic coding sequence

SEQ ID NO: 98135 - DNA, 801 bp, Artificial Sequence; identical to SEQ ID NO: 98131
  Description of Artificial Sequence: Synthetic coding sequence

SEQ ID NO: 98136 - DNA, 801 bp, Artificial Sequence; identical to SEQ ID NO: 98131
  Description of Artificial Sequence: Synthetic coding sequence

SEQ ID NO: 98137 - DNA, 1047 bp, Artificial Sequence
  Description of Artificial Sequence: Synthetic coding sequence
atgcccagaagcttcctggtgaagaaggtgaagctggacgccttcagcagcgccgacctggagagcgcctacggcagagccagaagcgacctgggcgcccccctgcacgacaagggctacctgagcgactacgtgggccccagcagcgtgtacgacggcgacgccgaggccgccctgctgaagggccccagccccgagcccatgtacgccgccgccgtgagaggcgagctgggccccgccgccgccggcagcgcccccccccccacccccagacccgagctggccaccgccgccggcggctacatcaacggcgacgccgccgtgagcgagggctacgccgccgacgccttcttcatcaccgacggcagaagcagaagaaaggccagcaacgccggcagcgccgccgcccccagcaccgccagcgccgccgcccccgacggcgacgccggcggcggcggcggcgccggcggcagaagcctgggcagcggccccggcggcagaggcggcaccagagccggcgccggcaccgaggccagagccggccccggcgccgccggcgccggcggcagacacgcctgcggcgagtgcggcaagacctacgccaccagcagcaacctgagcagacacaagcagacccacagaagcctggacagccagctggccagaagatgccccacctgcggcaaggtgtacgtgagcatgcccgccatggccatgcacctgctgacccacgacctgagacacaagtgcggcgtgtgcggcaaggccttcagcagaccctggctgctgcagggccacatgagaagccacaccggcgagaagcccttcggctgcgcccactgcggcaaggccttcgccgacagaagcaacctgagagcccacatgcagacccacagcgccttcaagcacttccagtgcaagagatgcaagaagagcttcgccctgaagagctacctgaacaagcactacgagagcgcctgcttcaagggcggcgccggcggccccgccgcccccgcccccccccagctgagccccgtgcaggcctag

SEQ ID NO: 98138 - DNA, 4893 bp, Artificial Sequence
  Description of Artificial Sequence: Synthetic coding sequence
atgctgaagtgcatccccctgtggagatgcaacagacacgtggagagcgtggacaagagacactgcagcctgcaggccgtgcccgaggagatctacagatacagcagaagcctggaggagctgctgctggacgccaaccagctgagagagctgcccaagcccttcttcagactgctgaacctgagaaagctgggcctgagcgacaacgagatccagagactgccccccgaggtggccaacttcatgcagctggtggagctggacgtgagcagaaacgacatccccgagatccccgagagcatcaagttctgcaaggccctggagatcgccgacttcagcggcaaccccctgagcagactgcccgacggcttcacccagctgagaagcctggcccacctggccctgaacgacgtgagcctgcaggccctgcccggcgacgtgggcaacctggccaacctggtgaccctggagctgagagagaacctgctgaagagcctgcccgccagcctgagcttcctggtgaagctggagcagctggacctgggcggcaacgacctggaggtgctgcccgacaccctgggcgccctgcccaacctgagagagctgtggctggacagaaaccagctgagcgccctgccccccgagctgggcaacctgagaagactggtgtgcctggacgtgagcgagaacagactggaggagctgcccgccgagctgggcggcctggtgctgctgaccgacctgctgctgagccagaacctgctgagaagactgcccgacggcatcggccagctgaagcagctgagcatcctgaaggtggaccagaacagactgtgcgaggtgaccgaggccatcggcgactgcgagaacctgagcgagctgatcctgaccgagaacctgctgatggccctgcccagaagcctgggcaagctgaccaagctgaccaacctgaacgtggacagaaaccacctggaggccctgccccccgagatcggcggctgcgtggccctgagcgtgctgagcctgagagacaacagactggccgtgctgccccccgagctggcccacaccaccgagctgcacgtgctggacgtggccggcaacagactgcagagcctgcccttcgccctgacccacctgaacctgaaggccctgtggctggccgagaaccaggcccagcccatgctgagattccagaccgaggacgacgccagaaccggcgagaaggtgctgacctgctacctgctgccccagcagcccccccccagcctggaggacgccggccagcagggcagcctgagcgagacctggagcgacgccccccccagcagagtgagcgtgatccagttcctggaggcccccatcggcgacgaggacgccgaggaggccgccgccgagaagagaggcctgcagagaagagccaccccccaccccagcgagctgaaggtgatgaagagaagcatcgagggcagaagaagcgaggcctgcccctgccagcccgacagcggcagccccctgcccgccgaggaggagaagagactgagcgccgagagcggcctgagcgaggacagcagacccagcgccagcaccgtgagcgaggccgagcccgagggccccagcgccgaggcccagggcggcagccagcaggaggccaccaccgccggcggcgaggaggacgccgaggaggactaccaggagcccaccgtgcacttcgccgaggacgccctgctgcccggcgacgacagagagatcgaggagggccagcccgaggccccctggaccctgcccggcggcagacagagactgatcagaaaggacaccccccactacaagaagcacttcaagatcagcaagctgccccagcccgaggccgtggtggccctgctgcagggcatgcagcccgacggcgagggccccgtggcccccggcggctggcacaacggcccccacgccccctgggcccccagagcccagaaggaggaggaggaggaggaggagggcagcccccaggaggaggaggtggaggaggaggaggagaacagagccgaggaggaggaggccagcaccgaggaggaggacaaggagggcgccgtggtgagcgcccccagcgtgaagggcgtgagcttcgaccaggccaacaacctgctgatcgagcccgccagaatcgaggaggaggagctgaccctgaccatcctgagacagaccggcggcctgggcatcagcatcgccggcggcaagggcagcaccccctacaagggcgacgacgagggcatcttcatcagcagagtgagcgaggagggccccgccgccagagccggcgtgagagtgggcgacaagctgctggaggtgaacggcgtggccctgcagggcgccgagcaccacgaggccgtggaggccctgagaggcgccggcaccgccgtgcagatgagagtgtggagagagagaatggtggagcccgagaacgccgtgaccatcacccccctgagacccgaggacgactacagccccagagagagaagaggcggcggcctgagactgcccctgctgccccccgagagccccggccccctgagacagagacacgtggcctgcctggccagaagcgagagaggcctgggcttcagcatcgccggcggcaagggcagcaccccctacagagccggcgacgccggcatcttcgtgagcagaatcgccgagggcggcgccgcccacagagccggcaccctgcaggtgggcgacagagtgctgagcatcaacggcgtggacgtgaccgaggccagacacgaccacgccgtgagcctgctgaccgccgccagccccaccatcgccctgctgctggagagagaggccggcggccccctgccccccagccccctgccccacagcagcccccccaccgccgccgtggccaccaccagcatcaccaccgccacccccggcgtgcccggcctgcccagcctggcccccagcctgctggccgccgccctggagggcccctaccccgtggaggagatcagactgcccagagccggcggccccctgggcctgagcatcgtgggcggcagcgaccacagcagccaccccttcggcgtgcaggagcccggcgtgttcatcagcaaggtgctgcccagaggcctggccgccagaagcggcctgagagtgggcgacagaatcctggccgtgaacggccaggacgtgagagacgccacccaccaggaggccgtgagcgccctgctgagaccctgcctggagctgagcctgctggtgagaagagaccccgccccccccggcctgagagagctgtgcatccagaaggcccccggcgagagactgggcatcagcatcagaggcggcgccagaggccacgccggcaaccccagagaccccaccgacgagggcatcttcatcagcaaggtgagccccaccggcgccgccggcagagacggcagactgagagtgggcctgagactgctggaggtgaaccagcagagcctgctgggcctgacccacggcgaggccgtgcagctgctgagaagcgtgggcgacaccctgaccgtgctggtgtgcgacggcttcgaggccagcaccgacgccgccctggaggtgagccccggcgtgatcgccaaccccttcgccgccggcatcggccacagaaacagcctggagagcatcagcagcatcgacagagagctgagccccgagggccccggcaaggagaaggagctgcccggccagaccctgcactggggccccgaggccaccgaggccgccggcagaggcctgcagcccctgaagctggactacagagccctggccgccgtgcccagcgccggcagcgtgcagagagtgcccagcggcgccgccggcggcaagatggccgagagcccctgcagccccagcggccagcagccccccagcccccccagccccgacgagctgcccgccaacgtgaagcaggcctacagagccttcgccgccgtgcccaccagccacccccccgaggacgcccccgcccagccccccacccccggccccgccgccagccccgagcagctgagcttcagagagagacagaagtacttcgagctggaggtgagagtgccccaggccgagggcccccccaagagagtgagcctggtgggcgccgacgacctgagaaagatgcaggaggaggaggccagaaagctgcagcagaagagagcccagatgctgagagaggccgccgaggccggcgccgaggccagactggccctggacggcgagaccctgggcgaggaggagcaggaggacgagcagcccccctgggccagccccagccccaccagcagacagagccccgccagccccccccccctgggcggcggcgcccccgtgagaaccgccaaggccgagagaagacaccaggagagactgagagtgcagagccccgagccccccgcccccgagagagccctgagccccgccgagctgagagccctggaggccgagaagagagccctgtggagagccgccagaatgaagagcctggagcaggacgccctgagagcccagatggtgctgagcagaagccaggagggcagaggcaccagaggccccctggagagactggccgaggcccccagccccgcccccacccccagccccacccccgtggaggacctgggcccccagaccagcaccagccccggcagactgagccccgacttcgccgaggagctgagaagcctggagcccagccccagccccggcccccaggaggaggacggcgaggtggccctggtgctgctgggcagacccagccccggcgccgtgggccccgaggacgtggccctgtgcagcagcagaagacccgtgagacccggcagaagaggcctgggccccgtgcccagctag

SEQ ID NO: 98139 - DNA, 4650 bp, Artificial Sequence
  Description of Artificial Sequence: Synthetic coding sequence
atgcagctggtggagctggacgtgagcagaaacgacatccccgagatccccgagagcatcaagttctgcaaggccctggagatcgccgacttcagcggcaaccccctgagcagactgcccgacggcttcacccagctgagaagcctggcccacctggccctgaacgacgtgagcctgcaggccctgcccggcgacgtgggcaacctggccaacctggtgaccctggagctgagagagaacctgctgaagagcctgcccgccagcctgagcttcctggtgaagctggagcagctggacctgggcggcaacgacctggaggtgctgcccgacaccctgggcgccctgcccaacctgagagagctgtggctggacagaaaccagctgagcgccctgccccccgagctgggcaacctgagaagactggtgtgcctggacgtgagcgagaacagactggaggagctgcccgccgagctgggcggcctggtgctgctgaccgacctgctgctgagccagaacctgctgagaagactgcccgacggcatcggccagctgaagcagctgagcatcctgaaggtggaccagaacagactgtgcgaggtgaccgaggccatcggcgactgcgagaacctgagcgagctgatcctgaccgagaacctgctgatggccctgcccagaagcctgggcaagctgaccaagctgaccaacctgaacgtggacagaaaccacctggaggccctgccccccgagatcggcggctgcgtggccctgagcgtgctgagcctgagagacaacagactggccgtgctgccccccgagctggcccacaccaccgagctgcacgtgctggacgtggccggcaacagactgcagagcctgcccttcgccctgacccacctgaacctgaaggccctgtggctggccgagaaccaggcccagcccatgctgagattccagaccgaggacgacgccagaaccggcgagaaggtgctgacctgctacctgctgccccagcagcccccccccagcctggaggacgccggccagcagggcagcctgagcgagacctggagcgacgccccccccagcagagtgagcgtgatccagttcctggaggcccccatcggcgacgaggacgccgaggaggccgccgccgagaagagaggcctgcagagaagagccaccccccaccccagcgagctgaaggtgatgaagagaagcatcgagggcagaagaagcgaggcctgcccctgccagcccgacagcggcagccccctgcccgccgaggaggagaagagactgagcgccgagagcggcctgagcgaggacagcagacccagcgccagcaccgtgagcgaggccgagcccgagggccccagcgccgaggcccagggcggcagccagcaggaggccaccaccgccggcggcgaggaggacgccgaggaggactaccaggagcccaccgtgcacttcgccgaggacgccctgctgcccggcgacgacagagagatcgaggagggccagcccgaggccccctggaccctgcccggcggcagacagagactgatcagaaaggacaccccccactacaagaagcacttcaagatcagcaagctgccccagcccgaggccgtggtggccctgctgcagggcatgcagcccgacggcgagggccccgtggcccccggcggctggcacaacggcccccacgccccctgggcccccagagcccagaaggaggaggaggaggaggaggagggcagcccccaggaggaggaggtggaggaggaggaggagaacagagccgaggaggaggaggccagcaccgaggaggaggacaaggagggcgccgtggtgagcgcccccagcgtgaagggcgtgagcttcgaccaggccaacaacctgctgatcgagcccgccagaatcgaggaggaggagctgaccctgaccatcctgagacagaccggcggcctgggcatcagcatcgccggcggcaagggcagcaccccctacaagggcgacgacgagggcatcttcatcagcagagtgagcgaggagggccccgccgccagagccggcgtgagagtgggcgacaagctgctggaggtgaacggcgtggccctgcagggcgccgagcaccacgaggccgtggaggccctgagaggcgccggcaccgccgtgcagatgagagtgtggagagagagaatggtggagcccgagaacgccgtgaccatcacccccctgagacccgaggacgactacagccccagagagagaagaggcggcggcctgagactgcccctgctgccccccgagagccccggccccctgagacagagacacgtggcctgcctggccagaagcgagagaggcctgggcttcagcatcgccggcggcaagggcagcaccccctacagagccggcgacgccggcatcttcgtgagcagaatcgccgagggcggcgccgcccacagagccggcaccctgcaggtgggcgacagagtgctgagcatcaacggcgtggacgtgaccgaggccagacacgaccacgccgtgagcctgctgaccgccgccagccccaccatcgccctgctgctggagagagaggccggcggccccctgccccccagccccctgccccacagcagcccccccaccgccgccgtggccaccaccagcatcaccaccgccacccccggcgtgcccggcctgcccagcctggcccccagcctgctggccgccgccctggagggcccctaccccgtggaggagatcagactgcccagagccggcggccccctgggcctgagcatcgtgggcggcagcgaccacagcagccaccccttcggcgtgcaggagcccggcgtgttcatcagcaaggtgctgcccagaggcctggccgccagaagcggcctgagagtgggcgacagaatcctggccgtgaacggccaggacgtgagagacgccacccaccaggaggccgtgagcgccctgctgagaccctgcctggagctgagcctgctggtgagaagagaccccgccccccccggcctgagagagctgtgcatccagaaggcccccggcgagagactgggcatcagcatcagaggcggcgccagaggccacgccggcaaccccagagaccccaccgacgagggcatcttcatcagcaaggtgagccccaccggcgccgccggcagagacggcagactgagagtgggcctgagactgctggaggtgaaccagcagagcctgctgggcctgacccacggcgaggccgtgcagctgctgagaagcgtgggcgacaccctgaccgtgctggtgtgcgacggcttcgaggccagcaccgacgccgccctggaggtgagccccggcgtgatcgccaaccccttcgccgccggcatcggccacagaaacagcctggagagcatcagcagcatcgacagagagctgagccccgagggccccggcaaggagaaggagctgcccggccagaccctgcactggggccccgaggccaccgaggccgccggcagaggcctgcagcccctgaagctggactacagagccctggccgccgtgcccagcgccggcagcgtgcagagagtgcccagcggcgccgccggcggcaagatggccgagagcccctgcagccccagcggccagcagccccccagcccccccagccccgacgagctgcccgccaacgtgaagcaggcctacagagccttcgccgccgtgcccaccagccacccccccgaggacgcccccgcccagccccccacccccggccccgccgccagccccgagcagctgagcttcagagagagacagaagtacttcgagctggaggtgagagtgccccaggccgagggcccccccaagagagtgagcctggtgggcgccgacgacctgagaaagatgcaggaggaggaggccagaaagctgcagcagaagagagcccagatgctgagagaggccgccgaggccggcgccgaggccagactggccctggacggcgagaccctgggcgaggaggagcaggaggacgagcagcccccctgggccagccccagccccaccagcagacagagccccgccagccccccccccctgggcggcggcgcccccgtgagaaccgccaaggccgagagaagacaccaggagagactgagagtgcagagccccgagccccccgcccccgagagagccctgagccccgccgagctgagagccctggaggccgagaagagagccctgtggagagccgccagaatgaagagcctggagcaggacgccctgagagcccagatggtgctgagcagaagccaggagggcagaggcaccagaggccccctggagagactggccgaggcccccagccccgcccccacccccagccccacccccgtggaggacctgggcccccagaccagcaccagccccggcagactgagccccgacttcgccgaggagctgagaagcctggagcccagccccagccccggcccccaggaggaggacggcgaggtggccctggtgctgctgggcagacccagccccggcgccgtgggccccgaggacgtggccctgtgcagcagcagaagacccgtgagacccggcagaagaggcctgggccccgtgcccagctag

SEQ ID NO: 98140 - DNA, 2268 bp, Artificial Sequence
  Description of Artificial Sequence: Synthetic coding sequence
atgcagcccgacggcgagggccccgtggcccccggcggctggcacaacggcccccacgccccctgggcccccagagcccagaaggaggaggaggaggaggaggagggcagcccccaggaggaggaggtggaggaggaggaggagaacagagccgaggaggaggaggccagcaccgaggaggaggacaaggagggcgccgtggtgagcgcccccagcgtgaagggcgtgagcttcgaccaggccaacaacctgctgatcgagcccgccagaatcgaggaggaggagctgaccctgaccatcctgagacagaccggcggcctgggcatcagcatcgccggcggcaagggcagcaccccctacaagggcgacgacgagggcatcttcatcagcagagtgagcgaggagggccccgccgccagagccggcgtgagagtgggcgacaagctgctggaggtgaacggcgtggccctgcagggcgccgagcaccacgaggccgtggaggccctgagaggcgccggcaccgccgtgcagatgagagtgtggagagagagaatggtggagcccgagaacgccgtgaccatcacccccctgagacccgaggacgactacagccccagagagagaagaggcggcggcctgagactgcccctgctgccccccgagagccccggccccctgagacagagacacgtggcctgcctggccagaagcgagagaggcctgggcttcagcatcgccggcggcaagggcagcaccccctacagagccggcgacgccggcatcttcgtgagcagaatcgccgagggcggcgccgcccacagagccggcaccctgcaggtgggcgacagagtgctgagcatcaacggcgtggacgtgaccgaggccagacacgaccacgccgtgagcctgctgaccgccgccagccccaccatcgccctgctgctggagagagaggccggcggccccctgccccccagccccctgccccacagcagcccccccaccgccgccgtggccaccaccagcatcaccaccgccacccccggcgtgcccggcctgcccagcctggcccccagcctgctggccgccgccctggagggcccctaccccgtggaggagatcagactgcccagagccggcggccccctgggcctgagcatcgtgggcggcagcgaccacagcagccaccccttcggcgtgcaggagcccggcgtgttcatcagcaaggtgctgcccagaggcctggccgccagaagcggcctgagagtgggcgacagaatcctggccgtgaacggccaggacgtgagagacgccacccaccaggaggccgtgagcgccctgctgagaccctgcctggagctgagcctgctggtgagaagagaccccgccccccccggcctgagagagctgtgcatccagaaggcccccggcgagagactgggcatcagcatcagaggcggcgccagaggccacgccggcaaccccagagaccccaccgacgagggcatcttcatcagcaaggtgagccccaccggcgccgccggcagagacggcagactgagagtgggcctgagactgctggaggtgaaccagcagagcctgctgggcctgacccacggcgaggccgtgcagctgctgagaagcgtgggcgacaccctgaccgtgctggtgtgcgacggcttcgaggccagcaccgacgccgccctggaggtgagccccggcgtgatcgccaaccccttcgccgccggcatcggccacagaaacagcctggagagcatcagcagcatcgacagagagctgagccccgagggccccggcaaggagaaggagctgcccggccagaccctgcactggggccccgaggccaccgaggccgccggcagaggcctgcagcccctgaagctggactacagagccctggccgccgtgcccagcgccggcagcgtgcagagagtgcccagcggcgccgccggcggcaagatggccgagagcccctgcagccccagcggccagcagccccccagcccccccagccccgacgagctgcccgccaacgtgaagcaggcctacagagccttcgccgccgtgcccaccagccacccccccgaggacgcccccgcccagccccccacccccggccccgccgccagccccgagcagctgagcttcagagagagacagaagtacttcgagctggaggtgagagtgccccaggccgagggccccctgagacccggcagaagaggcctgggccccgtgcccagctag

SEQ ID NO: 98141 - DNA, 4968 bp, Artificial Sequence
  Description of Artificial Sequence: Synthetic coding sequence
atgctgaagtgcatccccctgtggagatgcaacagacacgtggagagcgtggacaagagacactgcagcctgcaggccgtgcccgaggagatctacagatacagcagaagcctggaggagctgctgctggacgccaaccagctgagagagctgcccaagcccttcttcagactgctgaacctgagaaagctgggcctgagcgacaacgagatccagagactgccccccgaggtggccaacttcatgcagctggtggagctggacgtgagcagaaacgacatccccgagatccccgagagcatcaagttctgcaaggccctggagatcgccgacttcagcggcaaccccctgagcagactgcccgacggcttcacccagctgagaagcctggcccacctggccctgaacgacgtgagcctgcaggccctgcccggcgacgtgggcaacctggccaacctggtgaccctggagctgagagagaacctgctgaagagcctgcccgccagcctgagcttcctggtgaagctggagcagctggacctgggcggcaacgacctggaggtgctgcccgacaccctgggcgccctgcccaacctgagagagctgtggctggacagaaaccagctgagcgccctgccccccgagctgggcaacctgagaagactggtgtgcctggacgtgagcgagaacagactggaggagctgcccgccgagctgggcggcctggtgctgctgaccgacctgctgctgagccagaacctgctgagaagactgcccgacggcatcggccagctgaagcagctgagcatcctgaaggtggaccagaacagactgtgcgaggtgaccgaggccatcggcgactgcgagaacctgagcgagctgatcctgaccgagaacctgctgatggccctgcccagaagcctgggcaagctgaccaagctgaccaacctgaacgtggacagaaaccacctggaggccctgccccccgagatcggcggctgcgtggccctgagcgtgctgagcctgagagacaacagactggccgtgctgccccccgagctggcccacaccaccgagctgcacgtgctggacgtggccggcaacagactgcagagcctgcccttcgccctgacccacctgaacctgaaggccctgtggctggccgagaaccaggcccagcccatgctgagattccagaccgaggacgacgccagaaccggcgagaaggtgctgacctgctacctgctgccccagcagcccccccccagcctggaggacgccggccagcagggcagcctgagcgagacctggagcgacgccccccccagcagagtgagcgtgatccagttcctggaggcccccatcggcgacgaggacgccgaggaggccgccgccgagaagagaggcctgcagagaagagccaccccccaccccagcgagctgaaggtgatgaagagaagcatcgagggcagaagaagcgaggcctgcccctgccagcccgacagcggcagccccctgcccgccgaggaggagaagagactgagcgccgagagcggcctgagcgaggacagcagacccagcgccagcaccgtgagcgaggccgagcccgagggccccagcgccgaggcccagggcggcagccagcaggaggccaccaccgccggcggcgaggaggacgccgaggaggactaccaggagcccaccgtgcacttcgccgaggacgccctgctgcccggcgacgacagagagatcgaggagggccagcccgaggccccctggaccctgcccggcggcagacagagactgatcagaaaggacaccccccactacaagaagcacttcaagatcagcaagctgccccagcccgaggccgtggtggccctgctgcagggcatgcagcccgacggcgagggccccgtggcccccggcggctggcacaacggcccccacgccccctgggcccccagagcccagaaggaggaggaggaggaggaggagggcagcccccaggaggaggaggtggaggaggaggaggagaacagagccgaggaggaggaggccagcaccgaggaggaggacaaggagggcgccgtggtgagcgcccccagcgtgaagggcgtgagcttcgaccaggccaacaacctgctgatcgagcccgccagaatcgaggaggaggagctgaccctgaccatcctgagacagaccggcggcctgggcatcagcatcgccggcggcaagggcagcaccccctacaagggcgacgacgagggcatcttcatcagcagagtgagcgaggagggccccgccgccagagccggcgtgagagtgggcgacaagctgctggaggtgaacggcgtggccctgcagggcgccgagcaccacgaggccgtggaggccctgagaggcgccggcaccgccgtgcagatgagagtgtggagagagagaatggtggagcccgagaacgccgtgaccatcacccccctgagacccgaggacgactacagccccagagagagaagaggcggcggcctgagactgcccctgctgccccccgagagccccggccccctgagacagagacacgtggcctgcctggccagaagcgagagaggcctgggcttcagcatcgccggcggcaagggcagcaccccctacagagccggcgacgccggcatcttcgtgagcagaatcgccgagggcggcgccgcccacagagccggcaccctgcaggtgggcgacagagtgctgagcatcaacggcgtggacgtgaccgaggccagacacgaccacgccgtgagcctgctgaccgccgccagccccaccatcgccctgctgctggagagagaggccggcggccccctgccccccagccccctgccccacagcagcccccccaccgccgccgtggccaccaccagcatcaccaccgccacccccggcgtgcccggcctgcccagcctggcccccagcctgctggccgccgccctggagggcccctaccccgtggaggagatcagactgcccagagccggcggccccctgggcctgagcatcgtgggcggcagcgaccacagcagccaccccttcggcgtgcaggagcccggcgtgttcatcagcaaggtgctgcccagaggcctggccgccagaagcggcctgagagtgggcgacagaatcctggccgtgaacggccaggacgtgagagacgccacccaccaggaggccgtgagcgccctgctgagaccctgcctggagctgagcctgctggtgagaagagaccccgccccccccggcctgagagagctgtgcatccagaaggcccccggcgagagactgggcatcagcatcagaggcggcgccagaggccacgccggcaaccccagagaccccaccgacgagggcatcttcatcagcaaggtgagccccaccggcgccgccggcagagacggcagactgagagtgggcctgagactgctggaggtgaaccagcagagcctgctgggcctgacccacggcgaggccgtgcagctgctgagaagcgtgggcgacaccctgaccgtgctggtgtgcgacggcttcgaggccagcaccgacgccgccctggaggtgagccccggcgtgatcgccaaccccttcgccgccggcatcggccacagaaacagcctggagagcatcagcagcatcgacagagagctgagccccgagggccccggcaaggagaaggagctgcccggccagaccctgcactggggccccgaggccaccgaggccgccggcagaggcctgcagcccctgaagctggactacagagccctggccgccgtgcccagcgccggcagcgtgcagagagtgcccagcggcgccgccggcggcaagatggccgagagcccctgcagccccagcggccagcagccccccagcccccccagccccgacgagctgcccgccaacgtgaagcaggcctacagagccttcgccgccgtgcccaccagccacccccccgaggacgcccccgcccagccccccacccccggccccgccgccagccccgagcagctgagcttcagagagagacagaagtacttcgagctggaggtgagagtgccccaggccgagggcccccccaagagagtgagcctggtgggcgccgacgacctgagaaagatgcaggaggaggaggccagaaagctgcagcagaagagagcccagatgctgagagaggccgccgaggccggcgccgaggccagactggccctggacggcgagaccctgggcgaggaggagcaggaggacgagcagcccccctgggccagccccagccccaccagcagacagagccccgccagccccccccccctgggcggcggcgcccccgtgagaaccgccaaggccgagagaagacaccaggagagactgagagtgcagagccccgagccccccgcccccgagagagccctgagccccgccgagctgagagccctggaggccgagaagagagccctgtggagagccgccagaatgaagagcctggagcaggacgccctgagagcccagatggtgctgagcagaagccaggagggcagaggcaccagaggccccctggagagactggccgaggcccccagccccgcccccacccccagccccacccccgtggaggacctgggcccccagaccagcaccagccccggcagactgcccctgagcggcaagaagttcgactacagagccttcgccgccctgcccagcagcagacccgtgtacgacatccagagccccgacttcgccgaggagctgagaagcctggagcccagccccagccccggcccccaggaggaggacggcgaggtggccctggtgctgctgggcagacccagccccggcgccgtgggccccgaggacgtggccctgtgcagcagcagaagacccgtgagacccggcagaagaggcctgggccccgtgcccagctag

SEQ ID NO: 98142 - DNA, 2427 bp, Artificial Sequence
  Description of Artificial Sequence: Synthetic coding sequence
atgtggttcttcgccagagaccccgtgagagacttccccttcgagctgatccccgagccccccgagggcggcctgcccggcccctgggccctgcacagaggcagaaagaaggccaccggcagccccgtgagcatcttcgtgtacgacgtgaagcccggcgccgaggagcagacccaggtggccaaggccgccttcaagagattcaagaccctgagacaccccaacatcctggcctacatcgacggcctggagaccgagaagtgcctgcacgtggtgaccgaggccgtgacccccctgggcatctacctgaaggccagagtggaggccggcggcctgaaggagctggagatcagctggggcctgcaccagatcgtgaaggccctgagcttcctggtgaacgactgcagcctgatccacaacaacgtgtgcatggccgccgtgttcgtggacagagccggcgagtggaagctgggcggcctggactacatgtacagcgcccagggcaacggcggcggcccccccagaaagggcatccccgagctggagcagtacgacccccccgagctggccgacagcagcggcagagtggtgagagagaagtggagcgccgacatgtggagactgggctgcctgatctgggaggtgttcaacggccccctgcccagagccgccgccctgagaaaccccggcaagatccccaagaccctggtgccccactactgcgagctggtgggcgccaaccccaaggtgagacccaaccccgccagattcctgcagaactgcagagcccccggcggcttcatgagcaacagattcgtggagaccaacctgttcctggaggagatccagatcaaggagcccgccgagaagcagaagttcttccaggagctgagcaagagcctggacgccttccccgaggacttctgcagacacaaggtgctgccccagctgctgaccgccttcgagttcggcaacgccggcgccgtggtgctgacccccctgttcaaggtgggcaagttcctgagcgccgaggagtaccagcagaagatcatccccgtggtggtgaagatgttcagcagcaccgacagagccatgagaatcagactgctgcagcagatggagcagttcatccagtacctggacgagcccaccgtgaacacccagatcttcccccacgtggtgcacggcttcctggacaccaaccccgccatcagagagcagaccgtgaagagcatgctgctgctggcccccaagctgaacgaggccaacctgaacgtggagctgatgaagcacttcgccagactgcaggccaaggacgagcagggccccatcagatgcaacaccaccgtgtgcctgggcaagatcggcagctacctgagcgccagcaccagacacagagtgctgaccagcgccttcagcagagccaccagagaccccttcgcccccagcagagtggccggcgtgctgggcttcgccgccacccacaacctgtacagcatgaacgactgcgcccagaagatcctgcccgtgctgtgcggcctgaccgtggaccccgagaagagcgtgagagaccaggccttcaaggccatcagaagcttcctgagcaagctggagagcgtgagcgaggaccccacccagctggaggaggtggagaaggacgtgcacgccgccagcagccccggcatgggcggcgccgccgccagctgggccggctgggccgtgaccggcgtgagcagcctgaccagcaagctgatcagaagccaccccaccaccgcccccaccgagaccaacatcccccagagacccacccccgagggcgtgcccgcccccgcccccacccccgtgcccgccacccccaccaccagcggccactgggagacccaggaggaggacaaggacaccgccgaggacagcagcaccgccgacagatgggacgacgaggactggggcagcctggagcaggaggccgagagcgtgctggcccagcaggacgactggagcaccggcggccaggtgagcagagccagccaggtgagcaacagcgaccacaagagcagcaagagccccgagagcgactggagcagctgggaggccgagggcagctgggagcagggctggcaggagcccagcagccaggagcccccccccgacggcaccagactggccagcgagtacaactggggcggccccgagagcagcgacaagggcgaccccttcgccaccctgagcgccagacccagcacccagcccagacccgacagctggggcgaggacaactgggagggcctggagaccgacagcagacaggtgaaggccgagctggccagaaagaagagagaggagagaagaagagagatggaggccaagagagccgagagaaaggtggccaagggccccatgaagctgggcgccagaaagctggactag

SEQ ID NO: 98143 - DNA, 2346 bp, Artificial Sequence
  Description of Artificial Sequence: Synthetic coding sequence
atgtggttcttcgccagagaccccgtgagagacttccccttcgagctgatccccgagccccccgagggcggcctgcccggcccctgggccctgcacagaggcagaaagaaggccaccggcagccccgtgagcatcttcgtgtacgacgtgaagcccggcgccgaggagcagacccaggtggccaaggccgccttcaagagattcaagaccctgagacaccccaacatcctggcctacatcgacggcctggagaccgagaagtgcctgcacgtggtgaccgaggccgtgacccccctgggcatctacctgaaggccagagtggaggccggcggcctgaaggagctggagatcagctggggcctgcaccagatcgtgaaggccctgagcttcctggtgaacgactgcagcctgatccacaacaacgtgtgcatggccgccgtgttcgtggacagagccggcgagtggaagctgggcggcctggactacatgtacagcgcccagggcaacggcggcggcccccccagaaagggcatccccgagctggagcagtacgacccccccgagctggccgacagcagcggcagagtggtgagagagaagtggagcgccgacatgtggagactgggctgcctgatctgggaggtgttcaacggccccctgcccagagccgccgccctgagaaaccccggcaagatccccaagaccctggtgccccactactgcgagctggtgggcgccaaccccaaggtgagacccaaccccgccagattcctgcagaactgcagagcccccggcggcttcatgagcaacagattcgtggagaccaacctgttcctggaggagatccagatcaaggagcccgccgagaagcagaagttcttccaggagctgagcaagagcctggacgccttccccgaggacttctgcagacacaaggtgctgccccagctgctgaccgccttcgagttcggcaacgccggcgccgtggtgctgacccccctgttcaaggtgggcaagttcctgagcgccgaggagtaccagcagaagatcatccccgtggtggtgaagatgttcagcagcaccgacagagccatgagaatcagactgctgcagcagatggagcagttcatccagtacctggacgagcccaccgtgaacacccagatcttcccccacgtggtgcacggcttcctggacaccaaccccgccatcagagagcagaccgtgaagagcatgctgctgctggcccccaagctgaacgaggccaacctgaacgtggagctgatgaagcacttcgccagactgcaggccaaggacgagcagggccccatcagatgcaacaccaccgtgtgcctgggcaagatcggcagctacctgagcgccagcaccagacacagagtgctgaccagcgccttcagcagagccaccagagaccccttcgcccccagcagagtggccggcgtgctgggcttcgccgccacccacaacctgtacagcatgaacgactgcgcccagaagatcctgcccgtgctgtgcggcctgaccgtggaccccgagaagagcgtgagagaccaggccttcaaggccatcagaagcttcctgagcaagctggagagcgtgagcgaggaccccacccagctggaggaggtggagaaggacgtgcacgccgccagcagccccggcatgggcggcgccgccgccagctgggccggctgggccgtgaccggcgtgagcagcctgaccagcaagctgatcagaagccaccccaccaccgcccccaccgagaccaacatcccccagagacccacccccgagggcgtgcccgcccccgcccccacccccgtgcccgccacccccaccaccagcggccactgggagacccaggaggaggacaaggacaccgccgaggacagcagcaccgccgacagatgggacgacgaggactggggcagcctggagcaggaggccgagagcgtgctggcccagcaggacgactggagcaccggcggccaggtgagcagagccagccaggtgagcaacagcgaccacaagagcagcaagagccccgagagcgactggagcagctgggaggccgagggcagctgggagcagggctggcaggagcccagcagccaggagcccccccccgacggcaccagactggccagcgagtacaactggggcggccccgagagcagcgacaagggcgaccccttcgccaccctgagcgccagacccagcacccaggacagaagcagactgagctggcccggcagaagcgccagaagcggcggcggcagatggagacccaacgcccccagaggcagatggcccagagccccctag

SEQ ID NO: 98144 - DNA, 2124 bp, Artificial Sequence
  Description of Artificial Sequence: Synthetic coding sequence
atgtggttcttcgccagagaccccgtgagagacttccccttcgagctgatccccgagccccccgagggcggcctgcccggcccctgggccctgcacagaggcagaaagaaggccaccggcagccccgtgagcatcttcgtgtacgacgtgaagcccggcgccgaggagcagacccaggtggccaaggccgccttcaagagattcaagaccctgagacaccccaacatcctggcctacatcgacggcctggagaccgagaagtgcctgcacgtggtgaccgaggccgtgacccccctgggcatctacctgaaggccagagtggaggccggcggcctgaaggagctggagatcagctggggcctgcaccagatcgtgaaggccctgagcttcctggtgaacgactgcagcctgatccacaacaacgtgtgcatggccgccgtgttcgtggacagagccggcgagtggaagctgggcggcctggactacatgtacagcgcccagggcaacggcggcggcccccccagaaagggcatccccgagctggagcagtacgacccccccgagctggccgacagcagcggcagagtggtgagagagaagtggagcgccgacatgtggagactgggctgcctgatctgggaggtgttcaacggccccctgcccagagccgccgccctgagaaaccccggcaagatccccaagaccctggtgccccactactgcgagctggtgggcgccaaccccaaggtgagacccaaccccgccagattcctgcagaactgcagagcccccggcggcttcatgagcaacagattcgtggagaccaacctgttcctggaggagatccagatcaaggagcccgccgagaagcagaagttcttccaggagctgagcaagagcctggacgccttccccgaggacttctgcagacacaaggtgctgccccagctgctgaccgccttcgagttcggcaacgccggcgccgtggtgctgacccccctgttcaaggtgggcaagttcctgagcgccgaggagtaccagcagaagatcatccccgtggtggtgaagatgttcagcagcaccgacagagccatgagaatcagactgctgcagcagatggagcagttcatccagtacctggacgagcccaccgtgaacacccagatcttcccccacgtggtgcacggcttcctggacaccaaccccgccatcagagagcagaccgtgaagagcatgctgctgctggcccccaagctgaacgaggccaacctgaacgtggagctgatgaagcacttcgccagactgcaggccaaggacgagcagggccccatcagatgcaacaccaccgtgtgcctgggcaagatcggcagctacctgagcgccagcaccagacacagagtgctgaccagcgccttcagcagagccaccagagaccccttcgcccccagcagagtggccggcgtgctgggcttcgccgccacccacaacctgtacagcatgaacgactgcgcccagaagatcctgcccgtgctgtgcggcctgaccgtggaccccgagaagagcgtgagagaccaggccttcaaggccatcagaagcttcctgagcaagctggagagcgtgagcgaggaccccacccagctggaggaggtggagaaggacgtgcacgccgccagcagccccggcatgggcggcgccgccgccagctgggccggctgggccgtgaccggcgtgagcagcctgaccagcaagctgatcagaagccaccccaccaccgcccccaccgagaccaacatcccccagagacccacccccgagggccactgggagacccaggagcccccccccgacggcaccagactggccagcgagtacaactggggcggccccgagagcagcgacaagggcgaccccttcgccaccctgagcgccagacccagcacccagcccagacccgacagctggggcgaggacaactgggagggcctggagaccgacagcagacaggtgaaggccgagctggccagaaagaagagagaggagagaagaagagagatggaggccaagagagccgagagaaaggtggccaagggccccatgaagctgggcgccagaaagctggactag

SEQ ID NO: 98145 - DNA, 1071 bp, Artificial Sequence
  Description of Artificial Sequence: Synthetic coding sequence
atgtggttcttcgccagagaccccgtgagagacttccccttcgagctgatccccgagccccccgagggcggcctgcccggcccctgggccctgcacagaggcagaaagaaggccaccggcagccccgtgagcatcttcgtgtacgacgtgaagcccggcgccgaggagcagacccaggtggccaaggccgccttcaagagattcaagaccctgagacaccccaacatcctggcctacatcgacggcctggagaccgagaagtgcctgcacgtggtgaccgaggccgtgacccccctgggcatctacctgaaggccagagtggaggccggcggcctgaaggagctggagatcagctggggcctgcaccagatcgtgaaggccctgagcttcctggtgaacgactgcagcctgatccacaacaacgtgtgcatggccgccgtgttcgtggacagagccggcgagtggaagctgggcggcctggactacatgtacagcgcccagggcaacggcggcggcccccccagaaagggcatccccgagctggagcagtacgacccccccgagctggccgacagcagcggcagagtggtgagagagaagtggagcgccgacatgtggagactgggctgcctgatctgggaggtgttcaacggccccctgcccagagccgccgccctgagaaaccccggcaagatccccaagaccctggtgccccactactgcgagctggtgggcgccaaccccaaggtgagacccaaccccgccagattcctgcagaactgcagagcccccggcggcttcatgagcaacagattcgtggagaccaacctgttcctggaggagatccagcccaaggaccccagactgaaggagttcctgccccagcccccccccctgttcctgccccccctgcagccccaggccaccggcagaagaagaagaagaaccagaacccagcagagaaccgccgccctgctgaccgacggcaccaccaagaccggcgccgcctggagcagaagacccagcctgtgctggcccagcagaaccaccggcgcccccggcgccaagtag

SEQ ID NO: 98146 - DNA, 2376 bp, Artificial Sequence
  Description of Artificial Sequence: Synthetic coding sequence
atgtggttcttcgccagagaccccgtgagagacttccccttcgagctgatccccgagccccccgagggcggcctgcccggcccctgggccctgcacagaggcagaaagaaggccaccggcagccccgtgagcatcttcgtgtacgacgtgaagcccggcgccgaggagcagacccaggtggccaaggccgccttcaagagattcaagaccctgagacaccccaacatcctggcctacatcgacggcctggagaccgagaagtgcctgcacgtggtgaccgaggccgtgacccccctgggcatctacctgaaggccagagtggaggccggcggcctgaaggagctggagatcagctggggcctgcaccagatcgtgaaggccctgagcttcctggtgaacgactgcagcctgatccacaacaacgtgtgcatggccgccgtgttcgtggacagagccggcgagtggaagctgggcggcctggactacatgtacagcgcccagggcaacggcggcggcccccccagaaagggcatccccgagctggagcagtacgacccccccgagctggccgacagcagcggcagagtggtgagagagaagtggagcgccgacatgtggagactgggctgcctgatctgggaggtgttcaacggccccctgcccagagccgccgccctgagaaaccccggcaagatccccaagaccctggtgccccactactgcgagctggtgggcgccaaccccaaggtgagacccaaccccgccagattcctgcagaactgcagagcccccggcggcttcatgagcaacagattcgtggagaccaacctgttcctggaggagatccagatcaaggagcccgccgagaagcagaagttcttccaggagctgagcaagagcctggacgccttccccgaggacttctgcagacacaaggtgctgccccagctgctgaccgccttcgagttcggcaacgccggcgccgtggtgctgacccccctgttcaaggtgggcaagttcctgagcgccgaggagtaccagcagaagatcatccccgtggtggtgaagatgttcagcagcaccgacagagccatgagaatcagactgctgcagcagatggagcagttcatccagtacctggacgagcccaccgtgaacacccagatcttcccccacgtggtgcacggcttcctggacaccaaccccgccatcagagagcagaccgtgaagagcatgctgctgctggcccccaagctgaacgaggccaacctgaacgtggagctgatgaagcacttcgccagactgcaggccaaggacgagcagggccccatcagatgcaacaccaccgtgtgcctgggcaagatcggcagctacctgagcgccagcaccagacacagagtgctgaccagcgccttcagcagagccaccagagaccccttcgcccccagcagagtggccggcgtgctgggcttcgccgccacccacaacctgtacagcatgaacgactgcgcccagaagatcctgcccgtgctgtgcggcctgaccgtggaccccgagaagagcgtgagagaccaggccttcaaggccatcagaagcttcctgagcaagctggagagcgtgagcgaggaccccacccagctggaggaggtggagaaggacgtgcacgccgccagcagccccggcatgggcggcgccgccgccagctgggccggctgggccgtgaccggcgtgagcagcctgaccagcaagctgatcagaagccaccccaccaccgcccccaccgagaccaacatcccccagagacccacccccgagggccactgggagacccaggaggaggacaaggacaccgccgaggacagcagcaccgccgacagatgggacgacgaggactggggcagcctggagcaggaggccgagagcgtgctggcccagcaggacgactggagcaccggcggccaggtgagcagagccagccaggtgagcaacagcgaccacaagagcagcaagagccccgagagcgactggagcagctgggaggccgagggcagctgggagcagggctggcaggagcccagcagccaggagcccccccccgacggcaccagactggccagcgagtacaactggggcggccccgagagcagcgacaagggcgaccccttcgccaccctgagcgccagacccagcacccagcccagacccgacagctggggcgaggacaactgggagggcctggagaccgacagcagacaggtgaaggccgagctggccagaaagaagagagaggagagaagaagagagatggaggccaagagagccgagagaaaggtggccaagggccccatgaagctgggcgccagaaagctggactag

SEQ ID NO: 98147 - DNA, 2343 bp, Artificial Sequence
  Description of Artificial Sequence: Synthetic coding sequence
atgtggttcttcgccagagaccccgtgagagacttccccttcgagctgatccccgagccccccgagggcggcctgcccggcccctgggccctgcacagaggcagaaagaaggccaccggcagccccgtgagcatcttcgtgtacgacgtgaagcccggcgccgaggagcagacccaggtggccaaggccgccttcaagagattcaagaccctgagacaccccaacatcctggcctacatcgacggcctggagaccgagaagtgcctgcacgtggtgaccgaggccgtgacccccctgggcatctacctgaaggccagagtggaggccggcggcctgaaggagctggagatcagctggggcctgcaccagatcgtgaaggccctgagcttcctggtgaacgactgcagcctgatccacaacaacgtgtgcatggccgccgtgttcgtggacagagccggcgagtggaagctgggcggcctggactacatgtacagcgcccagggcaacggcggcggcccccccagaaagggcatccccgagctggagcagtacgacccccccgagctggccgacagcagcggcagagtggtgagagagaagtggagcgccgacatgtggagactgggctgcctgatctgggaggtgttcaacggccccctgcccagagccgccgccctgagaaaccccggcaagatccccaagaccctggtgccccactactgcgagctggtgggcgccaaccccaaggtgagacccaaccccgccagattcctgcagaactgcagagcccccggcggcttcatgagcaacagattcgtggagaccaacctgttcctggaggagatccagatcaaggagcccgccgagaagcagaagttcttccaggagctgagcaagagcctggacgccttccccgaggacttctgcagacacaaggtgctgccccagctgctgaccgccttcgagttcggcaacgccggcgccgtggtgctgacccccctgttcaaggtgggcaagttcctgagcgccgaggagtaccagcagaagatcatccccgtggtggtgaagatgttcagcagcaccgacagagccatgagaatcagactgctgcagcagatggagcagttcatccagtacctggacgagcccaccgtgaacacccagatcttcccccacgtggtgcacggcttcctggacaccaaccccgccatcagagagcagaccgtgaagagcatgctgctgctggcccccaagctgaacgaggccaacctgaacgtggagctgatgaagcacttcgccagactgcaggccaaggacgagcagggccccatcagatgcaacaccaccgtgtgcctgggcaagatcggcagctacctgagcgccagcaccagacacagagtgctgaccagcgccttcagcagagccaccagagaccccttcgcccccagcagagtggccggcgtgctgggcttcgccgccacccacaacctgtacagcatgaacgactgcgcccagaagatcctgcccgtgctgtgcggcctgaccgtggaccccgagaagagcgtgagagaccaggccttcaaggccatcagaagcttcctgagcaagctggagagcgtgagcgaggaccccacccagctggaggaggtggagaaggacgtgcacgccgccagcagccccggcatgggcggcgccgccgccagctgggccggctgggccgtgaccggcgtgagcagcctgaccagcaagctgatcagaagccaccccaccaccgcccccaccgagaccaacatcccccagagacccacccccgagggcgtgcccgcccccgcccccacccccgtgcccgccacccccaccaccagcggccactgggagacccaggaggaggacaaggacaccgccgaggacagcagcaccgccgacagatgggacgacgaggactggggcagcctggaggaggccgagagcgtgctggcccagcaggacgactggagcaccggcggccaggtgagcagagccagccaggtgagcaacagcgaccacaagagcagcaagagccccgagagcgactggagcagctgggaggccgagggcagctgggagcagggctggcaggagcccagcagccaggagcccccccccgacggcaccagactggccagcgagtacaactggggcggccccgagagcagcgacaagggcgaccccttcgccaccctgagcgccagacccagcacccaggacagaagcagactgagctggcccggcagaagcgccagaagcggcggcggcagatggagacccaacgcccccagaggcagatggcccagagccccctag

SEQ ID NO: 98148 - DNA, 2124 bp, Artificial Sequence; identical to SEQ ID NO: 98144
  Description of Artificial Sequence: Synthetic coding sequence

SEQ ID NO: 98149 - DNA, 2364 bp, Artificial Sequence
  Description of Artificial Sequence: Synthetic coding sequence
atgtggttcttcgccagagaccccgtgagagacttccccttcgagctgatccccgagccccccgagggcggcctgcccggcccctgggccctgcacagaggcagaaagaaggccaccggcagccccgtgagcatcttcgtgtacgacgtgaagcccggcgccgaggagcagacccaggtggccaaggccgccttcaagagattcaagaccctgagacaccccaacatcctggcctacatcgacggcctggagaccgagaagtgcctgcacgtggtgaccgaggccgtgacccccctgggcatctacctgaaggccagagtggaggccggcggcctgaaggagctggagatcagctggggcctgcaccagatcgtgaaggccctgagcttcctggtgaacgactgcagcctgatccacaacaacgtgtgcatggccgccgtgttcgtggacagagccggcgagtggaagctgggcggcctggactacatgtacagcgcccagggcaacggcggcggcccccccagaaagggcatccccgagctggagcagtacgacccccccgagctggccgacagcagcggcagagtggtgagagagaagtggagcgccgacatgtggagactgggctgcctgatctgggaggtgttcaacggccccctgcccagagccgccgccctgagaaaccccggcaagatccccaagaccctggtgccccactactgcgagctggtgggcgccaaccccaaggtgagacccaaccccgccagattcctgcagaactgcagagcccccggcggcttcatgagcaacagattcgtggagaccaacctgttcctggaggagatccagatcaaggagcccgccgagaagcagaagttcttccaggagctgagcaagagcctggacgccttccccgaggacttctgcagacacaaggtgctgccccagctgctgaccgccttcgagttcggcaacgccggcgccgtggtgctgacccccctgttcaaggtgggcaagttcctgagcgccgaggagtaccagcagaagatcatccccgtggtggtgaagatgttcagcagcaccgacagagccatgagaatcagactgctgcagcagatggagcagttcatccagtacctggacgagcccaccgtgaacacccagatcttcccccacgtggtgcacggcttcctggacaccaaccccgccatcagagagcagaccgtgaagagcatgctgctgctggcccccaagctgaacgaggccaacctgaacgtggagctgatgaagcacttcgccagactgcaggccaaggacgagcagggccccatcagatgcaacaccaccgtgtgcctgggcaagatcggcagctacctgagcgccagcaccagacacagagtgctgaccagcgccttcagcagagccaccagagaccccttcgcccccagcagagtggccggcgtgctgggcttcgccgccacccacaacctgtacagcatgaacgactgcgcccagaagatcctgcccgtgctgtgcggcctgaccgtggaccccgagaagagcgtgagagaccaggccttcaaggccatcagaagcttcctgagcaagctggagagcgtgagcgaggaccccacccagctggaggaggtggagaaggacgtgcacgccgccagcagccccggcatgggcggcgccgccgccagctgggccggctgggccgtgaccggcgtgagcagcctgaccagcaagctgatcagaagccaccccaccaccgcccccaccgagaccaacatcccccagagacccacccccgagggcgtgcccgcccccgcccccacccccgtgcccgccacccccaccaccagcggccactgggagacccaggaggaggacaaggacaccgccgaggacagcagcaccgccgacagatgggacgacgaggactggggcagcctggagcaggaggccgagagcgtgctggcccagcaggacgactggagcaccggcggccaggtgagcagagccagccagagccccaccggcgccgccggcaagctgagagcccccggcaacagagccggcagaagccaggcccccagaagccacctgctgaccgtgcacggctggcccgccagcatcaccggcgtggcccagagccccgccaccagagccacccccagcctgccctgcctgcacgtgcccgcccccagcagaggccagaccctgggcgtgagaaccaccggcagagccagcagactgaccgtggacagaagcagactgagctggcccggcagaagcgccagaagcggcggcggcagatggagacccaacgcccccagaggcagatggcccagagccccctag

SEQ ID NO: 98150 - DNA, 663 bp, Artificial Sequence
  Description of Artificial Sequence: Synthetic coding sequence
atgatcaagcccaagtggggcggcctggtgtgggcccagtggcacggccccctggccagacccagcggcaccctgcccttcgccagcagcatgcccagccccgtggacgccagcagcgccgacggcggcagcggcctgggcagccacagaagaaagagaaccaccttcagcaagggccagctgctggagctggagagagccttcgccgcctggccctaccccaacatcagcacccacgagcacctggcctgggtgacctgcctgcccgaggccaaggtgcaggtgtggttccagaagagatgggccaagatcatcaagaacagaaagagcggcatcctgagccccggcagcgagtgcccccagagcagctgcagcctgcccgacaccctgcagcagccctgggacccccagatgcccggccagcccccccccagcagcggcaccccccagagaaccagcgtgtgcagacacagcagctgccccgcccccggcctgagccccagacagggctgggagggcgccaaggccgtggccccctggggcagcgccggcgccagcgaggtgcaccccagcctggagagagccaccccccagaccagcctgggcagcctgagcgacctgatctacgccctggccatcgtggtgaacgtggaccacagctag

SEQ ID NO: 98151 - DNA, 651 bp, Artificial Sequence
  Description of Artificial Sequence: Synthetic coding sequence
atgggcggcagcggcgtgggcaccgcctggcacggccccctggccagacccagcggcaccctgcccttcgccagcagcatgcccagccccgtggacgccagcagcgccgacggcggcagcggcctgggcagccacagaagaaagagaaccaccttcagcaagggccagctgctggagctggagagagccttcgccgcctggccctaccccaacatcagcacccacgagcacctggcctgggtgacctgcctgcccgaggccaaggtgcaggtgtggttccagaagagatgggccaagatcatcaagaacagaaagagcggcatcctgagccccggcagcgagtgcccccagagcagctgcagcctgcccgacaccctgcagcagccctgggacccccagatgcccggccagcccccccccagcagcggcaccccccagagaaccagcgtgtgcagacacagcagctgccccgcccccggcctgagccccagacagggctgggagggcgccaaggccgtggccccctggggcagcgccggcgccagcgaggtgcaccccagcctggagagagccaccccccagaccagcctgggcagcctgagcgacctgatctacgccctggccatcgtggtgaacgtggaccacagctag

SEQ ID NO: 98152 - DNA, 648 bp, Artificial Sequence
  Description of Artificial Sequence: Synthetic coding sequence
atgatgaccaccggctggaccggcctgtgcctgccccccgtgaaccccagcagagtgagcagcagcagcctggagaccagcaccaccgagagcatcttcgcccacgacggcggcagcggcctgggcagccacagaagaaagagaaccaccttcagcaagggccagctgctggagctggagagagccttcgccgcctggccctaccccaacatcagcacccacgagcacctggcctgggtgacctgcctgcccgaggccaaggtgcaggtgtggttccagaagagatgggccaagatcatcaagaacagaaagagcggcatcctgagccccggcagcgagtgcccccagagcagctgcagcctgcccgacaccctgcagcagccctgggacccccagatgcccggccagcccccccccagcagcggcaccccccagagaaccagcgtgtgcagacacagcagctgccccgcccccggcctgagccccagacagggctgggagggcgccaaggccgtggccccctggggcagcgccggcgccagcgaggtgcaccccagcctggagagagccaccccccagaccagcctgggcagcctgagcgacctgatctacgccctggccatcgtggtgaacgtggaccacagctag

SEQ ID NO: 98153 - DNA, 648 bp, Artificial Sequence; identical to SEQ ID NO: 98152
  Description of Artificial Sequence: Synthetic coding sequence

SEQ ID NO: 98154 - DNA, 1212 bp, Artificial Sequence
  Description of Artificial Sequence: Synthetic coding sequence
atgagcggcagagtgggcgacctgagccccagacagaaggaggccctggccaagttcagagagaacgtgcaggacgtgctgcccgccctgcccaaccccgacgactacttcctgctgagatggctgagagccagaagcttcgacctgcagaagagcgaggccatgctgagaaagcacgtggagttcagaaagcagaaggacatcgacaacatcatcagctggcagccccccgaggtgatccagcagtacctgagcggcggcatgtgcggctacgacctggacggctgccccgtgtggtacgacatcatcggccccctggacgccaagggcctgctgttcagcgccagcaagcaggacctgctgagaaccaagatgagagagtgcgagctgctgctgcaggagtgcgcccaccagaccaccaagctgggcagaaaggtggagaccatcaccatcatctacgactgcgagggcctgggcctgaagcacctgtggaagcccgccgtggaggcctacggcgagttcctgtgcatgttcgaggagaactaccccgagaccctgaagagactgttcgtggtgaaggcccccaagctgttccccgtggcctacaacctgatcaagcccttcctgagcgaggacaccagaaagaagatcatggtgctgggcgccaactggaaggaggtgctgctgaagcacatcagccccgaccaggtgcccgtggagtacggcggcaccatgaccgaccccgacggcaaccccaagtgcaagagcaagatcaactacggcggcgacatccccagaaagtactacgtgagagaccaggtgaagcagcagtacgagcacagcgtgcagatcagcagaggcagcagccaccaggtggagtacgagatcctgttccccggctgcgtgctgagatggcagttcatgagcgacggcgccgacgtgggcttcggcatcttcctgaagaccaagatgggcgagagacagagagccggcgagatgaccgaggtgctgcccaaccagagatacaacagccacctggtgcccgaggacggcaccctgacctgcagcgaccccggcatctacgtgctgagattcgacaacacctacagcttcatccacgccaagaaggtgaacttcaccgtggaggtgctgctgcccgacaaggccagcgaggagaagatgaagcagctgggcgccggcacccccaagtag

SEQ ID NO: 98155 - DNA, 963 bp, Artificial Sequence
  Description of Artificial Sequence: Synthetic coding sequence
atgagcggcagagtgggcgacctgagccccagacagaaggaggccctggccaagttcagagagaacgtgcaggacgtgctgcccgccctgcccaaccccgacgactacttcctgctgagatggctgagagccagaagcttcgacctgcagaagagcgaggccatgctgagaaagctgggcagaaaggtggagaccatcaccatcatctacgactgcgagggcctgggcctgaagcacctgtggaagcccgccgtggaggcctacggcgagttcctgtgcatgttcgaggagaactaccccgagaccctgaagagactgttcgtggtgaaggcccccaagctgttccccgtggcctacaacctgatcaagcccttcctgagcgaggacaccagaaagaagatcatggtgctgggcgccaactggaaggaggtgctgctgaagcacatcagccccgaccaggtgcccgtggagtacggcggcaccatgaccgaccccgacggcaaccccaagtgcaagagcaagatcaactacggcggcgacatccccagaaagtactacgtgagagaccaggtgaagcagcagtacgagcacagcgtgcagatcagcagaggcagcagccaccaggtggagtacgagatcctgttccccggctgcgtgctgagatggcagttcatgagcgacggcgccgacgtgggcttcggcatcttcctgaagaccaagatgggcgagagacagagagccggcgagatgaccgaggtgctgcccaaccagagatacaacagccacctggtgcccgaggacggcaccctgacctgcagcgaccccggcatctacgtgctgagattcgacaacacctacagcttcatccacgccaagaaggtgaacttcaccgtggaggtgctgctgcccgacaaggccagcgaggagaagatgaagcagctgggcgccggcacccccaagtag

SEQ ID NO: 98156 - DNA, 990 bp, Artificial Sequence
  Description of Artificial Sequence: Synthetic coding sequence
atgctgagaaaggtgatccagcagtacctgagcggcggcatgtgcggctacgacctggacggctgccccgtgtggtacgacatcatcggccccctggacgccaagggcctgctgttcagcgccagcaagcaggacctgctgagaaccaagatgagagagtgcgagctgctgctgcaggagtgcgcccaccagaccaccaagctgggcagaaaggtggagaccatcaccatcatctacgactgcgagggcctgggcctgaagcacctgtggaagcccgccgtggaggcctacggcgagttcctgtgcatgttcgaggagaactaccccgagaccctgaagagactgttcgtggtgaaggcccccaagctgttccccgtggcctacaacctgatcaagcccttcctgagcgaggacaccagaaagaagatcatggtgctgggcgccaactggaaggaggtgctgctgaagcacatcagccccgaccaggtgcccgtggagtacggcggcaccatgaccgaccccgacggcaaccccaagtgcaagagcaagatcaactacggcggcgacatccccagaaagtactacgtgagagaccaggtgaagcagcagtacgagcacagcgtgcagatcagcagaggcagcagccaccaggtggagtacgagatcctgttccccggctgcgtgctgagatggcagttcatgagcgacggcgccgacgtgggcttcggcatcttcctgaagaccaagatgggcgagagacagagagccggcgagatgaccgaggtgctgcccaaccagagatacaacagccacctggtgcccgaggacggcaccctgacctgcagcgaccccggcatctacgtgctgagattcgacaacacctacagcttcatccacgccaagaaggtgaacttcaccgtggaggtgctgctgcccgacaaggccagcgaggagaagatgaagcagctgggcgccggcacccccaagtag

SEQ ID NO: 98157 - DNA, 1179 bp, Artificial Sequence
  Description of Artificial Sequence: Synthetic coding sequence
atgagcggcagagtgggcgacctgagccccagacagaaggaggccctggccaagttcagagagaacgtgcaggacgtgctgcccgccctgcccaaccccgacgactacttcctgctgagatggctgagagccagaagcttcgacctgcagaagagcgaggccatgctgagaaagcacgtggagttcagaaagcagaaggacatcgacaacatcatcagctggcagccccccgaggtgatccagcagtacctgagcggcggcatgtgcggctacgacctggacggctgccccgtgtggtacgacatcatcggccccctggacgccaagggcctgctgttcagcgccagcaagcaggacctgctgagaaccaagatgagagagtgcgagctgctgctgcaggagtgcgcccaccagaccaccaagctgggcagaaaggtggagaccatcaccatcatctacgactgcgagggcctgggcctgaagcacctgtggaagcccgccgtggaggcctacggcgagttcctgtgcatgttcgaggagaactaccccgagaccctgaagagactgttcgtggtgaaggcccccaagctgttccccgtggcctacaacctgatcaagcccttcctgagcgaggacaccagaaagaagatcatggtgctgggcgccaactggaaggaggtgctgctgaagcacatcagccccgaccaggtgcccgtggagtacggcggcaccatgaccgaccccgacggcaaccccaagtgcaagagcaagatcaactacggcggcgacatccccagaaagtactacgtgagagaccaggtgaagcagcagtacgagcacagcgtgcagatcagcagaggcagcagccaccaggtggagtacgagatcctgttccccggctgcgtgctgagatggcagttcatgagcgacggcgccgacgtgggcttcggcatcttcctgaagaccaagatgggcgagagacagagagccggcgagatgaccgaggtgctgcccaaccagagatacaacagccacctggtgcccgaggacggcaccctgacctgcagcgaccccggcatctgcaagtacctgtgcctgggcaacgccctgaagccccacgtgcagctgagcgcctgcgaggtgcccctgcccccctggatcttcggcagcgagtgctag

SEQ ID NO: 98158 - DNA, 1119 bp, Artificial Sequence
  Description of Artificial Sequence: Synthetic coding sequence
atgagcaaggccttcggcctgctgagacagatctgccagagcatcctggccgagagcagccagagccccgccgacctggaggagaagaaggaggaggacagcaacatgaagagagagcagcccagagagagacccagagcctgggactacccccacggcctggtgggcctgcacaacatcggccagacctgctgcctgaacagcctgatccaggtgttcgtgatgaacgtggacttcaccagaatcctgaagagaatcaccgtgcccagaggcgccgacgagcagagaagaagcgtgcccttccagatgctgctgctgctggagaagatgcaggacagcagacagaaggccgtgagacccctggagctggcctactgcctgcagaagtgcaacgtgcccctgttcgtgcagcacgacgccgcccagctgtacctgaagctgtggaacctgatcaaggaccagatcaccgacgtgcacctggtggagagactgcaggccctgtacaccatcagagtgaaggacagcctgatctgcgtggactgcgccatggagagcagcagaaacagcagcatgctgaccctgcccctgagcctgttcgacgtggacagcaagcccctgaagaccctggaggacgccctgcactgcttcttccagcccagagagctgagcagcaagagcaagtgcttctgcgagaactgcggcaagaagaccagaggcaagcaggtgctgaagctgacccacctgccccagaccctgaccatccacctgatgagattcagcatcagaaacagccagaccagaaagatctgccacagcctgtacttcccccagagcctggacttcagccagatcctgcccatgaagagagagagctgcgacgccgaggagcagagcggcggccagtacgagctgttcgccgtgatcgcccacgtgggcatggccgacagcggccactactgcgtgtacatcagaaacgccgtggacggcaagtggttctgcttcaacgacagcaacatctgcctggtgagctgggaggacatccagtgcacctacggcaaccccaactaccactggcaggagaccgcctacctgctggtgtacatgaagatggagtgctag

SEQ ID NO: 98159 - DNA, 1062 bp, Artificial Sequence
  Description of Artificial Sequence: Synthetic coding sequence
atggagttcagaaagaccatggacatcgaccacatcctggactggcagccccccgaggtgatccagaagtacatgcccggcggcctgtgcggctacgacagagacggctgccccgtgtggtacgacatcatcggccccctggaccccaagggcctgctgttcagcgtgaccaagcaggacctgctgaagaccaagatgagagactgcgagagaatcctgcacgagtgcgacctgcagaccgagagactgggcaagaagatcgagaccatcgtgatgatcttcgactgcgagggcctgggcctgaagcacttctggaagcccctggtggaggtgtaccaggagttcttcggcctgctggaggagaactaccccgagaccctgaagttcatgctgatcgtgaaggccaccaagctgttccccgtgggctacaacctgatgaagcccttcctgagcgaggacaccagaagaaagatcatcgtgctgggcaacaactggaaggagggcctgctgaagctgatcagccccgaggagctgcccgcccagttcggcggcaccctgaccgaccccgacggcaaccccaagtgcctgaccaagatcaactacggcggcgagatccccaagagcatgtacgtgagagaccaggtgaagacccagtacgagcacagcgtgcagatcaacagaggcagcagccaccaggtggagtacgagatcctgttccccggctgcgtgctgagatggcagttcagcagcgacggcgccgacatcggcttcggcgtgttcctgaagaccaagatgggcgagagacagagagccggcgagatgaccgacgtgctgcccagccagagatacaacgcccacatggtgcccgaggacggcaacctgacctgcagcgaggccggcgtgtacgtggagagcgagagcggcaagagctgctgccacctgcccgtgatcatctgcagccacgagctgcagaacagccacagcaacagccaggtgatggcctaccagatggtgagaaagtgcaagctgagcagacccctgcccctgcccgccagcaactag

SEQ ID NO: 98160 - DNA, 1026 bp, Artificial Sequence
  Description of Artificial Sequence: Synthetic coding sequence
atggagttcagaaagaccatggacatcgaccacatcctggactggcagccccccgaggtgatccagaagtacatgcccggcggcctgtgcggctacgacagagacggctgccccgtgtggtacgacatcatcggccccctggaccccaagggcctgctgttcagcgtgaccaagcaggacctgctgaagaccaagatgagagactgcgagagaatcctgcacgagtgcgacctgcagaccgagagactgggcaagaagatcgagaccatcgtgatgatcttcgactgcgagggcctgggcctgaagcacttctggaagcccctggtggaggtgtaccaggagttcttcggcctgctggaggagaactaccccgagaccctgaagttcatgctgatcgtgaaggccaccaagctgttccccgtgggctacaacctgatgaagcccttcctgagcgaggacaccagaagaaagatcatcgtgctgggcaacaactggaaggagggcctgctgaagctgatcagccccgaggagctgcccgcccagttcggcggcaccctgaccgaccccgacggcaaccccaagtgcctgaccaagatcaactacggcggcgagatccccaagagcatgtacgtgagagaccaggtgaagacccagtacgagcacagcgtgcagatcaacagaggcagcagccaccaggtggagtacgagatcctgttccccggctgcgtgctgagatggcagttcagcagcgacggcgccgacatcggcttcggcgtgttcctgaagaccaagatgggcgagagacagagagccggcgagatgaccgacgtgctgcccagccagagatacaacgcccacatggtgcccgaggacggcaacctgacctgcagcgaggccggcgtgtacgtgctgagattcgacaacacctacagcttcgtgcacgccaagaaggtgagcttcaccgtggaggtgctgctgcccgacgagggcatgcagaagtacgacaaggagctgacccccgtgtag

SEQ ID NO: 98161 - DNA, 972 bp, Artificial Sequence
  Description of Artificial Sequence: Synthetic coding sequence
atggtgatccagaagtacatgcccggcggcctgtgcggctacgacagagacggctgccccgtgtggtacgacatcatcggccccctggaccccaagggcctgctgttcagcgtgaccaagcaggacctgctgaagaccaagatgagagactgcgagagaatcctgcacgagtgcgacctgcagaccgagagactgggcaagaagatcgagaccatcgtgatgatcttcgactgcgagggcctgggcctgaagcacttctggaagcccctggtggaggtgtaccaggagttcttcggcctgctggaggagaactaccccgagaccctgaagttcatgctgatcgtgaaggccaccaagctgttccccgtgggctacaacctgatgaagcccttcctgagcgaggacaccagaagaaagatcatcgtgctgggcaacaactggaaggagggcctgctgaagctgatcagccccgaggagctgcccgcccagttcggcggcaccctgaccgaccccgacggcaaccccaagtgcctgaccaagatcaactacggcggcgagatccccaagagcatgtacgtgagagaccaggtgaagacccagtacgagcacagcgtgcagatcaacagaggcagcagccaccaggtggagtacgagatcctgttccccggctgcgtgctgagatggcagttcagcagcgacggcgccgacatcggcttcggcgtgttcctgaagaccaagatgggcgagagacagagagccggcgagatgaccgacgtgctgcccagccagagatacaacgcccacatggtgcccgaggacggcaacctgacctgcagcgaggccggcgtgtacgtgctgagattcgacaacacctacagcttcgtgcacgccaagaaggtgagcttcaccgtggaggtgctgctgcccgacgagggcatgcagaagtacgacaaggagctgacccccgtgtag

SEQ ID NO: 98162 - DNA, 972 bp, Artificial Sequence; identical to SEQ ID NO: 98161
  Description of Artificial Sequence: Synthetic coding sequence

SEQ ID NO: 98163 - DNA, 1221 bp, Artificial Sequence
  Description of Artificial Sequence: Synthetic coding sequence
atgagcagcagagtgggcgacctgagcccccagcagcaggaggccctggccagattcagagagaacctgcaggacctgctgcccatcctgcccaacgccgacgactacttcctgctgagatggctgagagccagaaacttcgacctgcagaagagcgaggacatgctgagaagacacatggagttcagaaagcagcaggacctggacaacatcgtgacctggcagccccccgaggtgatccagctgtacgacagcggcggcctgtgcggctacgactacgagggctgccccgtgtacttcaacatcatcggcagcctggaccccaagggcctgctgctgagcgccagcaagcaggacatgatcagaaagagaatcaaggtgtgcgagctgctgctgcacgagtgcgagctgcagacccagaagctgggcagaaagatcgagatggccctgatggtgttcgacatggagggcctgagcctgaagcacctgtggaagcccgccgtggaggtgtaccagcagttcttcagcatcctggaggccaactaccccgagaccctgaagaacctgatcgtgatcagagcccccaagctgttccccgtggccttcaacctggtgaagagcttcatgagcgaggagaccagaagaaagatcgtgatcctgggcgacaactggaagcaggagctgaccaagttcatcagccccgaccagctgcccgtggagttcggcggcaccatgaccgaccccgacggcaaccccaagtgcctgaccaagatcaactacggcggcgaggtgcccaagagctactacctgtgcgagcaggtgagactgcagtacgagcacaccagaagcgtgggcagaggcagcagcctgcaggtggagaacgagatcctgttccccggctgcgtgctgagatggcagttcgccagcgacggcggcgacatcggcttcggcgtgttcctgaagaccaagatgggcgagcagcagagcgccagagagatgaccgaggtgctgcccagccagagatacaacgcccacatggtgcccgaggacggcagcctgacctgcctgcaggccggcgtgtacgtgctgagattcgacaacacctacagcagaatgcacgccaagaagctgagctacaccgtggaggtgctgctgcccgacaaggccagcgaggagaccctgcagagcctgaaggccatgagacccagccccacccagtag

SEQ ID NO: 98164 - DNA, 1083 bp, Artificial Sequence
  Description of Artificial Sequence: Synthetic coding sequence
atgagcagcagagtgggcgacctgagcccccagcagcaggaggccctggccagattcagagagaacctgcaggacctgctgcccatcctgcccaacgccgacgactacttcctgctgagatggctgagagccagaaacttcgacctgcagaagagcgaggacatgctgagaagacacatggagttcagaaagcagcaggacctggacaacatcgtgacctggcagccccccgaggtgatccagctgtacgacagcggcggcctgtgcggctacgactacgagggctgccccgtgtacttcaacatcatcggcagcctggaccccaagggcctgctgctgagcgccagcaagcaggacatgatcagaaagagaatcaaggtgtgcgagctgctgctgcacgagtgcgagctgcagacccagaagctgggcagaaagatcgagatggccctgatggtgttcgacatggagggcctgagcctgaagcacctgtggaagcccgccgtggaggtgtaccagcagttcttcagcatcctggaggccaactaccccgagaccctgaagaacctgatcgtgatcagagcccccaagctgttccccgtggccttcaacctggtgaagagcttcatgagcgaggagaccagaagaaagatcgtgatcctgggcgacaactggaagcaggagctgaccaagttcatcagccccgaccagctgcccgtggagttcggcggcaccatgaccgaccccgacggcaaccccaagtgcctgaccaagatcaactacggcggcgaggtgcccaagagctactacctgtgcgagcaggtgagactgcagtacgagcacaccagaagcgtgggcagaggcagcagcctgcaggtggagaacgagatcctgttccccggctgcgtgctgagatggcagttcgccagcgacggcggcgacatcggcttcggcgtgttcctgaagaccaagatgggcgagcagcagagcgccagagagatgaccgaggtgctgcccagccagagatacaacgcccacatggtgcccgaggacggcagcctgacctgcctgcaggccggcgtgtag

SEQ ID NO: 98165 - DNA, 1083 bp, Artificial Sequence
  Description of Artificial Sequence: Synthetic coding sequence
atgctgagaagacacatggagttcagaaagcagcaggacctggacaacatcgtgacctggcagccccccgaggtgatccagctgtacgacagcggcggcctgtgcggctacgactacgagggctgccccgtgtacttcaacatcatcggcagcctggaccccaagggcctgctgctgagcgccagcaagcaggacatgatcagaaagagaatcaaggtgtgcgagctgctgctgcacgagtgcgagctgcagacccagaagctgggcagaaagatcgagatggccctgatggtgttcgacatggagggcctgagcctgaagcacctgtggaagcccgccgtggaggtgtaccagcagttcttcagcatcctggaggccaactaccccgagaccctgaagaacctgatcgtgatcagagcccccaagctgttccccgtggccttcaacctggtgaagagcttcatgagcgaggagaccagaagaaagatcgtgatcctgggcgacaactggaagcaggagctgaccaagttcatcagccccgaccagctgcccgtggagttcggcggcaccatgaccgaccccgacggcaaccccaagtgcctgaccaagatcaactacggcggcgaggtgcccaagagctactacctgtgcgagcaggtgagactgcagtacgagcacaccagaagcgtgggcagaggcagcagcctgcaggtggagaacgagatcctgttccccggctgcgtgctgagatggcagttcgccagcgacggcggcgacatcggcttcggcgtgttcctgaagaccaagatgggcgagcagcagagcgccagagagatgaccgaggtgctgcccagccagagatacaacgcccacatggtgcccgaggacggcagcctgacctgcctgcaggccggcgtgtacgtgagaggcctgtgcagcctgatcaccagccccagcctgcagatgagctgcgccagcaccacccccaccgccggctgcatgcccagaagcagcgccaccctgtggagatgctgcttccccaccagacccctgagaagaagatgcagagtgagcagaagatag

SEQ ID NO: 98166 - DNA, 1176 bp, Artificial Sequence
  Description of Artificial Sequence: Synthetic coding sequence
atgctgatgaccaccagcagctgcgccggctgcgagctggagaccctgacctgcagaaaccccaagacctgcagcgagggccccaagagcccccagcccaccagctgcccccacgccctgagagcctggcacatggagttcagaaagcagcaggacctggacaacatcgtgacctggcagccccccgaggtgatccagctgtacgacagcggcggcctgtgcggctacgactacgagggctgccccgtgtacttcaacatcatcggcagcctggaccccaagggcctgctgctgagcgccagcaagcaggacatgatcagaaagagaatcaaggtgtgcgagctgctgctgcacgagtgcgagctgcagacccagaagctgggcagaaagatcgagatggccctgatggtgttcgacatggagggcctgagcctgaagcacctgtggaagcccgccgtggaggtgtaccagcagttcttcagcatcctggaggccaactaccccgagaccctgaagaacctgatcgtgatcagagcccccaagctgttccccgtggccttcaacctggtgaagagcttcatgagcgaggagaccagaagaaagatcgtgatcctgggcgacaactggaagcaggagctgaccaagttcatcagccccgaccagctgcccgtggagttcggcggcaccatgaccgaccccgacggcaaccccaagtgcctgaccaagatcaactacggcggcgaggtgcccaagagctactacctgtgcgagcaggtgagactgcagtacgagcacaccagaagcgtgggcagaggcagcagcctgcaggtggagaacgagatcctgttccccggctgcgtgctgagatggcagttcgccagcgacggcggcgacatcggcttcggcgtgttcctgaagaccaagatgggcgagcagcagagcgccagagagatgaccgaggtgctgcccagccagagatacaacgcccacatggtgcccgaggacggcagcctgacctgcctgcaggccggcgtgtacgtgctgagattcgacaacacctacagcagaatgcacgccaagaagctgagctacaccgtggaggtgctgctgcccgacaaggccagcgaggagaccctgcagagcctgaaggccatgagacccagccccacccagtag

SEQ ID NO: 98167 - DNA, 2256 bp, Artificial Sequence
  Description of Artificial Sequence: Synthetic coding sequence
cccgccgccgccgccagcagcctggagagagagaccgagagattcagagagctgctgctgtacggcagaaagaaggacgccctggagagcgccatgaagaacggcctgtggggccacgccctgctgctggccagcaagatggacagcagaacccacgccagagtgatgaccagattcgccaacagcctgcccatcaacgaccccctgcagaccgtgtaccagctgatgagcggcagaatgcccgccgccagcacctgctgcggcgacgagaagtggggcgactggagaccccacctggccatggtgctgagcaacctgaacaacaacatggacgtggagagcagaaccatggccaccatgggcgacaccctggccagcagaggcctgctggacgccgcccacttctgctacctgatggcccaggccggcttcggcgtgtacaccaagaagaccaccaagctggtgctgatcggcagcaaccacagcctgcccttcctgaagttcgccaccaacgaggccatccagagaaccgaggcctacgagtacgcccagagcctgggcgccgagacctgccccctgcccagcttccaggtgttcaagttcatctacagctgcagactggccgagatgggcctggccacccaggccttccactactgcgaggccatcgccaagagcatcctgacccagccccacctgtacagccccgtgctgatcagccagctggtgcagatggccagccagctgagactgttcgacccccagctgaaggagaagcccgaggaggagagcctggccgcccccacctggctggtgcacctgcagcaggtggagagacagatcaaggagggcgccggcgtgtggcaccaggacggcgccctgccccagcagtgccccggcacccccagcagcgagatggagcagctggacagacccggcctgagccagcccggcgccctgggcatcgccaaccccctgctggccgtgcccgcccccagccccgagcacagcagccccagcgtgagactgctgcccagcgccccccagaccctgcccgacggccccctggccagccccgccagagtgcccatgttccccgtgcccctgccccccggccccctggagcccggccccggctgcgtgacccccggccccgccctgggcttcctggagcccagcggccccggcctgccccccggcgtgccccccctgcaggagagaagacacctgctgcaggaggccagaagccccgaccccggcatcgtgccccaggaggcccccgtgggcaacagcctgagcgagctgagcgaggagaacttcgacggcaagttcgccaacctgacccccagcagaaccgtgcccgacagcgaggccccccccggctgggacagagccgacagcggccccacccagccccccctgagcctgagccccgcccccgagaccaagagacccggccaggccgccaagaaggagaccaaggagcccaagaagggcgagagctggttcttcagatggctgcccggcaagaagaagaccgaggcctacctgcccgacgacaagaacaagagcatcgtgtgggacgagaagaagaaccagtgggtgaacctgaacgagcccgaggaggagaagaaggcccccccccccccccccaccagcatgcccaagaccgtgcaggccgccccccccgccctgcccggcccccccggcgcccccgtgaacatgtacagcagaagagccgccggcaccagagccagatacgtggacgtgctgaaccccagcggcacccagagaagcgagcccgccctggcccccgccgacttcgtggcccccctggcccccctgcccatccccagcaacctgttcgtgcccacccccgacgccgaggagccccagctgcccgacggcaccggcagagagggccccgccgccgccagaggcctggccaaccccgagcccgcccccgagcccaaggtgctgagcagcgccgccagcctgcccggcagcgagctgcccagcagcagacccgagggcagccagggcggcgagctgagcagatgcagcagcatgagcagcctgagcagagaggtgagccagcacttcaaccaggcccccggcgacctgcccgccgccggcggcccccccagcggcgccatgcccttctacaaccccgcccagctggcccaggcctgcgccaccagcggcagcagcagactgggcagaatcggccagagaaagcacctggtgctgaactag

SEQ ID NO: 98168 - DNA, 6480 bp, Artificial Sequence
  Description of Artificial Sequence: Synthetic coding sequence
atgcccggcctggacagacccctgagcagacagaacccccacgacggcgtggtgacccccgccgccagccccagcctgccccagcccggcctgcagatgcccggccagtggggccccgtgcagggcggcccccagcccagcggccagcacagaagcccctgccccgagggccccgtgcccagcggcgtgccctgcgccaccagcgtgccccacttccccacccccagcatcctgcaccagggccccggccacgagcagcacagccccctggtggccccccccgccgccctgcccagcgacggcagagacgaggtgagccacctgcagagcggcagccacctggccaacaacagcgaccccgagagcaccttcagacagaaccccagaatcgtgaaccactgggccagccccgagctgagacagaaccccggcgtgaagaacgagcacagacccgccagcgccctggtgaaccccctggccagaggcgacagccccgagaacagaacccaccaccccctgggcgccggcgccggcagcggctgcgcccccctggaggccgacagcggcgccagcggcgccctggccatgttcttccagggcggcgagaccgagaacgaggagaacctgagcagcgagaaggccggcctgagcggccaggccgacttcgacgacttctgcagcagccccggcctgggcagaccccccgcccccacccacgtgggcgccggcagcctgtgccaggccctgctgcccggccccagcaacgaggccgccggcgacgtgtggggcgacaccgccagcaccggcgtgcccgacgccagcggcagccagtacgagaacgtggagaacctggagttcgtgcagaaccaggaggtgctgcccagcgagcccctgaacctggaccccagcagccccagcgaccagttcagatacggccccctgcccggccccgccgtgcccagacacggcgccgtgtgccacaccggcgcccccgacgccaccctgcacaccgtgcaccccgacagcgtgagcagcagctacagcagcagaagccacggcagactgagcggcagcgccagaccccaggagctggtgggcaccttcatccagcaggaggtgggcaagcccgaggacgaggccagcggcagcttcttcaagcagatcgacagcagccccgtgggcggcgagaccgacgagaccaccgtgagccagaactacagaggcagcgtgagccagcccagcacccccagcccccccaagcccaccggcatcttccagaccagcgccaacagcagcttcgagcccgtgaagagccacctggtgggcgtgaagcccttcgaggccgacagagccaacgtggtgggcgaggtgagagagacctgcgtgagacagaagcagtgcagacccgccgccgccctgcccgacgccagccccggcaacctggagcagccccccgacaacatggagaccctgtgcgccccccaggtgtgccccctgcccctgaacagcaccaccgaggccgtgcacatgctgccccacgccggcgccccccccctggacaccgtgtaccccgcccccgagaagagacccagcgccagaacccagggccccgtgaagtgcgagagccccgccaccaccctgtgggcccagagcgagctgcccgacttcggcggcaacgtgctgctggcccccgccgcccccgccctgtacgtgtgcgccaagccccagccccccgtggtgcagccccccgaggaggccatgagcggccagcagagcagaaaccccagcagcgccgcccccgtgcagagcagaggcggcatcggcgccagcgagaacctggagaacccccccaagatgggcgaggaggaggccctgcagagccaggccagcagcggctacgccagcctgctgagcagcccccccaccgagagcctgcagaacccccccgtgctgatcgcccagcccgaccacagctacaacctggcccagcccatcaacttcagcgtgagcctgagcaacagccacgagaagaaccagagctggagagaggccctggtgggcgacagacccgccgtgagcagctgggccctgggcggcgacagcggcgagaacaccagcctgagcggcatccccaccagcagcgtgctgagcctgagcctgcccagcagcgtggcccagagcaacttcccccagggcagcggcgccagcgagatggtgagcaaccagcccgccaacctgctggtgcagccccccagccagcccgtgcccgagaacctggtgcccgagagccagaaggacagaaaggccggcagcgccctgcccggcttcgccaacagccccgccggcagcaccagcgtggtgctggtgccccccgcccacggcaccctggtgcccgacggcaacaaggccaaccacagcagccaccaggaggacacctacggcgccctggacttcaccctgagcagaaccctggagaaccccgtgaacgtgtacaaccccagccacagcgacagcctggccagccagcagagcgtggccagccaccccagacagagcggccccggcgcccccaacctggacagattctaccagcaggtgaccaaggacgcccagggccagcccggcctggagagagcccagcaggagctggtgcccccccagcagcaggccagccccccccagctgcccaaggccatgttcagcgagctgagcaaccccgagagcctgcccgcccagggccaggcccagaacagcgcccagagccccgccagcctggtgctggtggacgccggccagcagctgccccccagacccccccagagcagcagcgtgagcctggtgagcagcggcagcggccaggccgccgtgcccagcgagcagccctggccccagcccgtgcccgccctggcccccggcccccccccccaggacctggccgcctactactactacagacccctgtacgacgcctaccagccccagtacagcctgccctacccccccgagcccggcgccgccagcctgtactaccaggacgtgtacagcctgtacgagcccagatacagaccctacgacggcgccgccagcgcctacgcccagaactacagataccccgagcccgagagacccagcagcagagccagccacagcagcgagagacccccccccagacagggctaccccgagggctactacagcagcaagagcggctggagcagccagagcgactactacgccagctactacagcagccagtacgactacggcgaccccggccactgggacagataccactacagcgccagagtgagagaccccagaacctacgacagaagatactggtgcgacgccgagtacgacgcctacagaagagagcacagcgccttcggcgacagacccgagaagagagacaacaactggagatacgaccccagattcaccggcagcttcgacgacgaccccgacccccacagagacccctacggcgaggaggtggacagaagaagcgtgcacagcgagcacagcgccagaagcctgcacagcgcccacagcctggccagcagaagaagcagcctgagcagccacagccaccagagccagatctacagaagccacaacgtggccgccggcagctacgaggcccccctgccccccggcagcttccacggcgacttcgcctacggcacctacagaagcaacttcagcagcggccccggcttccccgagtacggctaccccgccgacaccgtgtggcccgccatggagcaggtgagcagcagacccaccagccccgagaagttcagcgtgccccacgtgtgcgccagattcggccccggcggccagctgatcaaggtgatccccaacctgcccagcgagggccagcccgccctggtggaggtgcacagcatggaggccctgctgcagcacaccagcgagcaggaggagatgagagccttccccggccccctggccaaggacgacacccacaaggtggacgtgatcaacttcgcccagaacaaggccatgaagtgcctgcagaacgagaacctgatcgacaaggagagcgccagcctgctgtggaacttcatcgtgctgctgtgcagacagaacggcaccgtggtgggcaccgacatcgccgagctgctgctgagagaccacagaaccgtgtggctgcccggcaagagccccaacgaggccaacctgatcgacttcaccaacgaggccgtggagcaggtggaggaggaggagagcggcgaggcccagctgagcttcctgaccggcggccccgccgccgccgccagcagcctggagagagagaccgagagattcagagagctgctgctgtacggcagaaagaaggacgccctggagagcgccatgaagaacggcctgtggggccacgccctgctgctggccagcaagatggacagcagaacccacgccagagtgatgaccagattcgccaacagcctgcccatcaacgaccccctgcagaccgtgtaccagctgatgagcggcagaatgcccgccgccagcacctgctgcggcgacgagaagtggggcgactggagaccccacctggccatggtgctgagcaacctgaacaacaacatggacgtggagagcagaaccatggccaccatgggcgacaccctggccagcagaggcctgctggacgccgcccacttctgctacctgatggcccaggccggcttcggcgtgtacaccaagaagaccaccaagctggtgctgatcggcagcaaccacagcctgcccttcctgaagttcgccaccaacgaggccatccagagaaccgaggcctacgagtacgcccagagcctgggcgccgagacctgccccctgcccagcttccaggtgttcaagttcatctacagctgcagactggccgagatgggcctggccacccaggccttccactactgcgaggccatcgccaagagcatcctgacccagccccacctgtacagccccgtgctgatcagccagctggtgcagatggccagccagctgagactgttcgacccccagctgaaggagaagcccgaggaggagagcctggccgcccccacctggctggtgcacctgcagcaggtggagagacagatcaaggagggcgccggcgtgtggcaccaggacggcgccctgccccagcagtgccccggcacccccagcagcgagatggagcagctggacagacccggcctgagccagcccggcgccctgggcatcgccaaccccctgctggccgtgcccgcccccagccccgagcacagcagccccagcgtgagactgctgcccagcgccccccagaccctgcccgacggccccctggccagccccgccagagtgcccatgttccccgtgcccctgccccccggccccctggagcccggccccggctgcgtgacccccggccccgccctgggcttcctggagcccagcggccccggcctgccccccggcgtgccccccctgcaggagagaagacacctgctgcaggaggccagaagccccgaccccggcatcgtgccccaggaggcccccgtgggcaacagcctgagcgagctgagcgaggagaacttcgacggcaagttcgccaacctgacccccagcagaaccgtgcccgacagcgaggccccccccggctgggacagagccgacagcggccccacccagccccccctgagcctgagccccgcccccgagaccaagagacccggccaggccgccaagaaggagaccaaggagcccaagaagggcgagagctggttcttcagatggctgcccggcaagaagaagaccgaggcctacctgcccgacgacaagaacaagagcatcgtgtgggacgagaagaagaaccagtgggtgaacctgaacgagcccgaggaggagaagaaggcccccccccccccccccaccagcatgcccaagaccgtgcaggccgccccccccgccctgcccggcccccccggcgcccccgtgaacatgtacagcagaagagccgccggcaccagagccagatacgtggacgtgctgaaccccagcggcacccagagaagcgagcccgccctggcccccgccgacttcgtggcccccctggcccccctgcccatccccagcaacctgttcgtgcccacccccgacgccgaggagccccagctgcccgacggcaccggcagagagggccccgccgccgccagaggcctggccaaccccgagcccgcccccgagcccaaggtgctgagcagcgccgccagcctgcccggcagcgagctgcccagcagcagacccgagggcagccagggcggcgaggcccccggcgacctgcccgccgccggcggcccccccagcggcgccatgcccttctacaaccccgcccagctggcccaggcctgcgccaccagcggcagcagcagactgggcagaatcggccagagaaagcacctggtgctgaactag

SEQ ID NO: 98169 - DNA, 7074 bp, Artificial Sequence
  Description of Artificial Sequence: Synthetic coding sequence
atgcagccccccccccagaccgtgcccagcggcatggccggccccccccccgccggcaaccccagaagcgtgttctgggccagcagcccctacagaagaagagccaacaacaacgccgccgtggcccccaccacctgccccctgcagcccgtgaccgaccccttcgccttcagcagacaggccctgcagagcacccccctgggcagcagcagcaagagcagcccccccgtgctgcagggccccgcccccgccggcttcagccagcaccccggcctgctggtgccccacacccacgccagagacagcagccagggcccctgcgagcccctgcccggccccctgacccagcccagagcccacgccagccccttcagcggcgccctgacccccagcgccccccccggccccgagatgaacagaagcgccgaggtgggccccagcagcgagcccgaggtgcagaccctgccctacctgccccactacatccccggcgtggaccccgagaccagccacggcggccacccccacggcaacatgcccggcctggacagacccctgagcagacagaacccccacgacggcgtggtgacccccgccgccagccccagcctgccccagcccggcctgcagatgcccggccagtggggccccgtgcagggcggcccccagcccagcggccagcacagaagcccctgccccgagggccccgtgcccagcggcgtgccctgcgccaccagcgtgccccacttccccacccccagcatcctgcaccagggccccggccacgagcagcacagccccctggtggccccccccgccgccctgcccagcgacggcagagacgaggtgagccacctgcagagcggcagccacctggccaacaacagcgaccccgagagcaccttcagacagaaccccagaatcgtgaaccactgggccagccccgagctgagacagaaccccggcgtgaagaacgagcacagacccgccagcgccctggtgaaccccctggccagaggcgacagccccgagaacagaacccaccaccccctgggcgccggcgccggcagcggctgcgcccccctggaggccgacagcggcgccagcggcgccctggccatgttcttccagggcggcgagaccgagaacgaggagaacctgagcagcgagaaggccggcctgagcggccaggccgacttcgacgacttctgcagcagccccggcctgggcagaccccccgcccccacccacgtgggcgccggcagcctgtgccaggccctgctgcccggccccagcaacgaggccgccggcgacgtgtggggcgacaccgccagcaccggcgtgcccgacgccagcggcagccagtacgagaacgtggagaacctggagttcgtgcagaaccaggaggtgctgcccagcgagcccctgaacctggaccccagcagccccagcgaccagttcagatacggccccctgcccggccccgccgtgcccagacacggcgccgtgtgccacaccggcgcccccgacgccaccctgcacaccgtgcaccccgacagcgtgagcagcagctacagcagcagaagccacggcagactgagcggcagcgccagaccccaggagctggtgggcaccttcatccagcaggaggtgggcaagcccgaggacgaggccagcggcagcttcttcaagcagatcgacagcagccccgtgggcggcgagaccgacgagaccaccgtgagccagaactacagaggcagcgtgagccagcccagcacccccagcccccccaagcccaccggcatcttccagaccagcgccaacagcagcttcgagcccgtgaagagccacctggtgggcgtgaagcccttcgaggccgacagagccaacgtggtgggcgaggtgagagagacctgcgtgagacagaagcagtgcagacccgccgccgccctgcccgacgccagccccggcaacctggagcagccccccgacaacatggagaccctgtgcgccccccaggtgtgccccctgcccctgaacagcaccaccgaggccgtgcacatgctgccccacgccggcgccccccccctggacaccgtgtaccccgcccccgagaagagacccagcgccagaacccagggccccgtgaagtgcgagagccccgccaccaccctgtgggcccagagcgagctgcccgacttcggcggcaacgtgctgctggcccccgccgcccccgccctgtacgtgtgcgccaagccccagccccccgtggtgcagccccccgaggaggccatgagcggccagcagagcagaaaccccagcagcgccgcccccgtgcagagcagaggcggcatcggcgccagcgagaacctggagaacccccccaagatgggcgaggaggaggccctgcagagccaggccagcagcggctacgccagcctgctgagcagcccccccaccgagagcctgcagaacccccccgtgctgatcgcccagcccgaccacagctacaacctggcccagcccatcaacttcagcgtgagcctgagcaacagccacgagaagaaccagagctggagagaggccctggtgggcgacagacccgccgtgagcagctgggccctgggcggcgacagcggcgagaacaccagcctgagcggcatccccaccagcagcgtgctgagcctgagcctgcccagcagcgtggcccagagcaacttcccccagggcagcggcgccagcgagatggtgagcaaccagcccgccaacctgctggtgcagccccccagccagcccgtgcccgagaacctggtgcccgagagccagaaggacagaaaggccggcagcgccctgcccggcttcgccaacagccccgccggcagcaccagcgtggtgctggtgccccccgcccacggcaccctggtgcccgacggcaacaaggccaaccacagcagccaccaggaggacacctacggcgccctggacttcaccctgagcagaaccctggagaaccccgtgaacgtgtacaaccccagccacagcgacagcctggccagccagcagagcgtggccagccaccccagacagagcggccccggcgcccccaacctggacagattctaccagcaggtgaccaaggacgcccagggccagcccggcctggagagagcccagcaggagctggtgcccccccagcagcaggccagccccccccagctgcccaaggccatgttcagcgagctgagcaaccccgagagcctgcccgcccagggccaggcccagaacagcgcccagagccccgccagcctggtgctggtggacgccggccagcagctgccccccagacccccccagagcagcagcgtgagcctggtgagcagcggcagcggccaggccgccgtgcccagcgagcagccctggccccagcccgtgcccgccctggcccccggcccccccccccaggacctggccgcctactactactacagacccctgtacgacgcctaccagccccagtacagcctgccctacccccccgagcccggcgccgccagcctgtactaccaggacgtgtacagcctgtacgagcccagatacagaccctacgacggcgccgccagcgcctacgcccagaactacagataccccgagcccgagagacccagcagcagagccagccacagcagcgagagacccccccccagacagggctaccccgagggctactacagcagcaagagcggctggagcagccagagcgactactacgccagctactacagcagccagtacgactacggcgaccccggccactgggacagataccactacagcgccagagtgagagaccccagaacctacgacagaagatactggtgcgacgccgagtacgacgcctacagaagagagcacagcgccttcggcgacagacccgagaagagagacaacaactggagatacgaccccagattcaccggcagcttcgacgacgaccccgacccccacagagacccctacggcgaggaggtggacagaagaagcgtgcacagcgagcacagcgccagaagcctgcacagcgcccacagcctggccagcagaagaagcagcctgagcagccacagccaccagagccagatctacagaagccacaacgtggccgccggcagctacgaggcccccctgccccccggcagcttccacggcgacttcgcctacggcacctacagaagcaacttcagcagcggccccggcttccccgagtacggctaccccgccgacaccgtgtggcccgccatggagcaggtgagcagcagacccaccagccccgagaagttcagcgtgccccacgtgtgcgccagattcggccccggcggccagctgatcaaggtgatccccaacctgcccagcgagggccagcccgccctggtggaggtgcacagcatggaggccctgctgcagcacaccagcgagcaggaggagatgagagccttccccggccccctggccaaggacgacacccacaaggtggacgtgatcaacttcgcccagaacaaggccatgaagtgcctgcagaacgagaacctgatcgacaaggagagcgccagcctgctgtggaacttcatcgtgctgctgtgcagacagaacggcaccgtggtgggcaccgacatcgccgagctgctgctgagagaccacagaaccgtgtggctgcccggcaagagccccaacgaggccaacctgatcgacttcaccaacgaggccgtggagcaggtggaggaggaggagagcggcgaggcccagctgagcttcctgaccggcggccccgccgccgccgccagcagcctggagagagagaccgagagattcagagagctgctgctgtacggcagaaagaaggacgccctggagagcgccatgaagaacggcctgtggggccacgccctgctgctggccagcaagatggacagcagaacccacgccagagtgatgaccagattcgccaacagcctgcccatcaacgaccccctgcagaccgtgtaccagctgatgagcggcagaatgcccgccgccagcacctgctgcggcgacgagaagtggggcgactggagaccccacctggccatggtgctgagcaacctgaacaacaacatggacgtggagagcagaaccatggccaccatgggcgacaccctggccagcagaggcctgctggacgccgcccacttctgctacctgatggcccaggccggcttcggcgtgtacaccaagaagaccaccaagctggtgctgatcggcagcaaccacagcctgcccttcctgaagttcgccaccaacgaggccatccagagaaccgaggcctacgagtacgcccagagcctgggcgccgagacctgccccctgcccagcttccaggtgttcaagttcatctacagctgcagactggccgagatgggcctggccacccaggccttccactactgcgaggccatcgccaagagcatcctgacccagccccacctgtacagccccgtgctgatcagccagctggtgcagatggccagccagctgagactgttcgacccccagctgaaggagaagcccgaggaggagagcctggccgcccccacctggctggtgcacctgcagcaggtggagagacagatcaaggagggcgccggcgtgtggcaccaggacggcgccctgccccagcagtgccccggcacccccagcagcgagatggagcagctggacagacccggcctgagccagcccggcgccctgggcatcgccaaccccctgctggccgtgcccgcccccagccccgagcacagcagccccagcgtgagactgctgcccagcgccccccagaccctgcccgacggccccctggccagccccgccagagtgcccatgttccccgtgcccctgccccccggccccctggagcccggccccggctgcgtgacccccggccccgccctgggcttcctggagcccagcggccccggcctgccccccggcgtgccccccctgcaggagagaagacacctgctgcaggaggccagaagccccgaccccggcatcgtgccccaggaggcccccgtgggcaacagcctgagcgagctgagcgaggagaacttcgacggcaagttcgccaacctgacccccagcagaaccgtgcccgacagcgaggccccccccggctgggacagagccgacagcggccccacccagccccccctgagcctgagccccgcccccgagaccaagagacccggccaggccgccaagaaggagaccaaggagcccaagaagggcgagagctggttcttcagatggctgcccggcaagaagaagaccgaggcctacctgcccgacgacaagaacaagagcatcgtgtgggacgagaagaagaaccagtgggtgaacctgaacgagcccgaggaggagaagaaggcccccccccccccccccaccagcatgcccaagaccgtgcaggccgccccccccgccctgcccggcccccccggcgcccccgtgaacatgtacagcagaagagccgccggcaccagagccagatacgtggacgtgctgaaccccagcggcacccagagaagcgagcccgccctggcccccgccgacttcgtggcccccctggcccccctgcccatccccagcaacctgttcgtgcccacccccgacgccgaggagccccagctgcccgacggcaccggcagagagggccccgccgccgccagaggcctggccaaccccgagcccgcccccgagcccaaggtgctgagcagcgccgccagcctgcccggcagcgagctgcccagcagcagacccgagggcagccagggcggcgagctgagcagatgcagcagcatgagcagcctgagcagagaggtgagccagcacttcaaccaggcccccggcgacctgcccgccgccggcggcccccccagcggcgccatgcccttctacaaccccgcccagctggcccaggcctgcgccaccagcggcagcagcagactgggcagaatcggccagagaaagcacctggtgctgaactag

SEQ ID NO: 98170 - DNA, 1158 bp, Artificial Sequence
  Description of Artificial Sequence: Synthetic coding sequence
atggacctgctgcccaccagcatcctgctggccagcctgtggatctgcagccacctgcacccccccggcgtgagcgtggacctgccccccaccagcatcctgctggtgagcctgtggatctgcagccacctgcacccccccggcgtgagcgtggacagaccccccccccccagcagctggtgcctgtgcggcagcccccccaccagcatcctgctggtgagcctgtggatctgcagccccccccccagcagctggtgcctgtgcggcagcgcccccaccagcatcctgctggtgagcctgtggatctggagactgtggggcctgaccgagggcgagagctggttcttcagatggctgcccggcaagaagaagaccgaggcctacctgcccgacgacaagaacaagagcatcgtgtgggacgagaagaagaaccagtgggtgaacctgaacgagcccgaggaggagaagaaggcccccccccccccccccaccagcatgcccaagaccgtgcaggccgccccccccgccctgcccggcccccccggcgcccccgtgaacatgtacagcagaagagccgccggcaccagagccagatacgtggacgtgctgaaccccagcggcacccagagaagcgagcccgccctggcccccgccgacttcgtggcccccctggcccccctgcccatccccagcaacctgttcgtgcccacccccgtgagcagcgtgagaccccagggcagaagcggcagaaacgacggcctgctggccctgagcagccccgacgccgaggagccccagctgcccgacggcaccggcagagagggccccgccgccgccagaggcctggccaaccccgagcccgcccccgagcccaaggtgctgagcagcgccgccagcctgcccggcagcgagctgcccagcagcagacccgagggcagccagggcggcgagctgagcagatgcagcagcatgagcagcctgagcagagaggtgagccagcacttcaaccaggcccccggcgacctgcccgccgccggcggcccccccagcggcgccatgcccttctacaaccccgcccagctggcccaggcctgcgccaccagcggcagcagcagactgggcagaatcggccagagaaagcacctggtgctgaactag

SEQ ID NO: 98171 - DNA, 6405 bp, Artificial Sequence
  Description of Artificial Sequence: Synthetic coding sequence
atgcccggcctggacagacccctgagcagacagaacccccacgacggcgtggtgacccccgccgccagccccagcctgccccagcccggcctgcagatgcccggccagtggggccccgtgcagggcggcccccagcccagcggccagcacagaagcccctgccccgagggccccgtgcccagcggcgtgccctgcgccaccagcgtgccccacttccccacccccagcatcctgcaccagggccccggccacgagcagcacagccccctggtggccccccccgccgccctgcccagcgacggcagagacgaggtgagccacctgcagagcggcagccacctggccaacaacagcgaccccgagagcaccttcagacagaaccccagaatcgtgaaccactgggccagccccgagctgagacagaaccccggcgtgaagaacgagcacagacccgccagcgccctggtgaaccccctggccagaggcgacagccccgagaacagaacccaccaccccctgggcgccggcgccggcagcggctgcgcccccctggaggccgacagcggcgccagcggcgccctggccatgttcttccagggcggcgagaccgagaacgaggagaacctgagcagcgagaaggccggcctgagcggccaggccgacttcgacgacttctgcagcagccccggcctgggcagaccccccgcccccacccacgtgggcgccggcagcctgtgccaggccctgctgcccggccccagcaacgaggccgccggcgacgtgtggggcgacaccgccagcaccggcgtgcccgacgccagcggcagccagtacgagaacgtggagaacctggagttcgtgcagaaccaggaggtgctgcccagcgagcccctgaacctggaccccagcagccccagcgaccagttcagatacggccccctgcccggccccgccgtgcccagacacggcgccgtgtgccacaccggcgcccccgacgccaccctgcacaccgtgcaccccgacagcgtgagcagcagctacagcagcagaagccacggcagactgagcggcagcgccagaccccaggagctggtgggcaccttcatccagcaggaggtgggcaagcccgaggacgaggccagcggcagcttcttcaagcagatcgacagcagccccgtgggcggcgagaccgacgagaccaccgtgagccagaactacagaggcagcgtgagccagcccagcacccccagcccccccaagcccaccggcatcttccagaccagcgccaacagcagcttcgagcccgtgaagagccacctggtgggcgtgaagcccttcgaggccgacagagccaacgtggtgggcgaggtgagagagacctgcgtgagacagaagcagtgcagacccgccgccgccctgcccgacgccagccccggcaacctggagcagccccccgacaacatggagaccctgtgcgccccccaggtgtgccccctgcccctgaacagcaccaccgaggccgtgcacatgctgccccacgccggcgccccccccctggacaccgtgtaccccgcccccgagaagagacccagcgccagaacccagggccccgtgaagtgcgagagccccgccaccaccctgtgggcccagagcgagctgcccgacttcggcggcaacgtgctgctggcccccgccgcccccgccctgtacgtgtgcgccaagccccagccccccgtggtgcagccccccgaggaggccatgagcggccagcagagcagaaaccccagcagcgccgcccccgtgcagagcagaggcggcatcggcgccagcgagaacctggagaacccccccaagatgggcgaggaggaggccctgcagagccaggccagcagcggctacgccagcctgctgagcagcccccccaccgagagcctgcagaacccccccgtgctgatcgcccagcccgaccacagctacaacctggcccagcccatcaacttcagcgtgagcctgagcaacagccacgagaagaaccagagctggagagaggccctggtgggcgacagacccgccgtgagcagctgggccctgggcggcgacagcggcgagaacaccagcctgagcggcatccccaccagcagcgtgctgagcctgagcctgcccagcagcgtggcccagagcaacttcccccagggcagcggcgccagcgagatggtgagcaaccagcccgccaacctgctggtgcagccccccagccagcccgtgcccgagaacctggtgcccgagagccagaaggacagaaaggccggcagcgccctgcccggcttcgccaacagccccgccggcagcaccagcgtggtgctggtgccccccgcccacggcaccctggtgcccgacggcaacaaggccaaccacagcagccaccaggaggacacctacggcgccctggacttcaccctgagcagaaccctggagaaccccgtgaacgtgtacaaccccagccacagcgacagcctggccagccagcagagcgtggccagccaccccagacagagcggccccggcgcccccaacctggacagattctaccagcaggtgaccaaggacgcccagggccagcccggcctggagagagcccagcaggagctggtgcccccccagcagcaggccagccccccccagctgcccaaggccatgttcagcgagctgagcaaccccgagagcctgcccgcccagggccaggcccagaacagcgcccagagccccgccagcctggtgctggtggacgccggccagcagctgccccccagacccccccagagcagcagcgtgagcctggtgagcagcggcagcggccaggccgccgtgcccagcgagcagccctggccccagcccgtgcccgccctggcccccggcccccccccccaggacctggccgcctactactactacagacccctgtacgacgcctaccagccccagtacagcctgccctacccccccgagcccggcgccgccagcctgtactaccaggacgtgtacagcctgtacgagcccagatacagaccctacgacggcgccgccagcgcctacgcccagaactacagataccccgagcccgagagacccagcagcagagccagccacagcagcgagagacccccccccagacagggctaccccgagggctactacagcagcaagagcggctggagcagccagagcgactactacgccagctactacagcagccagtacgactacggcgaccccggccactgggacagataccactacagcgccagagtgagagaccccagaacctacgacagaagatactggtgcgacgccgagtacgacgcctacagaagagagcacagcgccttcggcgacagacccgagaagagagacaacaactggagatacgaccccagattcaccggcagcttcgacgacgaccccgacccccacagagacccctacggcgaggaggtggacagaagaagcgtgcacagcgagcacagcgccagaagcctgcacagcgcccacagcctggccagcagaagaagcagcctgagcagccacagccaccagagccagatctacagaagccacaacgtggccgccggcagctacgaggcccccctgccccccggcagcttccacggcgacttcgcctacggcacctacagaagcaacttcagcagcggccccggcttccccgagtacggctaccccgccgacaccgtgtggcccgccatggagcaggtgagcagcagacccaccagccccgagaagttcagcgtgccccacgtgtgcgccagattcggccccggcggccagctgatcaaggtgatccccaacctgcccagcgagggccagcccgccctggtggaggtgcacagcatggaggccctgctgcagcacaccagcgagcaggaggagatgagagccttccccggccccctggccaaggacgacacccacaaggtggacgtgatcaacttcgcccagaacaaggccatgaagtgcctgcagaacgagaacctgatcgacaaggagagcgccagcctgctgtggaacttcatcgtgctgctgtgcagacagaacggcaccgtggtgggcaccgacatcgccgagctgctgctgagagaccacagaaccgtgtggctgcccggcaagagccccaacgaggccaacctgatcgacttcaccaacgaggccgtggagcaggtggaggaggaggagagcggcgaggcccagctgagcttcctgaccggcggccccgccgccgccgccagcagcctggagagagagaccgagagattcagagagctgctgctgtacggcagaaagaaggacgccctggagagcgccatgaagaacggcctgtggggccacgccctgctgctggccagcaagatggacagcagaacccacgccagagtgatgaccagattcgccaacagcctgcccatcaacgaccccctgcagaccgtgtaccagctgatgagcggcagaatgcccgccgccagcacctgctgcggcgacgagaagtggggcgactggagaccccacctggccatggtgctgagcaacctgaacaacaacatggacgtggagagcagaaccatggccaccatgggcgacaccctggccagcagaggcctgctggacgccgcccacttctgctacctgatggcccaggccggcttcggcgtgtacaccaagaagaccaccaagctggtgctgatcggcagcaaccacagcctgcccttcctgaagttcgccaccaacgaggccatccagagaaccgaggcctacgagtacgcccagagcctgggcgccgagacctgccccctgcccagcttccaggtgttcaagttcatctacagctgcagactggccgagatgggcctggccacccaggccttccactactgcgaggccatcgccaagagcatcctgacccagccccacctgtacagccccgtgctgatcagccagctggtgcagatggccagccagctgagactgttcgacccccagctgaaggagaagcccgaggaggagagcctggccgcccccacctggctggtgcacctgcagcaggtggagagacagatcaaggagggcgccggcgtgtggcaccaggacggcgccctgccccagcagtgccccggcacccccagcagcgagatggagcagctggacagacccggcctgagccagcccggcgccctgggcatcgccaaccccctgctggccgtgcccgcccccagccccgagcacagcagccccagcgtgagactgctgcccagcgccccccagaccctgcccgacggccccctggccagccccgccagagtgcccatgttccccgtgcccctgccccccggccccctggagcccggccccggctgcgtgacccccggccccgccctgggcttcctggagcccagcggccccggcctgccccccggcgtgccccccctgcaggagagaagacacctgctgcaggaggccagaagccccgaccccggcatcgtgccccaggaggcccccgtgggcaacagcctgagcgagctgagcgaggagaacttcgacggcaagttcgccaacctgacccccagcagaaccgtgcccgacagcgaggccccccccggctgggacagagccgacagcggccccacccagccccccctgagcctgagccccgcccccgagaccaagagacccggccaggccgccaagaaggagaccaaggagcccaagaagggcgagagctggttcttcagatggctgcccggcaagaagaagaccgaggcctacctgcccgacgacaagaacaagagcatcgtgtgggacgagaagaagaaccagtgggtgaacctgaacgagcccgaggaggagaagaaggcccccccccccccccccaccagcatgcccaagaccgtgcaggccgccccccccgccctgcccggcccccccggcgcccccgtgaacatgtacagcagaagagccgccggcaccagagccagatacgtggacgtgctgaaccccagcggcacccagagaagcgagcccgccctggcccccgccgacttcgtggcccccctggcccccctgcccatccccagcaacctgttcgtgcccacccccgacgccgaggagccccagctgcccgacggcaccggcagagagggccccgccgccgccagaggcctggccaaccccgagcccgcccccgagcccaaggcccccggcgacctgcccgccgccggcggcccccccagcggcgccatgcccttctacaaccccgcccagctggcccaggcctgcgccaccagcggcagcagcagactgggcagaatcggccagagaaagcacctggtgctgaactag

SEQ ID NO: 98172 - DNA, 423 bp, Artificial Sequence
  Description of Artificial Sequence: Synthetic coding sequence
atggacctgctgcccaccagcatcctgctggccagcctgtggatctgcagccacctgcacccccccggcgtgagcgtggacctgccccccaccagcatcctgctggtgagcctgtggatctgcagccacctgcacccccccggcgtgagcgtggacagaccccccccccccagcagctggtgcctgtgcggcagcccccccaccagcatcctgctggtgagcctgtggatctgcagccccccccccagcagctggtgcctgtgcggcagcgcccccaccagcatcctgctggtgagcctgtggatctggagactgtggggcctgaccgaggtgggccacgtggagttcgtgttcctgccctggctgatcagctggaacatcatgttcagcaagctgttcagctgcttcctgtacctgggctag

SEQ ID NO: 98173 - DNA, 2205 bp, Artificial Sequence
  Description of Artificial Sequence: Synthetic coding sequence
atgttcagcgagctgagcaaccccgagagcctgcccgcccagggccaggcccagaacagcgcccagagccccgccagcctggtgctggtggacgccggccagcagctgccccccagacccccccagagcagcagcgtgagcctggtgagcagcggcagcggccaggccgccgtgcccagcgagcagccctggccccagcccgtgcccgccctggcccccggcccccccccccaggacctggccgcctactactactacagacccctgtacgacgcctaccagccccagtacagcctgccctacccccccgagcccggcgccgccagcctgtactaccaggacgtgtacagcctgtacgagcccagatacagaccctacgacggcgccgccagcgcctacgcccagaactacagataccccgagcccgagagacccagcagcagagccagccacagcagcgagagacccccccccagacagggctaccccgagggctactacagcagcaagagcggctggagcagccagagcgactactacgccagctactacagcagccagtacgactacggcgaccccggccactgggacagataccactacagcgccagagtgagagaccccagaacctacgacagaagatactggtgcgacgccgagtacgacgcctacagaagagagcacagcgccttcggcgacagacccgagaagagagacaacaactggagatacgaccccagattcaccggcagcttcgacgacgaccccgacccccacagagacccctacggcgaggaggtggacagaagaagcgtgcacagcgagcacagcgccagaagcctgcacagcgcccacagcctggccagcagaagaagcagcctgagcagccacagccaccagagccagatctacagaagccacaacgtggccgccggcagctacgaggcccccctgccccccggcagcttccacggcgacttcgcctacggcacctacagaagcaacttcagcagcggccccggcttccccgagtacggctacagacccgccctgggcttcctggagcccagcggccccggcctgccccccggcgtgccccccctgcaggagagaagacacctgctgcaggaggccagaagccccgaccccggcatcgtgccccaggaggcccccgtgggcaacagcctgagcgagctgagcgaggagaacttcgacggcaagttcgccaacctgacccccagcagaaccgtgcccgacagcgaggccccccccggctgggacagagccgacagcggccccacccagccccccctgagcctgagccccgcccccgagaccaagagacccggccaggccgccaagaaggagaccaaggagcccaagaagggcgagagctggttcttcagatggctgcccggcaagaagaagaccgaggcctacctgcccgacgacaagaacaagagcatcgtgtgggacgagaagaagaaccagtgggtgaacctgaacgagcccgaggaggagaagaaggcccccccccccccccccaccagcatgcccaagaccgtgcaggccgccccccccgccctgcccggcccccccggcgcccccgtgaacatgtacagcagaagagccgccggcaccagagccagatacgtggacgtgctgaaccccagcggcacccagagaagcgagcccgccctggcccccgccgacttcgtggcccccctggcccccctgcccatccccagcaacctgttcgtgcccacccccgtgagaccccagggcagaagcggcagaaacgacggcctgctggccctgagcagccccgacgccgaggagccccagctgcccgacggcaccggcagagagggccccgccgccgccagaggcctggccaaccccgagcccgcccccgagcccaaggtgctgagcagcgccgccagcctgcccggcagcgagctgcccagcagcagacccgagggcagccagggcggcgagctgagcagatgcagcagcatgagcagcctgagcagagaggtgagccagcacttcaaccaggcccccggcgacctgcccgccgccggcggcccccccagcggcgccatgcccttctacaaccccgcccagctggcccaggcctgcgccaccagcggcagcagcagactgggcagaatcggccagagaaagcacctggtgctgaactag

SEQ ID NO: 98174 - DNA, 5184 bp, Artificial Sequence
  Description of Artificial Sequence: Synthetic coding sequence
atgttcttccagggcggcgagaccgagaacgaggagaacctgagcagcgagaaggccggcctgagcggccaggccgacttcgacgacttctgcagcagccccggcctgggcagaccccccgcccccacccacgtgggcgccggcagcctgtgccaggccctgctgcccggccccagcaacgaggccgccggcgacgtgtggggcgacaccgccagcaccggcgtgcccgacgccagcggcagccagtacgagaacgtggagaacctggagttcgtgcagaaccaggaggtgctgcccagcgagcccctgaacctggaccccagcagccccagcgaccagttcagatacggccccctgcccggccccgccgtgcccagacacggcgccgtgtgccacaccggcgcccccgacgccaccctgcacaccgtgcaccccgacagcgtgagcagcagctacagcagcagaagccacggcagactgagcggcagcgccagaccccaggagctggtgggcaccttcatccagcaggaggtgggcaagcccgaggacgaggccagcggcagcttcttcaagcagatcgacagcagccccgtgggcggcgagaccgacgagaccaccgtgagccagaactacagaggcagcgtgagccagcccagcacccccagcccccccaagcccaccggcatcttccagaccagcgccaacagcagcttcgagcccgtgaagagccacctggtgggcgtgaagcccttcgaggccgacagagccaacgtggtgggcgaggtgagagagacctgcgtgagacagaagcagtgcagacccgccgccgccctgcccgacgccagccccggcaacctggagcagccccccgacaacatggagaccctgtgcgccccccaggtgtgccccctgcccctgaacagcaccaccgaggccgtgcacatgctgccccacgccggcgccccccccctggacaccgtgtaccccgcccccgagaagagacccagcgccagaacccagggccccgtgaagtgcgagagccccgccaccaccctgtgggcccagagcgagctgcccgacttcggcggcaacgtgctgctggcccccgccgcccccgccctgtacgtgtgcgccaagccccagccccccgtggtgcagccccccgaggaggccatgagcggccagcagagcagaaaccccagcagcgccgcccccgtgcagagcagaggcggcatcggcgccagcgagaacctggagaacccccccaagatgggcgaggaggaggccctgcagagccaggtgaccaaggacgcccagggccagcccggcctggagagagcccagcaggagctggtgcccccccagcagcaggccagccccccccagctgcccaaggccatgttcagcgagctgagcaaccccgagagcctgcccgcccagggccaggcccagaacagcgcccagagccccgccagcctggtgctggtggacgccggccagcagctgccccccagacccccccagagcagcagcgtgagcctggtgagcagcggcagcggccaggccgccgtgcccagcgagcagccctggccccagcccgtgcccgccctggcccccggcccccccccccaggacctggccgcctactactactacagacccctgtacgacgcctaccagccccagtacagcctgccctacccccccgagcccggcgccgccagcctgtactaccaggacgtgtacagcctgtacgagcccagatacagaccctacgacggcgccgccagcgcctacgcccagaactacagataccccgagcccgagagacccagcagcagagccagccacagcagcgagagacccccccccagacagggctaccccgagggctactacagcagcaagagcggctggagcagccagagcgactactacgccagctactacagcagccagtacgactacggcgaccccggccactgggacagataccactacagcgccagagtgagagaccccagaacctacgacagaagatactggtgcgacgccgagtacgacgcctacagaagagagcacagcgccttcggcgacagacccgagaagagagacaacaactggagatacgaccccagattcaccggcagcttcgacgacgaccccgacccccacagagacccctacggcgaggaggtggacagaagaagcgtgcacagcgagcacagcgccagaagcctgcacagcgcccacagcctggccagcagaagaagcagcctgagcagccacagccaccagagccagatctacagaagccacaacgtggccgccggcagctacgaggcccccctgccccccggcagcttccacggcgacttcgcctacggcacctacagaagcaacttcagcagcggccccggcttccccgagtacggctaccccgccgacaccgtgtggcccgccatggagcaggtgagcagcagacccaccagccccgagaagttcagcgtgccccacgtgtgcgccagattcggccccggcggccagctgatcaaggtgatccccaacctgcccagcgagggccagcccgccctggtggaggtgcacagcatggaggccctgctgcagcacaccagcgagcaggaggagatgagagccttccccggccccctggccaaggacgacacccacaaggtggacgtgatcaacttcgcccagaacaaggccatgaagtgcctgcagaacgagaacctgatcgacaaggagagcgccagcctgctgtggaacttcatcgtgctgctgtgcagacagaacggcaccgtggtgggcaccgacatcgccgagctgctgctgagagaccacagaaccgtgtggctgcccggcaagagccccaacgaggccaacctgatcgacttcaccaacgaggccgtggagcaggtggaggaggaggagagcggcgaggcccagctgagcttcctgaccggcggccccgccgccgccgccagcagcctggagagagagaccgagagattcagagagctgctgctgtacggcagaaagaaggacgccctggagagcgccatgaagaacggcctgtggggccacgccctgctgctggccagcaagatggacagcagaacccacgccagagtgatgaccagattcgccaacagcctgcccatcaacgaccccctgcagaccgtgtaccagctgatgagcggcagaatgcccgccgccagcacctgctgcggcgacgagaagtggggcgactggagaccccacctggccatggtgctgagcaacctgaacaacaacatggacgtggagagcagaaccatggccaccatgggcgacaccctggccagcagaggcctgctggacgccgcccacttctgctacctgatggcccaggccggcttcggcgtgtacaccaagaagaccaccaagctggtgctgatcggcagcaaccacagcctgcccttcctgaagttcgccaccaacgaggccatccagagaaccgaggcctacgagtacgcccagagcctgggcgccgagacctgccccctgcccagcttccaggtgttcaagttcatctacagctgcagactggccgagatgggcctggccacccaggccttccactactgcgaggccatcgccaagagcatcctgacccagccccacctgtacagccccgtgctgatcagccagctggtgcagatggccagccagctgagactgttcgacccccagctgaaggagaagcccgaggaggagagcctggccgcccccacctggctggtgcacctgcagcaggtggagagacagatcaaggagggcgccggcgtgtggcaccaggacggcgccctgccccagcagtgccccggcacccccagcagcgagatggagcagctggacagacccggcctgagccagcccggcgccctgggcatcgccaaccccctgctggccgtgcccgcccccagccccgagcacagcagccccagcgtgagactgctgcccagcgccccccagaccctgcccgacggccccctggccagccccgccagagtgcccatgttccccgtgcccctgccccccggccccctggagcccggccccggctgcgtgacccccggccccgccctgggcttcctggagcccagcggccccggcctgccccccggcgtgccccccctgcaggagagaagacacctgctgcaggaggccagaagccccgaccccggcatcgtgccccaggaggcccccgtgggcaacagcctgagcgagctgagcgaggagaacttcgacggcaagttcgccaacctgacccccagcagaaccgtgcccgacagcgaggccccccccggctgggacagagccgacagcggccccacccagccccccctgagcctgagccccgcccccgagaccaagagacccggccaggccgccaagaaggagaccaaggagcccaagaagggcgagagctggttcttcagatggctgcccggcaagaagaagaccgaggcctacctgcccgacgacaagaacaagagcatcgtgtgggacgagaagaagaaccagtgggtgaacctgaacgagcccgaggaggagaagaaggcccccccccccccccccaccagcatgcccaagaccgtgcaggccgccccccccgccctgcccggcccccccggcgcccccgtgaacatgtacagcagaagagccgccggcaccagagccagatacgtggacgtgctgaaccccagcggcacccagagaagcgagcccgccctggcccccgccgacttcgtggcccccctggcccccctgcccatccccagcaacctgttcgtgcccacccccgacgccgaggagccccagctgcccgacggcaccggcagagagggccccgccgccgccagaggcctggccaaccccgagcccgcccccgagcccaaggtgctgagcagcgccgccagcctgcccggcagcgagctgcccagcagcagacccgagggcagccagggcggcgaggcccccggcgacctgcccgccgccggcggcccccccagcggcgccatgcccttctacaaccccgcccagctggcccaggcctgcgccaccagcggcagcagcagactgggcagaatcggccagagaaagcacctggtgctgaactag

SEQ ID NO: 98175 - DNA, 6465 bp, Artificial Sequence
  Description of Artificial Sequence: Synthetic coding sequence
atgcccggcctggacagacccctgagcagacagaacccccacgacggcgtggtgacccccgccgccagccccagcctgccccagcccggcctgcagatgcccggccagtggggccccgtgcagggcggcccccagcccagcggccagcacagaagcccctgccccgagggccccgtgcccagcggcgtgccctgcgccaccagcgtgccccacttccccacccccagcatcctgcaccagggccccggccacgagcagcacagccccctggtggccccccccgccgccctgcccagcgacggcagagacgaggtgagccacctgcagagcggcagccacctggccaacaacagcgaccccgagagcaccttcagacagaaccccagaatcgtgaaccactgggccagccccgagctgagacagaaccccggcgtgaagaacgagcacagacccgccagcgccctggtgaaccccctggccagaggcgacagccccgagaacagaacccaccaccccctgggcgccggcgccggcagcggctgcgcccccctggaggccgacagcggcgccagcggcgccctggccatgttcttccagggcggcgagaccgagaacgaggagaacctgagcagcgagaaggccggcctgagcggccaggccgacttcgacgacttctgcagcagccccggcctgggcagaccccccgcccccacccacgtgggcgccggcagcctgtgccaggccctgctgcccggccccagcaacgaggccgccggcgacgtgtggggcgacaccgccagcaccggcgtgcccgacgccagcggcagccagtacgagaacgtggagaacctggagttcgtgcagaaccaggaggtgctgcccagcgagcccctgaacctggaccccagcagccccagcgaccagttcagatacggccccctgcccggccccgccgtgcccagacacggcgccgtgtgccacaccggcgcccccgacgccaccctgcacaccgtgcaccccgacagcgtgagcagcagctacagcagcagaagccacggcagactgagcggcagcgccagaccccaggagctggtgggcaccttcatccagcaggaggtgggcaagcccgaggacgaggccagcggcagcttcttcaagcagatcgacagcagccccgtgggcggcgagaccgacgagaccaccgtgagccagaactacagaggcagcgtgagccagcccagcacccccagcccccccaagcccaccggcatcttccagaccagcgccaacagcagcttcgagcccgtgaagagccacctggtgggcgtgaagcccttcgaggccgacagagccaacgtggtgggcgaggtgagagagacctgcgtgagacagaagcagtgcagacccgccgccgccctgcccgacgccagccccggcaacctggagcagccccccgacaacatggagaccctgtgcgccccccaggtgtgccccctgcccctgaacagcaccaccgaggccgtgcacatgctgccccacgccggcgccccccccctggacaccgtgtaccccgcccccgagaagagacccagcgccagaacccagggccccgtgaagtgcgagagccccgccaccaccctgtgggcccagagcgagctgcccgacttcggcggcaacgtgctgctggcccccgccgcccccgccctgtacgtgtgcgccaagccccagccccccgtggtgcagccccccgaggaggccatgagcggccagcagagcagaaaccccagcagcgccgcccccgtgcagagcagaggcggcatcggcgccagcgagaacctggagaacccccccaagatgggcgaggaggaggccctgcagagccaggccagcagcggctacgccagcctgctgagcagcccccccaccgagagcctgcagaacccccccgtgctgatcgcccagcccgaccacagctacaacctggcccagcccatcaacttcagcgtgagcctgagcaacagccacgagaagaaccagagctggagagaggccctggtgggcgacagacccgccgtgagcagctgggccctgggcggcgacagcggcgagaacaccagcctgagcggcatccccaccagcagcgtgctgagcctgagcctgcccagcagcgtggcccagagcaacttcccccagggcagcggcgccagcgagatggtgagcaaccagcccgccaacctgctggtgcagccccccagccagcccgtgcccgagaacctggtgcccgagagccagaaggacagaaaggccggcagcgccctgcccggcttcgccaacagccccgccggcagcaccagcgtggtgctggtgccccccgcccacggcaccctggtgcccgacggcaacaaggccaaccacagcagccaccaggaggacacctacggcgccctggacttcaccctgagcagaaccctggagaaccccgtgaacgtgtacaaccccagccacagcgacagcctggccagccagcagagcgtggccagccaccccagacagagcggccccggcgcccccaacctggacagattctaccagcaggtgaccaaggacgcccagggccagcccggcctggagagagcccagcaggagctggtgcccccccagcagcaggccagccccccccagctgcccaaggccatgttcagcgagctgagcaaccccgagagcctgcccgcccagggccaggcccagaacagcgcccagagccccgccagcctggtgctggtggacgccggccagcagctgccccccagacccccccagagcagcagcgtgagcctggtgagcagcggcagcggccaggccgccgtgcccagcgagcagccctggccccagcccgtgcccgccctggcccccggcccccccccccaggacctggccgcctactactactacagacccctgtacgacgcctaccagccccagtacagcctgccctacccccccgagcccggcgccgccagcctgtactaccaggacgtgtacagcctgtacgagcccagatacagaccctacgacggcgccgccagcgcctacgcccagaactacagataccccgagcccgagagacccagcagcagagccagccacagcagcgagagacccccccccagacagggctaccccgagggctactacagcagcaagagcggctggagcagccagagcgactactacgccagctactacagcagccagtacgactacggcgaccccggccactgggacagataccactacagcgccagagtgagagaccccagaacctacgacagaagatactggtgcgacgccgagtacgacgcctacagaagagagcacagcgccttcggcgacagacccgagaagagagacaacaactggagatacgaccccagattcaccggcagcttcgacgacgaccccgacccccacagagacccctacggcgaggaggtggacagaagaagcgtgcacagcgagcacagcgccagaagcctgcacagcgcccacagcctggccagcagaagaagcagcctgagcagccacagccaccagagccagatctacagaagccacaacgtggccgccggcagctacgaggcccccctgccccccggcagcttccacggcgacttcgcctacggcacctacagaagcaacttcagcagcggccccggcttccccgagtacggctaccccgccgacaccgtgtggcccgccatggagcaggtgagcagcagacccaccagccccgagaagttcagcgtgccccacgtgtgcgccagattcggccccggcggccagctgatcaaggtgatccccaacctgcccagcgagggccagcccgccctggtggaggtgcacagcatggaggccctgctgcagcacaccagcgagcaggaggagatgagagccttccccggccccctggccaaggacgacacccacaaggtggacgtgatcaacttcgcccagaacaaggccatgaagtgcctgcagaacgagaacctgatcgacaaggagagcgccagcctgctgtggaacttcatcgtgctgctgtgcagacagaacggcaccgtggtgggcaccgacatcgccgagctgctgctgagagaccacagaaccgtgtggctgcccggcaagagccccaacgaggccaacctgatcgacttcaccaacgaggccgtggagcaggtggaggaggaggagagcggcgaggcccagctgagcttcctgaccggcggccccgccgccgccgccagcagcctggagagagagaccgagagattcagagagctgctgctgtacggcagaaagaaggacgccctggagagcgccatgaagaacggcctgtggggccacgccctgctgctggccagcaagatggacagcagaacccacgccagagtgatgaccagattcgccaacagcctgcccatcaacgaccccctgcagaccgtgtaccagctgatgagcggcagaatgcccgccgccagcacctgctgcggcgacgagaagtggggcgactggagaccccacctggccatggtgctgagcaacctgaacaacaacatggacgtggagagcagaaccatggccaccatgggcgacaccctggccagcagaggcctgctggacgccgcccacttctgctacctgatggcccaggccggcttcggcgtgtacaccaagaagaccaccaagctggtgctgatcggcagcaaccacagcctgcccttcctgaagttcgccaccaacgaggccatccagagaaccgaggcctacgagtacgcccagagcctgggcgccgagacctgccccctgcccagcttccaggtgttcaagttcatctacagctgcagactggccgagatgggcctggccacccaggccttccactactgcgaggccatcgccaagagcatcctgacccagccccacctgtacagccccgtgctgatcagccagctggtgcagatggccagccagctgagactgttcgacccccagctgaaggagaagcccgaggaggagagcctggccgcccccacctggctggtgcacctgcagcaggtggagagacagatcaaggagggcgccggcgtgtggcaccaggacggcgccctgccccagcagtgccccggcacccccagcagcgagatggagcagctggacagacccggcctgagccagcccggcgccctgggcatcgccaaccccctgctggccgtgcccgcccccagccccgagcacagcagccccagcgtgagactgctgcccagcgccccccagaccctgcccgacggccccctggccagccccgccagagtgcccatgttccccgtgcccctgccccccggccccctggagcccggccccggctgcgtgacccccggccccgccctgggcttcctggagcccagcggccccggcctgccccccggcgtgccccccctgcaggagagaagacacctgctgcaggaggccagaagccccgaccccggcatcgtgccccaggaggcccccgtgggcaacagcctgagcgagctgagcgaggagaacttcgacggcaagttcgccaacctgacccccagcagaaccgtgcccgacagcgaggccccccccggctgggacagagccgacagcggccccacccagccccccctgagcctgagccccgcccccgagaccaagagacccggccaggccgccaagaaggagaccaaggagcccaagaagggcgagagctggttcttcagatggctgcccggcaagaagaagaccgaggcctacctgcccgacgacaagaacaagagcatcgtgtgggacgagaagaagaaccagtgggtgaacctgaacgagcccgaggaggagaagaaggcccccccccccccccccaccagcatgcccaagaccgtgcaggccgccccccccgccctgcccggcccccccggcgcccccgtgaacatgtacagcagaagagccgccggcaccagagccagatacgtggacgtgctgaaccccagcggcacccagagaagcgagcccgccctggcccccgccgacttcgtggcccccctggcccccctgcccatccccagcaacctgttcgtgcccacccccgacgccgaggagccccagctgcccgacggcaccggcagagagggccccgccgccgccagaggcctggccaaccccgagcccgcccccgagcccaagctgagcagatgcagcagcatgagcagcctgagcagagaggtgagccagcacttcaaccaggcccccggcgacctgcccgccgccggcggcccccccagcggcgccatgcccttctacaaccccgcccagctggcccaggcctgcgccaccagcggcagcagcagactgggcagaatcggccagagaaagcacctggtgctgaactag

SEQ ID NO: 98176 - DNA, 1521 bp, Artificial Sequence
  Description of Artificial Sequence: Synthetic coding sequence
tgaagcgccttcggcgacagacccgagaagagagacaacaactggagatacgaccccagattcaccggcagcttcgacgacgaccccgacccccacagagacccctacggcgaggaggtggacagaagaagcgtgcacagcgagcacagcgccagaagcctgcacagcgcccacagcctggccagcagaagaagcagcctgagcagccacagccaccagagccagatctacagaagccacaacgtggccgccggcagctacgaggcccccctgccccccggcagcttccacggcgacttcgcctacggcacctacagaagcaacttcagcagcggccccggcttccccgagtacggctaccccgccctgggcttcctggagcccagcggccccggcctgccccccggcgtgccccccctgcaggagagaagacacctgctgcaggaggccagaagccccgaccccggcatcgtgccccaggaggcccccgtgggcaacagcctgagcgagctgagcgaggagaacttcgacggcaagttcgccaacctgacccccagcagaaccgtgcccgacagcgaggccccccccggctgggacagagccgacagcggccccacccagccccccctgagcctgagccccgcccccgagaccaagagacccggccaggccgccaagaaggagaccaaggagcccaagaagggcgagagctggttcttcagatggctgcccggcaagaagaagaccgaggcctacctgcccgacgacaagaacaagagcatcgtgtgggacgagaagaagaaccagtgggtgaacctgaacgagcccgaggaggagaagaaggcccccccccccccccccaccagcatgcccaagaccgtgcaggccgccccccccgccctgcccggcccccccggcgcccccgtgaacatgtacagcagaagagccgccggcaccagagccagatacgtggacgtgctgaaccccagcggcacccagagaagcgagcccgccctggcccccgccgacttcgtggcccccctggcccccctgcccatccccagcaacctgttcgtgcccacccccgtgagaccccagggcagaagcggcagaaacgacggcctgctggccctgagcagccccgacgccgaggagccccagctgcccgacggcaccggcagagagggccccgccgccgccagaggcctggccaaccccgagcccgcccccgagcccaaggtgctgagcagcgccgccagcctgcccggcagcgagctgcccagcagcagacccgagggcagccagggcggcgagctgagcagatgcagcagcatgagcagcctgagcagagaggtgagccagcacttcaaccaggcccccggcgacctgcccgccgccggcggcccccccagcggcgccatgcccttctacaaccccgcccagctggcccaggcctgcgccaccagcggcagcagcagactgggcagaatcggccagagaaagcacctggtgctgaactag

SEQ ID NO: 98177 - DNA, 3180 bp, Artificial Sequence
  Description of Artificial Sequence: Synthetic coding sequence
gccagagtgagagaccccagaacctacgacagaagatactggtgcgacgccgagtacgacgcctacagaagagagcacagcgccttcggcgacagacccgagaagagagacaacaactggagatacgaccccagattcaccggcagcttcgacgacgaccccgacccccacagagacccctacggcgaggaggtggacagaagaagcgtgcacagcgagcacagcgccagaagcctgcacagcgcccacagcctggccagcagaagaagcagcctgagcagccacagccaccagagccagatctacagaagccacaacgtggccgccggcagctacgaggcccccctgccccccggcagcttccacggcgacttcgcctacggcacctacagaagcaacttcagcagcggccccggcttccccgagtacggctaccccgccgacaccgtgtggcccgccatggagcaggtgagcagcagacccaccagccccgagaagttcagcgtgccccacgtgtgcgccagattcggccccggcggccagctgatcaaggtgatccccaacctgcccagcgagggccagcccgccctggtggaggtgcacagcatggaggccctgctgcagcacaccagcgagcaggaggagatgagagccttccccggccccctggccaaggacgacacccacaaggtggacgtgatcaacttcgcccagaacaaggccatgaagtgcctgcagaacgagaacctgatcgacaaggagagcgccagcctgctgtggaacttcatcgtgctgctgtgcagacagaacggcaccgtggtgggcaccgacatcgccgagctgctgctgagagaccacagaaccgtgtggctgcccggcaagagccccaacgaggccaacctgatcgacttcaccaacgaggccgtggagcaggtggaggaggaggagagcggcgaggcccagctgagcttcctgaccggcggccccgccgccgccgccagcagcctggagagagagaccgagagattcagagagctgctgctgtacggcagaaagaaggacgccctggagagcgccatgaagaacggcctgtggggccacgccctgctgctggccagcaagatggacagcagaacccacgccagagtgatgaccagattcgccaacagcctgcccatcaacgaccccctgcagaccgtgtaccagctgatgagcggcagaatgcccgccgccagcacctgctgcggcgacgagaagtggggcgactggagaccccacctggccatggtgctgagcaacctgaacaacaacatggacgtggagagcagaaccatggccaccatgggcgacaccctggccagcagaggcctgctggacgccgcccacttctgctacctgatggcccaggccggcttcggcgtgtacaccaagaagaccaccaagctggtgctgatcggcagcaaccacagcctgcccttcctgaagttcgccaccaacgaggccatccagagaaccgaggcctacgagtacgcccagagcctgggcgccgagacctgccccctgcccagcttccaggtgttcaagttcatctacagctgcagactggccgagatgggcctggccacccaggccttccactactgcgaggccatcgccaagagcatcctgacccagccccacctgtacagccccgtgctgatcagccagctggtgcagatggccagccagctgagactgttcgacccccagctgaaggagaagcccgaggaggagagcctggccgcccccacctggctggtgcacctgcagcaggtggagagacagatcaaggagggcgccggcgtgtggcaccaggacggcgccctgccccagcagtgccccggcacccccagcagcgagatggagcagctggacagacccggcctgagccagcccggcgccctgggcatcgccaaccccctgctggccgtgcccgcccccagccccgagcacagcagccccagcgtgagactgctgcccagcgccccccagaccctgcccgacggccccctggccagccccgccagagtgcccatgttccccgtgcccctgccccccggccccctggagcccggccccggctgcgtgacccccggccccgccctgggcttcctggagcccagcggccccggcctgccccccggcgtgccccccctgcaggagagaagacacctgctgcaggaggccagaagccccgaccccggcatcgtgccccaggaggcccccgtgggcaacagcctgagcgagctgagcgaggagaacttcgacggcaagttcgccaacctgacccccagcagaaccgtgcccgacagcgaggccccccccggctgggacagagccgacagcggccccacccagccccccctgagcctgagccccgcccccgagaccaagagacccggccaggccgccaagaaggagaccaaggagcccaagaagggcgagagctggttcttcagatggctgcccggcaagaagaagaccgaggcctacctgcccgacgacaagaacaagagcatcgtgtgggacgagaagaagaaccagtgggtgaacctgaacgagcccgaggaggagaagaaggcccccccccccccccccaccagcatgcccaagaccgtgcaggccgccccccccgccctgcccggcccccccggcgcccccgtgaacatgtacagcagaagagccgccggcaccagagccagatacgtggacgtgctgaaccccagcggcacccagagaagcgagcccgccctggcccccgccgacttcgtggcccccctggcccccctgcccatccccagcaacctgttcgtgcccacccccgacgccgaggagccccagctgcccgacggcaccggcagagagggccccgccgccgccagaggcctggccaaccccgagcccgcccccgagcccaaggtgctgagcagcgccgccagcctgcccggcagcgagctgcccagcagcagacccgagggcagccagggcggcgaggcccccggcgacctgcccgccgccggcggcccccccagcggcgccatgcccttctacaaccccgcccagctggcccaggcctgcgccaccagcggcagcagcagactgggcagaatcggccagagaaagcacctggtgctgaactag

SEQ ID NO: 98178 - DNA, 603 bp, Artificial Sequence
  Description of Artificial Sequence: Synthetic coding sequence
atgcccaagaccgtgcaggccgccccccccgccctgcccggcccccccggcgcccccgtgaacatgtacagcagaagagccgccggcaccagagccagatacgtggacgtgctgaaccccagcggcacccagagaagcgagcccgccctggcccccgccgacttcgtggcccccctggcccccctgcccatccccagcaacctgttcgtgcccacccccgtgagcagcgtgagaccccagggcagaagcggcagaaacgacggcctgctggccctgagcagccccgacgccgaggagccccagctgcccgacggcaccggcagagagggccccgccgccgccagaggcctggccaaccccgagcccgcccccgagcccaaggtgctgagcagcgccgccagcctgcccggcagcgagctgcccagcagcagacccgagggcagccagggcggcgaggcccccggcgacctgcccgccgccggcggcccccccagcggcgccatgcccttctacaaccccgcccagctggcccaggcctgcgccaccagcggcagcagcagactgggcagaatcggccagagaaagcacctggtgctgaactag

SEQ ID NO: 98179 - DNA, 924 bp, Artificial Sequence
  Description of Artificial Sequence: Synthetic coding sequence
atgagcatgatcctgagcgccagcgtgatcagagtgagagacggcctgcccctgagcgccagcaccgactacgagcagagcaccggcatgcaggagtgcagaaagtacttcaagatgctgagcagaaagctggcccagctgcccgacagatgcaccctgaagaccggccactacaacatcaacttcatcagcagcctgggcgtgagctacatgatgctgtgcaccgagaactaccccaacgtgctggccttcagcttcctggacgagctgcagaaggagttcatcaccacctacaacatgatgaagaccaacaccgccgtgagaccctactgcttcatcgagttcgacaacttcatccagagaaccaagcagagatacaacaaccccagaagcctgagcaccaagatcaacctgagcgacatgcagaccgagatcaagctgagacccccctaccagatcagcatgtgcgagctgggcagcgccaacggcgtgaccagcgccttcagcgtggactgcaagggcgccggcaagatcagcagcgcccaccagagactggagcccgccaccctgagcggcatcgtgggcttcatcctgagcctgctgtgcggcgccctgaacctgatcagaggcttccacgccatcgagagcctgctgcagagcgacggcgacgacttcaactacatcatcgccttcttcctgggcaccgccgcctgcctgtaccagtgctacctgctggtgtactacaccggctggagaaacgtgaagagcttcctgaccttcggcctgatctgcctgtgcaacatgtacctgtacgagctgagaaacctgtggcagctgttcttccacgtgaccgtgggcgccttcgtgaccctgcagatctggctgagacaggcccagggcaaggcccccgactacgacgtgtag

SEQ ID NO: 98180 - DNA, 330 bp, Artificial Sequence
  Description of Artificial Sequence: Synthetic coding sequence
atgagcatgatcctgagcgccagcgtgatcagagtgagagacggcctgcccctgagcgccagcaccgactacgagcagagcaccggcatgcaggagtgcagaaagtacttcaagatgctgagcagaaagctggcccagctgcccgacagatgcaccctgaagaccggccactacaacatcaacttcatcagcagcctgggcgtgagctacatgatgctgtgcaccgagaactaccccaacgtgctggccttcagcttcctggacgagctgcagaaggagttcatcaccacctacaacatgatgaagaccaacaccgccgtgagaccctag

SEQ ID NO: 98181 - DNA, 870 bp, Artificial Sequence
  Description of Artificial Sequence: Synthetic coding sequence
atgagcatgatcctgagcgccagcgtgatcagagtgagagacggcctgcccctgagcgccagcaccgactacgagcagagcaccggcatgcaggagtgcagaaagtacttcaagatgctgagcagaaagctggcccagctgcccgacagatgcaccctgaagaccggccactacaacatcaacttcatcagcagcctgggcgtgagctacatgatgctgtgcaccgagaactaccccaacgtgctggccttcagcttcctggacgagctgcagaaggagttcatcaccacctacaacatgatgaagaccaacaccgccgtgagaccctactgcttcatcgagttcgacaacttcatccagagaaccaagcagagatacaacaaccccagaagcctgagcaccaagatcaacctgagcgacatgcagaccgagatcaagctgagacccccctaccagatcagcatgtgcgagctgggcagcgccaacggcgtgaccagcgccttcagcgtggactgcaagggcgccggcaagatcagcagcgcccaccagagactggagcccgccaccctgagcggcatcgtgggcttcatcctgagcctgctgtgcggcgccctgaacctgatcagaggcttccacgccatcgagagcctgctgcagagcgacggcgacgacttcaactacatcatcgccttcttcctgggcaccgccgcctgcctgtaccagtgctacctgctggtgtactacaccggctggagaaacgtgaagagcttcctgaccttcggcctgatctgcctgtgcaacatgtacctgtacgagctgagaaacctgtggcagctgttcttccacgtgaccgtgggcgccttcgtgtag

SEQ ID NO: 98182 - DNA, 417 bp, Artificial Sequence
  Description of Artificial Sequence: Synthetic coding sequence
atgagcatgatcctgagcgccagcgtgatcagagtgagagacggcctgcccctgagcgccagcaccgactacgagcagagcaccggcatgcaggagtgcagaaagtacttcaagatgctgagcagaaagctggcccagctgcccgacagatgcaccctgaagaccggccactacaacatcaacttcatcagcagcctgggcgtgagctacatgatgctgtgcaccgagaactaccccaacgtgctggccttcagcttcctggacgagctgcagaaggagttcatcaccacctacaacatgatgaagaccaacaccgccgtgagaccctactgcttcatcgagttcgacaacttcatccagagaaccaagcagagatacaacaaccccagaagcctgagcaccaagatcaacctgtag

SEQ ID NO: 98183 - DNA, 657 bp, Artificial Sequence
  Description of Artificial Sequence: Synthetic coding sequence
atgagcatgatcctgagcgccagcgtgatcagagtgagagacggcctgcccctgagcgccagcaccgactacgagcagagcaccggcatgcaggagtgcagaaagtacttcaagatgctgagcagaaagctggcccagctgcccgacagatgcaccctgaagaccggccactacaacatcaacttcatcagcagcctgggcgtgagctacatgatgctgtgcaccgagaactaccccaacgtgctggccttcagcttcctggacgagctgcagaaggagttcatcaccacctacaacatgatgaagaccaacaccgccgtgagaccctactgcttcatcgagttcgacaacttcatccagagaaccaagcagagatacaacaaccccagaagcctgagcaccaagatcaacctgagcgacatgcagaccgagatcaagctgagacccccctaccagatcagcatgtgcgagctgggcagcgccaacggcgtgaccagcgccttcagcgtggactgcaagggcgccggcaagatcagcagcgcccaccagagactggagcccgccaccctgagcggcatcgtgggcttcatcctgagcctgctgtgcggcgccctgaacctgatcagaggcttccacgccatcgagagcctgctgtag

SEQ ID NO: 98184 - DNA, 306 bp, Artificial Sequence
  Description of Artificial Sequence: Synthetic coding sequence
atgagcatgatcctgagcgccagcgtgatcagagtgagagacggcctgcccctgagcgccagcaccgactacgagcagagcaccggcatgcaggagtgcagaaagtacttcaagatgctgagcagaaagctggcccagctgcccgacagatgcaccctgaagaccggccactacaacatcaacttcatcagcagcctgggcgtgagctacatgatgctgtgcaccgagaactaccccaacgtgctggccttcagcttcctggacgagctgcagaaggagttcatcaccacctacaacatgatgtag

SEQ ID NO: 98185 - DNA, 924 bp, Artificial Sequence; identical to SEQ ID NO: 98179
  Description of Artificial Sequence: Synthetic coding sequence

SEQ ID NO: 98186 - DNA, 2298 bp, Artificial Sequence
  Description of Artificial Sequence: Synthetic coding sequence
atgaccacctacctggagttcatccagcagaacgaggagagagacggcgtgagattcagctggaacgtgtggcccagcagcagactggaggccaccagaatggtggtgcccgtggccgccctgttcacccccctgaaggagagacccgacctgccccccatccagtacgagcccgtgctgtgcagcagaaccacctgcagagccgtgctgaaccccctgtgccaggtggactacagagccaagctgtgggcctgcaacttctgctaccagagaaaccagttcccccccagctacgccggcatcagcgagctgaaccagcccgccgagctgctgccccagttcagcagcatcgagtacgtggtgctgagaggcccccagatgcccctgatcttcctgtacgtggtggacacctgcatggaggacgaggacctgcaggccctgaaggagagcatgcagatgagcctgagcctgctgccccccaccgccctggtgggcctgatcaccttcggcagaatggtgcaggtgcacgagctgggctgcgagggcatcagcaagagctacgtgttcagaggcaccaaggacctgagcgccaagcagctgcaggagatgctgggcctgagcaaggtgcccctgacccaggccaccagaggcccccaggtgcagcagcccccccccagcaacagattcctgcagcccgtgcagaagatcgacatgaacctgaccgacctgctgggcgagctgcagagagacccctggcccgtgccccagggcaagagacccctgagaagcagcggcgtggccctgagcatcgccgtgggcctgctggagtgcaccttccccaacaccggcgccagaatcatgatgttcatcggcggccccgccacccagggccccggcatggtggtgggcgacgagctgaagacccccatcagaagctggcacgacatcgacaaggacaacgccaagtacgtgaagaagggcaccaagcacttcgaggccctggccaacagagccgccaccaccggccacgtgatcgacatctacgcctgcgccctggaccagaccggcctgctggagatgaagtgctgccccaacctgaccggcggctacatggtgatgggcgacagcttcaacaccagcctgttcaagcagaccttccagagagtgttcaccaaggacatgcacggccagttcaagatgggcttcggcggcaccctggagatcaagaccagcagagagatcaagatcagcggcgccatcggcccctgcgtgagcctgaacagcaagggcccctgcgtgagcgagaacgagatcggcaccggcggcacctgccagtggaagatctgcggcctgagccccaccaccaccctggccatctacttcgaggtggtgaaccagcacaacgcccccatcccccagggcggcagaggcgccatccagttcgtgacccagtaccagcacagcagcggccagagaagaatcagagtgaccaccatcgccagaaactgggccgacgcccagacccagatccagaacatcgccgccagcttcgaccaggaggccgccgccatcctgatggccagactggccatctacagagccgagaccgaggagggccccgacgtgctgagatggctggacagacagctgatcagactgtgccagaagttcggcgagtaccacaaggacgaccccagcagcttcagattcagcgagaccttcagcctgtacccccagttcatgttccacctgagaagaagcagcttcctgcaggtgttcaacaacagccccgacgagagcagctactacagacaccacttcatgagacaggacctgacccagagcctgatcatgatccagcccatcctgtacgcctacagcttcagcggcccccccgagcccgtgctgctggacagcagcagcatcctggccgacagaatcctgctgatggacaccttcttccagatcctgatctaccacggcgagaccatcgcccagtggagaaagagcggctaccaggacatgcccgagtacgagaacttcagacacctgctgcaggcccccgtggacgacgcccaggagatcctgcacagcagattccccatgcccagatacatcgacaccgagcacggcggcagccaggccagattcctgctgagcaaggtgaaccccagccagacccacaacaacatgtacgcctggggccaggagagcggcgcccccatcctgaccgacgacgtgagcctgcaggtgttcatggaccacctgaagaagctggccgtgagcagcgccgcctag

SEQ ID NO: 98187 - DNA, 1992 bp, Artificial Sequence
  Description of Artificial Sequence: Synthetic coding sequence
atgcccctgatcttcctgtacgtggtggacacctgcatggaggacgaggacctgcaggccctgaaggagagcatgcagatgagcctgagcctgctgccccccaccgccctggtgggcctgatcaccttcggcagaatggtgcaggtgcacgagctgggctgcgagggcatcagcaagagctacgtgttcagaggcaccaaggacctgagcgccaagcagctgcaggagatgctgggcctgagcaaggtgcccctgacccaggccaccagaggcccccaggtgcagcagcccccccccagcaacagattcctgcagcccgtgcagaagatcgacatgaacctgaccgacctgctgggcgagctgcagagagacccctggcccgtgccccagggcaagagacccctgagaagcagcggcgtggccctgagcatcgccgtgggcctgctggagtgcaccttccccaacaccggcgccagaatcatgatgttcatcggcggccccgccacccagggccccggcatggtggtgggcgacgagctgaagacccccatcagaagctggcacgacatcgacaaggacaacgccaagtacgtgaagaagggcaccaagcacttcgaggccctggccaacagagccgccaccaccggccacgtgatcgacatctacgcctgcgccctggaccagaccggcctgctggagatgaagtgctgccccaacctgaccggcggctacatggtgatgggcgacagcttcaacaccagcctgttcaagcagaccttccagagagtgttcaccaaggacatgcacggccagttcaagatgggcttcggcggcaccctggagatcaagaccagcagagagatcaagatcagcggcgccatcggcccctgcgtgagcctgaacagcaagggcccctgcgtgagcgagaacgagatcggcaccggcggcacctgccagtggaagatctgcggcctgagccccaccaccaccctggccatctacttcgaggtggtgaaccagcacaacgcccccatcccccagggcggcagaggcgccatccagttcgtgacccagtaccagcacagcagcggccagagaagaatcagagtgaccaccatcgccagaaactgggccgacgcccagacccagatccagaacatcgccgccagcttcgaccaggaggccgccgccatcctgatggccagactggccatctacagagccgagaccgaggagggccccgacgtgctgagatggctggacagacagctgatcagactgtgccagaagttcggcgagtaccacaaggacgaccccagcagcttcagattcagcgagaccttcagcctgtacccccagagaagagacttccccaagaccagcggcgagatcctggagaaccaggagaaggccagaagcgcctgcctgaagttcatgttccacctgagaagaagcagcttcctgcaggtgttcaacaacagccccgacgagagcagctactacagacaccacttcatgagacaggacctgacccagagcctgatcatgatccagcccatcctgtacgcctacagcttcagcggcccccccgagcccgtgctgctggacagcagcagcatcctggccgacagaatcctgctgatggacaccttcttccagatcctgatctaccacggcgagaccatcgcccagtggagaaagagcggctaccaggacatgcccgagtacgagaacttcagacacctgctgcaggcccccgtggacgacgcccaggagatcctgcacagcagattccccatgcccagatacatcgacaccgagcacggcggcagccaggccagattcctgctgagcaaggtgaaccccagccagacccacaacaacatgtacgcctggggccaggagagcggcgcccccatcctgaccgacgacgtgagcctgcaggtgttcatggaccacctgaagaagctggccgtgagcagcgccgcctag

SEQ ID NO: 98188 - DNA, 1692 bp, Artificial Sequence
  Description of Artificial Sequence: Synthetic coding sequence
atgctgggcctgagcaaggtgcccctgacccaggccaccagaggcccccaggtgcagcagcccccccccagcaacagattcctgcagcccgtgcagaagatcgacatgaacctgaccgacctgctgggcgagctgcagagagacccctggcccgtgccccagggcaagagacccctgagaagcagcggcgtggccctgagcatcgccgtgggcctgctggagtgcaccttccccaacaccggcgccagaatcatgatgttcatcggcggccccgccacccagggccccggcatggtggtgggcgacgagctgaagacccccatcagaagctggcacgacatcgacaaggacaacgccaagtacgtgaagaagggcaccaagcacttcgaggccctggccaacagagccgccaccaccggccacgtgatcgacatctacgcctgcgccctggaccagaccggcctgctggagatgaagtgctgccccaacctgaccggcggctacatggtgatgggcgacagcttcaacaccagcctgttcaagcagaccttccagagagtgttcaccaaggacatgcacggccagttcaagatgggcttcggcggcaccctggagatcaagaccagcagagagatcaagatcagcggcgccatcggcccctgcgtgagcctgaacagcaagggcccctgcgtgagcgagaacgagatcggcaccggcggcacctgccagtggaagatctgcggcctgagccccaccaccaccctggccatctacttcgaggtggtgaaccagcacaacgcccccatcccccagggcggcagaggcgccatccagttcgtgacccagtaccagcacagcagcggccagagaagaatcagagtgaccaccatcgccagaaactgggccgacgcccagacccagatccagaacatcgccgccagcttcgaccaggaggccgccgccatcctgatggccagactggccatctacagagccgagaccgaggagggccccgacgtgctgagatggctggacagacagctgatcagactgtgccagaagttcggcgagtaccacaaggacgaccccagcagcttcagattcagcgagaccttcagcctgtacccccagttcatgttccacctgagaagaagcagcttcctgcaggtgttcaacaacagccccgacgagagcagctactacagacaccacttcatgagacaggacctgacccagagcctgatcatgatccagcccatcctgtacgcctacagcttcagcggcccccccgagcccgtgctgctggacagcagcagcatcctggccgacagaatcctgctgatggacaccttcttccagatcctgatctaccacggcgagaccatcgcccagtggagaaagagcggctaccaggacatgcccgagtacgagaacttcagacacctgctgcaggcccccgtggacgacgcccaggagatcctgcacagcagattccccatgcccagatacatcgacaccgagcacggcggcagccaggccagattcctgctgagcaaggtgaaccccagccagacccacaacaacatgtacgcctggggccaggagagcggcgcccccatcctgaccgacgacgtgagcctgcaggtgttcatggaccacctgaagaagctggccgtgagcagcgccgcctag

SEQ ID NO: 98189 - DNA, 2211 bp, Artificial Sequence
  Description of Artificial Sequence: Synthetic coding sequence
atgaccacctacctggagttcatccagcagaacgaggagagagacggcgtgagattcagctggaacgtgtggcccagcagcagactggaggccaccagaatggtggtgcccgtggccgccctgttcacccccctgaaggagagacccgacctgccccccatccagtacgagcccgtgctgtgcagcagaaccacctgcagagccgtgctgaaccccctgtgccaggtggactacagagccaagctgtgggcctgcaacttctgctaccagagaaaccagagaggcccccagatgcccctgatcttcctgtacgtggtggacacctgcatggaggacgaggacctgcaggccctgaaggagagcatgcagatgagcctgagcctgctgccccccaccgccctggtgggcctgatcaccttcggcagaatggtgcaggtgcacgagctgggctgcgagggcatcagcaagagctacgtgttcagaggcaccaaggacctgagcgccaagcagctgcaggagatgctgggcctgagcaaggtgcccctgacccaggccaccagaggcccccaggtgcagcagcccccccccagcaacagattcctgcagcccgtgcagaagatcgacatgaacctgaccgacctgctgggcgagctgcagagagacccctggcccgtgccccagggcaagagacccctgagaagcagcggcgtggccctgagcatcgccgtgggcctgctggagtgcaccttccccaacaccggcgccagaatcatgatgttcatcggcggccccgccacccagggccccggcatggtggtgggcgacgagctgaagacccccatcagaagctggcacgacatcgacaaggacaacgccaagtacgtgaagaagggcaccaagcacttcgaggccctggccaacagagccgccaccaccggccacgtgatcgacatctacgcctgcgccctggaccagaccggcctgctggagatgaagtgctgccccaacctgaccggcggctacatggtgatgggcgacagcttcaacaccagcctgttcaagcagaccttccagagagtgttcaccaaggacatgcacggccagttcaagatgggcttcggcggcaccctggagatcaagaccagcagagagatcaagatcagcggcgccatcggcccctgcgtgagcctgaacagcaagggcccctgcgtgagcgagaacgagatcggcaccggcggcacctgccagtggaagatctgcggcctgagccccaccaccaccctggccatctacttcgaggtggtgaaccagcacaacgcccccatcccccagggcggcagaggcgccatccagttcgtgacccagtaccagcacagcagcggccagagaagaatcagagtgaccaccatcgccagaaactgggccgacgcccagacccagatccagaacatcgccgccagcttcgaccaggaggccgccgccatcctgatggccagactggccatctacagagccgagaccgaggagggccccgacgtgctgagatggctggacagacagctgatcagactgtgccagaagttcggcgagtaccacaaggacgaccccagcagcttcagattcagcgagaccttcagcctgtacccccagttcatgttccacctgagaagaagcagcttcctgcaggtgttcaacaacagccccgacgagagcagctactacagacaccacttcatgagacaggacctgacccagagcctgatcatgatccagcccatcctgtacgcctacagcttcagcggcccccccgagcccgtgctgctggacagcagcagcatcctggccgacagaatcctgctgatggacaccttcttccagatcctgatctaccacggcgagaccatcgcccagtggagaaagagcggctaccaggacatgcccgagtacgagaacttcagacacctgctgcaggcccccgtggacgacgcccaggagatcctgcacagcagattccccatgcccagatacatcgacaccgagcacggcggcagccaggccagattcctgctgagcaaggtgaaccccagccagacccacaacaacatgtacgcctggggccaggagagcggcgcccccatcctgaccgacgacgtgagcctgcaggtgttcatggaccacctgaagaagctggccgtgagcagcgccgcctag

SEQ ID NO: 98190 - DNA, 510 bp, Artificial Sequence
  Description of Artificial Sequence: Synthetic coding sequence
atgaccacctacctggagttcatccagcagaacgaggagagagacggcgtgagattcagctggaacgtgtggcccagcagcagactggaggccaccagaatggtggtgcccgtggccgccctgttcacccccctgaaggagagacccgacctgccccccatccagtacgagcccgtgctgtgcagcagaaccacctgcagagccgtgctgaaccccctgtgccaggtggactacagagccaagctgtgggcctgcaacttctgctaccagagaaaccagttcccccccagctacgccggcatcagcgagctgaaccagcccgccgagctgctgccccagttcagcagcatcgagtacgtggtgctgagaggcccccagatgcccctgatcttcctgtacgtggtggacacctgcatggaggacgaggacctgcaggccctgaaggagagcatgcagatgagcctgagcctgctgccccccaccgccctggtgggcctgatcaccttctag

SEQ ID NO: 98191 - DNA, 285 bp, Artificial Sequence
  Description of Artificial Sequence: Synthetic coding sequence
atgaccacctacctggagttcatccagcagaacgaggagagagacggcgtgagattcagctggaacgtgtggcccagcagcagactggaggccaccagaatggtggtgcccgtggccgccctgttcacccccctgaaggagagacccgacctgccccccatccagtacgagcccgtgctgtgcagcagaaccacctgcagagccgtgctgaaccccctgtgccaggtggactacagagccaagctgtgggcctgcaacttctgctaccagagaaaccaggtgtag

SEQ ID NO: 98192 - DNA, 423 bp, Artificial Sequence
  Description of Artificial Sequence: Synthetic coding sequence
atgaccacctacctggagttcatccagcagaacgaggagagagacggcgtgagattcagctggaacgtgtggcccagcagcagactggaggccaccagaatggtggtgcccgtggccgccctgttcacccccctgaaggagagacccgacctgccccccatccagtacgagcccgtgctgtgcagcagaaccacctgcagagccgtgctgaaccccctgtgccaggtggactacagagccaagctgtgggcctgcaacttctgctaccagagaaaccagttcccccccagctacgccggcatcagcgagctgaaccagcccgccgagctgctgccccagttcagcagcatcgagtacgtggtgctgagaggcccccagatgcccctgatcttcctgtacgtggtggacacctgcatggagtag

SEQ ID NO: 98193 - DNA, 123 bp, Artificial Sequence
  Description of Artificial Sequence: Synthetic coding sequence
atgaccacctacctggagttcatccagcagaacgaggagagagacggcgtgagattcagctggaacgtgtggcccagcagcagactggaggccaccagaatggtggtgcccgtggccgcctag

SEQ ID NO: 98194 - DNA, 2304 bp, Artificial Sequence
  Description of Artificial Sequence: Synthetic coding sequence
atggccacctacctggagttcatccagcagaacgaggagagagacggcgtgagattcagctggaacgtgtggcccagcagcagactggaggccaccagaatggtggtgcccctggcctgcctgctgacccccctgaaggagagacccgacctgccccccgtgcagtacgagcccgtgctgtgcagcagacccacctgcaaggccgtgctgaaccccctgtgccaggtggactacagagccaagctgtgggcctgcaacttctgcttccagagaaaccagttcccccccgcctacggcggcatcagcgaggtgaaccagcccgccgagctgatgccccagttcagcaccatcgagtacgtgatccagagaggcgcccagagccccctgatcttcctgtacgtggtggacacctgcctggaggaggacgacctgcaggccctgaaggagagcctgcagatgagcctgagcctgctgccccccgacgccctggtgggcctgatcaccttcggcagaatggtgcaggtgcacgagctgagctgcgagggcatcagcaagagctacgtgttcagaggcaccaaggacctgaccgccaagcagatccaggacatgctgggcctgaccaagcccgccatgcccatgcagcaggccagacccgcccagccccaggagcaccccttcgccagcagcagattcctgcagcccgtgcacaagatcgacatgaacctgaccgacctgctgggcgagctgcagagagacccctggcccgtgacccagggcaagagacccctgagaagcaccggcgtggccctgagcatcgccgtgggcctgctggagggcaccttccccaacaccggcgccagaatcatgctgttcaccggcggcccccccacccagggccccggcatggtggtgggcgacgagctgaagatccccatcagaagctggcacgacatcgagaaggacaacgccagattcatgaagaaggccaccaagcactacgagatgctggccaacagaaccgccgccaacggccactgcatcgacatctacgcctgcgccctggaccagaccggcctgctggagatgaagtgctgcgccaacctgaccggcggctacatggtgatgggcgacagcttcaacaccagcctgttcaagcagaccttccagagaatcttcaccaaggacttcaacggcgacttcagaatggccttcggcgccaccctggacgtgaagaccagcagagagctgaagatcgccggcgccatcggcccctgcgtgagcctgaacgtgaagggcccctgcgtgagcgagaacgagctgggcgtgggcggcaccagccagtggaagatctgcggcctggaccccaccagcaccctgggcatctacttcgaggtggtgaaccagcacaacacccccatcccccagggcggcagaggcgccatccagttcgtgacccactaccagcacagcagcacccagagaagaatcagagtgaccaccatcgccagaaactgggccgacgtgcagagccagctgagacacatcgaggccgccttcgaccaggaggccgccgccgtgctgatggccagactgggcgtgttcagagccgagagcgaggagggccccgacgtgctgagatggctggacagacagctgatcagactgtgccagaagttcggccagtacaacaaggaggaccccaccagcttcagactgagcgacagcttcagcctgtacccccagttcatgttccacctgagaagaagccccttcctgcaggtgttcaacaacagccccgacgagagcagctactacagacaccacttcgccagacaggacctgacccagagcctgatcatgatccagcccatcctgtacagctacagcttccacggcccccccgagcccgtgctgctggacagcagcagcatcctggccgacagaatcctgctgatggacaccttcttccagatcgtgatctacctgggcgagaccatcgcccagtggagaaaggccggctaccaggacatgcccgagtacgagaacttcaagcacctgctgcaggcccccctggacgacgcccaggagatcctgcaggccagattccccatgcccagatacatcaacaccgagcacggcggcagccaggccagattcctgctgagcaaggtgaaccccagccagacccacaacaacctgtacgcctggggccaggagaccggcgcccccatcctgaccgacgacgtgagcctgcaggtgttcatggaccacctgaagaagctggccgtgagcagcgcctgctag

SEQ ID NO: 98195 - DNA, 2304 bp, Artificial Sequence; identical to SEQ ID NO: 98194
  Description of Artificial Sequence: Synthetic coding sequence

SEQ ID NO: 98196 - DNA, 2304 bp, Artificial Sequence; identical to SEQ ID NO: 98194
  Description of Artificial Sequence: Synthetic coding sequence

SEQ ID NO: 98197 - DNA, 2304 bp, Artificial Sequence; identical to SEQ ID NO: 98194
  Description of Artificial Sequence: Synthetic coding sequence

SEQ ID NO: 98198 - DNA, 741 bp, Artificial Sequence
  Description of Artificial Sequence: Synthetic coding sequence
cagagaagaatcagagtgaccaccatcgccagaaactgggccgacgtgcagagccagctgagacacatcgaggccgccttcgaccaggaggccgccgccgtgctgatggccagactgggcgtgttcagagccgagagcgaggagggccccgacgtgctgagatggctggacagacagctgatcagactgtgccagaagttcggccagtacaacaaggaggaccccaccagcttcagactgagcgacagcttcagcctgtacccccagttcatgttccacctgagaagaagccccttcctgcaggtgttcaacaacagccccgacgagagcagctactacagacaccacttcgccagacaggacctgacccagagcctgatcatgatccagcccatcctgtacagctacagcttccacggcccccccgagaccatcgcccagtggagaaaggccggctaccaggacatgcccgagtacgagaacttcaagcacctgctgcaggcccccctggacgacgcccaggagatcctgcaggccagattccccatgcccagatacatcaacaccgagcacggcggcagccaggccagattcctgctgagcaaggtgaaccccagccagacccacaacaacctgtacgcctggggccaggagaccggcgcccccatcctgaccgacgacgtgagcctgcaggtgttcatggaccacctgaagaagctggccgtgagcagcgcctgctag

SEQ ID NO: 98199 - DNA, 996 bp, Artificial Sequence
  Description of Artificial Sequence: Synthetic coding sequence
atggccacctacctggagttcatccagcagaacgaggagagagacggcgtgagattcagctggaacgtgtggcccagcagcagactggaggccaccagaatggtggtgcccctggcctgcctgctgacccccctgaaggagagacccgacctgccccccgtgcagtacgagcccgtgctgtgcagcagacccacctgcaaggccgtgctgaaccccctgtgccaggtggactacagagccaagctgtgggcctgcaacttctgcttccagagaaaccagttcccccccgcctacggcggcatcagcgaggtgaaccagcccgccgagctgatgccccagttcagcaccatcgagtacgtgatccagagaggcgcccagagccccctgatcttcctgtacgtggtggacacctgcctggaggaggacgacctgcaggccctgaaggagagcctgcagatgagcctgagcctgctgccccccgacgccctggtgggcctgatcaccttcggcagaatggtgcaggtgcacgagctgagctgcgagggcatcagcaagagctacgtgttcagaggcaccaaggacctgaccgccaagcagatccaggacatgctgggcctgaccaagcccgccatgcccatgcagcaggccagacccgcccagccccaggagcaccccttcgccagcagcagattcctgcagcccgtgcacaagatcgacatgaacctgaccgacctgctgggcgagctgcagagagacccctggcccgtgacccagggcaagagacccctgagaagcaccggcgtggccctgagcatcgccgtgggcctgctggagggcaccttccccaacaccggcgccagaatcatgctgttcaccggcggcccccccacccagggccccggcatggtggtgggcgacgagctgaagatccccatcagaagctggcacgacatcgagaaggacaacgccagattcatgaagaaggccaccaagtag

SEQ ID NO: 98200 - DNA, 1200 bp, Artificial Sequence
  Description of Artificial Sequence: Synthetic coding sequence
atggccgagagaagaagacacaagaagagaatccaggaggtgggcgagcccagcaaggaggagaaggccgtggccaagtacctgagattcaactgccccaccaagagcaccaacatgatgggccacagagtggactacttcatcgccagcaaggccgtggactgcctgctggacagcaagtgggccaaggccaagaagggcgaggaggccctgttcaccaccagagagagcgtggtggactactgcaacagactgctgaagaagcagttcttccacagagccctgaaggtgatgaagatgaagtacgacaaggacatcaagaaggagaaggacaagggcaaggccgagagcggcaaggaggaggacaagaagagcaagaaggagaacatcaaggacgagaagaccaagaaggagaaggagaagaagaaggacggcgagaaggaggagagcaagaaggaggagacccccggcacccccaagaagaaggagaccaagaagaagttcaagctggagccccacgacgaccaggtgttcctggacggcaacgaggtgtacgtgtggatctacgaccccgtgcacttcaagaccttcgtgatgggcctgatcctggtgatcgccgtgatcgccgccaccctgttccccctgtggcccgccgagatgagagtgggcgtgtactacctgagcgtgggcgccggctgcttcgtggccagcatcctgctgctggccgtggccagatgcatcctgttcctgatcatctggctgatcaccggcggcagacaccacttctggttcctgcccaacctgaccgccgacgtgggcttcatcgacagcttcagacccctgtacacccacgagtacaagggccccaaggccgacctgaagaaggacgagaagagcgagaccaagaagcagcagaagagcgacagcgaggagaagagcgacagcgagaagaaggaggacgaggagggcaaggtgggccccggcaaccacggcaccgagggcagcggcggcgagagacacagcgacaccgacagcgacagaagagaggacgacagaagccagcacagcagcggcaacggcaacgacttcgagatgatcaccaaggaggagctggagcagcagaccgacggcgactgcgaggaggacgaggaggaggagaacgacggcgagacccccaagagcagccacgagaagagctag

SEQ ID NO: 98201 - DNA, 1200 bp, Artificial Sequence; identical to SEQ ID NO: 98200
  Description of Artificial Sequence: Synthetic coding sequence

SEQ ID NO: 98202 - DNA, 372 bp, Artificial Sequence
  Description of Artificial Sequence: Synthetic coding sequence
atggccgagagaagaagacacaagaagagaatccaggaggtgggcgagcccagcaaggacgagaagagcgagaccaagaagcagcagaagagcgacagcgaggagaagagcgacagcgagaagaaggaggacgaggagggcaaggtgggccccggcaaccacggcaccgagggcagcggcggcgagagacacagcgacaccgacagcgacagaagagaggacgacagaagccagcacagcagcggcaacggcaacgacttcgagatgatcaccaaggaggagctggagcagcagaccgacggcgactgcgaggaggacgaggaggaggagaacgacggcgagacccccaagagcagccacgagaagagctag

SEQ ID NO: 98203 - DNA, 2283 bp, Artificial Sequence
  Description of Artificial Sequence: Synthetic coding sequence
atggccggccagcagttccagtacgacgacagcggcaacaccttcttctacttcctgaccagcttcgtgggcctgatcgtgatccccgccacctactacctgtggcccagagaccagaacgccgagcagatcagactgaagaacatcagaaaggtgtacggcagatgcatgtggtacagactgagactgctgaagccccagcccaacatcatccccaccgtgaagaagatcgtgctgctggccggctgggccctgttcctgttcctggcctacaaggtgagcaagaccgacagagagtaccaggagtacaacccctacgaggtgctgaacctggaccccggcgccaccgtggccgagatcaagaagcagtacagactgctgagcctgaagtaccaccccgacaagggcggcgacgaggtgatgttcatgagaatcgccaaggcctacgccgccctgaccgacgaggagagcagaaagaactgggaggagttcggcaaccccgacggcccccaggccaccagcttcggcatcgccctgcccgcctggatcgtggaccagaagaacagcatcctggtgctgctggtgtacggcctggccttcatggtgatcctgcccgtggtggtgggcagctggtggtacagaagcatcagatacagcggcgaccagatcctgatcagaaccacccagatctacacctacttcgtgtacaagaccagaaacatggacatgaagagactgatcatggtgctggccggcgccagcgagttcgacccccagtacaacaaggacgccaccagcagacccaccgacaacatcctgatcccccagctgatcagagagatcggcagcatcaacctgaagaagaacgagccccccctgacctgcccctacagcctgaaggccagagtgctgctgctgagccacctggccagaatgaagatccccgagaccctggaggaggaccagcagttcatgctgaagaagtgccccgccctgctgcaggagatggtgaacgtgatctgccagctgatcgtgatggccagaaacagagaggagagagagttcagagcccccaccctggccagcctggagaactgcatgaagctgagccagatggccgtgcagggcctgcagcagttcaagagccccctgctgcagctgccccacatcgaggaggacaacctgagaagagtgagcaaccacaagaagtacaagatcaagaccatccaggacctggtgagcctgaaggagagcgacagacacaccctgctgcacttcctggaggacgagaagtacgaggaggtgatggccgtgctgggcagcttcccctacgtgaccatggacatcaagagccaggtgctggacgacgaggacagcaacaacatcaccgtgggcagcctggtgaccgtgctggtgaagctgaccagacagaccatggccgaggtgttcgagaaggagcagagcatctgcgccgccgaggagcagcccgccgaggacggccagggcgagaccaacaagaacagaaccaagggcggctggcagcagaagagcaagggccccaagaagaccgccaagagcaagaagaagaagcccctgaagaagaagcccacccccgtgctgctgccccagagcaagcagcagaagcagaagcaggccaacggcgtggtgggcaacgaggccgccgtgaaggaggacgaggaggaggtgagcgacaagggcagcgacagcgaggaggaggagaccaacagagacagccagagcgagaaggacgacggcagcgacagagacagcgacagagagcaggacgagaagcagaacaaggacgacgaggccgagtggcaggagctgcagcagagcatccagagaaaggagagagccctgctggagaccaagagcaagatcacccaccccgtgtacagcctgtacttccccgaggagaagcaggagtggtggtggctgtacatcgccgacagaaaggagcagaccctgatcagcatgccctaccacgtgtgcaccctgaaggacaccgaggaggtggagctgaagttccccgcccccggcaagcccggcaactaccagtacaccgtgttcctgagaagcgacagctacatgggcctggaccagatcaagcccctgaagctggaggtgcacgaggccaagcccgtgcccgagaaccacccccagtgggacaccgccatcgagggcgacgaggaccaggaggacagcgagggcttcgaggacagcttcgaggaggaggaggaggaggaggaggacgacgactag

SEQ ID NO: 98204 - DNA, 1254 bp, Artificial Sequence
  Description of Artificial Sequence: Synthetic coding sequence
atgttcatgagaatcgccaaggcctacgccgccctgaccgacgaggagagcagaaagaactgggaggagttcggcaaccccgacggcccccaggccaccagcttcggcatcgccctgcccgcctggatcgtggaccagaagaacagcatcctggtgctgctggtgtacggcctggccttcatggtgatcctgcccgtggtggtgggcagctggtggtacagaagcatcagatacagcggcgaccagatcctgatcagaaccacccagatctacacctacttcgtgtacaagaccagaaacatggacatgaagagactgatcatggtgctggccggcgccagcgagttcgacccccagtacaacaaggacgccaccagcagacccaccgacaacatcctgatcccccagctgatcagagagatcggcagcatcaacctgaagaagaacgagccccccctgacctgcccctacagcctgaaggccagagtgctgctgctgagccacctggccagaatgaagatccccgagaccctggaggaggaccagcagttcatgctgaagaagtgccccgccctgctgcaggagatggtgaacgtgatctgccagctgatcgtgatggccagaaacagagaggagagagagttcagagcccccaccctggccagcctggagaactgcatgaagctgagccagatggccgtgcagggcctgcagcagttcaagagccccctgctgcagctgccccacatcgaggaggacaacctgagaagagtgagcaaccacaagaagtacaagatcaagaccatccaggacctggtgagcctgaaggagagcgacagacacaccctgctgcacttcctggaggacgagaagtacgaggaggtgatggccgtgctgggcagcttcccctacgtgaccatggacatcaagagccaggtgctggacgacgaggacagcaacaacatcaccgtgggcagcctggtgaccgtgctggtgaagctgaccagacagaccatggccgaggtgttcgagaaggagcagagcatctgcgccgccgaggagcagcccgccgaggacggccagggcgagaccaacaagaacagaaccaagggcggctggcagcagaagagcaagggccccaagaagaccgccaagaagaagaaggagaccttcaagaagaagacctacacctgcgccatcaccaccgtgaaggccaccgagaccaaggccggcaagtggagcagatgggagtag

SEQ ID NO: 98205 - DNA, 1137 bp, Artificial Sequence
  Description of Artificial Sequence: Synthetic coding sequence
gagcacgagagagagttcagagcccccaccctggccagcctggagaactgcatgaagctgagccagatggccgtgcagggcctgcagcagttcaagagccccctgctgcagctgccccacatcgaggaggacaacctgagaagagtgagcaaccacaagaagtacaagatcaagaccatccaggacctggtgagcctgaaggagagcgacagacacaccctgctgcacttcctggaggacgagaagtacgaggaggtgatggccgtgctgggcagcttcccctacgtgaccatggacatcaagagccaggtgctggacgacgaggacagcaacaacatcaccgtgggcagcctggtgaccgtgctggtgaagctgaccagacagaccatggccgaggtgttcgagaaggagcagagcatctgcgccgccgaggagcagcccgccgaggacggccagggcgagaccaacaagaacagaaccaagggcggctggcagcagaagagcaagggccccaagaagaccgccaagagcaagaagaagaagcccctgaagaagaagcccacccccgtgctgctgccccagagcaagcagcagaagcagaagcaggccaacggcgtggtgggcaacgaggccgccgtgaaggaggacgaggaggaggtgagcgacaagggcagcgacagcgaggaggagtggcaggagctgcagcagagcatccagagaaaggagagagccctgctggagaccaagagcaagatcacccaccccgtgtacagcctgtacttccccgaggagaagcaggagtggtggtggctgtacatcgccgacagaaaggagcagaccctgatcagcatgccctaccacgtgtgcaccctgaaggacaccgaggaggtggagctgaagttccccgcccccggcaagcccggcaactaccagtacaccgtgttcctgagaagcgacagctacatgggcctggaccagatcaagcccctgaagctggaggtgcacgaggccaagcccgtgcccgagaaccacccccagtgggacaccgccatcgagggcgacgaggaccaggaggacagcgagggcttcgaggacagcttcgaggaggaggaggaggaggaggaggacgacgactag

SEQ ID NO: 98206 - DNA, 2346 bp, Artificial Sequence
  Description of Artificial Sequence: Synthetic coding sequence
atggtgagagtgctgagaagcatgtgcctgccccagctgtgcagccacatcctgagcgtgtgcagcggcaccaccagcgacagaaacgtgtacagcgtgcccggcagccagtacctgtacaaccagcccagctgctacagaggcttccagaccgtgaagcacagaaacgagaacacctgccccctgccccaggagatgaaggccctgttcaagaagaagacctacgacgagaagaagacctacgaccagcagaagttcgacagcgagagagccgacggcaccatcagcagcgagatcaagagcgccagaggcagccaccacctgagcatctacgccgagaacagcctgaagagcgacggctaccacaagagaaccgacagaaagagcagaatcatcgccaagaacgtgagcaccagcaagcccgagttcgagttcaccaccctggacttccccgagctgcagggcgccgagaacaacatgagcgagatccagaagcagcccaagtggggccccgtgcacagcgtgagcaccgacatcagcctgctgagagaggtggtgaagcccgccgccgtgctgagcaagggcgagatcgtggtgaagaacaaccccaacgagagcgtgaccgccaacgccgccaccaacagccccagctgcaccagagagctgagctggacccccatgggctacgtggtgagacagaccctgagcaccgagctgagcgccgcccccaagaacgtgaccagcatgatcaacctgaagaccatcgccagcagcgccgaccccaagaacgtgagcatccccagcagcgaggccctgagcagcgaccccagctacaacaaggagaagcacatcatccaccccacccagaagagcaaggccagccagggcagcgacctggagcagaacgaggccagcagaaagaacaagaagaagaaggagaagagcaccagcaagtacgaggtgctgaccgtgcaggagccccccagaatcgaggacgccgaggagttccccaacctggccgtggccagcgagagaagagacagaatcgagacccccaagttccagagcaagcagcagccccaggacaacttcaagaacaacgtgaagaagagccagctgcccgtgcagctggacctgggcggcatgctgaccgccctggagaagaagcagcacagccagcacgccaagcagagcagcaagcccgtggtggtgagcgtgggcgccgtgcccgtgctgagcaaggagtgcgccagcggcgagagaggcagaagaatgagccagatgaagaccccccacaaccccctggacagcagcgcccccctgatgaagaagggcaagcagagagagatccccaaggccaagaagcccaccagcctgaagaagatcatcctgaaggagagacaggagagaaagcagagactgcaggagaacgccgtgagccccgccttcaccagcgacgacacccaggacggcgagagcggcggcgacgaccagttccccgagcaggccgagctgagcggccccgagggcatggacgagctgatcagcacccccagcgtggaggacaagagcgaggagccccccggcaccgagctgcagagagacaccgaggccagccacctggcccccaaccacaccaccttccccaagatccacagcagaagattcagagactactgcagccagatgctgagcaaggaggtggacgcctgcgtgaccgacctgctgaaggagctggtgagattccaggacagaatgtaccagaaggaccccgtgaaggccaagaccaagagaagactggtgctgggcctgagagaggtgctgaagcacctgaagctgaagaagctgaagtgcgtgatcatcagccccaactgcgagaagatccagagcaagggcggcctggacgacaccctgcacaccatcatcgactacgcctgcgagcagaacatccccttcgtgttcgccctgaacagaaaggccctgggcagaagcctgaacaaggccgtgcccgtgagcgtggtgggcatcttcagctacgacggcgcccaggaccagttccacaagatggtggagctgaccgtggccgccagacaggcctacaagaccatgctggagaacgtgcagcaggagctggtgggcgagcccagaccccaggccccccccagcctgcccacccagggccccagctgccccgccgaggacggcccccccgccctgaaggagaaggaggagccccactacatcgagatctggaagaagcacctggaggcctacagcggctgcaccctggagctggaggagagcctggaggccagcaccagccagatgatgaacctgaacctgtag

SEQ ID NO: 98207 - DNA, 2565 bp, Artificial Sequence
  Description of Artificial Sequence: Synthetic coding sequence
atggccagcgagggccccagagagcccgagagcgagggcatcaagctgagcgccgacgtgaagcccttcgtgcccagattcgccggcctgaacgtggcctggctggagagcagcgaggcctgcgtgttccccagcagcgccgccacctactaccccttcgtgcaggagccccccgtgaccgagcagaagatctacaccgaggacatggccttcggcgccagcaccttccccccccagtacctgagcagcgagatcaccctgcacccctacgcctacagcccctacaccctggacagcacccagaacgtgtacagcgtgcccggcagccagtacctgtacaaccagcccagctgctacagaggcttccagaccgtgaagcacagaaacgagaacacctgccccctgccccaggagatgaaggccctgttcaagaagaagacctacgacgagaagaagacctacgaccagcagaagttcgacagcgagagagccgacggcaccatcagcagcgagatcaagagcgccagaggcagccaccacctgagcatctacgccgagaacagcctgaagagcgacggctaccacaagagaaccgacagaaagagcagaatcatcgccaagaacgtgagcaccagcaagcccgagttcgagttcaccaccctggacttccccgagctgcagggcgccgagaacaacatgagcgagatccagaagcagcccaagtggggccccgtgcacagcgtgagcaccgacatcagcctgctgagagaggtggtgaagcccgccgccgtgctgagcaagggcgagatcgtggtgaagaacaaccccaacgagagcgtgaccgccaacgccgccaccaacagccccagctgcaccagagagctgagctggacccccatgggctacgtggtgagacagaccctgagcaccgagctgagcgccgcccccaagaacgtgaccagcatgatcaacctgaagaccatcgccagcagcgccgaccccaagaacgtgagcatccccagcagcgaggccctgagcagcgaccccagctacaacaaggagaagcacatcatccaccccacccagaagagcaaggccagccagggcagcgacctggagcagaacgaggccagcagaaagaacaagaagaagaaggagaagagcaccagcaagtacgaggtgctgaccgtgcaggagccccccagaatcgaggacgccgaggagttccccaacctggccgtggccagcgagagaagagacagaatcgagacccccaagttccagagcaagcagcagccccaggacaacttcaagaacaacgtgaagaagagccagctgcccgtgcagctggacctgggcggcatgctgaccgccctggagaagaagcagcacagccagcacgccaagcagagcagcaagcccgtggtggtgagcgtgggcgccgtgcccgtgctgagcaaggagtgcgccagcggcgagagaggcagaagaatgagccagatgaagaccccccacaaccccctggacagcagcgcccccctgatgaagaagggcaagcagagagagatccccaaggccaagaagcccaccagcctgaagaagatcatcctgaaggagagacaggagagaaagcagagactgcaggagaacgccgtgagccccgccttcaccagcgacgacacccaggacggcgagagcggcggcgacgaccagttccccgagcaggccgagctgagcggccccgagggcatggacgagctgatcagcacccccagcgtggaggacaagagcgaggagccccccggcaccgagctgcagagagacaccgaggccagccacctggcccccaaccacaccaccttccccaagatccacagcagaagattcagagactactgcagccagatgctgagcaaggaggtggacgcctgcgtgaccgacctgctgaaggagctggtgagattccaggacagaatgtaccagaaggaccccgtgaaggccaagaccaagagaagactggtgctgggcctgagagaggtgctgaagcacctgaagctgaagaagctgaagtgcgtgatcatcagccccaactgcgagaagatccagagcaagggcggcctggacgacaccctgcacaccatcatcgactacgcctgcgagcagaacatccccttcgtgttcgccctgaacagaaaggccctgggcagaagcctgaacaaggccgtgcccgtgagcgtggtgggcatcttcagctacgacggcgcccaggaccagttccacaagatggtggagctgaccgtggccgccagacaggcctacaagaccatgctggagaacgtgcagcaggagctggtgggcgagcccagaccccaggccccccccagcctgcccacccagggccccagctgccccgccgaggacggcccccccgccctgaaggagaaggaggagccccactacatcgagatctggaagaagcacctggaggcctacagcggctgcaccctggagctggaggagagcctggaggccagcaccagccagatgatgaacctgaacctgtag

SEQ ID NO: 98208 - DNA, 2583 bp, Artificial Sequence
  Description of Artificial Sequence: Synthetic coding sequence
cccgccagcagaagacccgccgccggcctgagagacgccgccagcagcgcccccagaggcatggccagcgagggccccagagagcccgagagcgagggcatcaagctgagcgccgacgtgaagcccttcgtgcccagattcgccggcctgaacgtggcctggctggagagcagcgaggcctgcgtgttccccagcagcgccgccacctactaccccttcgtgcaggagccccccgtgaccgagcagaagatctacaccgaggacatggccttcggcgccagcaccttccccccccagtacctgagcagcgagatcaccctgcacccctacgcctacagcccctacaccctggacagcacccagaacgtgtacagcgtgcccggcagccagtacctgtacaaccagcccagctgctacagaggcttccagaccgtgaagcacagaaacgagaacacctgccccctgccccaggagatgaaggccctgttcaagaagaagacctacgacgagaagaagacctacgaccagcagaagttcgacagcgagagagccgacggcaccatcagcagcgagatcaagagcgccagaggcagccaccacctgagcatctacgccgagaacagcctgaagagcgacggctaccacaagagaaccgacagaaagagcagaatcatcgccaagaacgtgagcaccagcaagcccgagttcgagttcaccaccctggacttccccgagctgcagggcgccgagaacaacatgagcgagatccagaagcagcccaagtggggccccgtgcacagcgtgagcaccgacatcagcctgctgagagaggtggtgaagcccgccgccgtgctgagcaagggcgagatcgtggtgaagaacaaccccaacgagagcgtgctgatgcccctgcccatcctgctgcacgtgcaggagaccctgagcaccgagctgagcgccgcccccaagaacgtgaccagcatgatcaacctgaagaccatcgccagcagcgccgaccccaagaacgtgagcatccccagcagcgaggccctgagcagcgaccccagctacaacaaggagaagcacatcatccaccccacccagaagagcaaggccagccagggcagcgacctggagcagaacgaggccagcagaaagaacaagaagaagaaggagaagagcaccagcaagtacgaggtgctgaccgtgcaggagccccccagaatcgaggacgccgaggagttccccaacctggccgtggccagcgagagaagagacagaatcgagacccccaagttccagagcaagcagcagccccaggacaacttcaagaacaacgtgaagaagagccagctgcccgtgcagctggacctgggcggcatgctgaccgccctggagaagaagcagcacagccagcacgccaagcagagcagcaagcccgtggtggtgagcgtgggcgccgtgcccgtgctgagcaaggagtgcgccagcggcgagagaggcagaagaatgagccagatgaagaccccccacaaccccctggacagcagcgcccccctgatgaagaagggcaagcagagagagatccccaaggccaagaagcccaccagcctgaagaagatcatcctgaaggagagacaggagagaaagcagagactgcaggagaacgccgtgagccccgccttcaccagcgacgacacccaggacggcgagagcggcggcgacgaccagttccccgagcaggccgagctgagcggccccgagggcatggacgagctgatcagcacccccagcgtggaggacaagagcgaggagccccccggcaccgagctgcagagagacaccgaggccagccacctggcccccaaccacaccaccttccccaagatccacagcagaagattcagagactactgcagccagatgctgagcaaggaggtggacgcctgcgtgaccgacctgctgaaggagctggtgagattccaggacagaatgtaccagaaggaccccgtgaaggccaagaccaagagaagactggtgctgggcctgagagaggtgctgaagcacctgaagctgaagaagctgaagtgcgtgatcatcagccccaactgcgagaagatccagagcaagggcggcctggacgacaccctgcacaccatcatcgactacgcctgcgagcagaacatccccttcgtgttcgccctgaacagaaaggccctgggcagaagcctgaacaaggccgtgcccgtgagcgtggtgggcatcttcagctacgacggcgcccaggaccagttccacaagatggtggagctgaccgtggccgccagacaggcctacaagaccatgctggagaacgtgcagcaggagctggtgggcgagcccagaccccaggccccccccagcctgcccacccagggccccagctgccccgccgaggacggcccccccgccctgaaggagaaggaggagccccactacatcgagatctggaagaagcacctggaggcctacagcggctgcaccctggagctggaggagagcctggaggccagcaccagccagatgatgaacctgaacctgtag

SEQ ID NO: 98209 - DNA, 828 bp, Artificial Sequence
  Description of Artificial Sequence: Synthetic coding sequence
ggcaccatcagcagcgagatcaagagcgccagaggcagccaccacctgagcatctacgccgagaacagcctgaagagcgacggctaccacaagagaaccgacagaaagagcagaatcatcgccaagaacgtgagcaccagcaagcccgagttcgagttcaccaccctggacttccccgagctgcagggcgccgagaacaacatgagcgagatccagaagcagcccaagtggggccccgtgcacagcgtgagcaccgacatcagcctgctgagagaggtggtgaagcccgccgccgtgctgagcaagggcgagatcgtggtgaagaacaaccccaacgagagcgtgaccgccaacgccgccaccaacagccccagctgcaccagagccgaccccaagaacgtgagcatccccagcagcgaggccctgagcagcgaccccagctacaacaaggagaagcacatcatccaccccacccagaagagcaaggccagccagggcagcgacctggagcagaacgaggccagcagaaagaacaagaagaagaaggagaagagcaccagcaagtacgaggtgctgaccgtgcaggagccccccagaatcgaggacgccgaggagttccccaacctggccgtggccagcgagagaagagacagaatcgagacccccaagttccagagcaagcagcagccccaggacaacttcaagaacaacgtgaagaagagccagctgcccgtgcagctggacctgggcggcatgctgaccgccctggagaagaagcagcacagccagcacgccaagcagagcagcaagcccgtggtggtgagctag

SEQ ID NO: 98210 - DNA, 183 bp, Artificial Sequence
  Description of Artificial Sequence: Synthetic coding sequence
atgcccctgcccatcctgctgcacgtgcaggagcagatcctgaagatgctggtgtaccacctgctgaagctgtacctgagaatcctgcccaccaccaagaagaacaccctgttcatcctgcccaagagcctgaagcaccacaaggtggtgaccctgaacaagatgaagccccaggagagatag

SEQ ID NO: 98211 - DNA, 2361 bp, Artificial Sequence
  Description of Artificial Sequence: Synthetic coding sequence
atggccttcggcgccagcaccttccccccccagtacctgagcagcgagatcaccctgcacccctacgcctacagcccctacaccctggacagcacccagaacgtgtacagcgtgcccggcagccagtacctgtacaaccagcccagctgctacagaggcttccagaccgtgaagcacagaaacgagaacacctgccccctgccccaggagatgaaggccctgttcaagaagaagacctacgacgagaagaagacctacgaccagcagaagttcgacagcgagagagccgacggcaccatcagcagcgagatcaagagcgccagaggcagccaccacctgagcatctacgccgagaacagcctgaagagcgacggctaccacaagagaaccgacagaaagagcagaatcatcgccaagaacgtgagcaccagcaagcccgagttcgagttcaccaccctggacttccccgagctgcagggcgccgagaacaacatgagcgagatccagaagcagcccaagtggggccccgtgcacagcgtgagcaccgacatcagcctgctgagagaggtggtgaagcccgccgccgtgctgagcaagggcgagatcgtggtgaagaacaaccccaacgagagcgtgaccgccaacgccgccaccaacagccccagctgcaccagagagctgagctggacccccatgggctacgtggtgagacagaccctgagcaccgagctgagcgccgcccccaagaacgtgaccagcatgatcaacctgaagaccatcgccagcagcgccgaccccaagaacgtgagcatccccagcagcgaggccctgagcagcgaccccagctacaacaaggagaagcacatcatccaccccacccagaagagcaaggccagccagggcagcgacctggagcagaacgaggccagcagaaagaacaagaagaagaaggagaagagcaccagcaagtacgaggtgctgaccgtgcaggagccccccagaatcgaggacgccgaggagttccccaacctggccgtggccagcgagagaagagacagaatcgagacccccaagttccagagcaagcagcagccccaggacaacttcaagaacaacgtgaagaagagccagctgcccgtgcagctggacctgggcggcatgctgaccgccctggagaagaagcagcacagccagcacgccaagcagagcagcaagcccgtggtggtgagcgtgggcgccgtgcccgtgctgagcaaggagtgcgccagcggcgagagaggcagaagaatgagccagatgaagaccccccacaaccccctggacagcagcgcccccctgatgaagaagggcaagcagagagagatccccaaggccaagaagcccaccagcctgaagaagatcatcctgaaggagagacaggagagaaagcagagactgcaggagaacgccgtgagccccgccttcaccagcgacgacacccaggacggcgagagcggcggcgacgaccagttccccgagcaggccgagctgagcggccccgagggcatggacgagctgatcagcacccccagcgtggaggacaagagcgaggagccccccggcaccgagctgcagagagacaccgaggccagccacctggcccccaaccacaccaccttccccaagatccacagcagaagattcagagactactgcagccagatgctgagcaaggaggtggacgcctgcgtgaccgacctgctgaaggagctggtgagattccaggacagaatgtaccagaaggaccccgtgaaggccaagaccaagagaagactggtgctgggcctgagagaggtgctgaagcacctgaagctgaagaagctgaagtgcgtgatcatcagccccaactgcgagaagatccagagcaagggcggcctggacgacaccctgcacaccatcatcgactacgcctgcgagcagaacatccccttcgtgttcgccctgaacagaaaggccctgggcagaagcctgaacaaggccgtgcccgtgagcgtggtgggcatcttcagctacgacggcgcccaggaccagttccacaagatggtggagctgaccgtggccgccagacaggcctacaagaccatgctggagaacgtgcagcaggagctggtgggcgagcccagaccccaggccccccccagcctgcccacccagggccccagctgccccgccgaggacggcccccccgccctgaaggagaaggaggagccccactacatcgagatctggaagaagcacctggaggcctacagcggctgcaccctggagctggaggagagcctggaggccagcaccagccagatgatgaacctgaacctgtag

SEQ ID NO: 98212 - DNA, 747 bp, Artificial Sequence
  Description of Artificial Sequence: Synthetic coding sequence
atgcagacctgccccctggccttccccggccacgtgagccaggccctgggcaccctgctgttcctggccgccagcctgagcgcccagaacgagggctgggacagccccatctgcaccgagggcgtggtgagcgtgagctggggcgagaacaccgtgatgagctgcaacatcagcaacgccttcagccacgtgaacatcaagctgagagcccacggccaggagagcgccatcttcaacgaggtggcccccggctacttcagcagagacggctggcagctgcaggtgcagggcggcgtggcccagctggtgatcaagggcgccagagacagccacgccggcctgtacatgtggcacctggtgggccaccagagaaacaacagacaggtgaccctggaggtgagcggcgccgagccccagagcgcccccgacaccggcttctggcccgtgcccgccgtggtgaccgccgtgttcatcctgctggtggccctggtgatgttcgcctggtacagatgcagatgcagccagcagagaagagagaagaagttcttcctgctggagccccagatgaaggtggccgccctgagagccggcgcccagcagggcctgagcagagccagcgccgagctgtggacccccgacagcgagcccacccccagacccctggccctggtgttcaagcccagccccctgggcgccctggagctgctgagcccccagcccctgttcccctacgccgccgacccctag

SEQ ID NO: 98213 - DNA, 888 bp, Artificial Sequence
  Description of Artificial Sequence: Synthetic coding sequence
atgctgcagggccccggcagcctgctgctgctgttcctggccagccactgctgcctgggcagcgccagaggcctgttcctgttcggccagcccgacttcagctacaagagaagcaactgcaagcccatccccgccaacctgcagctgtgccacggcatcgagtaccagaacatgagactgcccaacctgctgggccacgagaccatgaaggaggtgctggagcaggccggcgcctggatccccctggtgatgaagcagtgccaccccgacaccaagaagttcctgtgcagcctgttcgcccccgtgtgcctggacgacctggacgagaccatccagccctgccacagcctgtgcgtgcaggtgaaggacagatgcgcccccgtgatgagcgccttcggcttcccctggcccgacatgctggagtgcgacagattcccccaggacaacgacctgtgcatccccctggccagcagcgaccacctgctgcccgccaccgaggaggcccccaaggtgtgcgaggcctgcaagaacaagaacgacgacgacaacgacatcatggagaccctgtgcaagaacgacttcgccctgaagatcaaggtgaaggagatcacctacatcaacagagacaccaagatcatcctggagaccaagagcaagaccatctacaagctgaacggcgtgagcgagagagacctgaagaagagcgtgctgtggctgaaggacagcctgcagtgcacctgcgaggagatgaacgacatcaacgccccctacctggtgatgggccagaagcagggcggcgagctggtgatcaccagcgtgaagagatggcagaagggccagagagagttcaagagaatcagcagaagcatcagaaagctgcagtgctag

SEQ ID NO: 98214 - DNA, 312 bp, Artificial Sequence
  Description of Artificial Sequence: Synthetic coding sequence
atggccagcagatgggccgtgcagctgctgctggtggccgcctggagcatgggctgcggcgaggccctgaagtgctacacctgcaaggagcccatgaccagcgccagctgcagaaccatcaccagatgcaagcccgaggacaccgcctgcatgaccaccctggtgaccgtggaggccgagtaccccttcaaccagagccccgtggtgaccagaagctgcagcagcagctgcgtggccaccgaccccgacagcatcggcgccgcccacctgatcttctgctgcttcagagacctgtgcaacagcgagctgtag

SEQ ID NO: 98215 - DNA, 636 bp, Artificial Sequence
  Description of Artificial Sequence: Synthetic coding sequence
atgatcagcagaatggagaagatgaccatgatgatgaagatcctgatcatgttcgccctgggcatgaactactggagctgcagcggcttccccgtgtacgactacgaccccagcagcctgagagacgccctgagcgccagcgtggtgaaggtgaacagccagagcctgagcccctacctgttcagagccttcagaagcagcctgaagagagtggaggtgctggacgagaacaacctggtgatgaacctggagttcagcatcagagagaccacctgcagaaaggacagcggcgaggaccccgccacctgcgccttccagagagactactacgtgagcaccgccgtgtgcagaagcaccgtgaaggtgagcgcccagcaggtgcagggcgtgcacgccagatgcagctggagcagcagcaccagcgagagctacagcagcgaggagatgatcttcggcgacatgctgggcagccacaagtggagaaacaactacctgttcggcctgatcagcgacgagagcatcagcgagcagttctacgacagaagcctgggcatcatgagaagagtgctgccccccggcaacagaagataccccaaccacagacacagagccagaatcaacaccgacttcgagtag

SEQ ID NO: 98216 - DNA, 636 bp, Artificial Sequence; identical to SEQ ID NO: 98215
  Description of Artificial Sequence: Synthetic coding sequence

SEQ ID NO: 98217 - DNA, 366 bp, Artificial Sequence
  Description of Artificial Sequence: Synthetic coding sequence
atggcccccagacccctgctgctgctgctgctgctgctgggcggcagcgccgccagacccgccccccccagagccagaagacacagcgacggcaccttcaccagcgagctgagcagactgagagagggcgccagactgcagagactgctgcagggcctggtgggcaagagaagcgagcaggacgccgagaacagcatggcctggaccagactgagcgccggcctgctgtgccccagcggcagcaacatgcccatcctgcaggcctggatgcccctggacggcacctggagcccctggctgccccccggccccatggtgagcgagcccgccggcgccgccgccgagggcaccctgagacccagatag

SEQ ID NO: 98218 - DNA, 1323 bp, Artificial Sequence
  Description of Artificial Sequence: Synthetic coding sequence
atgagaccccacctgagcccccccctgcagcagctgctgctgcccgtgctgctggcctgcgccgcccacagcaccggcgccctgcccagactgtgcgacgtgctgcaggtgctgtgggaggagcaggaccagtgcctgcaggagctgagcagagagcagaccggcgacctgggcaccgagcagcccgtgcccggctgcgagggcatgtgggacaacatcagctgctggcccagcagcgtgcccggcagaatggtggaggtggagtgccccagattcctgagaatgctgaccagcagaaacggcagcctgttcagaaactgcacccaggacggctggagcgagaccttccccagacccaacctggcctgcggcgtgaacgtgaacgacagcagcaacgagaagagacacagctacctgctgaagctgaaggtgatgtacaccgtgggctacagcagcagcctggtgatgctgctggtggccctgggcatcctgtgcgccttcagaagactgcactgcaccagaaactacatccacatgcacctgttcgtgagcttcatcctgagagccctgagcaacttcatcaaggacgccgtgctgttcagcagcgacgacgtgacctactgcgacgcccacagagccggctgcaagctggtgatggtgctgttccagtactgcatcatggccaactacagctggctgctggtggagggcctgtacctgcacaccctgctggccatcagcttcttcagcgagagaaagtacctgcagggcttcgtggccttcggctggggcagccccgccatcttcgtggccctgtgggccatcgccagacacttcctggaggacgtgggctgctgggacatcaacgccaacgccagcatctggtggatcatcagaggccccgtgatcctgagcatcctgatcaacttcatcctgttcatcaacatcctgagaatcctgatgagaaagctgagaacccaggagaccagaggcaacgaggtgagccactacaagagactggccagaagcaccctgctgctgatccccctgttcggcatccactacatcgtgttcgccttcagccccgaggacgccatggagatccagctgttcttcgagctggccctgggcagcttccagggcctggtggtggccgtgctgtactgcttcctgaacggcgaggtgcagctggaggtgcagaagaagtggcagcagtggcacctgagagagttccccctgcaccccgtggccagcttcagcaacagcaccaaggccagccacctggagcagagccagggcacctgcagaaccagcatcatctag

SEQ ID NO: 98219 - DNA, 288 bp, Artificial Sequence
  Description of Artificial Sequence: Synthetic coding sequence
atgaagctgctgatggtgctgatgctggccgccctgctgctgcactgctacgccgacagcggctgcaagctgctggaggacatggtggagaagaccatcaacagcgacatcagcatccccgagtacaaggagctgctgcaggagttcatcgacagcgacgccgccgccgaggccatgggcaagttcaagcagtgcttcctgaaccagagccacagaaccctgaagaacttcggcctgatgatgcacaccgtgtacgacagcatctggtgcaacatgaagagcaactag

SEQ ID NO: 98220 - DNA, 1746 bp, Artificial Sequence
  Description of Artificial Sequence: Synthetic coding sequence
atgcccgcccccagagccagagagcagcccagagtgcccggcgagagacagcccctgctgcccagaggcgccagaggccccagaagatggagaagagccgccggcgccgccgtgctgctggtggagatgctggagagagccgccttcttcggcgtgaccgccaacctggtgctgtacctgaacagcaccaacttcaactggaccggcgagcaggccaccagagccgccctggtgttcctgggcgccagctacctgctggcccccgtgggcggctggctggccgacgtgtacctgggcagatacagagccgtggccctgagcctgctgctgtacctggccgccagcggcctgctgcccgccaccgccttccccgacggcagaagcagcttctgcggcgagatgcccgccagccccctgggccccgcctgccccagcgccggctgccccagaagcagccccagcccctactgcgcccccgtgctgtacgccggcctgctgctgctgggcctggccgccagcagcgtgagaagcaacctgaccagcttcggcgccgaccaggtgatggacctgggcagagacgccaccagaagattcttcaactggttctactggagcatcaacctgggcgccgtgctgagcctgctggtggtggccttcatccagcagaacatcagcttcctgctgggctacagcatccccgtgggctgcgtgggcctggccttcttcatcttcctgttcgccacccccgtgttcatcaccaagccccccatgggcagccaggtgagcagcatgctgaagctggccctgcagaactgctgcccccagctgtggcagagacacagcgccagagacagacagtgcgccagagtgctggccgacgagagaagcccccagcccggcgccagcccccaggaggacatcgccaacttccaggtgctggtgaagatcctgcccgtgatggtgaccctggtgccctactggatggtgtacttccagatgcagagcacctacgtgctgcagggcctgcacctgcacatccccaacatcttccccgccaaccccgccaacatcagcgtggccctgagagcccagggcagcagctacaccatccccgaggcctggctgctgctggccaacgtggtggtggtgctgatcctggtgcccctgaaggacagactgatcgaccccctgctgctgagatgcaagctgctgcccagcgccctgcagaagatggccctgggcatgttcttcggcttcaccagcgtgatcgtggccggcgtgctggagatggagagactgcactacatccaccacaacgagaccgtgagccagcagatcggcgaggtgctgtacaacgccgcccccctgagcatctggtggcagatcccccagtacctgctgatcggcatcagcgagatcttcgccagcatccccggcctggagttcgcctacagcgaggcccccagaagcatgcagggcgccatcatgggcatcttcttctgcctgagcggcgtgggcagcctgctgggcagcagcctggtggccctgctgagcctgcccggcggctggctgcactgccccaaggacttcggcaacatcaacaactgcagaatggacctgtacttcttcctgctggccggcatccaggccgtgaccgccctgctgttcgtgtggatcgccggcagatacgagagagccagccagggccccgccagccacagcagattcagcagagacagaggctag

SEQ ID NO: 98221 - DNA, 363 bp, Artificial Sequence
  Description of Artificial Sequence: Synthetic coding sequence
atgaagctgctgatggtgctgatgctggccgccctgagccagcactgctacgccggcagcggctgccccctgctggagaacgtgatcagcaagaccatcaacccccaggtgagcaagaccgagtacaaggagctgctgcaggagttcatcgacgacaacgccaccaccaacgccatcgacgagctgaaggagtgcttcctgaaccagaccgacgagaccctgagcaacgtggaggtgttcatggtgatcagcttcagcagctacaagctgttcaagagccccgaccagggccaggtgggcagcagcttcctgaccgacaacgccaaggccaccagcgagcaggccttcagctacatcggctag

SEQ ID NO: 98222 - DNA, 315 bp, Artificial Sequence
  Description of Artificial Sequence: Synthetic coding sequence
atgaagctggccgccctgctgggcctgtgcgtggccctgagctgcagcagcgccgccgccttcctggtgggcagcgccaagcccgtggcccagcccgtggccgccctggagagcgccgccgaggccggcgccggcaccctggccaaccccctgggcaccctgaaccccctgaagctgctgctgagcagcctgggcatccccgtgaaccacctgatcgagggcagccagaagtgcgtggccgagctgggcccccaggccgtgggcgccgtgaaggccctgaaggccctgctgggcgccctgaccgtgttcggctag

SEQ ID NO: 98223 - DNA, 282 bp, Artificial Sequence
  Description of Artificial Sequence: Synthetic coding sequence
atgaagctggtgaccatcttcctgctggtgaccatcagcctgtgcagctacagcgccaccgccttcctgatcaacaaggtgcccctgcccgtggacaagctggcccccctgcccctggacaacatcctgcccttcatggaccccctgaagctgctgctgaagaccctgggcatcagcgtggagcacctggtggagggcctgagaaagtgcgtgaacgagctgggccccgaggccagcgaggccgtgaagaagctgctggaggccctgagccacctggtgtag

SEQ ID NO: 98224 - DNA, 1854 bp, Artificial Sequence
  Description of Artificial Sequence: Synthetic coding sequence
atggccgaggccaagacccactggctgggcgccgccctgagcctgatccccctgatcttcctgatcagcggcgccgaggccgccagcttccagagaaaccagctgctgcagaaggagcccgacctgagactggagaacgtgcagaagttccccagccccgagatgatcagagccctggagtacatcgagaacctgagacagcaggcccacaaggaggagagcagccccgactacaacccctaccagggcgtgagcgtgcccctgcagcagaaggagaacggcgacgagagccacctgcccgagagagacagcctgagcgaggaggactggatgagaatcatcctggaggccctgagacaggccgagaacgagccccagagcgcccccaaggagaacaagccctacgccctgaacagcgagaagaacttccccatggacatgagcgacgactacgagacccagcagtggcccgagagaaagctgaagcacatgcagttcccccccatgtacgaggagaacagcagagacaaccccttcaagagaaccaacgagatcgtggaggagcagtacaccccccagagcctggccaccctggagagcgtgttccaggagctgggcaagctgaccggccccaacaaccagaagagagagagaatggacgaggagcagaagctgtacaccgacgacgaggacgacatctacaaggccaacaacatcgcctacgaggacgtggtgggcggcgaggactggaaccccgtggaggagaagatcgagagccagacccaggaggaggtgagagacagcaaggagaacatcgagaagaacgagcagatcaacgacgagatgaagagaagcggccagctgggcatccaggaggaggacctgagaaaggagagcaaggaccagctgagcgacgacgtgagcaaggtgatcgcctacctgaagagactggtgaacgccgccggcagcggcagactgcagaacggccagaacggcgagagagccaccagactgttcgagaagcccctggacagccagagcatctaccagctgatcgagatcagcagaaacctgcagatcccccccgaggacctgatcgagatgctgaagaccggcgagaagcccaacggcagcgtggagcccgagagagagctggacctgcccgtggacctggacgacatcagcgaggccgacctggaccaccccgacctgttccagaacagaatgctgagcaagagcggctaccccaagacccccggcagagccggcaccgaggccctgcccgacggcctgagcgtggaggacatcctgaacctgctgggcatggagagcgccgccaaccagaagaccagctacttccccaacccctacaaccaggagaaggtgctgcccagactgccctacggcgccggcagaagcagaagcaaccagctgcccaaggccgcctggatcccccacgtggagaacagacagatggcctacgagaacctgaacgacaaggaccaggagctgggcgagtacctggccagaatgctggtgaagtaccccgagatcatcaacagcaaccaggtgaagagagtgcccggccagggcagcagcgaggacgacctgcaggaggaggagcagatcgagcaggccatcaaggagcacctgaaccagggcagcagccaggagaccgacaagctggcccccgtgagcaagagattccccgtgggcccccccaagaacgacgacacccccaacagacagtactgggacgaggacctgctgatgaaggtgctggagtacctgaaccaggagaaggccgagaagggcagagagcacatcgccaagagagccatggagaacatgtag

SEQ ID NO: 98225 - DNA, 435 bp, Artificial Sequence
  Description of Artificial Sequence: Synthetic coding sequence
atggccgaggccaagacccactggctgggcgccgccctgagcctgatccccctgatcttcctgatcagcggcgccgaggccgccagcttccagagaaaccagctgctgcagaaggagcccgacctgagactggagaacgtgcagaagttccccagccccgagatgatcagagccctggagtacatcgagaacctgagacagcaggcccacaaggaggagagcagccccgactacaacccctaccagggcgtgagcgtgcccctgcagcagaaggagaacggcgacgagagccacctgcccgagagagacagcctgagcgaggaggactggatgagaatcatcctggaggccctgagacaggccgagaacgagccccagagcgcccccaaggagaacaagccctacgccctgaacagcgagaagaacttcccctag

SEQ ID NO: 98226 - DNA, 378 bp, Artificial Sequence
  Description of Artificial Sequence: Synthetic coding sequence
atggccgaggccaagacccactggctgggcgccgccctgagcctgatccccctgatcttcctgatcagcggcgccgaggccgccagcttccagagaaaccagctgctgcagaaggagcccgacctgagactggagaacgtgcagaagttccccagccccgagatgatcagagccctggagtacatcgagaacctgagacagcaggcccacaaggaggagagcagccccgactacaacccctaccagggcgtgagcgtgcccctgcagcagaaggagaacggcgacgagagccacctgcccgagagagacagcctgagcgaggaggactggatgagaatcatcctggaggccctgagacaggccgagaacgagccctag

SEQ ID NO: 98227 - DNA, 1434 bp, Artificial Sequence
  Description of Artificial Sequence: Synthetic coding sequence
atggccgaggccaagacccactggctgggcgccgccctgagcctgatccccctgatcttcctgatcagcggcgccgaggccgccagcttccagagaaaccagctgctgcagaaggagcccgacctgagactggagaacgtgcagaagttccccagccccgagatgatcagagccctggagtacatcgagaacctgagacagcaggcccacaaggaggagagcagccccgactacaacccctaccagggcgtgagcgtgcccctgcagcagaaggagaacggcgacgagagccacctgcccgagagagacagcctgagaggcgaggactggaaccccgtggaggagaagatcgagagccagacccaggaggaggtgagagacagcaaggagaacatcgagaagaacgagcagatcaacgacgagatgaagagaagcggccagctgggcatccaggaggaggacctgagaaaggagagcaaggaccagctgagcgacgacgtgagcaaggtgatcgcctacctgaagagactggtgaacgccgccggcagcggcagactgcagaacggccagaacggcgagagagccaccagactgttcgagaagcccctggacagccagagcatctaccagctgatcgagatcagcagaaacctgcagatcccccccgaggacctgatcgagatgctgaagaccggcgagaagcccaacggcagcgtggagcccgagagagagctggacctgcccgtggacctggacgacatcagcgaggccgacctggaccaccccgacctgttccagaacagaatgctgagcaagagcggctaccccaagacccccggcagagccggcaccgaggccctgcccgacggcctgagcgtggaggacatcctgaacctgctgggcatggagagcgccgccaaccagaagaccagctacttccccaacccctacaaccaggagaaggtgctgcccagactgccctacggcgccggcagaagcagaagcaaccagctgcccaaggccgcctggatcccccacgtggagaacagacagatggcctacgagaacctgaacgacaaggaccaggagctgggcgagtacctggccagaatgctggtgaagtaccccgagatcatcaacagcaaccaggtgaagagagtgcccggccagggcagcagcgaggacgacctgcaggaggaggagcagatcgagcaggccatcaaggagcacctgaaccagggcagcagccaggagaccgacaagctggcccccgtgagcaagagattccccgtgggcccccccaagaacgacgacacccccaacagacagtactgggacgaggacctgctgatgaaggtgctggagtacctgaaccaggagaaggccgagaagggcagagagcacatcgccaagagagccatggagaacatgtag

SEQ ID NO: 98228 - DNA, 390 bp, Artificial Sequence; identical to SEQ ID NO: 74097
  Description of Artificial Sequence: Synthetic coding sequence

SEQ ID NO: 98229 - DNA, 711 bp, Artificial Sequence
  Description of Artificial Sequence: Synthetic coding sequence
atggccgccatccaggacggcctggccaagggcgagaacgacgagaccgtgagcaacaccctgaccctgaccaacggcctggagagaagaaccaagacctacagcgaggacaacttcgaggagctgcagtacttccccaacttctacgccctgctgaagagcatcgacagcgagaaggaggccaaggagaaggagaccctgatcaccatcatgaagaccctgatcgacttcgtgaagatgatggtgaagtacggcaccatcagccccgaggagggcgtgagctacctggagaacctggacgagatgatcgccctgcagaccaagaacaagctggagaagaacgccaccgacaacatcagcaagctgttccccgcccccagcgagaagagccacgaggagaccgacagcaccaaggaggaggccgccaagatggagaaggagtacggcagcctgaaggacagcaccaaggacgacaacagcaaccccggcggcaagaccgacgagcccaagggcaagaccgaggcctacctggaggccatcagaaagaacatcgagtggctgaagaagcacgacaagaagggcaacaaggaggactacgacctgagcaagatgagagacttcatcaacaagcaggccgacgcctacgtggagaagggcatcctggacaaggaggaggccgaggccatcaagagaatctacagcagcctgtag

SEQ ID NO: 98230 - DNA, 174 bp, Artificial Sequence
  Description of Artificial Sequence: Synthetic coding sequence
atggccgccatccaggacggcctggccaagggcgagaacgacgagaccgtgagcaacaccctgaccctgaccaacggcctggagagaagaaccaagacctacagcgaggacaacttcgaggagctgcagtacttccccaacttctacgccctgctgaagagcatcgacagctag

SEQ ID NO: 98231 - DNA, 990 bp, Artificial Sequence
  Description of Artificial Sequence: Synthetic coding sequence
atgagcgccttcgacaccaaccccttcgccgaccccgtggacgtgaaccccttccaggaccccagcgtgacccagctgaccaacgccccccagggcggcctggccgagttcaaccccttcagcgagaccaacgccgccaccaccgtgcccgtgacccagctgcccggcagcagccagcccgccgtgctgcagcccagcgtggagcccacccagcccaccccccaggccgtggtgagcgccgcccaggccggcctgctgagacagcaggaggagctggacagaaaggccgccgagctggagagaaaggagagagagctgcagaacaccgtggccaacctgcacgtgagacagaacaactggccccccctgcccagctggtgccccgtgaagccctgcttctaccaggacttcagcaccgagatccccgccgactaccagagaatctgcaagatgctgtactacctgtggatgctgcacagcgtgaccctgttcctgaacctgctggcctgcctggcctggttcagcggcaacagcagcaagggcgtggacttcggcctgagcatcctgtggttcctgatcttcaccccctgcgccttcctgtgctggtacagacccatctacaaggccttcagaagcgacaacagcttcagcttcttcgtgttcttcttcgtgttcttctgccagatcggcatctacatcatccagctggtgggcatccccggcctgggcgacagcggctggatcgccgccctgagcaccctggacaaccacagcctggccatcagcgtgatcatgatggtggtggccggcttcttcaccctgtgcgccgtgctgagcgtgttcctgctgcagagagtgcacagcctgtacagaagaaccggcgccagcttccagcaggcccaggaggagttcagccagggcatcttcagcagcagaaccttccacagagccgccagcagcgccgcccagggcgccttccagggcaactag

SEQ ID NO: 98232 - DNA, 864 bp, Artificial Sequence
  Description of Artificial Sequence: Synthetic coding sequence
atgagcgccttcgacaccaaccccttcgccgacaccaacgccgccaccaccgtgcccgtgacccagctgcccggcagcagccagcccgccgtgctgcagcccagcgtggagcccacccagcccaccccccaggccgtggtgagcgccgcccaggccggcctgctgagacagcaggaggagctggacagaaaggccgccgagctggagagaaaggagagagagctgcagaacaccgtggccaacctgcacgtgagacagaacaactggccccccctgcccagctggtgccccgtgaagccctgcttctaccaggacttcagcaccgagatccccgccgactaccagagaatctgcaagatgctgtactacctgtggatgctgcacagcgtgaccctgttcctgaacctgctggcctgcctggcctggttcagcggcaacagcagcaagggcgtggacttcggcctgagcatcctgtggttcctgatcttcaccccctgcgccttcctgtgctggtacagacccatctacaaggccttcagaagcgacaacagcttcagcttcttcgtgttcttcttcgtgttcttctgccagatcggcatctacatcatccagctggtgggcatccccggcctgggcgacagcggctggatcgccgccctgagcaccctggacaaccacagcctggccatcagcgtgatcatgatggtggtggccggcttcttcaccctgtgcgccgtgctgagcgtgttcctgctgcagagagtgagcggcgtgggcagagccgacagcaagtgggaggaggccggcaacagattcctgcccctgcccagagacgtgttccaccactgcagctgggccagctag

SEQ ID NO: 98233 - DNA, 1044 bp, Artificial Sequence
  Description of Artificial Sequence: Synthetic coding sequence
atggcccagagcagagacggcggcaaccccttcgccgagcccagcgagctggacaaccccttccaggaccccgccgtgatccagcacagacccagcagacagtacgccaccctggacgtgtacaaccccttcgagaccagagagcccccccccgcctacgagccccccgcccccgcccccctgcccccccccagcgcccccagcctgcagcccagcagaaagctgagccccaccgagcccaagaactacggcagctacagcacccaggccagcgccgccgccgccaccgccgagctgctgaagaagcaggaggagctgaacagaaaggccgaggagctggacagaagagagagagagctgcagcacgccgccctgggcggcaccgccaccagacagaacaactggccccccctgcccagcttctgccccgtgcagccctgcttcttccaggacatcagcatggagatcccccaggagttccagaagaccgtgagcaccatgtactacctgtggatgtgcagcaccctggccctgctgctgaacttcctggcctgcctggccagcttctgcgtggagaccaacaacggcgccggcttcggcctgagcatcctgtgggtgctgctgttcaccccctgcagcttcgtgtgctggtacagacccatgtacaaggccttcagaagcgacagcagcttcaacttcttcgtgttcttcttcatcttcttcgtgcaggacgtgctgttcgtgctgcaggccatcggcatccccggctggggcttcagcggctggatcagcgccctggtggtgcccaagggcaacaccgccgtgagcgtgctgatgctgctggtggccctgctgttcaccggcatcgccgtgctgggcatcgtgatgctgaagagaatccacagcctgtacagaagaaccggcgccagcttccagaaggcccagcaggagttcgccgccggcgtgttcagcaaccccgccgtgagaaccgccgccgccaacgccgccgccggcgccgccgagaacgccttcagagccccctag

SEQ ID NO: 98234 - DNA, 966 bp, Artificial Sequence
  Description of Artificial Sequence: Synthetic coding sequence
atggcccagagcagagacggcggcaaccccttcgccgagcccagcgagctggacaaccccttccagcccccccccgcctacgagccccccgcccccgcccccctgcccccccccagcgcccccagcctgcagcccagcagaaagctgagccccaccgagcccaagaactacggcagctacagcacccaggccagcgccgccgccgccaccgccgagctgctgaagaagcaggaggagctgaacagaaaggccgaggagctggacagaagagagagagagctgcagcacgccgccctgggcggcaccgccaccagacagaacaactggccccccctgcccagcttctgccccgtgcagccctgcttcttccaggacatcagcatggagatcccccaggagttccagaagaccgtgagcaccatgtactacctgtggatgtgcagcaccctggccctgctgctgaacttcctggcctgcctggccagcttctgcgtggagaccaacaacggcgccggcttcggcctgagcatcctgtgggtgctgctgttcaccccctgcagcttcgtgtgctggtacagacccatgtacaaggccttcagaagcgacagcagcttcaacttcttcgtgttcttcttcatcttcttcgtgcaggacgtgctgttcgtgctgcaggccatcggcatccccggctggggcttcagcggctggatcagcgccctggtggtgcccaagggcaacaccgccgtgagcgtgctgatgctgctggtggccctgctgttcaccggcatcgccgtgctgggcatcgtgatgctgaagagaatccacagcctgtacagaagaaccggcgccagcttccagaaggcccagcaggagttcgccgccggcgtgttcagcaaccccgccgtgagaaccgccgccgccaacgccgccgccggcgccgccgagaacgccttcagagccccctag

SEQ ID NO: 98235 - DNA, 690 bp, Artificial Sequence
  Description of Artificial Sequence: Synthetic coding sequence
atgagcgagaaggagaacaacttcccccccctgcccaagttcatccccgtgaagccctgcttctaccagaacttcagcgacgagatccccgtggagcaccaggtgctggtgaagagaatctacagactgtggatgttctactgcgccaccctgggcgtgaacctgatcgcctgcctggcctggtggatcggcggcggcagcggcaccaacttcggcctggccttcgtgtggctgctgctgttcaccccctgcggctacgtgtgctggttcagacccgtgtacaaggccttcagagccgacagcagcttcaacttcatggccttcttcttcatcttcggcgcccagttcgtgctgaccgtgatccaggccatcggcttcagcggctggggcgcctgcggctggctgagcgccatcggcttcttccagtacagccccggcgccgccgtggtgatgctgctgcccgccatcatgttcagcgtgagcgccgccatgatggccatcgccatcatgaaggtgcacagaatctacagaggcgccggcggcagcttccagaaggcccagaccgagtggaacaccggcacctggagaaacccccccagcagagaggcccagtacaacaacttcagcggcaacagcctgcccgagtaccccaccgtgcccagctaccccggcagcggccagtggccctag

SEQ ID NO: 98236 - DNA, 588 bp, Artificial Sequence
  Description of Artificial Sequence: Synthetic coding sequence
atgagcgagaaggagaacaacttcccccccctgcccaagttcatccccgtgaagccctgcttctaccagaacttcagcgacgagatccccgtggagcaccaggtgctggtgaagagaatctacagactgtggatgttctactgcgccaccctgggcgtgaacctgatcgcctgcctggcctggtggatcggcggcggcagcggcaccaacttcggcctggccttcgtgtggctgctgctgttcaccccctgcggctacgtgtgctggttcagacccgtgtacaaggccttcagaggctggctgagcgccatcggcttcttccagtacagccccggcgccgccgtggtgatgctgctgcccgccatcatgttcagcgtgagcgccgccatgatggccatcgccatcatgaaggtgcacagaatctacagaggcgccggcggcagcttccagaaggcccagaccgagtggaacaccggcacctggagaaacccccccagcagagaggcccagtacaacaacttcagcggcaacagcctgcccgagtaccccaccgtgcccagctaccccggcagcggccagtggccctag

SEQ ID NO: 98237 - DNA, 588 bp, Artificial Sequence
  Description of Artificial Sequence: Synthetic coding sequence
atgatccagagacacatccccgtgtgcggcagaagcagaccctaccagagaggctgcgtggtgcaggccggcagcagcggcagccccggctggagccacttcaagatcatctgcggcctggcccccgcccccagcgaggccgtgctgagcgccagaaacaactgcgagcacaccggcggctgcagactgcagcccgccctggtgggcgagaccgagatgagcgagaaggagaacaacttcccccccctgcccaagttcatccccgtgaagccctgcttctaccagaacttcagcgacgagatccccgtggagcaccaggtgctggtgaagagaatctacagactgtggatgttctactgcgccaccctgggcgtgaacctgatcgcctgcctggcctggtggatcggcggcggcagcggcaccaacttcggcctggccttcgtgtggctgctgctgttcaccccctgcggctacgtgtgctggttcagacccgtgtacaaggccttcagagccgacagcagcttcaacttcatggccttcttcttcatcttcggcgcccagttcgtgctgaccgtgatccaggcctag

SEQ ID NO: 98238 - DNA, 708 bp, Artificial Sequence
  Description of Artificial Sequence: Synthetic coding sequence
atggccgagaaggtgaacaacttcccccccctgcccaagttcatccccctgaagccctgcttctaccaggacttcgaggccgacatccccccccagcacgtgagcatgaccaagagactgtactacctgtggatgctgaacagcgtgaccctggccgtgaacctggtgggctgcctggcctggctgatcggcggcggcggcgccaccaacttcggcctggccttcctgtggctgatcctgttcaccccctgcagctacgtgtgctggttcagacccatctacaaggccttcaagaccgacagcagcttcagcttcatggccttcttcttcaccttcatggcccagctggtgatcagcatcatccaggccgtgggcatccccggctggggcgtgtgcggctggatcgccaccatcagcttcttcggcaccaacatcggcagcgccgtggtgatgctgatccccaccgtgatgttcaccgtgatggccgtgttcagcttcatcgccctgagcatggtgcacaagttctacagaggcagcggcggcagcttcagcaaggcccaggaggagtggaccaccggcgcctggaagaacccccacgtgcagcaggccgcccagaacgccgccatgggcgccgcccagggcgccatgaaccagccccagacccagtacagcgccacccccaactacacctacagcaacgagatgtag

SEQ ID NO: 98239 - DNA, 708 bp, Artificial Sequence; identical to SEQ ID NO: 98238
  Description of Artificial Sequence: Synthetic coding sequence

SEQ ID NO: 98240 - DNA, 495 bp, Artificial Sequence
  Description of Artificial Sequence: Synthetic coding sequence
atgttcctgcccagactgagaggcagatacagcagccccgcctgccagcacgaccaggcccccctgctgcccctggacgtgaccgacagcagcttcagcttcatggccttcttcttcaccttcatggcccagctggtgatcagcatcatccaggccgtgggcatccccggctggggcgtgtgcggctggatcgccaccatcagcttcttcggcaccaacatcggcagcgccgtggtgatgctgatccccaccgtgatgttcaccgtgatggccgtgttcagcttcatcgccctgagcatggtgcacaagttctacagaggcagcggcggcagcttcagcaaggcccaggaggagtggaccaccggcgcctggaagaacccccacgtgcagcaggccgcccagaacgccgccatgggcgccgcccagggcgccatgaaccagccccagacccagtacagcgccacccccaactacacctacagcaacgagatgtag

SEQ ID NO: 98241 - DNA, 1083 bp, Artificial Sequence
  Description of Artificial Sequence: Synthetic coding sequence
atgttcgtggccagaagcatcgccgccgaccacaaggacctgatccacgacgtgagcttcgacttccacggcagaagaatggccacctgcagcagcgaccagagcgtgaaggtgtgggacaagagcgagagcggcgactggcactgcaccgccagctggaagacccacagcggcagcgtgtggagagtgacctgggcccaccccgagttcggccaggtgctggccagctgcagcttcgacagaaccgccgccgtgtgggaggagatcgtgggcgagagcaacgacaagctgagaggccagagccactgggtgaagagaaccaccctggtggacagcagaaccagcgtgaccgacgtgaagttcgcccccaagcacatgggcctgatgctggccacctgcagcgccgacggcatcgtgagaatctacgaggcccccgacgtgatgaacctgagccagtggagcctgcagcacgagatcagctgcaagctgagctgcagctgcatcagctggaaccccagcagcagcagagcccacagccccatgatcgccgtgggcagcgacgacagcagccccaacgccatggccaaggtgcagatcttcgagtacaacgagaacaccagaaagtacgccaaggccgagaccctgatgaccgtgaccgaccccgtgcacgacatcgccttcgcccccaacctgggcagaagcttccacatcctggccatcgccaccaaggacgtgagaatcttcaccctgaagcccgtgagaaaggagctgaccagcagcggcggccccaccaagttcgagatccacatcgtggcccagttcgacaaccacaacagccaggtgtggagagtgagctggaacatcaccggcaccgtgctggccagcagcggcgacgacggctgcgtgagactgtggaaggccaactacatggacaactggaagtgcaccggcatcctgaagggcaacggcagccccgtgaacggcagcagccagcagggcaccagcaaccccagcctgggcagcaccatccccagcctgcagaacagcctgaacggcagcagcgccggcagaaagcacagctag

SEQ ID NO: 98242 - DNA, 1266 bp, Artificial Sequence
  Description of Artificial Sequence: Synthetic coding sequence
atgttcgtggccagaagcatcgccgccgaccacaaggacctgatccacgacgtgagcttcgacttccacggcagaagaatggccacctgcagcagcgaccagagcgtgaaggtgtgggacaagagcgagagcggcgactggcactgcaccgccagctggaagacccacagcggcagcgtgtggagagtgacctgggcccaccccgagttcggccaggtgctggccagctgcagcttcgacagaaccgccgccgtgtgggaggagatcgtgggcgagagcaacgacaagctgagaggccagagccactgggtgaagagaaccaccctggtggacagcagaaccagcgtgaccgacgtgaagttcgcccccaagcacatgggcctgatgctggccacctgcagcgccgacggcatcgtgagaatctacgaggcccccgacgtgatgaacctgagccagtggagcctgcagcacgagatcagctgcaagctgagctgcagctgcatcagctggaaccccagcagcagcagagcccacagccccatgatcgccgtgggcagcgacgacagcagccccaacgccatggccaaggtgcagatcttcgagtacaacgagaacaccagaaagtacgccaaggccgagaccctgatgaccgtgaccgaccccgtgcacgacatcgccttcgcccccaacctgggcagaagcttccacatcctggccatcgccaccaaggacgtgagaatcttcaccctgaagcccgtgagaaaggagctgaccagcagcggcggccccaccaagttcgagatccacatcgtggcccagttcgacaaccacaacagccaggtgtggagagtgagctggaacatcaccggcaccgtgctggccagcagcggcgacgacggctgcgtgagactgtggaaggccaactacatggacaactggaagtgcaccggcatcctgaagggcaacggcagccccgtgaacggcagcagccagcagggcaccagcaaccccagcctgggcagcaccatccccagcctgcagaacagcctgaacggcagcagcgccggcagatacttcttcacccccctggacagccccagagccggcagcagatggagcagctacgcccagctgctgccccccccccccccccccctggtggagcacagctgcgacgccgacaccgccaacctgcagtacccccaccccagaagaagatacctgagcagacccctgaaccccctgcccgagaacgagggcatctag

SEQ ID NO: 98243 - DNA, 3075 bp, Artificial Sequence
  Description of Artificial Sequence: Synthetic coding sequence
atgcccgccgccagaccccccgccgccggcctgagaggcatcagcctgttcctggccctgctgctgggcagccccgccgccgccctggagagagacgccctgcccgagggcgacgccagccccctgggcccctacctgctgcccagcggcgcccccgagagaggcagccccggcaaggagcaccccgaggagagagtggtgaccgccccccccagcagcagccagagcgccgaggtgctgggcgagctggtgctggacggcaccgcccccagcgcccaccacgacatccccgccctgagccccctgctgcccgaggaggccagacccaagcacgccctgccccccaagaagaagctgcccagcctgaagcaggtgaacagcgccagaaagcagctgagacccaaggccaccagcgccgccaccgtgcagagagccggcagccagcccgccagccagggcctggacctgctgagcagcagcaccgagaagcccggcccccccggcgaccccgaccccatcgtggccagcgaggaggccagcgaggtgcccctgtggctggacagaaaggagagcgccgtgcccaccacccccgcccccctgcagatcagccccttcaccagccagccctacgtggcccacaccctgccccagagacccgagcccggcgagcccggccccgacatggcccaggaggccccccaggaggacaccagccccatggccctgatggacaagggcgagaacgagctgaccggcagcgccagcgaggagagccaggagaccaccaccagcaccatcatcaccaccaccgtgatcaccaccgagcaggcccccgccctgtgcagcgtgagcttcagcaaccccgagggctacatcgacagcagcgactaccccctgctgcccctgaacaacttcctggagtgcacctacaacgtgaccgtgtacaccggctacggcgtggagctgcaggtgaagagcgtgaacctgagcgacggcgagctgctgagcatcagaggcgtggacggccccaccctgaccgtgctggccaaccagaccctgctggtggagggccaggtgatcagaagccccaccaacaccatcagcgtgtacttcagaaccttccaggacgacggcctgggcaccttccagctgcactaccaggccttcatgctgagctgcaacttccccagaagacccgacagcggcgacgtgaccgtgatggacctgcacagcggcggcgtggcccacttccactgccacctgggctacgagctgcagggcgccaagatgctgacctgcatcaacgccagcaagccccactggagcagccaggagcccatctgcagcgccccctgcggcggcgccgtgcacaacgccaccatcggcagagtgctgagccccagctaccccgagaacaccaacggcagccagttctgcatctggaccatcgaggcccccgagggccagaagctgcacctgcacttcgagagactgctgctgcacgacaaggacagaatgaccgtgcacagcggccagaccaacaagagcgccctgctgtacgacagcctgcagaccgagagcgtgcccttcgagggcctgctgagcgagggcaacaccatcagaatcgagttcaccagcgaccaggccagagccgccagcaccttcaacatcagattcgaggccttcgagaagggccactgctacgagccctacatccagaacggcaacttcaccaccagcgaccccacctacaacatcggcaccatcgtggagttcacctgcgaccccggccacagcctggagcagggccccgccatcatcgagtgcatcaacgtgagagacccctactggaacgacaccgagcccctgtgcagagccatgtgcggcggcgagctgagcgccgtggccggcgtggtgctgagccccaactggcccgagccctacgtggagggcgaggactgcatctggaagatccacgtgggcgaggagaagagaatcttcctggacatccagttcctgaacctgagcaacagcgacatcctgaccatctacgacggcgacgaggtgatgccccacatcctgggccagtacctgggcaacagcggcccccagaagctgtacagcagcacccccgacctgaccatccagttccacagcgaccccgccggcctgatcttcggcaagggccagggcttcatcatgaactacatcgaggtgagcagaaacgacagctgcagcgacctgcccgagatccagaacggctggaagaccaccagccacaccgagctggtgagaggcgccagaatcacctaccagtgcgaccccggctacgacatcgtgggcagcgacaccctgacctgccagtgggacctgagctggagcagcgacccccccttctgcgagaagatcatgtactgcaccgaccccggcgaggtggaccacagcaccagactgatcagcgaccccgtgctgctggtgggcaccaccatccagtacacctgcaaccccggcttcgtgctggagggcagcagcctgctgacctgctacagcagagagaccggcacccccatctggaccagcagactgccccactgcgtgagcgaggagagcctggcctgcgacaaccccggcctgcccgagaacggctaccagatcctgtacaagagactgtacctgcccggcgagagcctgaccttcatgtgctacgagggcttcgagctgatgggcgaggtgaccatcagatgcatcctgggccagcccagccactggaacggccccctgcccgtgtgcaaggtgaaccaggacagcttcgagcacgccctggaggtggccgaggccgccgccgagaccagcctggagggcggcaacatggccctggccatcttcatccccgtgctgatcatcagcctgctgctgggcggcgcctacatctacatcaccagatgcagatactacagcaacctgagactgcccctgatgtacagccacccctacagccagatcaccgtggagaccgagttcgacaaccccatctacgagaccggcgagaccagagagtacgaggtgagcatctag

SEQ ID NO: 98244 - DNA, 2847 bp, Artificial Sequence
  Description of Artificial Sequence: Synthetic coding sequence
atgcccgccgccagaccccccgccgccggcctgagaggcatcagcctgttcctggccctgctgctgggcagccccgccgccgccctggagagagacgccctgcccgagggcgacgccagccccctgggcccctacctgctgcccagcggcgcccccgagagaggcagccccggcaaggagcaccccgaggagagagtggtgaccgccccccccagcagcagccagagcgccgaggtgctgggcgagctggtgctggacggcaccgcccccagcgcccaccacgacatccccgccctgagccccctgctgcccgaggaggccagacccaagcacgccctgccccccaagaagaagctgcccagcctgaagcaggtgaacagcgccagaaagcagctgagacccaaggccaccagcgccgccaccgtgcagagagccggcagccagcccgccagccagggcctggacctgctgagcagcagcaccgagaagcccggcccccccggcgaccccgaccccatcgtggccagcgaggaggccagcgaggtgcccctgtggctggacagaaaggagagcgccgtgcccaccacccccgcccccctgcagatcagccccttcaccagccagccctacgtggcccacaccctgccccagagacccgagcccggcgagcccggccccgacatggcccaggaggccccccaggaggacaccagccccatggccctgatggacaagggcgagaacgagctgaccggcagcgccagcgaggagagccaggagaccaccaccagcaccatcatcaccaccaccgtgatcaccaccgagcaggcccccgccctgtgcagcgtgagcttcagcaaccccgagggctacatcgacagcagcgactaccccctgctgcccctgaacaacttcctggagtgcacctacaacgtgaccgtgtacaccggctacggcgtggagctgcaggtgaagagcgtgaacctgagcgacggcgagctgctgagcatcagaggcgtggacggccccaccctgaccgtgctggccaaccagaccctgctggtggagggccaggtgatcagaagccccaccaacaccatcagcgtgtacttcagaaccttccaggacgacggcctgggcaccttccagctgcactaccaggccttcatgctgagctgcaacttccccagaagacccgacagcggcgacgtgaccgtgatggacctgcacagcggcggcgtggcccacttccactgccacctgggctacgagctgcagggcgccaagatgctgacctgcatcaacgccagcaagccccactggagcagccaggagcccatctgcagcgccccctgcggcggcgccgtgcacaacgccaccatcggcagagtgctgagccccagctaccccgagaacaccaacggcagccagttctgcatctggaccatcgaggcccccgagggccagaagctgcacctgcacttcgagagactgctgctgcacgacaaggacagaatgaccgtgcacagcggccagaccaacaagagcgccctgctgtacgacagcctgcagaccgagagcgtgcccttcgagggcctgctgagcgagggcaacaccatcagaatcgagttcaccagcgaccaggccagagccgccagcaccttcaacatcagattcgaggccttcgagaagggccactgctacgagccctacatccagaacggcaacttcaccaccagcgaccccacctacaacatcggcaccatcgtggagttcacctgcgaccccggccacagcctggagcagggccccgccatcatcgagtgcatcaacgtgagagacccctactggaacgacaccgagcccctgtgcagagccatgtgcggcggcgagctgagcgccgtggccggcgtggtgctgagccccaactggcccgagccctacgtggagggcgaggactgcatctggaagatccacgtgggcgaggagaagagaatcttcctggacatccagttcctgaacctgagcaacagcgacatcctgaccatctacgacggcgacgaggtgatgccccacatcctgggccagtacctgggcaacagcggcccccagaagctgtacagcagcacccccgacctgaccatccagttccacagcgaccccgccggcctgatcttcggcaagggccagggcttcatcatgaactacatcgaggtgagcagaaacgacagctgcagcgacctgcccgagatccagaacggctggaagaccaccagccacaccgagctggtgagaggcgccagaatcacctaccagtgcgaccccggctacgacatcgtgggcagcgacaccctgacctgccagtgggacctgagctggagcagcgacccccccttctgcgagaagatcatgtactgcaccgaccccggcgaggtggaccacagcaccagactgatcagcgaccccgtgctgctggtgggcaccaccatccagtacacctgcaaccccggcttcgtgctggagggcagcagcctgctgacctgctacagcagagagaccggcacccccatctggaccagcagactgccccactgcgtgctggccgaggccgccgccgagaccagcctggagggcggcaacatggccctggccatcttcatccccgtgctgatcatcagcctgctgctgggcggcgcctacatctacatcaccagatgcagatactacagcaacctgagactgcccctgatgtacagccacccctacagccagatcaccgtggagaccgagttcgacaaccccatctacgagaccggcgagaccagagagtacgaggtgagcatctag

SEQ ID NO: 98245 - DNA, 2850 bp, Artificial Sequence
  Description of Artificial Sequence: Synthetic coding sequence
atgcccgccgccagaccccccgccgccggcctgagaggcatcagcctgttcctggccctgctgctgggcagccccgccgccgccctggagagagacgccctgcccgagggcgacgccagccccctgggcccctacctgctgcccagcggcgcccccgagagaggcagccccggcaaggagcaccccgaggagagagtggtgaccgccccccccagcagcagccagagcgccgaggtgctgggcgagctggtgctggacggcaccgcccccagcgcccaccacgacatccccgccctgagccccctgctgcccgaggaggccagacccaagcacgccctgccccccaagaagaagctgcccagcctgaagcaggtgaacagcgccagaaagcagctgagacccaaggccaccagcgccgccaccgtgcagagagccggcagccagcccgccagccagggcctggacctgctgagcagcagcaccgagaagcccggcccccccggcgaccccgaccccatcgtggccagcgaggaggccagcgaggtgcccctgtggctggacagaaaggagagcgccgtgcccaccacccccgcccccctgcagatcagccccttcaccagccagccctacgtggcccacaccctgccccagagacccgagcccggcgagcccggccccgacatggcccaggaggccccccaggaggacaccagccccatggccctgatggacaagggcgagaacgagctgaccggcagcgccagcgaggagagccaggagaccaccaccagcaccatcatcaccaccaccgtgatcaccaccgagcaggcccccgccctgtgcagcgtgagcttcagcaaccccgagggctacatcgacagcagcgactaccccctgctgcccctgaacaacttcctggagtgcacctacaacgtgaccgtgtacaccggctacggcgtggagctgcaggtgaagagcgtgaacctgagcgacggcgagctgctgagcatcagaggcgtggacggccccaccctgaccgtgctggccaaccagaccctgctggtggagggccaggtgatcagaagccccaccaacaccatcagcgtgtacttcagaaccttccaggacgacggcctgggcaccttccagctgcactaccaggccttcatgctgagctgcaacttccccagaagacccgacagcggcgacgtgaccgtgatggacctgcacagcggcggcgtggcccacttccactgccacctgggctacgagctgcagggcgccaagatgctgacctgcatcaacgccagcaagccccactggagcagccaggagcccatctgcagcgccccctgcggcggcgccgtgcacaacgccaccatcggcagagtgctgagccccagctaccccgagaacaccaacggcagccagttctgcatctggaccatcgaggcccccgagggccagaagctgcacctgcacttcgagagactgctgctgcacgacaaggacagaatgaccgtgcacagcggccagaccaacaagagcgccctgctgtacgacagcctgcagaccgagagcgtgcccttcgagggcctgctgagcgagggcaacaccatcagaatcgagttcaccagcgaccaggccagagccgccagcaccttcaacatcagattcgaggccttcgagaagggccactgctacgagccctacatccagaacggcaacttcaccaccagcgaccccacctacaacatcggcaccatcgtggagttcacctgcgaccccggccacagcctggagcagggccccgccatcatcgagtgcatcaacgtgagagacccctactggaacgacaccgagcccctgtgcagagccatgtgcggcggcgagctgagcgccgtggccggcgtggtgctgagccccaactggcccgagccctacgtggagggcgaggactgcatctggaagatccacgtgggcgaggagaagagaatcttcctggacatccagttcctgaacctgagcaacagcgacatcctgaccatctacgacggcgacgaggtgatgccccacatcctgggccagtacctgggcaacagcggcccccagaagctgtacagcagcacccccgacctgaccatccagttccacagcgaccccgccggcctgatcttcggcaagggccagggcttcatcatgaactacatcgaggtgagcagaaacgacagctgcagcgacctgcccgagatccagaacggctggaagaccaccagccacaccgagctggtgagaggcgccagaatcacctaccagtgcgaccccggctacgacatcgtgggcagcgacaccctgacctgccagtgggacctgagctggagcagcgacccccccttctgcgagaagaccgaggagagcctggcctgcgacaaccccggcctgcccgagaacggctaccagatcctgtacaagagactgtacctgcccggcgagagcctgaccttcatgtgctacgagggcttcgagctgatgggcgaggtgaccatcagatgcatcctgggccagcccagccactggaacggccccctgcccgtgtgcaaggtggccgaggccgccgccgagaccagcctggagggcggcaacatggccctggccatcttcatccccgtgctgatcatcagcctgctgctgggcggcgcctacatctacatcaccagatgcagatactacagcaacctgagactgcccctgatgtacagccacccctacagccagatcaccgtggagaccgagttcgacaaccccatctacgagaccggcgagaccagagagtacgaggtgagcatctag

SEQ ID NO: 98246 - DNA, 420 bp, Artificial Sequence
  Description of Artificial Sequence: Synthetic coding sequence
atgtactgcaccgaccccggcgaggtggaccacagcaccagactgatcagcgaccccgtgctgctggtgggcaccaccatccagtacacctgcaaccccggcttcgtgctggagggcagcagcctgctgacctgctacagcagagagaccggcacccccatctggaccagcagactgccccactgcgtgagcgaggagagcctggcctgcgacaaccccggcctgcccgagaacggctaccagatcctgtacaagagactgtacctgcccggcgagagcctgaccttcatgtgctacgagggcttcgagctgatgggcgaggtgaccatcagatgcatcctgggccagcccagccactggaacggccccctgcccgtgtgcaaggacgtggccaccatccccaccagcgcctgcctgtag

SEQ ID NO: 98247 - DNA, 3042 bp, Artificial Sequence
  Description of Artificial Sequence: Synthetic coding sequence
atgcccgccgccagaccccccgccgccggcctgagaggcatcagcctgttcctggccctgctgctgggcagccccgccgccgccctggagagagacgccctgcccgagggcgacgccagccccctgggcccctacctgctgcccagcggcgcccccgagagaggcagccccggcaaggagcaccccgaggagagagtggtgaccgccccccccagcagcagccagagcgccgaggtgctgggcgagctggtgctggacggcaccgcccccagcgcccaccacgacatccccgccctgagccccctgctgcccgaggaggccagacccaagcacgccctgccccccaagaagaagctgcccagcctgaagcaggtgaacagcgccagaaagcagctgagacccaaggccaccagcgccgccaccgtgcagagagccggcagccagcccgccagccagggcctggacctgctgagcagcagcaccgagaagcccggcccccccggcgaccccgaccccatcgtggccagcgaggaggccagcgaggtgcccctgtggctggacagaaaggagagcgccgtgcccaccacccccgcccccctgcagatcagccccttcaccagccagccctacgtggcccacaccctgccccagagacccgagcccggcgagcccggccccgacatggcccaggaggccccccaggaggacaccagccccatggccctgatggacaagggcgagaacgagctgaccggcagcgccagcgaggagagccaggagaccaccaccagcaccatcatcaccaccaccgtgatcaccaccgagcaggcccccgccctgtgcagcgtgagcttcagcaaccccgagggctacatcgacagcagcgactaccccctgctgcccctgaacaacttcctggagtgcacctacaacgtgaccgtgtacaccggctacggcgtggagctgcaggtgaagagcgtgaacctgagcgacggcgagctgctgagcatcagaggcgtggacggccccaccctgaccgtgctggccaaccagaccctgctggtggagggccaggtgatcagaagccccaccaacaccatcagcgtgtacttcagaaccttccaggacgacggcctgggcaccttccagctgcactaccaggccttcatgctgagctgcaacttccccagaagacccgacagcggcgacgtgaccgtgatggacctgcacagcggcggcgtggcccacttccactgccacctgggctacgagctgcagggcgccaagatgctgacctgcatcaacgccagcaagccccactggagcagccaggagcccatctgcagcgccccctgcggcggcgccgtgcacaacgccaccatcggcagagtgctgagccccagctaccccgagaacaccaacggcagccagttctgcatctggaccatcgaggcccccgagggccagaagctgcacctgcacttcgagagactgctgctgcacgacaaggacagaatgaccgtgcacagcggccagaccaacaagagcgccctgctgtacgacagcctgcagaccgagagcgtgcccttcgagggcctgctgagcgagggcaacaccatcagaatcgagttcaccagcgaccaggccagagccgccagcaccttcaacatcagattcgaggccttcgagaagggccactgctacgagccctacatccagaacggcaacttcaccaccagcgaccccacctacaacatcggcaccatcgtggagttcacctgcgaccccggccacagcctggagcagggccccgccatcatcgagtgcatcaacgtgagagacccctactggaacgacaccgagcccctgtgcagagccatgtgcggcggcgagctgagcgccgtggccggcgtggtgctgagccccaactggcccgagccctacgtggagggcgaggactgcatctggaagatccacgtgggcgaggagaagagaatcttcctggacatccagttcctgaacctgagcaacagcgacatcctgaccatctacgacggcgacgaggtgatgccccacatcctgggccagtacctgggcaacagcggcccccagaagctgtacagcagcacccccgacctgaccatccagttccacagcgaccccgccggcctgatcttcggcaagggccagggcttcatcatgaactacatcgaggtgagcagaaacgacagctgcagcgacctgcccgagatccagaacggctggaagaccaccagccacaccgagctggtgagaggcgccagaatcacctaccagtgcgaccccggctacgacatcgtgggcagcgacaccctgacctgccagtgggacctgagctggagcagcgacccccccttctgcgagaagatcatgtactgcaccgaccccggcgaggtggaccacagcaccagactgatcagcgaccccgtgctgctggtgggcaccaccatccagtacacctgcaaccccggcttcgtgctggagggcagcagcctgctgacctgctacagcagagagaccggcacccccatctggaccagcagactgccccactgcgtgagcgaggagagcctggcctgcgacaaccccggcctgcccgagaacggctaccagatcctgtacaagagactgtacctgcccggcgagagcctgaccttcatgtgctacgagggcttcgagctgatgggcgaggtgaccatcagatgcatcctgggccagcccagccactggaacggccccctgcccgtgtgcaaggtggccgaggccgccgccgagaccagcctggagggcggcaacatggccctggccatcttcatccccgtgctgatcatcagcctgctgctgggcggcgcctacatctacatcaccagatgcagatactacagcaacctgagactgcccctgatgtacagccacccctacagccagatcaccgtggagaccgagttcgacaaccccatctacgagaccggcgagaccagagagtacgaggtgagcatctag

SEQ ID NO: 98248 - DNA, 3072 bp, Artificial Sequence
  Description of Artificial Sequence: Synthetic coding sequence
atgcccgccgccagaccccccgccgccggcctgagaggcatcagcctgttcctggccctgctgctgggcagccccgccgccgccctggagagagacgccctgcccgagggcgacgccagccccctgggcccctacctgctgcccagcggcgcccccgagagaggcagccccggcaaggagcaccccgaggagagagtggtgaccgccccccccagcagcagccagagcgccgaggtgctgggcgagctggtgctggacggcaccgcccccagcgcccaccacgacatccccgccctgagccccctgctgcccgaggaggccagacccaagcacgccctgccccccaagaagaagctgcccagcctgaagcaggtgaacagcgccagaaagcagctgagacccaaggccaccagcgccgccaccgtgcagagagccggcagccagcccgccagccagggcctggacctgctgagcagcagcaccgagaagcccggcccccccggcgaccccgaccccatcgtggccagcgaggaggccagcgaggtgcccctgtggctggacagaaaggagagcgccgtgcccaccacccccgcccccctgcagatcagccccttcaccagccagccctacgtggcccacaccctgccccagagacccgagcccggcgagcccggccccgacatggcccaggaggccccccaggaggacaccagccccatggccctgatggacaagggcgagaacgagctgaccggcagcgccagcgaggagagccaggagaccaccaccagcaccatcatcaccaccaccgtgatcaccaccgagcaggcccccgccctgtgcagcgtgagcttcagcaaccccgagggctacatcgacagcagcgactaccccctgctgcccctgaacaacttcctggagtgcacctacaacgtgaccgtgtacaccggctacggcgtggagctgcaggtgaagagcgtgaacctgagcgacggcgagctgctgagcatcagaggcgtggacggccccaccctgaccgtgctggccaaccagaccctgctggtggagggccaggtgatcagaagccccaccaacaccatcagcgtgtacttcagaaccttccaggacgacggcctgggcaccttccagctgcactaccaggccttcatgctgagctgcaacttccccagaagacccgacagcggcgacgtgaccgtgatggacctgcacagcggcggcgtggcccacttccactgccacctgggctacgagctgcagggcgccaagatgctgacctgcatcaacgccagcaagccccactggagcagccaggagcccatctgcagcgccccctgcggcggcgccgtgcacaacgccaccatcggcagagtgctgagccccagctaccccgagaacaccaacggcagccagttctgcatctggaccatcgaggcccccgagggccagaagctgcacctgcacttcgagagactgctgctgcacgacaaggacagaatgaccgtgcacagcggccagaccaacaagagcgccctgctgtacgacagcctgcagaccgagagcgtgcccttcgagggcctgctgagcgagggcaacaccatcagaatcgagttcaccagcgaccaggccagagccgccagcaccttcaacatcagattcgaggccttcgagaagggccactgctacgagccctacatccagaacggcaacttcaccaccagcgaccccacctacaacatcggcaccatcgtggagttcacctgcgaccccggccacagcctggagcagggccccgccatcatcgagtgcatcaacgtgagagacccctactggaacgacaccgagcccctgtgcagagccatgtgcggcggcgagctgagcgccgtggccggcgtggtgctgagccccaactggcccgagccctacgtggagggcgaggactgcatctggaagatccacgtgggcgaggagaagagaatcttcctggacatccagttcctgaacctgagcaacagcgacatcctgaccatctacgacggcgacgaggtgatgccccacatcctgggccagtacctgggcaacagcggcccccagaagctgtacagcagcacccccgacctgaccatccagttccacagcgaccccgccggcctgatcttcggcaagggccagggcttcatcatgaactacatcgaggtgagcagaaacgacagctgcagcgacctgcccgagatccagaacggctggaagaccaccagccacaccgagctggtgagaggcgccagaatcacctaccagtgcgaccccggctacgacatcgtgggcagcgacaccctgacctgccagtgggacctgagctggagcagcgacccccccttctgcgagaagatcatgtactgcaccgaccccggcgaggtggaccacagcaccagactgatcagcgaccccgtgctgctggtgggcaccaccatccagtacacctgcaaccccggcttcgtgctggagggcagcagcctgctgacctgctacagcagagagaccggcacccccatctggaccagcagactgccccactgcgtgagcgaggagagcctggcctgcgacaaccccggcctgcccgagaacggctaccagatcctgtacaagagactgtacctgcccggcgagagcctgaccttcatgtgctacgagggcttcgagctgatgggcgaggtgaccatcagatgcatcctgggccagcccagccactggaacggccccctgcccgtgtgcaaggtgaaccaggacagcttcgagcacgccctggaggccgaggccgccgccgagaccagcctggagggcggcaacatggccctggccatcttcatccccgtgctgatcatcagcctgctgctgggcggcgcctacatctacatcaccagatgcagatactacagcaacctgagactgcccctgatgtacagccacccctacagccagatcaccgtggagaccgagttcgacaaccccatctacgagaccggcgagaccagagagtacgaggtgagcatctag

SEQ ID NO: 98249 - DNA, 258 bp, Artificial Sequence
  Description of Artificial Sequence: Synthetic coding sequence
ggcttcggcaccgacgtggactacgagaccgccttcatccactacagactggccagcgagcagcagcacagcgcccaggccatgttcaacctgggctacatgcacgagaagggcctgggcatcaagcaggacatccacctggccaagagattctacgacatggccgccagccagcccagatgcaccagcagcagcctgcccagccccctgcagatcggcagaagactgttcctggccgtgcacaccggcaacaagtag

SEQ ID NO: 98250 - DNA, 2385 bp, Artificial Sequence
  Description of Artificial Sequence: Synthetic coding sequence
atgagagtgagaatcggcctgaccctgctgctgtgcgccgtgctgctgagcctggccagcgccagcagcgacgaggagggcagccaggacgagagcctggacagcaagaccaccctgaccagcgacgagagcgtgaaggaccacaccaccgccggcagagtggtggccggccagatcttcctggacagcgaggagagcgagctggagagcagcatccaggaggaggaggacagcctgaagagccaggagggcgagagcgtgaccgaggacatcagcttcctggagagccccaaccccgagaacaaggactacgaggagcccaagaaggtgagaaagcccgccctgaccgccatcgagggcaccgcccacggcgagccctgccacttccccttcctgttcctggacaaggagtacgacgagtgcaccagcgacggcagagaggacggcagactgtggtgcgccaccacctacgactacaaggccgacgagaagtggggcttctgcgagaccgaggaggaggccgccaagagaagacagatgcaggaggccgagatgatgtaccagaccggcatgaagatcctgaacggcagcaacaagaagagccagaagagagaggcctacagatacctgcagaaggccgccagcatgaaccacaccaaggccctggagagagtgagctacgccctgctgttcggcgactacctgccccagaacatccaggccgccagagagatgttcgagaagctgaccgaggagggcagccccaagggccagaccgccctgggcttcctgtacgccagcggcctgggcgtgaacagcagccaggccaaggccctggtgtactacaccttcggcgccctgggcggcaacctgatcgcccacatggtgctgggctacagatactgggccggcatcggcgtgctgcagagctgcgagagcgccctgacccactacagactggtggccaaccacgtggccagcgacatcagcctgaccggcggcagcgtggtgcagagaatcagactgcccgacgaggtggagaaccccggcatgaacagcggcatgctggaggaggacctgatccagtactaccagttcctggccgagaagggcgacgtgcaggcccaggtgggcctgggccagctgcacctgcacggcggcagaggcgtggagcagaaccaccagagagccttcgactacttcaacctggccgccaacgccggcaacagccacgccatggccttcctgggcaagatgtacagcgagggcagcgacatcgtgccccagagcaacgagaccgccctgcactacttcaagaaggccgccgacatgggcaaccccgtgggccagagcggcctgggcatggcctacctgtacggcagaggcgtgcaggtgaactacgacctggccctgaagtacttccagaaggccgccgagcagggctgggtggacggccagctgcagctgggcagcatgtactacaacggcatcggcgtgaagagagactacaagcaggccctgaagtacttcaacctggccagccagggcggccacatcctggccttctacaacctggcccagatgcacgccagcggcaccggcgtgatgagaagctgccacaccgccgtggagctgttcaagaacgtgtgcgagagaggcagatggagcgagagactgatgaccgcctacaacagctacaaggacggcgactacaacgccgccgtgatccagtacctgctgctggccgagcagggctacgaggtggcccagagcaacgccgccttcatcctggaccagagagaggccagcatcgtgggcgagaacgagacctaccccagagccctgctgcactggaacagagccgccagccagggctacaccgtggccagaatcaagctgggcgactaccacttctacggcttcggcaccgacgtggactacgagaccgccttcatccactacagactggccagcgagcagcagcacagcgcccaggccatgttcaacctgggctacatgcacgagaagggcctgggcatcaagcaggacatccacctggccaagagattctacgacatggccgccgaggccagccccgacgcccaggtgcccgtgttcctggccctgtgcaagctgggcgtggtgtacttcctgcagtacatcagagagaccaacatcagagacatgttcacccagctggacatggaccagctgctgggccccgagtgggacctgtacctgatgaccatcatcgccctgctgctgggcaccgtgatcgcctacagacagagacagcaccaggacatgcccgcccccagaccccccggccccagacccgcccccccccagcaggagggcccccccgagcagcagcccccccagtag

SEQ ID NO: 98251 - DNA, 906 bp, Artificial Sequence
  Description of Artificial Sequence: Synthetic coding sequence
atgagagtgagaatcggcctgaccctgctgctgtgcgccgtgctgctgagcctggccagcgccagcagcgacgaggagggcagccaggacgagagcctggacagcaagaccaccctgaccagcgacgagagcgtgaaggaccacaccaccgccggcagagtggtggccggccagatcttcctggacagcgaggagagcgagctggagagcagcatccaggaggaggaggacagcctgaagagccaggagggcgagagcgtgaccgaggacatcagcttcctggagagccccaaccccgagaacaaggactacgaggagcccaagaaggtgagaaagcccgccctgaccgccatcgagggcaccgcccacggcgagccctgccacttccccttcctgttcctggacaaggagtacgacgagtgcaccagcgacggcagagaggacggcagactgtggtgcgccaccacctacgactacaaggccgacgagaagtggggcttctgcgagaccgaggaggaggccgccaagagaagacagatgcaggaggccgagatgatgtaccagaccggcatgaagatcctgaacggcagcaacaagaagagccagaagagagaggcctacagatacctgcagaaggccgccagcatgaaccacaccaaggccctggagagagtgagctacgccctgctgttcggcgactacctgccccagaacatccaggccgccagagagatgttcgagaagctgaccgaggagggcagccccaagggccagaccgccctgggcttcctgtacgccagcggcctgggcgtgaacagcagccaggccaaggccctggtgtactacaccttcggcgccctgggcggcaacctgatcgcccacatggtgctggtgagcagactgtag

SEQ ID NO: 98252 - DNA, 2067 bp, Artificial Sequence
  Description of Artificial Sequence: Synthetic coding sequence
atgaagcccctgagcctgctgatcgagatcctgatcatcctgggcgtgaccatcaagaccatcaaggccgaggagcacaacaagagacagaaggagagaaacgtgaccacccaggtgagcgtgaacgagatcaagcagtacctgagccacatcctggagcagagaaccagcagcaacgtgatcaacaagagagagaacctgctggagaagaagaagaaccagagaaagatcagaatcaagggcatccagaacaaggacatcctgaagagaaacaagaaccacctgcagaagcaggccgagaagaacttcaccgacgagggcgaccagctgttcaagatgggcatcaaggtgctgcagcagagcaagagccagaagcagaaggaggaggcctacctgctgttcgccaaggccgccgacatgggcaacctgaaggccatggagaagatggccgacgccctgctgttcggcaacttcggcgtgcagaacatcaccgccgccatccagctgtacgagagcctggccaaggagggcagctgcaaggcccagaacgccctgggcttcctgagcagctacggcatcggcatggagtacgaccaggccaaggccctgatctactacaccttcggcagcgccggcggcaacatgatgagccagatgatcctgggctacagatacctgagcggcatcaacgtgctgcagaactgcgaggtggccctgagctactacaagaaggtggccgactacatcgccgacaccttcgagaagagcgagggcgtgcccgtggagaaggtgagactgaccgagagacccgagaacctgagcagcaacagcgagatcctggactgggacatctaccagtactacaagttcctggccgagagaggcgacgtgcagatccaggtgagcctgggccagctgcacctgatcggcagaaagggcctggaccaggactactacaaggccctgcactacttcctgaaggccgccaaggccggcagcgccaacgccatggccttcatcggcaagatgtacctggagggcaacgccgccgtgccccagaacaacgccaccgccttcaagtacttcagcatggccgccagcaagggcaacgccatcggcctgcacggcctgggcctgctgtacttccacggcaagggcgtgcccctgaactacgccgaggccctgaagtacttccagaaggccgccgagaagggctggcccgacgcccagttccagctgggcttcatgtactacagcggcagcggcatctggaaggactacaagctggccttcaagtacttctacctggccagccagagcggccagcccctggccatctactacctggccaagatgtacgccaccggcaccggcgtggtgagaagctgcagaaccgccgtggagctgtacaagggcgtgtgcgagctgggccactgggccgagaagttcctgaccgcctacttcgcctacaaggacggcgacatcgacagcagcctggtgcagtacgccctgctggccgagatgggctacgaggtggcccagagcaacagcgccttcatcctggagagcaagaaggccaacatcctggagaaggagaagatgtaccccatggccctgctgctgtggaacagagccgccatccagggcaacgccttcgccagagtgaagatcggcgactaccactactacggctacggcaccaagaaggactaccagaccgccgccacccactacagcatcgccgccaacaagtaccacaacgcccaggccatgttcaacctggcctacatgtacgagcacggcctgggcatcaccaaggacatccacctggccagaagactgtacgacatggccgcccagaccagccccgacgcccacatccccgtgctgttcgccgtgatgaagctggagaccacccacctgctgagagacatcctgttcttcaacttcaccaccagatggaactggctgaagctggacaacaccatcggcccccactgggacctgttcgtgatcggcctgatcgtgcccggcctgatcctgctgctgagaaaccaccacggctag

SEQ ID NO: 98253 - DNA, 1728 bp, Artificial Sequence
  Description of Artificial Sequence: Synthetic coding sequence
atgaagcccctgagcctgctgatcgagatcctgatcatcctgggcgtgaccatcaagaccatcaaggccgaggagcacaacaagagacagaaggagagaaacgtgaccacccaggtgagcgtgaacgagatcaagcagtacctgagccacatcctggagcagagaaccagcagcaacgtgatcaacaagagagagaacctgctggagaagaagaagaaccagagaaagatcagaatcaagggcatccagaacaaggacatcctgaagagaaacaagaaccacctgcagaagcaggccgagaagaacttcaccgacgagggcgaccagctgttcaagatgggcatcaaggtgctgcagcagagcaagagccagaagcagaaggaggaggcctacctgctgttcgccaaggccgccgacatgggcaacctgaaggccatggagaagatggccgacgccctgctgttcggcaacttcggcgtgcagaacatcaccgccgccatccagctgtacgagagcctggccaaggagggcagctgcaaggcccagaacgccctgggcttcctgagcagctacggcatcggcatggagtacgaccaggccaaggccctgatctactacaccttcggcagcgccggcggcaacatgatgagccagatgatcctgggctacagatacctgagcggcatcaacgtgctgcagaactgcgaggtggccctgagctactacaagaaggtggccgactacatcgccgacaccttcgagaagagcgagggcgtgcccgtggagaaggtgagactgaccgagagacccgagaacctgagcagcaacagcgagatcctggactgggacatctaccagtactacaagttcctggccgagagaggcgacgtgcagatccaggtgagcctgggccagctgcacctgatcggcagaaagggcctggaccaggactactacaaggccctgcactacttcctgaaggccgccaaggccggcagcgccaacgccatggccttcatcggcaagatgtacctggagggcaacgccgccgtgccccagaacaacgccaccgccttcaagtacttcagcatggccgccagcaagggcaacgccatcggcctgcacggcctgggcctgctgtacttccacggcaagggcgtgcccctgaactacgccgaggccctgaagtacttccagaaggccgccgagaagggctggcccgacgcccagttccagctgggcttcatgtactacagcggcagcggcatctggaaggactacaagctggccttcaagtacttctacctggccagccagagcggccagcccctggccatctactacctggccaagatgtacgccaccggcaccggcgtggtgagaagctgcagaaccgccgtggagaagagactgaccttcctgaagaagagaagatgcatccagtggagattcagctacggcatcgagctgcccttcaaggacatccacctggccagaagactgtacgacatggccgcccagaccagccccgacgcccacatccccgtgctgttcgccgtgatgaagctggagaccacccacctgctgagagacatcctgttcttcaacttcaccaccagatggaactggctgaagctggacaacaccatcggcccccactgggacctgttcgtgatcggcctgatcgtgcccggcctgatcctgctgctgagaaaccaccacggctag

SEQ ID NO: 98254 - DNA, 1833 bp, Artificial Sequence
  Description of Artificial Sequence: Synthetic coding sequence
atgatcgccagccagttcctgagcgccctgaccctggtgctgctgatcaaggagagcggcgcctggagctacaacaccagcaccgaggccatgacctacgacgaggccagcgcctactgccagcagagatacacccacctggtggccatccagaacaaggaggagatcgagtacctgaacagcatcctgagctacagccccagctactactggatcggcatcagaaaggtgaacaacgtgtgggtgtgggtgggcacccagaagcccctgaccgaggaggccaagaactgggcccccggcgagcccaacaacagacagaaggacgaggactgcgtggagatctacatcaagagagagaaggacgtgggcatgtggaacgacgagagatgcagcaagaagaagctggccctgtgctacaccgccgcctgcaccaacaccagctgcagcggccacggcgagtgcgtggagaccatcaacaactacacctgcaagtgcgaccccggcttcagcggcctgaagtgcgagcagatcgtgaactgcaccgccctggagagccccgagcacggcagcctggtgtgcagccaccccctgggcaacttcagctacaacagcagctgcagcatcagctgcgacagaggctacctgcccagcagcatggagaccatgcagtgcatgagcagcggcgagtggagcgcccccatccccgcctgcaacgtggtggagtgcgacgccgtgaccaaccccgccaacggcttcgtggagtgcttccagaaccccggcagcttcccctggaacaccacctgcaccttcgactgcgaggagggcttcgagctgatgggcgcccagagcctgcagtgcaccagcagcggcaactgggacaacgagaagcccacctgcaaggccgtgacctgcagagccgtgagacagccccagaacggcagcgtgagatgcagccacagccccgccggcgagttcaccttcaagagcagctgcaacttcacctgcgaggagggcttcatgctgcagggccccgcccaggtggagtgcaccacccagggccagtggacccagcagatccccgtgtgcgaggccttccagtgcaccgccctgagcaaccccgagagaggctacatgaactgcctgcccagcgccagcggcagcttcagatacggcagcagctgcgagttcagctgcgagcagggcttcgtgctgaagggcagcaagagactgcagtgcggccccaccggcgagtgggacaacgagaagcccacctgcgaggccgtgagatgcgacgccgtgcaccagccccccaagggcctggtgagatgcgcccacagccccatcggcgagttcacctacaagagcagctgcgccttcagctgcgaggagggcttcgagctgcacggcagcacccagctggagtgcaccagccagggccagtggaccgaggaggtgcccagctgccaggtggtgaagtgcagcagcctggccgtgcccggcaagatcaacatgagctgcagcggcgagcccgtgttcggcaccgtgtgcaagttcgcctgccccgagggctggaccctgaacggcagcgccgccagaacctgcggcgccaccggccactggagcggcctgctgcccacctgcgaggcccccaccgagagcaacatccccctggtggccggcctgagcgccgccggcctgagcctgctgaccctggcccccttcctgctgtggctgagaaagtgcctgagaaaggccaagaagttcgtgcccgccagcagctgccagagcctggagagcgacggcagctaccagaagcccagctacatcctgtag

SEQ ID NO: 98255 - DNA, 1455 bp, Artificial Sequence
  Description of Artificial Sequence: Synthetic coding sequence
atgatcgccagccagttcctgagcgccctgaccctggtgctgctgatcaaggagagcggcgcctggagctacaacaccagcaccgaggccatgacctacgacgaggccagcgcctactgccagcagagatacacccacctggtggccatccagaacaaggaggagatcgagtacctgaacagcatcctgagctacagccccagctactactggatcggcatcagaaaggtgaacaacgtgtgggtgtgggtgggcacccagaagcccctgaccgaggaggccaagaactgggcccccggcgagcccaacaacagacagaaggacgaggactgcgtggagatctacatcaagagagagaaggacgtgggcatgtggaacgacgagagatgcagcaagaagaagctggccctgtgctacaccgccgcctgcaccaacaccagctgcagcggccacggcgagtgcgtggagaccatcaacaactacacctgcaagtgcgaccccggcttcagcggcctgaagtgcgagcagatcgtgaactgcaccgccctggagagccccgagcacggcagcctggtgtgcagccaccccctgggcaacttcagctacaacagcagctgcagcatcagctgcgacagaggctacctgcccagcagcatggagaccatgcagtgcatgagcagcggcgagtggagcgcccccatccccgcctgcaacgtggtggagtgcgacgccgtgaccaaccccgccaacggcttcgtggagtgcttccagaaccccggcagcttcccctggaacaccacctgcaccttcgactgcgaggagggcttcgagctgatgggcgcccagagcctgcagtgcaccagcagcggcaactgggacaacgagaagcccacctgcaaggccgtgacctgcagagccgtgagacagccccagaacggcagcgtgagatgcagccacagccccgccggcgagttcaccttcaagagcagctgcaacttcacctgcgaggagggcttcatgctgcagggccccgcccaggtggagtgcaccacccagggccagtggacccagcagatccccgtgtgcgaggtggtgaagtgcagcagcctggccgtgcccggcaagatcaacatgagctgcagcggcgagcccgtgttcggcaccgtgtgcaagttcgcctgccccgagggctggaccctgaacggcagcgccgccagaacctgcggcgccaccggccactggagcggcctgctgcccacctgcgaggcccccaccgagagcaacatccccctggtggccggcctgagcgccgccggcctgagcctgctgaccctggcccccttcctgctgtggctgagaaagtgcctgagaaaggccaagaagttcgtgcccgccagcagctgccagagcctggagagcgacggcagctaccagaagcccagctacatcctgtag

SEQ ID NO: 98256 - DNA, 1458 bp, Artificial Sequence
  Description of Artificial Sequence: Synthetic coding sequence
atgatcgccagccagttcctgagcgccctgaccctggtgctgctgatcaaggagagcggcgcctggagctacaacaccagcaccgaggccatgacctacgacgaggccagcgcctactgccagcagagatacacccacctggtggccatccagaacaaggaggagatcgagtacctgaacagcatcctgagctacagccccagctactactggatcggcatcagaaaggtgaacaacgtgtgggtgtgggtgggcacccagaagcccctgaccgaggaggccaagaactgggcccccggcgagcccaacaacagacagaaggacgaggactgcgtggagatctacatcaagagagagaaggacgtgggcatgtggaacgacgagagatgcagcaagaagaagctggccctgtgctacaccgccgcctgcaccaacaccagctgcagcggccacggcgagtgcgtggagaccatcaacaactacacctgcaagtgcgaccccggcttcagcggcctgaagtgcgagcagatggtggagtgcgacgccgtgaccaaccccgccaacggcttcgtggagtgcttccagaaccccggcagcttcccctggaacaccacctgcaccttcgactgcgaggagggcttcgagctgatgggcgcccagagcctgcagtgcaccagcagcggcaactgggacaacgagaagcccacctgcaaggccgtgacctgcagagccgtgagacagccccagaacggcagcgtgagatgcagccacagccccgccggcgagttcaccttcaagagcagctgcaacttcacctgcgaggagggcttcatgctgcagggccccgcccaggtggagtgcaccacccagggccagtggacccagcagatccccgtgtgcgaggccgtgagatgcgacgccgtgcaccagccccccaagggcctggtgagatgcgcccacagccccatcggcgagttcacctacaagagcagctgcgccttcagctgcgaggagggcttcgagctgcacggcagcacccagctggagtgcaccagccagggccagtggaccgaggaggtgcccagctgccaggtggtgaagtgcagcagcctggccgtgcccggcaagatcaacatgagctgcagcggcgagcccgtgttcggcaccgtgtgcaagttcgcctgccccgagggctggaccctgaacggcagcgccgccagaacctgcggcgccaccggccactggagcggcctgctgcccacctgcgaggcccccaccgagagcaacatccccctggtggccggcctgagcgccgccggcctgagcctgctgaccctggcccccttcctgctgtggctgagaaagtgcctgagaaaggccaagaagttcgtgcccgccagcagctgccagagcctggagagcgacggcagctaccagaagcccagctacatcctgtag

SEQ ID NO: 98257 - DNA, 1644 bp, Artificial Sequence
  Description of Artificial Sequence: Synthetic coding sequence
atgatcgccagccagttcctgagcgccctgaccctggtgctgctgatcaaggagagcggcgcctggagctacaacaccagcaccgaggccatgacctacgacgaggccagcgcctactgccagcagagatacacccacctggtggccatccagaacaaggaggagatcgagtacctgaacagcatcctgagctacagccccagctactactggatcggcatcagaaaggtgaacaacgtgtgggtgtgggtgggcacccagaagcccctgaccgaggaggccaagaactgggcccccggcgagcccaacaacagacagaaggacgaggactgcgtggagatctacatcaagagagagaaggacgtgggcatgtggaacgacgagagatgcagcaagaagaagctggccctgtgctacaccgccgcctgcaccaacaccagctgcagcggccacggcgagtgcgtggagaccatcaacaactacacctgcaagtgcgaccccggcttcagcggcctgaagtgcgagcagatcgtgaactgcaccgccctggagagccccgagcacggcagcctggtgtgcagccaccccctgggcaacttcagctacaacagcagctgcagcatcagctgcgacagaggctacctgcccagcagcatggagaccatgcagtgcatgagcagcggcgagtggagcgcccccatccccgcctgcaacgtggtggagtgcgacgccgtgaccaaccccgccaacggcttcgtggagtgcttccagaaccccggcagcttcccctggaacaccacctgcaccttcgactgcgaggagggcttcgagctgatgggcgcccagagcctgcagtgcaccagcagcggcaactgggacaacgagaagcccacctgcaaggccgtgacctgcagagccgtgagacagccccagaacggcagcgtgagatgcagccacagccccgccggcgagttcaccttcaagagcagctgcaacttcacctgcgaggagggcttcatgctgcagggccccgcccaggtggagtgcaccacccagggccagtggacccagcagatccccgtgtgcgaggccgtgagatgcgacgccgtgcaccagccccccaagggcctggtgagatgcgcccacagccccatcggcgagttcacctacaagagcagctgcgccttcagctgcgaggagggcttcgagctgcacggcagcacccagctggagtgcaccagccagggccagtggaccgaggaggtgcccagctgccaggtggtgaagtgcagcagcctggccgtgcccggcaagatcaacatgagctgcagcggcgagcccgtgttcggcaccgtgtgcaagttcgcctgccccgagggctggaccctgaacggcagcgccgccagaacctgcggcgccaccggccactggagcggcctgctgcccacctgcgaggcccccaccgagagcaacatccccctggtggccggcctgagcgccgccggcctgagcctgctgaccctggcccccttcctgctgtggctgagaaagtgcctgagaaaggccaagaagttcgtgcccgccagcagctgccagagcctggagagcgacggcagctaccagaagcccagctacatcctgtag

SEQ ID NO: 98258 - DNA, 1644 bp, Artificial Sequence
  Description of Artificial Sequence: Synthetic coding sequence
atgatcgccagccagttcctgagcgccctgaccctggtgctgctgatcaaggagagcggcgcctggagctacaacaccagcaccgaggccatgacctacgacgaggccagcgcctactgccagcagagatacacccacctggtggccatccagaacaaggaggagatcgagtacctgaacagcatcctgagctacagccccagctactactggatcggcatcagaaaggtgaacaacgtgtgggtgtgggtgggcacccagaagcccctgaccgaggaggccaagaactgggcccccggcgagcccaacaacagacagaaggacgaggactgcgtggagatctacatcaagagagagaaggacgtgggcatgtggaacgacgagagatgcagcaagaagaagctggccctgtgctacaccgccgcctgcaccaacaccagctgcagcggccacggcgagtgcgtggagaccatcaacaactacacctgcaagtgcgaccccggcttcagcggcctgaagtgcgagcagatcgtgaactgcaccgccctggagagccccgagcacggcagcctggtgtgcagccaccccctgggcaacttcagctacaacagcagctgcagcatcagctgcgacagaggctacctgcccagcagcatggagaccatgcagtgcatgagcagcggcgagtggagcgcccccatccccgcctgcaacgtggtggagtgcgacgccgtgaccaaccccgccaacggcttcgtggagtgcttccagaaccccggcagcttcccctggaacaccacctgcaccttcgactgcgaggagggcttcgagctgatgggcgcccagagcctgcagtgcaccagcagcggcaactgggacaacgagaagcccacctgcaaggccgtgacctgcagagccgtgagacagccccagaacggcagcgtgagatgcagccacagccccgccggcgagttcaccttcaagagcagctgcaacttcacctgcgaggagggcttcatgctgcagggccccgcccaggtggagtgcaccacccagggccagtggacccagcagatccccgtgtgcgaggccttccagtgcaccgccctgagcaaccccgagagaggctacatgaactgcctgcccagcgccagcggcagcttcagatacggcagcagctgcgagttcagctgcgagcagggcttcgtgctgaagggcagcaagagactgcagtgcggccccaccggcgagtgggacaacgagaagcccacctgcgaggtggtgaagtgcagcagcctggccgtgcccggcaagatcaacatgagctgcagcggcgagcccgtgttcggcaccgtgtgcaagttcgcctgccccgagggctggaccctgaacggcagcgccgccagaacctgcggcgccaccggccactggagcggcctgctgcccacctgcgaggcccccaccgagagcaacatccccctggtggccggcctgagcgccgccggcctgagcctgctgaccctggcccccttcctgctgtggctgagaaagtgcctgagaaaggccaagaagttcgtgcccgccagcagctgccagagcctggagagcgacggcagctaccagaagcccagctacatcctgtag

SEQ ID NO: 98259 - DNA, 1455 bp, Artificial Sequence; identical to SEQ ID NO: 98255
  Description of Artificial Sequence: Synthetic coding sequence

SEQ ID NO: 98260 - DNA, 1458 bp, Artificial Sequence; identical to SEQ ID NO: 98256
  Description of Artificial Sequence: Synthetic coding sequence

SEQ ID NO: 98261 - DNA, 1644 bp, Artificial Sequence; identical to SEQ ID NO: 98257
  Description of Artificial Sequence: Synthetic coding sequence

SEQ ID NO: 98262 - DNA, 1644 bp, Artificial Sequence; identical to SEQ ID NO: 98258
  Description of Artificial Sequence: Synthetic coding sequence

SEQ ID NO: 98263 - DNA, 1158 bp, Artificial Sequence
  Description of Artificial Sequence: Synthetic coding sequence
atgggctgcagaagaaccagagagggccccagcaaggccatgatcttcccctggaagtgccagagcacccagagagacctgtggaacatcttcaagctgtggggctggaccatgctgtgctgcgacttcctggcccaccacggcaccgactgctggacctaccactacagcgagaagcccatgaactggcagagagccagaagattctgcagagacaactacaccgacctggtggccatccagaacaaggccgagatcgagtacctggagaagaccctgcccttcagcagaagctactactggatcggcatcagaaagatcggcggcatctggacctgggtgggcaccaacaagagcctgaccgaggaggccgagaactggggcgacggcgagcccaacaacaagaagaacaaggaggactgcgtggagatctacatcaagagaaacaaggacgccggcaagtggaacgacgacgcctgccacaagctgaaggccgccctgtgctacaccgccagctgccagccctggagctgcagcggccacggcgagtgcgtggagatcatcaacaactacacctgcaactgcgacgtgggctactacggcccccagtgccagttcgtgatccagtgcgagcccctggaggcccccgagctgggcaccatggactgcacccaccccctgggcaacttcagcttcagcagccagtgcgccttcagctgcagcgagggcaccaacctgaccggcatcgaggagaccacctgcggccccttcggcaactggagcagccccgagcccacctgccaggtgatccagtgcgagcccctgagcgcccccgacctgggcatcatgaactgcagccaccccctggccagcttcagcttcaccagcgcctgcaccttcatctgcagcgagggcaccgagctgatcggcaagaagaagaccatctgcgagagcagcggcatctggagcaaccccagccccatctgccagaagctggacaagagcttcagcatgatcaaggagggcgactacaaccccctgttcatccccgtggccgtgatggtgaccgccttcagcggcctggccttcatcatctggctggccagaagactgaagaagggcaagaagagcaagagaagcatgaacgacccctactag

SEQ ID NO: 98264 - DNA, 2493 bp, Artificial Sequence
  Description of Artificial Sequence: Synthetic coding sequence
atggccaactgccagatcgccatcctgtaccagagattccagagagtggtgttcggcatcagccagctgctgtgcttcagcgccctgatcagcgagctgaccaaccagaaggaggtggccgcctggacctaccactacagcaccaaggcctacagctggaacatcagcagaaagtactgccagaacagatacaccgacctggtggccatccagaacaagaacgagatcgactacctgaacaaggtgctgccctactacagcagctactactggatcggcatcagaaagaacaacaagacctggacctgggtgggcaccaagaaggccctgaccaacgaggccgagaactgggccgacaacgagcccaacaacaagagaaacaacgaggactgcgtggagatctacatcaagagccccagcgcccccggcaagtggaacgacgagcactgcctgaagaagaagcacgccctgtgctacaccgccagctgccaggacatgagctgcagcaagcagggcgagtgcctggagaccatcggcaactacacctgcagctgctaccccggcttctacggccccgagtgcgagtacgtgagagagtgcggcgagctggagctgccccagcacgtgctgatgaactgcagccaccccctgggcaacttcagcttcaacagccagtgcagcttccactgcaccgacggctaccaggtgaacggccccagcaagctggagtgcctggccagcggcatctggaccaacaagcccccccagtgcctggccgcccagtgcccccccctgaagatccccgagagaggcaacatgacctgcctgcacagcgccaaggccttccagcaccagagcagctgcagcttcagctgcgaggagggcttcgccctggtgggccccgaggtggtgcagtgcaccgccagcggcgtgtggaccgcccccgcccccgtgtgcaaggccgtgcagtgccagcacctggaggcccccagcgagggcaccatggactgcgtgcaccccctgaccgccttcgcctacggcagcagctgcaagttcgagtgccagcccggctacagagtgagaggcctggacatgctgagatgcatcgacagcggccactggagcgcccccctgcccacctgcgaggccatcagctgcgagcccctggagagccccgtgcacggcagcatggactgcagccccagcctgagagccttccagtacgacaccaactgcagcttcagatgcgccgagggcttcatgctgagaggcgccgacatcgtgagatgcgacaacctgggccagtggaccgcccccgcccccgtgtgccaggccctgcagtgccaggacctgcccgtgcccaacgaggccagagtgaactgcagccaccccttcggcgccttcagataccagagcgtgtgcagcttcacctgcaacgagggcctgctgctggtgggcgccagcgtgctgcagtgcctggccaccggcaactggaacagcgtgccccccgagtgccaggccatcccctgcacccccctgctgagcccccagaacggcaccatgacctgcgtgcagcccctgggcagcagcagctacaagagcacctgccagttcatctgcgacgagggctacagcctgagcggccccgagagactggactgcaccagaagcggcagatggaccgacagcccccccatgtgcgaggccatcaagtgccccgagctgttcgcccccgagcagggcagcctggactgcagcgacaccagaggcgagttcaacgtgggcagcacctgccacttcagctgcgacaacggcttcaagctggagggccccaacaacgtggagtgcaccaccagcggcagatggagcgccaccccccccacctgcaagggcatcgccagcctgcccacccccggcgtgcagtgccccgccctgaccacccccggccagggcaccatgtactgcagacaccaccccggcaccttcggcttcaacaccacctgctacttcggctgcaacgccggcttcaccctgatcggcgacagcaccctgagctgcagacccagcggccagtggaccgccgtgacccccgcctgcagagccgtgaagtgcagcgagctgcacgtgaacaagcccatcgccatgaactgcagcaacctgtggggcaacttcagctacggcagcatctgcagcttccactgcctggagggccagctgctgaacggcagcgcccagaccgcctgccaggagaacggccactggagcaccaccgtgcccacctgccaggccggccccctgaccatccaggaggccctgacctacttcggcggcgccgtggccagcaccatcggcctgatcatgggcggcaccctgctggccctgctgagaaagagattcagacagaaggacgacggcaagtgccccctgaacccccacagccacctgggcacctacggcgtgttcaccaacgccgccttcgaccccagcccctag

SEQ ID NO: 98265 - DNA, 2307 bp, Artificial Sequence
  Description of Artificial Sequence: Synthetic coding sequence
atggccaactgccagatcgccatcctgtaccagagattccagagagtggtgttcggcatcagccagctgctgtgcttcagcgccctgatcagcgagctgaccaaccagaaggaggtggccgcctggacctaccactacagcaccaaggcctacagctggaacatcagcagaaagtactgccagaacagatacaccgacctggtggccatccagaacaagaacgagatcgactacctgaacaaggtgctgccctactacagcagctactactggatcggcatcagaaagaacaacaagacctggacctgggtgggcaccaagaaggccctgaccaacgaggccgagaactgggccgacaacgagcccaacaacaagagaaacaacgaggactgcgtggagatctacatcaagagccccagcgcccccggcaagtggaacgacgagcactgcctgaagaagaagcacgccctgtgctacaccgccagctgccaggacatgagctgcagcaagcagggcgagtgcctggagaccatcggcaactacacctgcagctgctaccccggcttctacggccccgagtgcgagtacgtgagagagtgcggcgagctggagctgccccagcacgtgctgatgaactgcagccaccccctgggcaacttcagcttcaacagccagtgcagcttccactgcaccgacggctaccaggtgaacggccccagcaagctggagtgcctggccagcggcatctggaccaacaagcccccccagtgcctggccgcccagtgcccccccctgaagatccccgagagaggcaacatgacctgcctgcacagcgccaaggccttccagcaccagagcagctgcagcttcagctgcgaggagggcttcgccctggtgggccccgaggtggtgcagtgcaccgccagcggcgtgtggaccgcccccgcccccgtgtgcaaggccatcagctgcgagcccctggagagccccgtgcacggcagcatggactgcagccccagcctgagagccttccagtacgacaccaactgcagcttcagatgcgccgagggcttcatgctgagaggcgccgacatcgtgagatgcgacaacctgggccagtggaccgcccccgcccccgtgtgccaggccctgcagtgccaggacctgcccgtgcccaacgaggccagagtgaactgcagccaccccttcggcgccttcagataccagagcgtgtgcagcttcacctgcaacgagggcctgctgctggtgggcgccagcgtgctgcagtgcctggccaccggcaactggaacagcgtgccccccgagtgccaggccatcccctgcacccccctgctgagcccccagaacggcaccatgacctgcgtgcagcccctgggcagcagcagctacaagagcacctgccagttcatctgcgacgagggctacagcctgagcggccccgagagactggactgcaccagaagcggcagatggaccgacagcccccccatgtgcgaggccatcaagtgccccgagctgttcgcccccgagcagggcagcctggactgcagcgacaccagaggcgagttcaacgtgggcagcacctgccacttcagctgcgacaacggcttcaagctggagggccccaacaacgtggagtgcaccaccagcggcagatggagcgccaccccccccacctgcaagggcatcgccagcctgcccacccccggcgtgcagtgccccgccctgaccacccccggccagggcaccatgtactgcagacaccaccccggcaccttcggcttcaacaccacctgctacttcggctgcaacgccggcttcaccctgatcggcgacagcaccctgagctgcagacccagcggccagtggaccgccgtgacccccgcctgcagagccgtgaagtgcagcgagctgcacgtgaacaagcccatcgccatgaactgcagcaacctgtggggcaacttcagctacggcagcatctgcagcttccactgcctggagggccagctgctgaacggcagcgcccagaccgcctgccaggagaacggccactggagcaccaccgtgcccacctgccaggccggccccctgaccatccaggaggccctgacctacttcggcggcgccgtggccagcaccatcggcctgatcatgggcggcaccctgctggccctgctgagaaagagattcagacagaaggacgacggcaagtgccccctgaacccccacagccacctgggcacctacggcgtgttcaccaacgccgccttcgaccccagcccctag

SEQ ID NO: 98266 - DNA, 2307 bp, Artificial Sequence
  Description of Artificial Sequence: Synthetic coding sequence
atggccaactgccagatcgccatcctgtaccagagattccagagagtggtgttcggcatcagccagctgctgtgcttcagcgccctgatcagcgagctgaccaaccagaaggaggtggccgcctggacctaccactacagcaccaaggcctacagctggaacatcagcagaaagtactgccagaacagatacaccgacctggtggccatccagaacaagaacgagatcgactacctgaacaaggtgctgccctactacagcagctactactggatcggcatcagaaagaacaacaagacctggacctgggtgggcaccaagaaggccctgaccaacgaggccgagaactgggccgacaacgagcccaacaacaagagaaacaacgaggactgcgtggagatctacatcaagagccccagcgcccccggcaagtggaacgacgagcactgcctgaagaagaagcacgccctgtgctacaccgccagctgccaggacatgagctgcagcaagcagggcgagtgcctggagaccatcggcaactacacctgcagctgctaccccggcttctacggccccgagtgcgagtacgtgagagagtgcggcgagctggagctgccccagcacgtgctgatgaactgcagccaccccctgggcaacttcagcttcaacagccagtgcagcttccactgcaccgacggctaccaggtgaacggccccagcaagctggagtgcctggccagcggcatctggaccaacaagcccccccagtgcctggccgtgcagtgccagcacctggaggcccccagcgagggcaccatggactgcgtgcaccccctgaccgccttcgcctacggcagcagctgcaagttcgagtgccagcccggctacagagtgagaggcctggacatgctgagatgcatcgacagcggccactggagcgcccccctgcccacctgcgaggccatcagctgcgagcccctggagagccccgtgcacggcagcatggactgcagccccagcctgagagccttccagtacgacaccaactgcagcttcagatgcgccgagggcttcatgctgagaggcgccgacatcgtgagatgcgacaacctgggccagtggaccgcccccgcccccgtgtgccaggccctgcagtgccaggacctgcccgtgcccaacgaggccagagtgaactgcagccaccccttcggcgccttcagataccagagcgtgtgcagcttcacctgcaacgagggcctgctgctggtgggcgccagcgtgctgcagtgcctggccaccggcaactggaacagcgtgccccccgagtgccaggccatcccctgcacccccctgctgagcccccagaacggcaccatgacctgcgtgcagcccctgggcagcagcagctacaagagcacctgccagttcatctgcgacgagggctacagcctgagcggccccgagagactggactgcaccagaagcggcagatggaccgacagcccccccatgtgcgaggccatcaagtgccccgagctgttcgcccccgagcagggcagcctggactgcagcgacaccagaggcgagttcaacgtgggcagcacctgccacttcagctgcgacaacggcttcaagctggagggccccaacaacgtggagtgcaccaccagcggcagatggagcgccaccccccccacctgcaagggcatcgccagcctgcccacccccggcgtgcagtgccccgccctgaccacccccggccagggcaccatgtactgcagacaccaccccggcaccttcggcttcaacaccacctgctacttcggctgcaacgccggcttcaccctgatcggcgacagcaccctgagctgcagacccagcggccagtggaccgccgtgacccccgcctgcagagccgtgaagtgcagcgagctgcacgtgaacaagcccatcgccatgaactgcagcaacctgtggggcaacttcagctacggcagcatctgcagcttccactgcctggagggccagctgctgaacggcagcgcccagaccgcctgccaggagaacggccactggagcaccaccgtgcccacctgccaggccggccccctgaccatccaggaggccctgacctacttcggcggcgccgtggccagcaccatcggcctgatcatgggcggcaccctgctggccctgctgagaaagagattcagacagaaggacgacggcaagtgccccctgaacccccacagccacctgggcacctacggcgtgttcaccaacgccgccttcgaccccagcccctag

SEQ ID NO: 98267 - DNA, 1941 bp, Artificial Sequence
  Description of Artificial Sequence: Synthetic coding sequence
atggccaactgccagatcgccatcctgtaccagagattccagagagtggtgttcggcatcagccagctgctgtgcttcagcgccctgatcagcgagctgaccaaccagaaggaggtggccgcctggacctaccactacagcaccaaggcctacagctggaacatcagcagaaagtactgccagaacagatacaccgacctggtggccatccagaacaagaacgagatcgactacctgaacaaggtgctgccctactacagcagctactactggatcggcatcagaaagaacaacaagacctggacctgggtgggcaccaagaaggccctgaccaacgaggccgagaactgggccgacaacgagcccaacaacaagagaaacaacgaggactgcgtggagatctacatcaagagccccagcgcccccggcaagtggaacgacgagcactgcctgaagaagaagcacgccctgtgctacaccgccagctgccaggacatgagctgcagcaagcagggcgagtgcctggagaccatcggcaactacacctgcagctgctaccccggcttctacggccccgagtgcgagtacgtgagagagtgcggcgagctggagctgccccagcacgtgctgatgaactgcagccaccccctgggcaacttcagcttcaacagccagtgcagcttccactgcaccgacggctaccaggtgaacggccccagcaagctggagtgcctggccagcggcatctggaccaacaagcccccccagtgcctggccgcccagtgcccccccctgaagatccccgagagaggcaacatgacctgcctgcacagcgccaaggccttccagcaccagagcagctgcagcttcagctgcgaggagggcttcgccctggtgggccccgaggtggtgcagtgcaccgccagcggcgtgtggaccgcccccgcccccgtgtgcaaggccatcagctgcgagcccctggagagccccgtgcacggcagcatggactgcagccccagcctgagagccttccagtacgacaccaactgcagcttcagatgcgccgagggcttcatgctgagaggcgccgacatcgtgagatgcgacaacctgggccagtggaccgcccccgcccccgtgtgccaggccctgcagtgccaggacctgcccgtgcccaacgaggccagagtgaactgcagccaccccttcggcgccttcagataccagagcgtgtgcagcttcacctgcaacgagggcctgctgctggtgggcgccagcgtgctgcagtgcctggccaccggcaactggaacagcgtgccccccgagtgccagggcaagagcatcgccagcctgcccacccccggcgtgcagtgccccgccctgaccacccccggccagggcaccatgtactgcagacaccaccccggcaccttcggcttcaacaccacctgctacttcggctgcaacgccggcttcaccctgatcggcgacagcaccctgagctgcagacccagcggccagtggaccgccgtgacccccgcctgcagagccgtgaagtgcagcgagctgcacgtgaacaagcccatcgccatgaactgcagcaacctgtggggcaacttcagctacggcagcatctgcagcttccactgcctggagggccagctgctgaacggcagcgcccagaccgcctgccaggagaacggccactggagcaccaccgtgcccacctgccaggccggccccctgaccatccaggaggccctgacctacttcggcggcgccgtggccagcaccatcggcctgatcatgggcggcaccctgctggccctgctgagaaagagattcagacagaaggacgacggcaagtgccccctgaacccccacagccacctgggcacctacggcgtgttcaccaacgccgccttcgaccccagcccctag

SEQ ID NO: 98268 - DNA, 2493 bp, Artificial Sequence; identical to SEQ ID NO: 98264
  Description of Artificial Sequence: Synthetic coding sequence

SEQ ID NO: 98269 - DNA, 1935 bp, Artificial Sequence
  Description of Artificial Sequence: Synthetic coding sequence
atggccaactgccagatcgccatcctgtaccagagattccagagagtggtgttcggcatcagccagctgctgtgcttcagcgccctgatcagcgagctgaccaaccagaaggaggtggccgcctggacctaccactacagcaccaaggcctacagctggaacatcagcagaaagtactgccagaacagatacaccgacctggtggccatccagaacaagaacgagatcgactacctgaacaaggtgctgccctactacagcagctactactggatcggcatcagaaagaacaacaagacctggacctgggtgggcaccaagaaggccctgaccaacgaggccgagaactgggccgacaacgagcccaacaacaagagaaacaacgaggactgcgtggagatctacatcaagagccccagcgcccccggcaagtggaacgacgagcactgcctgaagaagaagcacgccctgtgctacaccgccagctgccaggacatgagctgcagcaagcagggcgagtgcctggagaccatcggcaactacacctgcagctgctaccccggcttctacggccccgagtgcgagtacgtgagagagtgcggcgagctggagctgccccagcacgtgctgatgaactgcagccaccccctgggcaacttcagcttcaacagccagtgcagcttccactgcaccgacggctaccaggtgaacggccccagcaagctggagtgcctggccagcggcatctggaccaacaagcccccccagtgcctggccgcccagtgcccccccctgaagatccccgagagaggcaacatgacctgcctgcacagcgccaaggccttccagcaccagagcagctgcagcttcagctgcgaggagggcttcgccctggtgggccccgaggtggtgcagtgcaccgccagcggcgtgtggaccgcccccgcccccgtgtgcaaggccctgcagtgccaggacctgcccgtgcccaacgaggccagagtgaactgcagccaccccttcggcgccttcagataccagagcgtgtgcagcttcacctgcaacgagggcctgctgctggtgggcgccagcgtgctgcagtgcctggccaccggcaactggaacagcgtgccccccgagtgccaggccatcccctgcacccccctgctgagcccccagaacggcaccatgacctgcgtgcagcccctgggcagcagcagctacaagagcacctgccagttcatctgcgacgagggctacagcctgagcggccccgagagactggactgcaccagaagcggcagatggaccgacagcccccccatgtgcgagggcatcgccagcctgcccacccccggcgtgcagtgccccgccctgaccacccccggccagggcaccatgtactgcagacaccaccccggcaccttcggcttcaacaccacctgctacttcggctgcaacgccggcttcaccctgatcggcgacagcaccctgagctgcagacccagcggccagtggaccgccgtgacccccgcctgcagagccgtgaagtgcagcgagctgcacgtgaacaagcccatcgccatgaactgcagcaacctgtggggcaacttcagctacggcagcatctgcagcttccactgcctggagggccagctgctgaacggcagcgcccagaccgcctgccaggagaacggccactggagcaccaccgtgcccacctgccaggccggccccctgaccatccaggaggccctgacctacttcggcggcgccgtggccagcaccatcggcctgatcatgggcggcaccctgctggccctgctgagaaagagattcagacagaaggacgacggcaagtgccccctgaacccccacagccacctgggcacctacggcgtgttcaccaacgccgccttcgaccccagcccctag

SEQ ID NO: 98270 - DNA, 1941 bp, Artificial Sequence; identical to SEQ ID NO: 98267
  Description of Artificial Sequence: Synthetic coding sequence

SEQ ID NO: 98271 - DNA, 2307 bp, Artificial Sequence; identical to SEQ ID NO: 98266
  Description of Artificial Sequence: Synthetic coding sequence

SEQ ID NO: 98272 - DNA, 2307 bp, Artificial Sequence; identical to SEQ ID NO: 98265
  Description of Artificial Sequence: Synthetic coding sequence

SEQ ID NO: 98273 - DNA, 1935 bp, Artificial Sequence; identical to SEQ ID NO: 98269
  Description of Artificial Sequence: Synthetic coding sequence

SEQ ID NO: 98274 - DNA, 2490 bp, Artificial Sequence
  Description of Artificial Sequence: Synthetic coding sequence
gccaactgccagatcgccatcctgtaccagagattccagagagtggtgttcggcatcagccagctgctgtgcttcagcgccctgatcagcgagctgaccaaccagaaggaggtggccgcctggacctaccactacagcaccaaggcctacagctggaacatcagcagaaagtactgccagaacagatacaccgacctggtggccatccagaacaagaacgagatcgactacctgaacaaggtgctgccctactacagcagctactactggatcggcatcagaaagaacaacaagacctggacctgggtgggcaccaagaaggccctgaccaacgaggccgagaactgggccgacaacgagcccaacaacaagagaaacaacgaggactgcgtggagatctacatcaagagccccagcgcccccggcaagtggaacgacgagcactgcctgaagaagaagcacgccctgtgctacaccgccagctgccaggacatgagctgcagcaagcagggcgagtgcctggagaccatcggcaactacacctgcagctgctaccccggcttctacggccccgagtgcgagtacgtgagagagtgcggcgagctggagctgccccagcacgtgctgatgaactgcagccaccccctgggcaacttcagcttcaacagccagtgcagcttccactgcaccgacggctaccaggtgaacggccccagcaagctggagtgcctggccagcggcatctggaccaacaagcccccccagtgcctggccgcccagtgcccccccctgaagatccccgagagaggcaacatgacctgcctgcacagcgccaaggccttccagcaccagagcagctgcagcttcagctgcgaggagggcttcgccctggtgggccccgaggtggtgcagtgcaccgccagcggcgtgtggaccgcccccgcccccgtgtgcaaggccgtgcagtgccagcacctggaggcccccagcgagggcaccatggactgcgtgcaccccctgaccgccttcgcctacggcagcagctgcaagttcgagtgccagcccggctacagagtgagaggcctggacatgctgagatgcatcgacagcggccactggagcgcccccctgcccacctgcgaggccatcagctgcgagcccctggagagccccgtgcacggcagcatggactgcagccccagcctgagagccttccagtacgacaccaactgcagcttcagatgcgccgagggcttcatgctgagaggcgccgacatcgtgagatgcgacaacctgggccagtggaccgcccccgcccccgtgtgccaggccctgcagtgccaggacctgcccgtgcccaacgaggccagagtgaactgcagccaccccttcggcgccttcagataccagagcgtgtgcagcttcacctgcaacgagggcctgctgctggtgggcgccagcgtgctgcagtgcctggccaccggcaactggaacagcgtgccccccgagtgccaggccatcccctgcacccccctgctgagcccccagaacggcaccatgacctgcgtgcagcccctgggcagcagcagctacaagagcacctgccagttcatctgcgacgagggctacagcctgagcggccccgagagactggactgcaccagaagcggcagatggaccgacagcccccccatgtgcgaggccatcaagtgccccgagctgttcgcccccgagcagggcagcctggactgcagcgacaccagaggcgagttcaacgtgggcagcacctgccacttcagctgcgacaacggcttcaagctggagggccccaacaacgtggagtgcaccaccagcggcagatggagcgccaccccccccacctgcaagggcatcgccagcctgcccacccccggcgtgcagtgccccgccctgaccacccccggccagggcaccatgtactgcagacaccaccccggcaccttcggcttcaacaccacctgctacttcggctgcaacgccggcttcaccctgatcggcgacagcaccctgagctgcagacccagcggccagtggaccgccgtgacccccgcctgcagagccgtgaagtgcagcgagctgcacgtgaacaagcccatcgccatgaactgcagcaacctgtggggcaacttcagctacggcagcatctgcagcttccactgcctggagggccagctgctgaacggcagcgcccagaccgcctgccaggagaacggccactggagcaccaccgtgcccacctgccaggccggccccctgaccatccaggaggccctgacctacttcggcggcgccgtggccagcaccatcggcctgatcatgggcggcaccctgctggccctgctgagaaagagattcagacagaaggacgacggcaagtgccccctgaacccccacagccacctgggcacctacggcgtgttcaccaacgccgccttcgaccccagcccctag

SEQ ID NO: 98275 - DNA, 1941 bp, Artificial Sequence
  Description of Artificial Sequence: Synthetic coding sequence
tgagccaactgccagatcgccatcctgtaccagagattccagagagtggtgttcggcatcagccagctgctgtgcttcagcgccctgatcagcgagctgaccaaccagaaggaggtggccgcctggacctaccactacagcaccaaggcctacagctggaacatcagcagaaagtactgccagaacagatacaccgacctggtggccatccagaacaagaacgagatcgactacctgaacaaggtgctgccctactacagcagctactactggatcggcatcagaaagaacaacaagacctggacctgggtgggcaccaagaaggccctgaccaacgaggccgagaactgggccgacaacgagcccaacaacaagagaaacaacgaggactgcgtggagatctacatcaagagccccagcgcccccggcaagtggaacgacgagcactgcctgaagaagaagcacgccctgtgctacaccgccagctgccaggacatgagctgcagcaagcagggcgagtgcctggagaccatcggcaactacacctgcagctgctaccccggcttctacggccccgagtgcgagtacgtgagagagtgcggcgagctggagctgccccagcacgtgctgatgaactgcagccaccccctgggcaacttcagcttcaacagccagtgcagcttccactgcaccgacggctaccaggtgaacggccccagcaagctggagtgcctggccagcggcatctggaccaacaagcccccccagtgcctggccgcccagtgcccccccctgaagatccccgagagaggcaacatgacctgcctgcacagcgccaaggccttccagcaccagagcagctgcagcttcagctgcgaggagggcttcgccctggtgggccccgaggtggtgcagtgcaccgccagcggcgtgtggaccgcccccgcccccgtgtgcaaggccatcagctgcgagcccctggagagccccgtgcacggcagcatggactgcagccccagcctgagagccttccagtacgacaccaactgcagcttcagatgcgccgagggcttcatgctgagaggcgccgacatcgtgagatgcgacaacctgggccagtggaccgcccccgcccccgtgtgccaggccctgcagtgccaggacctgcccgtgcccaacgaggccagagtgaactgcagccaccccttcggcgccttcagataccagagcgtgtgcagcttcacctgcaacgagggcctgctgctggtgggcgccagcgtgctgcagtgcctggccaccggcaactggaacagcgtgccccccgagtgccagggcaagagcatcgccagcctgcccacccccggcgtgcagtgccccgccctgaccacccccggccagggcaccatgtactgcagacaccaccccggcaccttcggcttcaacaccacctgctacttcggctgcaacgccggcttcaccctgatcggcgacagcaccctgagctgcagacccagcggccagtggaccgccgtgacccccgcctgcagagccgtgaagtgcagcgagctgcacgtgaacaagcccatcgccatgaactgcagcaacctgtggggcaacttcagctacggcagcatctgcagcttccactgcctggagggccagctgctgaacggcagcgcccagaccgcctgccaggagaacggccactggagcaccaccgtgcccacctgccaggccggccccctgaccatccaggaggccctgacctacttcggcggcgccgtggccagcaccatcggcctgatcatgggcggcaccctgctggccctgctgagaaagagattcagacagaaggacgacggcaagtgccccctgaacccccacagccacctgggcacctacggcgtgttcaccaacgccgccttcgaccccagcccctag

SEQ ID NO: 98276 - DNA, 2262 bp, Artificial Sequence
  Description of Artificial Sequence: Synthetic coding sequence
gtggtgttcggcatcagccagctgctgtgcttcagcgccctgatcagcgagctgaccaaccagaaggaggtggccgcctggacctaccactacagcaccaaggcctacagctggaacatcagcagaaagtactgccagaacagatacaccgacctggtggccatccagaacaagaacgagatcgactacctgaacaaggtgctgccctactacagcagctactactggatcggcatcagaaagaacaacaagacctggacctgggtgggcaccaagaaggccctgaccaacgaggccgagaactgggccgacaacgagcccaacaacaagagaaacaacgaggactgcgtggagatctacatcaagagccccagcgcccccggcaagtggaacgacgagcactgcctgaagaagaagcacgccctgtgctacaccgccagctgccaggacatgagctgcagcaagcagggcgagtgcctggagaccatcggcaactacacctgcagctgctaccccggcttctacggccccgagtgcgagtacgtgagagagtgcggcgagctggagctgccccagcacgtgctgatgaactgcagccaccccctgggcaacttcagcttcaacagccagtgcagcttccactgcaccgacggctaccaggtgaacggccccagcaagctggagtgcctggccagcggcatctggaccaacaagcccccccagtgcctggccgcccagtgcccccccctgaagatccccgagagaggcaacatgacctgcctgcacagcgccaaggccttccagcaccagagcagctgcagcttcagctgcgaggagggcttcgccctggtgggccccgaggtggtgcagtgcaccgccagcggcgtgtggaccgcccccgcccccgtgtgcaaggccatcagctgcgagcccctggagagccccgtgcacggcagcatggactgcagccccagcctgagagccttccagtacgacaccaactgcagcttcagatgcgccgagggcttcatgctgagaggcgccgacatcgtgagatgcgacaacctgggccagtggaccgcccccgcccccgtgtgccaggccctgcagtgccaggacctgcccgtgcccaacgaggccagagtgaactgcagccaccccttcggcgccttcagataccagagcgtgtgcagcttcacctgcaacgagggcctgctgctggtgggcgccagcgtgctgcagtgcctggccaccggcaactggaacagcgtgccccccgagtgccaggccatcccctgcacccccctgctgagcccccagaacggcaccatgacctgcgtgcagcccctgggcagcagcagctacaagagcacctgccagttcatctgcgacgagggctacagcctgagcggccccgagagactggactgcaccagaagcggcagatggaccgacagcccccccatgtgcgaggccatcaagtgccccgagctgttcgcccccgagcagggcagcctggactgcagcgacaccagaggcgagttcaacgtgggcagcacctgccacttcagctgcgacaacggcttcaagctggagggccccaacaacgtggagtgcaccaccagcggcagatggagcgccaccccccccacctgcaagggcatcgccagcctgcccacccccggcgtgcagtgccccgccctgaccacccccggccagggcaccatgtactgcagacaccaccccggcaccttcggcttcaacaccacctgctacttcggctgcaacgccggcttcaccctgatcggcgacagcaccctgagctgcagacccagcggccagtggaccgccgtgacccccgcctgcagagccgtgaagtgcagcgagctgcacgtgaacaagcccatcgccatgaactgcagcaacctgtggggcaacttcagctacggcagcatctgcagcttccactgcctggagggccagctgctgaacggcagcgcccagaccgcctgccaggagaacggccactggagcaccaccgtgcccacctgccaggccggccccctgaccatccaggaggccctgacctacttcggcggcgccgtggccagcaccatcggcctgatcatgggcggcaccctgctggccctgctgagaaagagattcagacagaaggacgacggcaagtgccccctgaacccccacagccacctgggcacctacggcgtgttcaccaacgccgccttcgaccccagcccctag

SEQ ID NO: 98277 - DNA, 2373 bp, Artificial Sequence
  Description of Artificial Sequence: Synthetic coding sequence
atggccaactgccagatcgccatcctgtaccagagattccagagagtggtgttcggcatcagccagctgctgtgcttcagcgccctgatcagcgagctgaccaaccagaaggaggtggccgcctggacctaccactacagcaccaaggcctacagctggaacatcagcagaaagtactgccagaacagatacaccgacctggtggccatccagaacaagaacgagatcgactacctgaacaaggtgctgccctactacagcagctactactggatcggcatcagaaagaacaacaagacctggacctgggtgggcaccaagaaggccctgaccaacgaggccgagaactgggccgacaacgagcccaacaacaagagaaacaacgaggactgcgtggagatctacatcaagagccccagcgcccccggcaagtggaacgacgagcactgcctgaagaagaagcacgccctgtgctacaccgccagctgccaggacatgagctgcagcaagcagggcgagtgcctggagaccatcggcaactacacctgcagctgctaccccggcttctacggccccgagtgcgagtacgtgagagagtgcggcgagctggagctgccccagcacgtgctgatgaactgcagccaccccctgggcaacttcagcttcaacagccagtgcagcttccactgcaccgacggctaccaggtgaacggccccagcaagctggagtgcctggccagcggcatctggaccaacaagcccccccagtgcctggccgcccagtgcccccccctgaagatccccgagagaggcaacatgacctgcctgcacagcgccaaggccttccagcaccagagcagctgcagcttcagctgcgaggagggcttcgccctggtgggccccgaggtggtgcagtgcaccgccagcggcgtgtggaccgcccccgcccccgtgtgcaaggccgtgcagtgccagcacctggaggcccccagcgagggcaccatggactgcgtgcaccccctgaccgccttcgcctacggcagcagctgcaagttcgagtgccagcccggctacagagtgagaggcctggacatgctgagatgcatcgacagcggccactggagcgcccccctgcccacctgcgaggccatcagctgcgagcccctggagagccccgtgcacggcagcatggactgcagccccagcctgagagccttccagtacgacaccaactgcagcttcagatgcgccgagggcttcatgctgagaggcgccgacatcgtgagatgcgacaacctgggccagtggaccgcccccgcccccgtgtgccaggccctgcagtgccaggacctgcccgtgcccaacgaggccagagtgaactgcagccaccccttcggcgccttcagataccagagcgtgtgcagcttcacctgcaacgagggcctgctgctggtgggcgccagcgtgctgcagtgcctggccaccggcaactggaacagcgtgccccccgagtgccaggccatcccctgcacccccctgctgagcccccagaacggcaccatgacctgcgtgcagcccctgggcagcagcagctacaagagcacctgccagttcatctgcgacgagggctacagcctgagcggccccgagagactggactgcaccagaagcggcagatggaccgacagcccccccatgtgcgaggccatcaagtgccccgagctgttcgcccccgagcagggcagcctggactgcagcgacaccagaggcgagttcaacgtgggcagcacctgccacttcagctgcgacaacggcttcaagctggagggccccaacaacgtggagtgcaccaccagcggcagatggagcgccaccccccccacctgcaagggcatcgccagcctgcccacccccggcgtgcagtgccccgccctgaccacccccggccagggcaccatgtactgcagacaccaccccggcaccttcggcttcaacaccacctgctacttcggctgcaacgccggcttcaccctgatcggcgacagcaccctgagctgcagacccagcggccagtggaccgccgtgacccccgcctgcagagccgtgaagtgcagcgagctgcacgtgaacaagcccatcgccatgaactgcagcaacctgtggggcaacttcagctacggcagcatctgcagcttccactgcctggagggccagctgctgaacggcagcgcccagaccgcctgccaggagaacggccactggagcaccaccgtgcccacctgccaggacgacggcaagtgccccctgaacccccacagccacctgggcacctacggcgtgttcaccaacgccgccttcgaccccagcccctag

SEQ ID NO: 98278 - DNA, 450 bp, Artificial Sequence
  Description of Artificial Sequence: Synthetic coding sequence
atgatgaccaagcacaagaagtgcttcatcatcgtgggcgtgctgatcaccaccaacatcatcaccctgatcgtgaagctgaccagagacagccagagcctgtgcccctacgactggatcggcttccagaacaagtgctactacttcagcaaggaggagggcgactggaacagcagcaagtacaactgcagcacccagcacgccgacctgaccatcatcgacaacatcgaggagatgaacttcctgagaagatacaagtgcagcagcgaccactggatcggcctgaagatggccaagaacagaaccggccagtgggtggacggcgccaccttcaccaagagcttcggcatgagaggcagcgagggctgcgcctacctgagcgacgacggcgccgccaccgccagatgctacaccgagagaaagtggatctgcagaaagagaatccactag

SEQ ID NO: 98279 - DNA, 1209 bp, Artificial Sequence
  Description of Artificial Sequence: Synthetic coding sequence
atgcccctgcagctgctgctgctgctgatcctgctgggccccggcaacagcctgcagctgtgggacacctgggccgacgaggccgagaaggccctgggccccctgctggccagagacagaagacaggccaccgagtacgagtacctggactacgacttcctgcccgagaccgagccccccgagatgctgagaaacagcaccgacaccacccccctgaccggccccggcacccccgagagcaccaccgtggagcccgccgccagaagaagcaccggcctggacgccggcggcgccgtgaccgagctgaccaccgagctggccaacatgggcaacctgagcaccgacagcgccgccatggagatccagaccacccagcccgccgccaccgaggcccagaccacccccctggccgccaccgaggcccagaccaccagactgaccgccaccgaggcccagaccacccccctggccgccaccgaggcccagaccaccccccccgccgccaccgaggcccagaccacccagcccaccggcctggaggcccagaccaccgcccccgccgccatggaggcccagaccaccgcccccgccgccatggaggcccagaccaccccccccgccgccatggaggcccagaccacccagaccaccgccatggaggcccagaccaccgcccccgaggccaccgaggcccagaccacccagcccaccgccaccgaggcccagaccacccccctggccgccatggaggccctgagcaccgagcccagcgccaccgaggccctgagcatggagcccaccaccaagagaggcctgttcatccccttcagcgtgagcagcgtgacccacaagggcatccccatggccgccagcaacctgagcgtgaactaccccgtgggcgcccccgaccacatcagcgtgaagcagtgcctgctggccatcctgatcctggccctggtggccaccatcttcttcgtgtgcaccgtggtgctggccgtgagactgagcagaaagggccacatgtaccccgtgagaaactacagccccaccgagatggtgtgcatcagcagcctgctgcccgacggcggcgagggccccagcgccaccgccaacggcggcctgagcaaggccaagagccccggcctgacccccgagcccagagaggacagagagggcgacgacctgaccctgcacagcttcctgccctag

SEQ ID NO: 98280 - DNA, 1239 bp, Artificial Sequence
  Description of Artificial Sequence: Synthetic coding sequence
atgcccctgcagctgctgctgctgctgatcctgctgggccccggcaacagcctgcagctgtgggacacctgggccgacgaggccgagaaggccctgggccccctgctggccagagacagaagacaggccaccgagtacgagtacctggactacgacttcctgcccgagaccgagccccccgagatgctgagaaacagcaccgacaccacccccctgaccggccccggcacccccgagagcaccaccgtggagcccgccgccagaagaagcaccggcctggacgccggcggcgccgtgaccgagctgaccaccgagctggccaacatgggcaacctgagcaccgacagcgccgccatggagatccagaccacccagcccgccgccaccgaggcccagaccacccagcccgtgcccaccgaggcccagaccacccccctggccgccaccgaggcccagaccaccagactgaccgccaccgaggcccagaccacccccctggccgccaccgaggcccagaccaccccccccgccgccaccgaggcccagaccacccagcccaccggcctggaggcccagaccaccgcccccgccgccatggaggcccagaccaccgcccccgccgccatggaggcccagaccaccccccccgccgccatggaggcccagaccacccagaccaccgccatggaggcccagaccaccgcccccgaggccaccgaggcccagaccacccagcccaccgccaccgaggcccagaccacccccctggccgccatggaggccctgagcaccgagcccagcgccaccgaggccctgagcatggagcccaccaccaagagaggcctgttcatccccttcagcgtgagcagcgtgacccacaagggcatccccatggccgccagcaacctgagcgtgaactaccccgtgggcgcccccgaccacatcagcgtgaagcagtgcctgctggccatcctgatcctggccctggtggccaccatcttcttcgtgtgcaccgtggtgctggccgtgagactgagcagaaagggccacatgtaccccgtgagaaactacagccccaccgagatggtgtgcatcagcagcctgctgcccgacggcggcgagggccccagcgccaccgccaacggcggcctgagcaaggccaagagccccggcctgacccccgagcccagagaggacagagagggcgacgacctgaccctgcacagcttcctgccctag

SEQ ID NO: 98281 - DNA, 1419 bp, Artificial Sequence
  Description of Artificial Sequence: Synthetic coding sequence
atggccaccaagtgcggcaactgcggccccggctacagcacccccctggaggccatgaagggccccagagaggagatcgtgtacctgccctgcatctacagaaacaccggcaccgaggcccccgactacctggccaccgtggacgtggaccccaagagcccccagtactgccaggtgatccacagactgcccatgcccaacctgaaggacgagctgcaccacagcggctggaacacctgcagcagctgcttcggcgacagcaccaagagcagaaccaagctggtgctgcccagcctgatcagcagcagaatctacgtggtggacgtgggcagcgagcccagagcccccaagctgcacaaggtgatcgagcccaaggacatccacgccaagtgcgagctggccttcctgcacaccagccactgcctggccagcggcgaggtgatgatcagcagcctgggcgacgtgaagggcaacggcaagggcggcttcgtgctgctggacggcgagaccttcgaggtgaagggcacctgggagagacccggcggcgccgcccccctgggctacgacttctggtaccagcccagacacaacgtgatgatcagcaccgagtgggccgcccccaacgtgctgagagacggcttcaaccccgccgacgtggaggccggcctgtacggcagccacctgtacgtgtgggactggcagagacacgagatcgtgcagaccctgagcctgaaggacggcctgatccccctggagatcagattcctgcacaaccccgacgccgcccagggcttcgtgggctgcgccctgagcagcaccatccagagattctacaagaacgagggcggcacctggagcgtggagaaggtgatccaggtgccccccaagaaggtgaagggctggctgctgcccgagatgcccggcctgatcaccgacatcctgctgagcctggacgacagattcctgtacttcagcaactggctgcacggcgacctgagacagtacgacatcagcgacccccagagacccagactgaccggccagctgttcctgggcggcagcatcgtgaagggcggccccgtgcaggtgctggaggacgaggagctgaagagccagcccgagcccctggtggtgaagggcaagagagtggccggcggcccccagatgatccagctgagcctggacggcaagagactgtacatcaccaccagcctgtacagcgcctgggacaagcagttctaccccgacctgatcagagagggcagcgtgatgctgcaggtggacgtggacaccgtgaagggcggcctgaagctgaaccccaacttcctggtggacttcggcaaggagcccctgggccccgccctggcccacgagctgagataccccggcggcgactgcagcagcgacatctggatctag

SEQ ID NO: 98282 - DNA, 1227 bp, Artificial Sequence
  Description of Artificial Sequence: Synthetic coding sequence
atgcccaacctgaaggacgagctgcaccacagcggctggaacacctgcagcagctgcttcggcgacagcaccaagagcagaaccaagctggtgctgcccagcctgatcagcagcagaatctacgtggtggacgtgggcagcgagcccagagcccccaagctgcacaaggtgatcgagcccaaggacatccacgccaagtgcgagctggccttcctgcacaccagccactgcctggccagcggcgaggtgatgatcagcagcctgggcgacgtgaagggcaacggcaagggcggcttcgtgctgctggacggcgagaccttcgaggtgaagggcacctgggagagacccggcggcgccgcccccctgggctacgacttctggtaccagcccagacacaacgtgatgatcagcaccgagtgggccgcccccaacgtgctgagagacggcttcaaccccgccgacgtggaggccggcctgtacggcagccacctgtacgtgtgggactggcagagacacgagatcgtgcagaccctgagcctgaaggacggcctgatccccctggagatcagattcctgcacaaccccgacgccgcccagggcttcgtgggctgcgccctgagcagcaccatccagagattctacaagaacgagggcggcacctggagcgtggagaaggtgatccaggtgccccccaagaaggtgaagggctggctgctgcccgagatgcccggcctgatcaccgacatcctgctgagcctggacgacagattcctgtacttcagcaactggctgcacggcgacctgagacagtacgacatcagcgacccccagagacccagactgaccggccagctgttcctgggcggcagcatcgtgaagggcggccccgtgcaggtgctggaggacgaggagctgaagagccagcccgagcccctggtggtgaagggcaagagagtggccggcggcccccagatgatccagctgagcctggacggcaagagactgtacatcaccaccagcctgtacagcgcctgggacaagcagttctaccccgacctgatcagagagggcagcgtgatgctgcaggtggacgtggacaccgtgaagggcggcctgaagctgaaccccaacttcctggtggacttcggcaaggagcccctgggccccgccctggcccacgagctgagataccccggcggcgactgcagcagcgacatctggatctag

SEQ ID NO: 98283 - DNA, 1233 bp, Artificial Sequence
  Description of Artificial Sequence: Synthetic coding sequence
atggccaccaagtgcggcaactgcggccccggctacagcacccccctggaggccatgaagggccccagagaggagatcgtgtacctgccctgcatctacagaaacaccggcaccgaggcccccgactacctggccaccgtggacgtggaccccaagagcccccagtactgccaggtgatcgagcccaaggacatccacgccaagtgcgagctggccttcctgcacaccagccactgcctggccagcggcgaggtgatgatcagcagcctgggcgacgtgaagggcaacggcaagggcggcttcgtgctgctggacggcgagaccttcgaggtgaagggcacctgggagagacccggcggcgccgcccccctgggctacgacttctggtaccagcccagacacaacgtgatgatcagcaccgagtgggccgcccccaacgtgctgagagacggcttcaaccccgccgacgtggaggccggcctgtacggcagccacctgtacgtgtgggactggcagagacacgagatcgtgcagaccctgagcctgaaggacggcctgatccccctggagatcagattcctgcacaaccccgacgccgcccagggcttcgtgggctgcgccctgagcagcaccatccagagattctacaagaacgagggcggcacctggagcgtggagaaggtgatccaggtgccccccaagaaggtgaagggctggctgctgcccgagatgcccggcctgatcaccgacatcctgctgagcctggacgacagattcctgtacttcagcaactggctgcacggcgacctgagacagtacgacatcagcgacccccagagacccagactgaccggccagctgttcctgggcggcagcatcgtgaagggcggccccgtgcaggtgctggaggacgaggagctgaagagccagcccgagcccctggtggtgaagggcaagagagtggccggcggcccccagatgatccagctgagcctggacggcaagagactgtacatcaccaccagcctgtacagcgcctgggacaagcagttctaccccgacctgatcagagagggcagcgtgatgctgcaggtggacgtggacaccgtgaagggcggcctgaagctgaaccccaacttcctggtggacttcggcaaggagcccctgggccccgccctggcccacgagctgagataccccggcggcgactgcagcagcgacatctggatctag

SEQ ID NO: 98284 - DNA, 1362 bp, Artificial Sequence
  Description of Artificial Sequence: Synthetic coding sequence
atgcccggcagcagcggcgccggcatggaggccgccgtggcccccggcagagacgcccccgcccccgccgccagccagcccagcggctgcggcaagcacaacagccccgagagaaaggtgtacatggactacaacgccaccacccccctggagcccgaggtgatccaggccatgaccaaggccatgtgggaggcctggggcaaccccagcagcccctacagcgccggcagaaaggccaaggacatcatcaacgccgccagagagagcctggccaagatgatcggcggcaagccccaggacatcatcttcaccagcggcggcaccgagagcaacaacctggtgatccacagcgtggtgaagcacttccacgccaaccagaccagcaagggccacaccggcggccaccacagccccgtgaagggcgccaagccccacttcatcaccagcagcgtggagcacgacagcatcagactgcccctggagcacctggtggaggagcaggtggccgccgtgaccttcgtgcccgtgagcaaggtgagcggccaggccgaggtggacgacatcctggccgccgtgagacccaccaccagactggtgaccatcatgctggccaacaacgagaccggcatcgtgatgcccgtgcccgagatcagccagagaatcaaggccctgaaccaggagagagtggccgccggcctgccccccatcctggtgcacaccgacgccgcccaggccctgggcaagcagagagtggacgtggaggacctgggcgtggacttcctgaccatcgtgggccacaagttctacggccccagaatcggcgccctgtacatcagaggcctgggcgagttcacccccctgtaccccatgctgttcggcggcggccaggagagaaacttcagacccggcaccgagaacacccccatgatcgccggcctgggcaaggccgccgagctggtgacccagaactgcgaggcctacgaggcccacatgagagacgtgagagactacctggaggagagactggaggccgagttcggccagaagagaatccacctgaacagccagttccccggcacccagagactgcccaacacctgcaacttcagcatcagaggccccagactgcagggccacgtggtgctggcccagtgcagagtgctgatggccagcgtgggcgccgcctgccacagcgaccacggcgaccagcccagccccgtgctgctgagctacggcgtgcccttcgacgtggccagaaacgccctgagactgagcgtgggcagaagcaccaccagagccgaggtggacctggtggtgcaggacctgaagcaggccgtggcccagctggaggaccaggcctag

SEQ ID NO: 98285 - DNA, 708 bp, Artificial Sequence
  Description of Artificial Sequence: Synthetic coding sequence
ttcagcaaccccttctgcggcgagaccttccccagaaagcccgacctgaagggcacccacagatgggccccccagcccagcgagggcggccaggcccccttccactacttcctgggcggcaccagactgcaccccgccgcccccggcgcccccggcggcagaaccagcggcagcctgctgaacgtgaagatgatgaagatgaagaccttcatgatgatctgcttccacctgatcaacaccgtgaccttcgtgcccgtgagcaaggtgagcggccaggccgaggtggacgacatcctggccgccgtgagacccaccaccagactggtgaccatcatgctggccaacaacgagaccggcatcgtgatgcccgtgcccgagatcagccagagaatcaaggccctgaaccaggagagagtggccgccggcctgccccccatcctggtgcacaccgacgccgcccaggccctgggcaagcagagagtggacgtggaggacctgggcgtggacttcctgaccatcgtgggccacaagttctacggccccagaatcggcgccctgtacatcagaggcctgggcgagttcacccccctgtaccccatgctgttcggcggcggccaggagagaaacttcagacccggcaccgagaacacccccatgatcgccggcctgggcaaggtgagccccggcgagctggaggagatgagctag

SEQ ID NO: 98286 - DNA, 954 bp, Artificial Sequence
  Description of Artificial Sequence: Synthetic coding sequence
atggaggccgccgtggcccccggcagagacgcccccgcccccgccgccagccagcccagcggctgcggcaagcacaacagccccgagagaaaggtgtacatggactacaacgccaccacccccctggagcccgaggtgatccaggccatgaccaaggccatgtgggaggcctggggcaaccccagcagcccctacagcgccggcagaaaggccaaggacatcatcaacgccgccagagagagcctggccaagatgatcggcggcaagccccaggacatcatcttcaccagcggcggcaccgagagcaacaacctggtgatccacagcgtggtgaagcacttccacgccaaccagaccagcaagggccacaccggcggccaccacagccccgtgaagggcgccaagccccacttcatcaccagcagcgtggagcacgacagcatcagactgcccctggagcacctggtggaggagcaggtggccgccgtgaccttcgtgcccgtgagcaaggtgagcggccaggccgaggtggacgacatcctggccgccgtgagacccaccaccagactggtgaccatcatgctggccaacaacgagaccggcatcgtgatgcccgtgcccgagatcagccagagaatcaaggccctgaaccaggagagagtggccgccggcctgccccccatcctggtgcacaccgacgccgcccaggccctgggcaagcagagagtggacgtggaggacctgggcgtggacttcctgaccatcgtgggccacaagttctacggccccagaatcggcgccctgtacatcagaggcctgggcgagttcacccccctgtaccccatgctgttcggcggcggccaggagagaaacttcagacccggcaccgagaacacccccatgatcgccggcctgggcaaggtgagccccggcgagctggaggagatgagctag

SEQ ID NO: 98287 - DNA, 1056 bp, Artificial Sequence
  Description of Artificial Sequence: Synthetic coding sequence
atggaggccgccgtggcccccggcagagacgcccccgcccccgccgccagccagcccagcggctgcggcaagcacaacagccccgagagaaaggtgtacatggactacaacgccaccacccccctggagcccgaggtgatccaggccatgaccaaggccatgtgggaggcctggggcaaccccagcagcccctacagcgccgccgtgaccttcgtgcccgtgagcaaggtgagcggccaggccgaggtggacgacatcctggccgccgtgagacccaccaccagactggtgaccatcatgctggccaacaacgagaccggcatcgtgatgcccgtgcccgagatcagccagagaatcaaggccctgaaccaggagagagtggccgccggcctgccccccatcctggtgcacaccgacgccgcccaggccctgggcaagcagagagtggacgtggaggacctgggcgtggacttcctgaccatcgtgggccacaagttctacggccccagaatcggcgccctgtacatcagaggcctgggcgagttcacccccctgtaccccatgctgttcggcggcggccaggagagaaacttcagacccggcaccgagaacacccccatgatcgccggcctgggcaaggccgccgagctggtgacccagaactgcgaggcctacgaggcccacatgagagacgtgagagactacctggaggagagactggaggccgagttcggccagaagagaatccacctgaacagccagttccccggcacccagagactgcccaacacctgcaacttcagcatcagaggccccagactgcagggccacgtggtgctggcccagtgcagagtgctgatggccagcgtgggcgccgcctgccacagcgaccacggcgaccagcccagccccgtgctgctgagctacggcgtgcccttcgacgtggccagaaacgccctgagactgagcgtgggcagaagcaccaccagagccgaggtggacctggtggtgcaggacctgaagcaggccgtggcccagctggaggaccaggcctag

SEQ ID NO: 98288 - DNA, 720 bp, Artificial Sequence
  Description of Artificial Sequence: Synthetic coding sequence
atggaggccgccgtggcccccggcagagacgcccccgcccccgccgccagccagcccagcggctgcggcaagcacaacagccccgagagaaaggtgtacatggactacaacgccaccacccccctggagcccgaggtgatccaggccatgaccaaggccatgtgggaggcctggggcaaccccagcagcccctacagcgccggcagaaaggccaaggacatcatcaacgccgccagagagagcctggccaagatgatcggcggcaagccccaggacatcatcttcaccagcggcggcaccgaggccgccgagctggtgacccagaactgcgaggcctacgaggcccacatgagagacgtgagagactacctggaggagagactggaggccgagttcggccagaagagaatccacctgaacagccagttccccggcacccagagactgcccaacacctgcaacttcagcatcagaggccccagactgcagggccacgtggtgctggcccagtgcagagtgctgatggccagcgtgggcgccgcctgccacagcgaccacggcgaccagcccagccccgtgctgctgagctacggcgtgcccttcgacgtggccagaaacgccctgagactgagcgtgggcagaagcaccaccagagccgaggtggacctggtggtgcaggacctgaagcaggccgtggcccagctggaggaccaggcctag

SEQ ID NO: 98289 - DNA, 1338 bp, Artificial Sequence
  Description of Artificial Sequence: Synthetic coding sequence
atggaggccgccgtggcccccggcagagacgcccccgcccccgccgccagccagcccagcggctgcggcaagcacaacagccccgagagaaaggtgtacatggactacaacgccaccacccccctggagcccgaggtgatccaggccatgaccaaggccatgtgggaggcctggggcaaccccagcagcccctacagcgccggcagaaaggccaaggacatcatcaacgccgccagagagagcctggccaagatgatcggcggcaagccccaggacatcatcttcaccagcggcggcaccgagagcaacaacctggtgatccacagcgtggtgaagcacttccacgccaaccagaccagcaagggccacaccggcggccaccacagccccgtgaagggcgccaagccccacttcatcaccagcagcgtggagcacgacagcatcagactgcccctggagcacctggtggaggagcaggtggccgccgtgaccttcgtgcccgtgagcaaggtgagcggccaggccgaggtggacgacatcctggccgccgtgagacccaccaccagactggtgaccatcatgctggccaacaacgagaccggcatcgtgatgcccgtgcccgagatcagccagagaatcaaggccctgaaccaggagagagtggccgccggcctgccccccatcctggtgcacaccgacgccgcccaggccctgggcaagcagagagtggacgtggaggacctgggcgtggacttcctgaccatcgtgggccacaagttctacggccccagaatcggcgccctgtacatcagaggcctgggcgagttcacccccctgtaccccatgctgttcggcggcggccaggagagaaacttcagacccggcaccgagaacacccccatgatcgccggcctgggcaaggccgccgagctggtgacccagaactgcgaggcctacgaggcccacatgagagacgtgagagactacctggaggagagactggaggccgagttcggccagaagagaatccacctgaacagccagttccccggcacccagagactgcccaacacctgcaacttcagcatcagaggccccagactgcagggccacgtggtgctggcccagtgcagagtgctgatggccagcgtgggcgccgcctgccacagcgaccacggcgaccagcccagccccgtgctgctgagctacggcgtgcccttcgacgtggccagaaacgccctgagactgagcgtgggcagaagcaccaccagagccgaggtggacctggtggtgcaggacctgaagcaggccgtggcccagctggaggaccaggcctag

SEQ ID NO: 98290 - DNA, 966 bp, Artificial Sequence
  Description of Artificial Sequence: Synthetic coding sequence
atgagcaccagagagagcttcaaccccgagagctacgagctggacaagagcttcagactgaccagattcaccgagctgaagggcaccggctgcaaggtgccccaggacgtgctgcagaagctgctggagagcctgcaggagaaccacttccaggaggacgagcagttcctgggcgccgtgatgcccagactgggcatcggcatggacacctgcgtgatccccctgagacacggcggcctgagcctggtgcagaccaccgactacatctaccccatcgtggacgacccctacatgatgggcagaatcgcctgcgccaacgtgctgagcgacctgtacgccatgggcgtgaccgagtgcgacaacatgctgatgctgctgggcgtgagcaacaagatgaccgacagagagagagacaaggtgatgcccctgatcatccagggcttcaaggacgccgccgaggaggccggcaccagcgtgaccggcggccagaccgtgctgaacccctggatcgtgctgggcggcgtggccaccaccgtgtgccagcccaacgagttcatcatgcccgacaacgccgtgcccggcgacgtgctggtgctgaccaagcccctgggcacccaggtggccgtggccgtgcaccagtggctggacatccccgagaagtggaacaagatcaagctggtggtgacccaggaggacgtggagctggcctaccaggaggccatgatgaacatggccagactgaacagaaccggcggcctgctgatctgcctgcccagagagcaggccgccagattctgcgccgagatcaagagccccaagtacggcgagggccaccaggcctggatcatcggcatcgtggagaagggcaacagaaccgccagaatcatcgacaagcccagaatcatcgaggtggccccccaggtggccacccagaacgtgaaccccacccccggcgccaccagctag

SEQ ID NO: 98291 - DNA, 1179 bp, Artificial Sequence
  Description of Artificial Sequence: Synthetic coding sequence
atgagcaccagagagagcttcaaccccgagagctacgagctggacaagagcttcagactgaccagattcaccgagctgaagggcaccggctgcaaggtgccccaggacgtgctgcagaagctgctggagagcctgcaggagaaccacttccaggaggacgagcagttcctgggcgccgtgatgcccagactgggcatcggcatggacacctgcgtgatccccctgagacacggcggcctgagcctggtgcagaccaccgactacatctaccccatcgtggacgacccctacatgatgggcagaatcgcctgcgccaacgtgctgagcgacctgtacgccatgggcgtgaccgagtgcgacaacatgctgatgctgctgggcgtgagcaacaagatgaccgacagagagagagacaaggtgatgcccctgatcatccagggcttcaaggacgccgccgaggaggccggcaccagcgtgaccggcggccagaccgtgctgaacccctggatcgtgctgggcggcgtggccaccaccgtgtgccagcccaacgagttcatcatgcccgacaacgccgtgcccggcgacgtgctggtgctgaccaagcccctgggcacccaggtggccgtggccgtgcaccagtggctggacatccccgagaagtggaacaagatcaagctggtggtgacccaggaggacgtggagctggcctaccaggaggccatgatgaacatggccagactgaacagaaccgccgccggcctgatgcacaccttcaacgcccacgccgccaccgacatcaccggcttcggcatcctgggccacgcccagaacctggccaagcagcagagaaacgaggtgagcttcgtgatccacaacctgcccgtgctggccaagatggccgccgtgagcaaggcctgcggcaacatgttcggcctgatgcacggcacctgccccgagaccagcggcggcctgctgatctgcctgcccagagagcaggccgccagattctgcgccgagatcaagagccccaagtacggcgagggccaccaggcctggatcatcggcatcgtggagaagggcaacagaaccgccagaatcatcgacaagcccagaatcatcgaggtggccccccaggtggccacccagaacgtgaaccccacccccggcgccaccagctag

SEQ ID NO: 98292 - DNA, 966 bp, Artificial Sequence; identical to SEQ ID NO: 98290
  Description of Artificial Sequence: Synthetic coding sequence

SEQ ID NO: 98293 - DNA, 501 bp, Artificial Sequence
  Description of Artificial Sequence: Synthetic coding sequence
atgagcaccagagagagcttcaaccccgagagctacgagctggacaagagcttcagactgaccagattcaccgagctgaagggcaccggctgcaaggtgccccaggacgtgctgcagaagctgctggagagcctgcaggagaaccacttccaggaggacgagcagttcctgggcgccgtgatgcccagactgggcatcggcatggacacctgcgtgatccccctgagacacggcggcctgagcctggtgcagaccaccgactacatctaccccatcgtggacgacccctacatgatgggcagaatcgcctgcgccaacgtgctgagcgacctgtacgccatgggcgtgaccgagtgcgacaacatgctgatgctgctgggcgtgagcaacaagatgaccgacagagagagagacaaggtgatgcccctgatcatccagggcttcaaggacgccgccgaggaggccggcaccagcgtgaccggcggccagaccgtgctgtag

SEQ ID NO: 98294 - DNA, 279 bp, Artificial Sequence
  Description of Artificial Sequence: Synthetic coding sequence
atggacacctgcgtgatccccctgagacacggcggcctgagcctggtgcagaccaccgactacatctaccccatcgtggacgacccctacatgatgggcagaatcgcctgcgccaacgtgctgagcgacctgtacgccatgggcgtgaccgagtgcgacaacatgctgatgctgctgggcgtgagcaacaagatgaccgacagagagagagacaaggtgatgcccctgatcatccagggcttcaaggacgccgccgaggaggccggcaccagcgtgtag

SEQ ID NO: 98295 - DNA, 978 bp, Artificial Sequence
  Description of Artificial Sequence: Synthetic coding sequence
atggacacctgcgtgatccccctgagacacggcggcctgagcctggtgcagaccaccgactacatctaccccatcgtggacgacccctacatgatgggcagaatcgcctgcgccaacgtgctgagcgacctgtacgccatgggcgtgaccgagtgcgacaacatgctgatgctgctgggcgtgagcaacaagatgaccgacagagagagagacaaggtgatgcccctgatcatccagggcttcaaggacgccgccgaggaggccggcaccagcgtgaccggcggccagaccgtgctgaacccctggatcgtgctgggcggcgtggccaccaccgtgtgccagcccaacgagttcatcatgcccgacaacgccgtgcccggcgacgtgctggtgctgaccaagcccctgggcacccaggtggccgtggccgtgcaccagtggctggacatccccgagaagtggaacaagatcaagctggtggtgacccaggaggacgtggagctggcctaccaggaggccatgatgaacatggccagactgaacagaaccgccgccggcctgatgcacaccttcaacgcccacgccgccaccgacatcaccggcttcggcatcctgggccacgcccagaacctggccaagcagcagagaaacgaggtgagcttcgtgatccacaacctgcccgtgctggccaagatggccgccgtgagcaaggcctgcggcaacatgttcggcctgatgcacggcacctgccccgagaccagcggcggcctgctgatctgcctgcccagagagcaggccgccagattctgcgccgagatcaagagccccaagtacggcgagggccaccaggcctggatcatcggcatcgtggagaagggcaacagaaccgccagaatcatcgacaagcccagaatcatcgaggtggccccccaggtggccacccagaacgtgaaccccacccccggcgccaccagctag

SEQ ID NO: 98296 - DNA, 975 bp, Artificial Sequence
  Description of Artificial Sequence: Synthetic coding sequence
atgagcaccagagagagcttcaaccccgagagctacgagctggacaagagcttcagactgaccagattcaccgagctgaagggcaccggctgcaaggtgccccaggacgtgctgcagaagctgctggagagcctgcaggagaaccacttccaggaggacgagcagttcctgggcgccgtgatgcccagactgggcatcggcatggacacctgcgtgatccccctgagacacggcggcctgagcctggtgcagaccaccgactacatctaccccatcgtggacgacccctacatgatgggcagaatcgcctgcgccaacgtgctgagcgacctgtacgccatgggcgtgaccgagtgcgacaacatgctgatgctgctgggcgtgagcaacaagatgaccgacagagagagagacaaggtgatgcccctgatcatccagggcttcaaggacgccgccgaggaggccggcaccagcgtgaccggcggccagaccgtgctgaacccctggatcgtgctgggcggcgtggccaccaccgtgtgccagcccaacgagttcatcatgcccgacaacgccgtgcccggcgacgtgctggtgctgaccaagcccctgggcacccaggtggccgtggccgtgcaccagtggctggacatccccgagaagtggaacaagatcaagctggtggtgacccaggaggacgtggagctggcctaccaggaggccatgatgaacatggccagactgaacagaaccgccgccggcctgatgcacaccttcaacgcccacgccgccaccgacatcaccggcttcggcatcctgggccacgcccagaacctggccaagcagcagagaaacgaggtgagcttcgtgatccacaacctgcccgtgctggccaagatggccgccgtgagcaaggcctgcggcaacatgttcggcctgatgcacggcacctgccccgagaccagcgacgtgcagtag

SEQ ID NO: 98297 - DNA, 1200 bp, Artificial Sequence
  Description of Artificial Sequence: Synthetic coding sequence
atggccgaggccagcgccaccggcgcctgcggcgaggccatggccgccgccgagggcagcagcggccccgccggcctgaccctgggcagactgaccggcttcagcggcatgaagggcctggtgggcggccaggaggaggccagccaggaggccggcctgcccgccggcgccggccccagccccaccttccccgccctgggcatcggcatggacagctgcgtgatccccctgagacacggcggcctgagcctggtgcagaccaccgacttcttctaccccctggtggaggacccctacatgatgggcagaatcgcctgcgccaacgtgctgagcgacctgtacgccatgggcatcaccgagtgcgacaacatgctgatgctgctgagcgtgagccagagcatgagcgaggaggagagagagaaggtgacccccctgatggtgaagggcttcagagacgccgccgaggagggcggcaccgccgtgaccggcggccagaccgtggtgaacccctggatcatcatcggcggcgtggccaccgtggtgtgccagcccaacgagttcatcatgcccgacagcgccgtggtgggcgacgtgctggtgctgaccaagcccctgggcacccaggtggccgtgaacgcccaccagtggctggacaaccccgagagatggaacaaggtgaagatggtggtgagcagagaggaggtggagctggcctaccaggaggccatgttcaacatggccaccctgaacagaaccgccgccggcctgatgcacaccttcaacgcccacgccgccaccgacatcaccggcttcggcatcctgggccacagccagaacctggccaagcagcagagaaacgaggtgagcttcgtgatccacaacctgcccatcatcgccaagatggccgccgtgagcaaggccagcggcagattcggcctgctgcagggcaccagcgccgagaccagcggcggcctgctgatctgcctgcccagagagcaggccgccagattctgcagcgagatcaagagcagcaagtacggcgagggccaccaggcctggatcgtgggcatcgtggagaagggcaacagaaccgccagaatcatcgacaagcccagagtgatcgaggtgctgcccagaggcgccaccgccgccgtgctggcccccgacagcagcaacgccagcagcgagcccagcagctag

SEQ ID NO: 98298 - DNA, 1452 bp, Artificial Sequence
  Description of Artificial Sequence: Synthetic coding sequence
  Description of Combined DNA/RNA Molecule: Synthetic coding sequence
atggccgaggccagcgccaccggcgcctgcggcgaggccatggccgccgccgagggcagcagcggccccgccggcctgaccctgggcagaagcttcagcaactacagacccttcgagccccaggccctgggcctgagccccagctggagactgaccggcttcagcggcatgaagggcugaggctgcaaggtgccccaggaggccctgctgaagctgctggccggcctgaccagacccgacgtgagaccccccctgggcagaggcctggtgggcggccaggaggaggccagccaggaggccggcctgcccgccggcgccggccccagccccaccttccccgccctgggcatcggcatggacagctgcgtgatccccctgagacacggcggcctgagcctggtgcagaccaccgacttcttctaccccctggtggaggacccctacatgatgggcagaatcgcctgcgccaacgtgctgagcgacctgtacgccatgggcatcaccgagtgcgacaacatgctgatgctgctgagcgtgagccagagcatgagcgaggaggagagagagaaggtgacccccctgatggtgaagggcttcagagacgccgccgaggagggcggcaccgccgtgaccggcggccagaccgtggtgaacccctggatcatcatcggcggcgtggccaccgtggtgtgccagcccaacgagttcatcatgcccgacagcgccgtggtgggcgacgtgctggtgctgaccaagcccctgggcacccaggtggccgtgaacgcccaccagtggctggacaaccccgagagatggaacaaggtgaagatggtggtgagcagagaggaggtggagctggcctaccaggaggccatgttcaacatggccaccctgaacagaaccgccgccggcctgatgcacaccttcaacgcccacgccgccaccgacatcaccggcttcggcatcctgggccacagccagaacctggccaagcagcagagaaacgaggtgagcttcgtgatccacaacctgcccatcatcgccaagatggccgccgtgagcaaggccagcggcagattcggcctgctgcagggcaccagcgccgagaccagcggcggcctgctgatctgcctgcccagagagcaggccgccagattctgcagcgagatcaagagcagcaagtacggcgagggccaccaggcctggatcgtgggcatcgtggagaagggcaacagaaccgccagaatcatcgacaagcccagagtgatcgaggtgctgcccagaggcgccaccgccgccgtgctggcccccgacagcagcaacgccagcagcgagcccagcagcugagacgagagaaccgaggtggtgtggaccctggagcccctgagcaccatcaccgacggcagccaggagctgatcgtgagaaacttccagagaagactgcccgcctag

SEQ ID NO: 98299 - DNA, 1347 bp, Artificial Sequence
  Description of Artificial Sequence: Synthetic coding sequence
  Description of Combined DNA/RNA Molecule: Synthetic coding sequence
atggccgaggccagcgccaccggcgcctgcggcgaggccatggccgccgccgagggcagcagcggccccgccggcctgaccctgggcagaagcttcagcaactacagacccttcgagccccaggccctgggcctgagccccagctggagactgaccggcttcagcggcatgaagggcugaggctgcaaggtgccccaggaggccctgctgaagctgctggccggcctgaccagacccgacgtgagaccccccctgggcagaggcctggtgggcggccaggaggaggccagccaggaggccggcctgcccgccggcgccggccccagccccaccttccccgccctgggcatcggcatggacagctgcgtgatccccctgagacacggcggcctgagcctggtgcagaccaccgacttcttctaccccctggtggaggacccctacatgatgggcagaatcgcctgcgccaacgtgctgagcgacctgtacgccatgggcatcaccgagtgcgacaacatgctgatgctgctgagcgtgagccagagcatgagcgaggaggagagagagaaggtgacccccctgatggtgaagggcttcagagacgccgccgaggagggcggcaccgccgtgaccggcggccagaccgtggtgaacccctggatcatcatcggcggcgtggccaccgtggtgtgccagcccaacgagttcatcatgcccgacagcgccgtggtgggcgacgtgctggtgctgaccaagcccctgggcacccaggtggccgtgaacgcccaccagtggctggacaaccccgagagatggaacaaggtgaagatggtggtgagcagagaggaggtggagctggcctaccaggaggccatgttcaacatggccaccctgaacagaaccgccgccggcctgatgcacaccttcaacgcccacgccgccaccgacatcaccggcttcggcatcctgggccacagccagaacctggccaagcagcagagaaacgaggtgagcttcgtgatccacaacctgcccatcatcgccaagatggccgccgtgagcaaggccagcggcagattcggcctgctgcagggcaccagcgccgagaccagcggcggcctgctgatctgcctgcccagagagcaggccgccagattctgcagcgagatcaagagcagcaagtacggcgagggccaccaggcctggatcgtgggcatcgtggagaagggcaacagaaccgccagaatcatcgacaagcccagagtgatcgaggtgctgcccagaggcgccaccgccgccgtgctggcccccgacagcagcaacgccagcagcgagcccagcagctag

SEQ ID NO: 98300 - DNA, 1176 bp, Artificial Sequence
  Description of Artificial Sequence: Synthetic coding sequence
atggccgaggccagcgccaccggcgcctgcggcgaggccatggccgccgccgagggcagcagcggccccgccggcctgaccctgggcagaagcttcagcaactacagacccttcgagccccaggaggccggcctgcccgccggcgccggccccagccccaccttccccgccctgggcatcggcatggacagctgcgtgatccccctgagacacggcggcctgagcctggtgcagaccaccgacttcttctaccccctggtggaggacccctacatgatgggcagaatcgcctgcgccaacgtgctgagcgacctgtacgccatgggcatcaccgagtgcgacaacatgctgatgctgctgagcgtgagccagagcatgagcgaggaggagagagagaaggtgacccccctgatggtgaagggcttcagagacgccgccgaggagggcggcaccgccgtgaccggcggccagaccgtggtgaacccctggatcatcatcggcggcgtggccaccgtggtgtgccagcccaacgagttcatcatgcccgacagcgccgtggtgggcgacgtgctggtgctgaccaagcccctgggcacccaggtggccgtgaacgcccaccagtggctggacaaccccgagagatggaacaaggtgaagatggtggtgagcagagaggaggtggagctggcctaccaggaggccatgttcaacatggccaccctgaacagaaccgccgccggcctgatgcacaccttcaacgcccacgccgccaccgacatcaccggcttcggcatcctgggccacagccagaacctggccaagcagcagagaaacgaggtgagcttcgtgatccacaacctgcccatcatcgccaagatggccgccgtgagcaaggccagcggcagattcggcctgctgcagggcaccagcgccgagaccagcggcggcctgctgatctgcctgcccagagagcaggccgccagattctgcagcgagatcaagagcagcaagtacggcgagggccaccaggcctggatcgtgggcatcgtggagaagggcaacagaaccgccagaatcatcgacaagcccagagtgatcgaggtgctgcccagaggcgccaccgccgccgtgctggcccccgacagcagcaacgccagcagcgagcccagcagctag

SEQ ID NO: 98301 - DNA, 1671 bp, Artificial Sequence
  Description of Artificial Sequence: Synthetic coding sequence
atgggcagagccagacccggccagagaggcccccccagccccggccccgccgcccagccccccgccccccccagaagaagagccagaagcctggccctgctgggcgccctgctggccgccgccgccgccgccgccgtgagagtgtgcgccagacacgccgaggcccaggccgccgccagacaggagctggccctgaagaccctgggcaccgacggcctgttcctgttcagcagcctggacaccgacggcgacatgtacatcagccccgaggagttcaagcccatcgccgagaagctgaccggcagcacccccgccgccagctgcgaggaggaggagctgccccccgaccccagcgaggagaccctgaccatcgaggccagattccagcccctgctgcccgagaccatgaccaagagcaaggacggcttcctgggcgtgagcagactggccctgagcggcctgagaaactggaccgccgccgccagccccagcgccgtgttcgccaccagacacttccagcccttcctgcccccccccggccaggagctgggcgagccctggtggatcatccccagcgagctgagcatgttcaccggctacctgagcaacaacagattctacccccccccccccaagggcaaggaggtgatcatccacagactgctgagcatgttccaccccagacccttcgtgaagaccagattcgccccccagggcgccgtggcctgcctgaccgccatcagcgacttctactacaccgtgatgttcagaatccacgccgagttccagctgagcgagccccccgacttccccttctggttcagccccgcccagttcaccggccacatcatcctgagcaaggacgccacccacgtgagagacttcagactgttcgtgcccaaccacagaagcctgaacgtggacatggagtggctgtacggcgccagcgagagcagcaacatggaggtggacatcggctacatcccccagatggagctggaggccaccggccccagcgtgcccagcgtgatcctggacgaggacggcagcatgatcgacagccacctgcccagcggcgagcccctgcagttcgtgttcgaggagatcaagtggcagcaggagctgagctgggaggaggccgccagaagactggaggtggccatgtaccccttcaagaaggtgagctacctgcccttcaccgaggccttcgacagagccaaggccgagaacaagctggtgcacagcatcctgctgtggggcgccctggacgaccagagctgccactgcagcggcagaaccctgagagagaccgtgctggagagcagccccatcctgaccctgctgaacgagagcttcatcagcacctggagcctggtgaaggagctggaggagctgcagaacaaccaggagaacagcagccaccagaagctggccggcctgcacctggagaagtacagcttccccgtggagatgatgatctgcctgcccaacggcaccgtggtgcaccacatcaacgccaactacttcctggacatcaccagcgtgaagcccgaggagatcgagagcaacctgttcagcttcagcagcaccttcgaggaccccagcaccgccacctacatgcagttcctgaaggagggcctgagaagaggcctgcccctgctgcagccctag

SEQ ID NO: 98302 - DNA, 1773 bp, Artificial Sequence
  Description of Artificial Sequence: Synthetic coding sequence
  Description of Combined DNA/RNA Molecule: Synthetic coding sequence
atgggcagagccagacccggccagagaggcccccccagccccggccccgccgcccagccccccgccccccccagaagaagagccagaagcctggccctgctgggcgccctgctggccgccgccgccgccgccgccgtgagagtgtgcgccagacacgccgaggcccaggccgccgccagacaggagctggccctgaagaccctgggcaccgacggcctgttcctgttcagcagcctggacaccgacggcgacatgtacatcagccccgaggagttcaagcccatcgccgagaagctgaccggcagctgcagcgtgacccagaccggcgtgcagtggtgcagccacagcagcctgcagccccagctgccctggctgaacugaagcagctgcctgagcctgctgagaagcacccccgccgccagctgcgaggaggaggagctgccccccgaccccagcgaggagaccctgaccatcgaggccagattccagcccctgctgcccgagaccatgaccaagagcaaggacggcttcctgggcgtgagcagactggccctgagcggcctgagaaactggaccgccgccgccagccccagcgccgtgttcgccaccagacacttccagcccttcctgcccccccccggccaggagctgggcgagccctggtggatcatccccagcgagctgagcatgttcaccggctacctgagcaacaacagattctacccccccccccccaagggcaaggaggtgatcatccacagactgctgagcatgttccaccccagacccttcgtgaagaccagattcgccccccagggcgccgtggcctgcctgaccgccatcagcgacttctactacaccgtgatgttcagaatccacgccgagttccagctgagcgagccccccgacttccccttctggttcagccccgcccagttcaccggccacatcatcctgagcaaggacgccacccacgtgagagacttcagactgttcgtgcccaaccacagaagcctgaacgtggacatggagtggctgtacggcgccagcgagagcagcaacatggaggtggacatcggctacatcccccagatggagctggaggccaccggccccagcgtgcccagcgtgatcctggacgaggacggcagcatgatcgacagccacctgcccagcggcgagcccctgcagttcgtgttcgaggagatcaagtggcagcaggagctgagctgggaggaggccgccagaagactggaggtggccatgtaccccttcaagaaggtgagctacctgcccttcaccgaggccttcgacagagccaaggccgagaacaagctggtgcacagcatcctgctgtggggcgccctggacgaccagagctgcugaggcagcggcagaaccctgagagagaccgtgctggagagcagccccatcctgaccctgctgaacgagagcttcatcagcacctggagcctggtgaaggagctggaggagctgcagaacaaccaggagaacagcagccaccagaagctggccggcctgcacctggagaagtacagcttccccgtggagatgatgatctgcctgcccaacggcaccgtggtgcaccacatcaacgccaactacttcctggacatcaccagcgtgaagcccgaggagatcgagagcaacctgttcagcttcagcagcaccttcgaggaccccagcaccgccacctacatgcagttcctgaaggagggcctgagaagaggcctgcccctgctgcagccctag

SEQ ID NO: 98303 - DNA, 1671 bp, Artificial Sequence
  Description of Artificial Sequence: Synthetic coding sequence
  Description of Combined DNA/RNA Molecule: Synthetic coding sequence
atgggcagagccagacccggccagagaggcccccccagccccggccccgccgcccagccccccgccccccccagaagaagagccagaagcctggccctgctgggcgccctgctggccgccgccgccgccgccgccgtgagagtgtgcgccagacacgccgaggcccaggccgccgccagacaggagctggccctgaagaccctgggcaccgacggcctgttcctgttcagcagcctggacaccgacggcgacatgtacatcagccccgaggagttcaagcccatcgccgagaagctgaccggcagcacccccgccgccagctgcgaggaggaggagctgccccccgaccccagcgaggagaccctgaccatcgaggccagattccagcccctgctgcccgagaccatgaccaagagcaaggacggcttcctgggcgtgagcagactggccctgagcggcctgagaaactggaccgccgccgccagccccagcgccgtgttcgccaccagacacttccagcccttcctgcccccccccggccaggagctgggcgagccctggtggatcatccccagcgagctgagcatgttcaccggctacctgagcaacaacagattctacccccccccccccaagggcaaggaggtgatcatccacagactgctgagcatgttccaccccagacccttcgtgaagaccagattcgccccccagggcgccgtggcctgcctgaccgccatcagcgacttctactacaccgtgatgttcagaatccacgccgagttccagctgagcgagccccccgacttccccttctggttcagccccgcccagttcaccggccacatcatcctgagcaaggacgccacccacgtgagagacttcagactgttcgtgcccaaccacagaagcctgaacgtggacatggagtggctgtacggcgccagcgagagcagcaacatggaggtggacatcggctacatcccccagatggagctggaggccaccggccccagcgtgcccagcgtgatcctggacgaggacggcagcatgatcgacagccacctgcccagcggcgagcccctgcagttcgtgttcgaggagatcaagtggcagcaggagctgagctgggaggaggccgccagaagactggaggtggccatgtaccccttcaagaaggtgagctacctgcccttcaccgaggccttcgacagagccaaggccgagaacaagctggtgcacagcatcctgctgtggggcgccctggacgaccagagctgcugaggcagcggcagaaccctgagagagaccgtgctggagagcagccccatcctgaccctgctgaacgagagcttcatcagcacctggagcctggtgaaggagctggaggagctgcagaacaaccaggagaacagcagccaccagaagctggccggcctgcacctggagaagtacagcttccccgtggagatgatgatctgcctgcccaacggcaccgtggtgcaccacatcaacgccaactacttcctggacatcaccagcgtgaagcccgaggagatcgagagcaacctgttcagcttcagcagcaccttcgaggaccccagcaccgccacctacatgcagttcctgaaggagggcctgagaagaggcctgcccctgctgcagccctag

SEQ ID NO: 98304 - DNA, 1146 bp, Artificial Sequence
  Description of Artificial Sequence: Synthetic coding sequence
  Description of Combined DNA/RNA Molecule: Synthetic coding sequence
atgtggagaagcctgggcctggccctggccctgtgcctgctgcccagcggcggcaccgagagccaggaccagagcagcctgtgcaagcagccccccgcctggagcatcagagaccaggaccccatgctgaacagcaacggcagcgtgaccgtggtggccctgctgcaggccagcugatacctgtgcatcctgcaggccagcaagctggaggacctgagagtgaagctgaagaaggagggctacagcaacatcagctacatcgtggtgaaccaccagggcatcagcagcagactgaagtacacccacctgaagaacaaggtgagcgagcacatccccgtgtaccagcaggaggagaaccagaccgacgtgtggaccctgctgaacggcagcaaggacgacttcctgatctacgacagatgcggcagactggtgtaccacctgggcctgcccttcagcttcctgaccttcccctacgtggaggaggccatcaagatcgcctactgcgagaagaagtgcggcaactgcagcctgaccaccctgaaggacgaggacttctgcaagagagtgagcctggccaccgtggacaagaccgtggagacccccagcccccactaccaccacgagcaccaccacaaccacggccaccagcacctgggcagcagcgagctgagcgagaaccagcagcccggcgcccccaacgcccccacccaccccgccccccccggcctgcaccaccaccacaagcacaagggccagcacagacagggccaccccgagaacagagacatgcccgccagcgaggacctgcaggacctgcagaagaagctgtgcagaaagagatgcatcaaccagctgctgtgcaagctgcccaccgacagcgagctggcccccagaagcugatgctgccactgcagacacctgatcttcgagaagaccggcagcgccatcaccugacagtgcaaggagaacctgcccagcctgtgcagcugacagggcctgagagccgaggagaacatcaccgagagctgccagugaagactgccccccgccgccugacagatcagccagcagctgatccccaccgaggccagcgccagcugaagaugaaagaaccaggccaagaagugagagugacccagcaactag

SEQ ID NO: 98305 - DNA, 630 bp, Artificial Sequence
  Description of Artificial Sequence: Synthetic coding sequence
  Description of Combined DNA/RNA Molecule: Synthetic coding sequence
atgtggagaagcctgggcctggccctggccctgtgcctgctgcccagcggcggcaccgagagccaggaccagagcagcctgtgcaagcagccccccgcctggagcatcagagaccaggaccccatgctgaacagcaacggcagcgtgaccgtggtggccctgctgcaggccagcugatacctgtgcatcctgcaggccagcaagctggaggacctgagagtgaagctgaagaaggagggctacagcaacatcagctacatcgtggtgaaccaccagggcatcagcagcagactgaagtacacccacctgaagaacaaggtgagcgagcacatccccgtgtaccagcaggaggagaaccagaccgacgtgtggaccctgctgaacggcagcaaggacgacttcctgatctacgacagatgcggcagactggtgtaccacctgggcctgcccttcagcttcctgaccttcccctacgtggaggaggccatcaagatcgcctactgcgagaagaagtgcggcaactgcagcctgaccaccctgaaggacgaggacttctgcaagagagtgagcctggccaccgtggacaagaccgtggagacccccagcccccactaccaccacgagcactag

SEQ ID NO: 98306 - DNA, 1146 bp, Artificial Sequence; identical to SEQ ID NO: 98304
  Description of Artificial Sequence: Synthetic coding sequence
  Description of Combined DNA/RNA Molecule: Synthetic coding sequence

SEQ ID NO: 98307 - DNA, 933 bp, Artificial Sequence
  Description of Artificial Sequence: Synthetic coding sequence
  Description of Combined DNA/RNA Molecule: Synthetic coding sequence
atgtggagaagcctgggcctggccctggccctgtgcctgctgcccagcggcggcaccgagagccaggaccagagcagcctgtgcaagcagccccccgcctggagcatcagagaccaggaccccatgctgaacagcaacggcagcgtgaccgtggtggccctgctgcaggccagcugatacctgtgcatcctgcaggccagcaagctggaggacctgagagtgaagctgaagaaggagggctacagcaacatcagctacatcgtggtgaaccaccagggcatcagcagcagactgaagtacacccacctgaagaacaaggtgagcgagcacatccccgtgtaccagcaggaggagaaccagaccgacgtgtggaccctgctgaacggcagcaaggacgacttcctgatctacgacagatgcggcagactggtgtaccacctgggcctgcccttcagcttcctgaccttcccctacgtggaggaggccatcaagatcgcctactgcgagaagaagtgcggcaactgcagcctgaccaccctgaaggacgaggacttctgcaagagagtgagcctggccaccgtggacaagaccgtggagacccccagcccccactaccaccacgagcaccaccacaaccacggccaccagcacctgggcagcagcgagctgagcgagaaccagcagcccggcgcccccaacgcccccacccaccccgccccccccggcctgcaccaccaccacaagcacaagggccagcacagacagggccaccccgagaacagagacatgcccgccagcgaggacctgcaggacctgcagaagaagctgtgcagaaagagatgcatcaaccagctgctgtgcaagctgcccaccgacagcgagctggcccccagaagcugatgctgccactgcagacacctgatcttcgagtag

SEQ ID NO: 98308 - DNA, 1146 bp, Artificial Sequence; identical to SEQ ID NO: 98304
  Description of Artificial Sequence: Synthetic coding sequence
  Description of Combined DNA/RNA Molecule: Synthetic coding sequence

SEQ ID NO: 98309 - DNA, 264 bp, Artificial Sequence
  Description of Artificial Sequence: Synthetic coding sequence
  Description of Combined DNA/RNA Molecule: Synthetic coding sequence
atggccctggccgtgagagtggtgtactgcggcgccugaggctacaagagcaagtacctgcagctgaagaagaagctggaggacgagttccccggcagactggacatctgcggcgagggcaccccccaggccaccggcttcttcgaggtgatggtggccggcaagctgatccacagcaagaagaagggcgacggctacgtggacaccgagagcaagttcctgaagctggtggccgccatcaaggccgccctggcccagggctag

SEQ ID NO: 98310 - DNA, 267 bp, Artificial Sequence
  Description of Artificial Sequence: Synthetic coding sequence
atggccctggccgtgagagtggtgtactgctgcggcgccggcggctacaagagcaagtacctgcagctgaagaagaagctggaggacgagttccccggcagactggacatctgcggcgagggcaccccccaggccaccggcttcttcgaggtgatggtggccggcaagctgatccacagcaagaagaagggcgacggctacgtggacaccgagagcaagttcctgaagctggtggccgccatcaaggccgccctggcccagggctag

SEQ ID NO: 98311 - DNA, 351 bp, Artificial Sequence
  Description of Artificial Sequence: Synthetic coding sequence
  Description of Combined DNA/RNA Molecule: Synthetic coding sequence
atgagcttctgcagcttcttcggcggcgaggtgttccagaaccacttcgagcccggcgtgtacgtgtgcgccaagtgcggctacgagctgttcagcagcagaagcaagtacgcccacagcagcccctggcccgccttcaccgagaccatccacgccgacagcgtggccaagagacccgagcacaacagaagcgaggccctgaaggtgagctgcggcaagtgcggcaacggcctgggccacgagttcctgaacgacggccccaagcccggccagagcagattcugaatcttcagcagcagcctgaagttcgtgcccaagggcaaggagaccagcgccagccagggccactag

SEQ ID NO: 98312 - DNA, 681 bp, Artificial Sequence
  Description of Artificial Sequence: Synthetic coding sequence
atgagcttctgcagcttcttcggcggcgaggtgttccagaaccacttcgagcccggcgtgtacgtgtgcgccaagtgcggctacgagctgttcagcagcagaagcaagtacgcccacagcagcccctggcccgccttcaccgagaccatccacgccgacagcgtggccaagagacccgagcacaacagaagcgaggccctgaaggtgagaggccacagaggcggcggcggcaccggcgccgccagagagagcagagagcccgtgccccccagcagcctgtgcctgccccacagcagcagaggcctggaggccagcatccccggcctgctgcccctgcccggcagctgccaccccagactgagcggcgagcccggcctgctggtgcagatgtgggagaccggccaggtgagctgcaccggcagcagaaccaaggtgaacctgctgtgcagaagaagcgcctgggagatcggcgtgtgggaggagacccccagcgccagccccagcaagggcctgcactgcggctgcatcatggccagaagcagccccagctgcctggtgatcttccccggcgtgctgtggcaggtgtggcagtgggtgggccccagagtgcccgagagaagaccccaggccggcgccgtgcccatcctgaacatccagcagctggccgaggtgtgcccctag

SEQ ID NO: 98313 - DNA, 2328 bp, Artificial Sequence
  Description of Artificial Sequence: Synthetic coding sequence
atggccagcgccggccacatcatcaccctgctgctgtggggctacctgctggagctgtggaccggcggccacaccgccgacaccacccaccccagactgagactgagccacaaggagctgctgaacctgaacagaaccagcatcttccacagccccttcggcttcctggacctgcacaccatgctgctggacgagtaccaggagagactgttcgtgggcggcagagacctggtgtacagcctgagcctggagagaatcagcgacggctacaaggagatccactggcccagcaccgccctgaagatggaggagtgcatcatgaagggcaaggacgccggcgagtgcgccaactacgtgagagtgctgcaccactacaacagaacccacctgctgacctgcggcaccggcgccttcgaccccgtgtgcgccttcatcagagtgggctaccacctggaggaccccctgttccacctggagagccccagaagcgagagaggcagaggcagatgccccttcgaccccagcagcagcttcatcagcaccctgatcggcagcgagctgttcgccggcctgtacagcgactactggagcagagacgccgccatcttcagaagcatgggcagactggcccacatcagaaccgagcacgacgacgagagactgctgaaggagcccaagttcgtgggcagctacatgatccccgacaacgaggacagagacgacaacaaggtgtacttcttcttcaccgagaaggccctggaggccgagaacaacgcccacgccatctacaccagagtgggcagactgtgcgtgaacgacgtgggcggccagagaatcctggtgaacaagtggagcaccttcctgaaggccagactggtgtgcagcgtgcccggcatgaacggcatcgacacctacttcgacgagctggaggacgtgttcctgctgcccaccagagaccacaagaaccccgtgatcttcggcctgttcaacaccaccagcaacatcttcagaggccacgccatctgcgtgtaccacatgagcagcatcagagccgccttcaacggcccctacgcccacaaggagggccccgagtaccactggagcgtgtacgagggcaaggtgccctaccccagacccggcagctgcgccagcaaggtgaacggcggcagatacggcaccaccaaggactaccccgacgacgccatcagattcgccagaagccaccccctgatgtaccaggccatcaagcccgcccacaagaagcccatcctggtgaagaccgacggcaagtacaacctgaagcagatcgccgtggacagagtggaggccgaggacggccagtacgacgtgctgttcatcggcaccgacaacggcatcgtgctgaaggtgatcaccatctacaaccaggagatggagagcatggaggaggtgatcctggaggagctgcagatcttcaaggaccccgtgcccatcatcagcatggagatcagcagcaagagacagcagctgtacatcggcagcgccagcgccgtggcccaggtgagattccaccactgcgacatgtacggcagcgcctgcgccgactgctgcctggccagagacccctactgcgcctgggacggcatcagctgcagcagatactaccccaccggcacccacgccaagagaagattcagaagacaggacgtgagacacggcaacgccgcccagcagtgcttcggccagcagttcgtgggcgacgccctggacaagaccgaggagcacctggcctacggcatcgagaacaacagcaccctgctggagtgcacccccagaagcctgcaggccaaggtgatctggttcgtgcagaagggcagagagaccagaaaggaggaggtgaagaccgacgacagagtggtgaagatggacctgggcctgctgttcctgagactgcacaagagcgacgccggcacctacttctgccagaccgtggagcacagcttcgtgcacaccgtgagaaagatcaccctggaggtggtggaggaggagaaggtggaggacatgttcaacaaggacgacgaggaggacagacaccacagaatgccctgccccgcccagagcagcatcagccagggcgccaagccctggtacaaggagttcctgcagctgatcggctacagcaacttccagagagtggaggagtactgcgagaaggtgtggtgcaccgacagaaagagaaagaagctgaagatgagccccagcaagtggaagtacgccaacccccaggagaagaagctgagaagcaagcccgagcactacagactgcccagacacaccctggacagctag

SEQ ID NO: 98314 - DNA, 2148 bp, Artificial Sequence
  Description of Artificial Sequence: Synthetic coding sequence
atgctgctggacgagtaccaggagagactgttcgtgggcggcagagacctggtgtacagcctgagcctggagagaatcagcgacggctacaaggagatccactggcccagcaccgccctgaagatggaggagtgcatcatgaagggcaaggacgccggcgagtgcgccaactacgtgagagtgctgcaccactacaacagaacccacctgctgacctgcggcaccggcgccttcgaccccgtgtgcgccttcatcagagtgggctaccacctggaggaccccctgttccacctggagagccccagaagcgagagaggcagaggcagatgccccttcgaccccagcagcagcttcatcagcaccctgatcggcagcgagctgttcgccggcctgtacagcgactactggagcagagacgccgccatcttcagaagcatgggcagactggcccacatcagaaccgagcacgacgacgagagactgctgaaggagcccaagttcgtgggcagctacatgatccccgacaacgaggacagagacgacaacaaggtgtacttcttcttcaccgagaaggccctggaggccgagaacaacgcccacgccatctacaccagagtgggcagactgtgcgtgaacgacgtgggcggccagagaatcctggtgaacaagtggagcaccttcctgaaggccagactggtgtgcagcgtgcccggcatgaacggcatcgacacctacttcgacgagctggaggacgtgttcctgctgcccaccagagaccacaagaaccccgtgatcttcggcctgttcaacaccaccagcaacatcttcagaggccacgccatctgcgtgtaccacatgagcagcatcagagccgccttcaacggcccctacgcccacaaggagggccccgagtaccactggagcgtgtacgagggcaaggtgccctaccccagacccggcagctgcgccagcaaggtgaacggcggcagatacggcaccaccaaggactaccccgacgacgccatcagattcgccagaagccaccccctgatgtaccaggccatcaagcccgcccacaagaagcccatcctggtgaagaccgacggcaagtacaacctgaagcagatcgccgtggacagagtggaggccgaggacggccagtacgacgtgctgttcatcggcaccgacaacggcatcgtgctgaaggtgatcaccatctacaaccaggagatggagagcatggaggaggtgatcctggaggagctgcagatcttcaaggaccccgtgcccatcatcagcatggagatcagcagcaagagacagcagctgtacatcggcagcgccagcgccgtggcccaggtgagattccaccactgcgacatgtacggcagcgcctgcgccgactgctgcctggccagagacccctactgcgcctgggacggcatcagctgcagcagatactaccccaccggcacccacgccaagagaagattcagaagacaggacgtgagacacggcaacgccgcccagcagtgcttcggccagcagttcgtgggcgacgccctggacaagaccgaggagcacctggcctacggcatcgagaacaacagcaccctgctggagtgcacccccagaagcctgcaggccaaggtgatctggttcgtgcagaagggcagagagaccagaaaggaggaggtgaagaccgacgacagagtggtgaagatggacctgggcctgctgttcctgagactgcacaagagcgacgccggcacctacttctgccagaccgtggagcacagcttcgtgcacaccgtgagaaagatcaccctggaggtggtggaggaggagaaggtggaggacatgttcaacaaggacgacgaggaggacagacaccacagaatgccctgccccgcccagagcagcatcagccagggcgccaagccctggtacaaggagttcctgcagctgatcggctacagcaacttccagagagtggaggagtactgcgagaaggtgtggtgcaccgacagaaagagaaagaagctgaagatgagccccagcaagtggaagtacgccaacccccaggagaagaagctgagaagcaagcccgagcactacagactgcccagacacaccctggacagctag

SEQ ID NO: 98315 - DNA, 2301 bp, Artificial Sequence
  Description of Artificial Sequence: Synthetic coding sequence
atggccagcgccggccacatcatcaccctgctgctgtggggctacctgctggagctgtggaccggcggccacaccgccgacaccacccaccccagactgagactgagccacaaggagctgctgaacctgaacagaaccagcatcttccacagccccttcggcttcctggacctgcacaccatgctgctggacgagtaccaggagagactgttcgtgggcggcagagacctggtgtacagcctgagcctggagagaatcagcgacggctacaaggagatccactggcccagcaccgccctgaagatggaggagtgcatcatgaagggcaaggacgccggcgagtgcgccaactacgtgagagtgctgcaccactacaacagaacccacctgctgacctgcggcaccggcgccttcgaccccgtgtgcgccttcatcagagtgggctaccacctggaggaccccctgttccacctggagagccccagaagcgagagaggcagaggcagatgccccttcgaccccagcagcagcttcatcagcaccctgatcggcagcgagctgttcgccggcctgtacagcgactactggagcagagacgccgccatcttcagaagcatgggcagactggcccacatcagaaccgagcacgacgacgagagactgctgaaggagcccaagttcgtgggcagctacatgatccccgacaacgaggacagagacgacaacaaggtgtacttcttcttcaccgagaaggccctggaggccgagaacaacgcccacgccatctacaccagagtgggcagactgtgcgtgaacgacgtgggcggccagagaatcctggtgaacaagtggagcaccttcctgaaggccagactggtgtgcagcgtgcccggcatgaacggcatcgacacctacttcgacgagctggaggacgtgttcctgctgcccaccagagaccacaagaaccccgtgatcttcggcctgttcaacaccaccagcaacatcttcagaggccacgccatctgcgtgtaccacatgagcagcatcagagccgccttcaacggcccctacgcccacaaggagggccccgagtaccactggagcgtgtacgagggcaaggtgccctaccccagacccggcagctgcgccagcaaggtgaacggcggcagatacggcaccaccaaggactaccccgacgacgccatcagattcgccagaagccaccccctgatgtaccaggccatcaagcccgcccacaagaagcccatcctggtgaagaccgacggcaagtacaacctgaagcagatcgccgtggacagagtggaggccgaggacggccagtacgacgtgctgttcatcggcaccgacaacggcatcgtgctgaaggtgatcaccatctacaaccaggagatggagagcatggaggaggtgatcctggaggagctgcagatcttcaaggaccccgtgcccatcatcagcatggagatcagcagcaagagacagcagctgtacatcggcagcgccagcgccgtggcccaggtgagattccaccactgcgacatgtacggcagcgcctgcgccgactgctgcctggccagagacccctactgcgcctgggacggcatcagctgcagcagatactaccccaccggcacccacgccaagagaagattcagaagacaggacgtgagacacggcaacgccgcccagcagtgcttcggccagcagttcgtgggcgacgccctggacaagaccgaggagcacctggcctacggcatcgagaacaacagcaccctgctggagtgcacccccagaagcctgcaggccaaggtgatctggttcgtgcagaagggcagagagaccagaaaggaggaggtgaagaccgacgacagagtggtgaagatggacctgggcctgctgttcctgagactgcacaagagcgacgccggcacctacttctgccagaccgtggagcacagcttcgtgcacaccgtgagaaagatcaccctggaggtggtggaggaggagaaggtggaggacatgttcaacaaggacgacgaggaggacagacaccacagaatgccctgccccgcccagagcagcatcagccagggcgccaagccctggtacaaggagttcctgcagctgatcggctacagcaacttccagagagtggaggagtactgcgagaaggtgtggtgcaccgacagaaagagaaagaagctgaagatgagccccagcaagtggaagtacgccaacccccagcactacagactgcccagacacaccctggacagctag

SEQ ID NO: 98316 - DNA, 2286 bp, Artificial Sequence
  Description of Artificial Sequence: Synthetic coding sequence
atggccctgcccgccctgggcctggacccctggagcctgctgggcctgttcctgttccagctgctgcagctgctgctgcccaccaccaccgccggcggcggcggccagggccccatgcccagagtgagatactacgccggcgacgagagaagagccctgagcttcttccaccagaagggcctgcaggacttcgacaccctgctgctgagcggcgacggcaacaccctgtacgtgggcgccagagaggccatcctggccctggacatccaggaccccggcgtgcccagactgaagaacatgatcccctggcccgccagcgacagaaagaagagcgagtgcgccttcaagaagaagagcaacgagacccagtgcttcaacttcatcagagtgctggtgagctacaacgtgacccacctgtacacctgcggcaccttcgccttcagccccgcctgcaccttcatcgagctgcaggacagctacctgctgcccatcagcgaggacaaggtgatggagggcaagggccagagccccttcgaccccgcccacaagcacaccgccgtgctggtggacggcatgctgtacagcggcaccatgaacaacttcctgggcagcgagcccatcctgatgagaaccctgggcagccagcccgtgctgaagaccgacaacttcctgagatggctgcaccacgacgccagcttcgtggccgccatccccagcacccaggtggtgtacttcttcttcgaggagaccgccagcgagttcgacttcttcgagagactgcacaccagcagagtggccagagtgtgcaagaacgacgtgggcggcgagaagctgctgcagaagaagtggaccaccttcctgaaggcccagctgctgtgcacccagcccggccagctgcccttcaacgtgatcagacacgccgtgctgctgcccgccgacagccccaccgccccccacatctacgccgtgttcaccagccagtggcaggtgggcggcaccagaagcagcgccgtgtgcgccttcagcctgctggacatcgagagagtgttcaagggcaagtacaaggagctgaacaaggagaccagcagatggaccacctacagaggccccgagaccaaccccagacccggcagctgcagcgtgggccccagcagcgacaaggccctgaccttcatgaaggaccacttcctgatggacgagcaggtggtgggcacccccctgctggtgaagagcggcgtggagtacaccagactggccgtggagaccgcccagggcctggacggccacagccacctggtgatgtacctgggcaccaccaccggcagcctgcacaaggccgtggtgagcggcgacagcagcgcccacctggtggaggagatccagctgttccccgaccccgagcccgtgagaaacctgcagctggcccccacccagggcgccgtgttcgtgggcttcagcggcggcgtgtggagagtgcccagagccaactgcagcgtgtacgagagctgcgtggactgcgtgctggccagagacccccactgcgcctgggaccccgagagcagaacctgctgcctgctgagcgcccccaacctgaacagctggaagcaggacatggagagaggcaaccccgagtgggcctgcgccagcggccccatgagcagaagcctgagaccccagagcagaccccagatcatcaaggaggtgctggccgtgcccaacagcatcctggagctgccctgcccccacctgagcgccctggccagctactactggagccacggccccgccgccgtgcccgaggccagcagcaccgtgtacaacggcagcctgctgctgatcgtgcaggacggcgtgggcggcctgtaccagtgctgggccaccgagaacggcttcagctaccccgtgatcagctactgggtggacagccaggaccagaccctggccctggaccccgagctggccggcatccccagagagcacgtgaaggtgcccctgaccagagtgagcggcggcgccgccctggccgcccagcagagctactggccccacttcgtgaccgtgaccgtgctgttcgccctggtgctgagcggcgccctgatcatcctggtggccagccccctgagagccctgagagccagaggcaaggtgcagggctgcgagaccctgagacccggcgagaaggcccccctgagcagagagcagcacctgcagagccccaaggagtgcagaaccagcgccagcgacgtggacgccgacaacaactgcctgggcaccgaggtggcctag

SEQ ID NO: 98317 - DNA, 2286 bp, Artificial Sequence; identical to SEQ ID NO: 98316
  Description of Artificial Sequence: Synthetic coding sequence

SEQ ID NO: 98318 - DNA, 2172 bp, Artificial Sequence
  Description of Artificial Sequence: Synthetic coding sequence
atgcccagagtgagatactacgccggcgacgagagaagagccctgagcttcttccaccagaagggcctgcaggacttcgacaccctgctgctgagcggcgacggcaacaccctgtacgtgggcgccagagaggccatcctggccctggacatccaggaccccggcgtgcccagactgaagaacatgatcccctggcccgccagcgacagaaagaagagcgagtgcgccttcaagaagaagagcaacgagacccagtgcttcaacttcatcagagtgctggtgagctacaacgtgacccacctgtacacctgcggcaccttcgccttcagccccgcctgcaccttcatcgagctgcaggacagctacctgctgcccatcagcgaggacaaggtgatggagggcaagggccagagccccttcgaccccgcccacaagcacaccgccgtgctggtggacggcatgctgtacagcggcaccatgaacaacttcctgggcagcgagcccatcctgatgagaaccctgggcagccagcccgtgctgaagaccgacaacttcctgagatggctgcaccacgacgccagcttcgtggccgccatccccagcacccaggtggtgtacttcttcttcgaggagaccgccagcgagttcgacttcttcgagagactgcacaccagcagagtggccagagtgtgcaagaacgacgtgggcggcgagaagctgctgcagaagaagtggaccaccttcctgaaggcccagctgctgtgcacccagcccggccagctgcccttcaacgtgatcagacacgccgtgctgctgcccgccgacagccccaccgccccccacatctacgccgtgttcaccagccagtggcaggtgggcggcaccagaagcagcgccgtgtgcgccttcagcctgctggacatcgagagagtgttcaagggcaagtacaaggagctgaacaaggagaccagcagatggaccacctacagaggccccgagaccaaccccagacccggcagctgcagcgtgggccccagcagcgacaaggccctgaccttcatgaaggaccacttcctgatggacgagcaggtggtgggcacccccctgctggtgaagagcggcgtggagtacaccagactggccgtggagaccgcccagggcctggacggccacagccacctggtgatgtacctgggcaccaccaccggcagcctgcacaaggccgtggtgagcggcgacagcagcgcccacctggtggaggagatccagctgttccccgaccccgagcccgtgagaaacctgcagctggcccccacccagggcgccgtgttcgtgggcttcagcggcggcgtgtggagagtgcccagagccaactgcagcgtgtacgagagctgcgtggactgcgtgctggccagagacccccactgcgcctgggaccccgagagcagaacctgctgcctgctgagcgcccccaacctgaacagctggaagcaggacatggagagaggcaaccccgagtgggcctgcgccagcggccccatgagcagaagcctgagaccccagagcagaccccagatcatcaaggaggtgctggccgtgcccaacagcatcctggagctgccctgcccccacctgagcgccctggccagctactactggagccacggccccgccgccgtgcccgaggccagcagcaccgtgtacaacggcagcctgctgctgatcgtgcaggacggcgtgggcggcctgtaccagtgctgggccaccgagaacggcttcagctaccccgtgatcagctactgggtggacagccaggaccagaccctggccctggaccccgagctggccggcatccccagagagcacgtgaaggtgcccctgaccagagtgagcggcggcgccgccctggccgcccagcagagctactggccccacttcgtgaccgtgaccgtgctgttcgccctggtgctgagcggcgccctgatcatcctggtggccagccccctgagagccctgagagccagaggcaaggtgcagggctgcgagaccctgagacccggcgagaaggcccccctgagcagagagcagcacctgcagagccccaaggagtgcagaaccagcgccagcgacgtggacgccgacaacaactgcctgggcaccgaggtggcctag

SEQ ID NO: 98319 - DNA, 1890 bp, Artificial Sequence
  Description of Artificial Sequence: Synthetic coding sequence
atgatcccctggcccgccagcgacagaaagaagagcgagtgcgccttcaagaagaagagcaacgaggagctgcaggacagctacctgctgcccatcagcgaggacaaggtgatggagggcaagggccagagccccttcgaccccgcccacaagcacaccgccgtgctggtggacggcatgctgtacagcggcaccatgaacaacttcctgggcagcgagcccatcctgatgagaaccctgggcagccagcccgtgctgaagaccgacaacttcctgagatggctgcaccacgacgccagcttcgtggccgccatccccagcacccaggtggtgtacttcttcttcgaggagaccgccagcgagttcgacttcttcgagagactgcacaccagcagagtggccagagtgtgcaagaacgacgtgggcggcgagaagctgctgcagaagaagtggaccaccttcctgaaggcccagctgctgtgcacccagcccggccagctgcccttcaacgtgatcagacacgccgtgctgctgcccgccgacagccccaccgccccccacatctacgccgtgttcaccagccagtggcaggtgggcggcaccagaagcagcgccgtgtgcgccttcagcctgctggacatcgagagagtgttcaagggcaagtacaaggagctgaacaaggagaccagcagatggaccacctacagaggccccgagaccaaccccagacccggcagctgcagcgtgggccccagcagcgacaaggccctgaccttcatgaaggaccacttcctgatggacgagcaggtggtgggcacccccctgctggtgaagagcggcgtggagtacaccagactggccgtggagaccgcccagggcctggacggccacagccacctggtgatgtacctgggcaccaccaccggcagcctgcacaaggccgtggtgagcggcgacagcagcgcccacctggtggaggagatccagctgttccccgaccccgagcccgtgagaaacctgcagctggcccccacccagggcgccgtgttcgtgggcttcagcggcggcgtgtggagagtgcccagagccaactgcagcgtgtacgagagctgcgtggactgcgtgctggccagagacccccactgcgcctgggaccccgagagcagaacctgctgcctgctgagcgcccccaacctgaacagctggaagcaggacatggagagaggcaaccccgagtgggcctgcgccagcggccccatgagcagaagcctgagaccccagagcagaccccagatcatcaaggaggtgctggccgtgcccaacagcatcctggagctgccctgcccccacctgagcgccctggccagctactactggagccacggccccgccgccgtgcccgaggccagcagcaccgtgtacaacggcagcctgctgctgatcgtgcaggacggcgtgggcggcctgtaccagtgctgggccaccgagaacggcttcagctaccccgtgatcagctactgggtggacagccaggaccagaccctggccctggaccccgagctggccggcatccccagagagcacgtgaaggtgcccctgaccagagtgagcggcggcgccgccctggccgcccagcagagctactggccccacttcgtgaccgtgaccgtgctgttcgccctggtgctgagcggcgccctgatcatcctggtggccagccccctgagagccctgagagccagaggcaaggtgcagggctgcgagaccctgagacccggcgagaaggcccccctgagcagagagcagcacctgcagagccccaaggagtgcagaaccagcgccagcgacgtggacgccgacaacaactgcctgggcaccgaggtggcctag

SEQ ID NO: 98320 - DNA, 2286 bp, Artificial Sequence; identical to SEQ ID NO: 98316
  Description of Artificial Sequence: Synthetic coding sequence

SEQ ID NO: 98321 - DNA, 1890 bp, Artificial Sequence; identical to SEQ ID NO: 98319
  Description of Artificial Sequence: Synthetic coding sequence

SEQ ID NO: 98322 - DNA, 663 bp, Artificial Sequence
  Description of Artificial Sequence: Synthetic coding sequence
atgatcccctggcccgccagcgacagaaagaagagcgagtgcgccttcaagaagaagagcaacgagacccagtgcttcaacttcatcagagtgctggtgagctacaacgtgacccacctgtacacctgcggcaccttcgccttcagccccgcctgcaccttcatcgagctgcaggacagctacctgctgcccatcagcgaggacaaggtgatggagggcaagggccagagccccttcgaccccgcccacaagcacaccgccgtgctggtggacggcatgctgtacagcggcaccatgaacaacttcctgggcagcgagcccatcctgatgagaaccctgggcagccagcccgtgctgaagaccgacaacttcctgagatggctgcaccacgacgccagcttcgtggccgccatccccagcacccaggtggtgtacttcttcttcgaggagaccgccagcgagttcgacttcttcgagagactgcacaccagcagagtggccagagtgtgcaagaacgacgtgggcggcgagaagctgctgcagaagaagtggaccaccttcctgaaggcccagctgctgtgcacccagcccggccagctgcccttcaacgtgatcagacacgccgtgctgctgcccgccgacagccccaccgccccccactag

SEQ ID NO: 98323 - DNA, 966 bp, Artificial Sequence
  Description of Artificial Sequence: Synthetic coding sequence
atggccctgcccgccctgggcctggacccctggagcctgctgggcctgttcctgttccagctgctgcagctgctgctgcccaccaccaccgccggcggcggcggccagggccccatgcccagagtgagatactacgccggcgacgagagaagagccctgagcttcttccaccagaagggcctgcaggacttcgacaccctgctgctgagcggcgacggcaacaccctgtacgtgggcgccagagaggccatcctggccctggacatccaggaccccggcgtgcccagactgaagaacatgatcccctggcccgccagcgacagaaagaagagcgagtgcgccttcaagaagaagagcaacgagacccagtgcttcaacttcatcagagtgctggtgagctacaacgtgacccacctgtacacctgcggcaccttcgccttcagccccgcctgcaccttcatcgagctgcaggacagctacctgctgcccatcagcgaggacaaggtgatggagggcaagggccagagccccttcgaccccgcccacaagcacaccgccgtgctggtggacggcatgctgtacagcggcaccatgaacaacttcctgggcagcgagcccatcctgatgagaaccctgggcagccagcccgtgctgaagaccgacaacttcctgagatggctgcaccacgacgccagcttcgtggccgccatccccagcacccaggtggtgtacttcttcttcgaggagaccgccagcgagttcgacttcttcgagagactgcacaccagcagagtggccagagtgtgcaagaacgacgtgggcggcgagaagctgctgcagaagaagtggaccaccttcctgaaggcccagctgctgtgcacccagcccggccagctgcccttcaacgtgatcagacacgccgtgctgctgcccgccgacagccccaccgccccccacatctactag

SEQ ID NO: 98324 - DNA, 711 bp, Artificial Sequence
  Description of Artificial Sequence: Synthetic coding sequence
atggccctgcccgccctgggcctggacccctggagcctgctgggcctgttcctgttccagctgctgcagctgctgctgcccaccaccaccgccggcggcggcggccagggccccatgcccagagtgagatactacgccggcgacgagagaagagccctgagcttcttccaccagaagggcctgcaggacttcgacaccctgctgctgagcggcgacggcaacaccctgtacgtgggcgccagagaggccatcctggccctggacatccaggaccccggcgtgcccagactgaagaacatgatcccctggcccgccagcgacagaaagaagagcgagtgcgccttcaagaagaagagcaacgaggagctgcaggacagctacctgctgcccatcagcgaggacaaggtgatggagggcaagggccagagccccttcgaccccgcccacaagcacaccgccgtgctggtggacggcatgctgtacagcggcaccatgaacaacttcctgggcagcgagcccatcctgatgagaaccctgggcagccagcccgtgctgaagaccgacaacttcctgagatggctgcaccacgacgccagcttcgtggccgccatccccagcacccaggtggtgtacttcttcttcgaggagaccgccagcgagttcgacttcttcgagagactgcacaccagcagagtggccagagtgtgctag

SEQ ID NO: 98325 - DNA, 2172 bp, Artificial Sequence; identical to SEQ ID NO: 98318
  Description of Artificial Sequence: Synthetic coding sequence

SEQ ID NO: 98326 - DNA, 3225 bp, Artificial Sequence
  Description of Artificial Sequence: Synthetic coding sequence
atgaagggcacctgcgtgatcgcctggctgttcagcagcctgggcctgtggagactggcccaccccgaggcccagggcaccacccagtgccagagaaccgagcaccccgtgatcagctacaaggagatcggcccctggctgagagagttcagagccaagaacgccgtggacttcagccagctgaccttcgaccccggccagaaggagctggtggtgggcgccagaaactacctgttcagactgcagctggaggacctgagcctgatccaggccgtggagtgggagtgcgacgaggccaccaagaaggcctgctacagcaagggcaagagcaaggaggagtgccagaactacatcagagtgctgctggtgggcggcgacagactgttcacctgcggcaccaacgccttcacccccgtgtgcaccaacagaagcctgagcaacctgaccgagatccacgaccagatcagcggcatggccagatgcccctacagcccccagcacaacagcaccgccctgctgaccgccggcggcgagctgtacgccgccaccgccatggacttccccggcagagaccccgccatctacagaagcctgggcatcctgccccccctgagaaccgcccagtacaacagcaagtggctgaacgagcccaacttcgtgagcagctacgacatcggcaacttcacctacttcttcttcagagagaacgccgtggagcacgactgcggcaagaccgtgttcagcagagccgccagagtgtgcaagaacgacatcggcggcagattcctgctggaggacacctggaccaccttcatgaaggccagactgaactgcagcagacccggcgaggtgcccttctactacaacgagctgcagagcaccttcttcctgcccgagctggacctgatctacggcatcttcaccaccaacgtgaacagcatcgccgccagcgccgtgtgcgtgttcaacctgagcgccatcgcccaggccttcagcggccccttcaagtaccaggagaacagcagaagcgcctggctgccctaccccaaccccaacccccacttccagtgcggcaccgtggaccagggcctgtacgtgaacctgaccgagagaaacctgcaggacgcccagaagttcatcctgatgcacgaggtggtgcagcccgtgaccaccgtgcccagcttcatggaggacaacagcagattcagccacgtggccgtggacgtggtgcagggcagagaggccctggtgcacatcatctacctggccaccgactacggcaccatcaagaaggtgagagtgcccctgaaccagaccagcagcagctgcctgctggaggagatcgagctgttccccgagagaagaagagagcccatcagaagcctgcagatcctgcacagccagagcgtgctgttcgtgggcctgagagagcacgtggtgaagatccccctgaagagatgccagttctacagaaccagaagcacctgcatcggcgcccaggacccctactgcggctgggacgtggtgatgaagaagtgcaccagcctggaggagagcctgagcatgacccagtgggagcagagcatcagcgcctgccccaccagaaacctgaccgtggacggccacttcggcgtgtggagcccctggaccccctgcacccacaccgacggcagcgccgtgggcagctgcctgtgcagaaccagaagctgcgacagccccgccccccagtgcggcggctggcagtgcgagggccccggcatggagatcgccaactgcagcagaaacggcggctggaccccctggaccagctggagcccctgcagcaccacctgcggcatcggcttccaggtgagacagagaagctgcagcaaccccacccccagacacggcggcagagtgtgcgtgggccagaacagagaggagagatactgcaacgagcacctgctgtgccccccccacatgttctggaccggctggggcccctgggagagatgcaccgcccagtgcggcggcggcatccaggccagaagaagaatctgcgagaacggccccgactgcgccggctgcaacgtggagtaccagagctgcaacaccaacccctgccccgagctgaagaagaccaccccctggaccccctggacccccgtgaacatcagcgacaacggcggccactacgagcagagattcagatacacctgcaaggccagactggccgaccccaacctgctggaggtgggcagacagagaatcgagatgagatactgcagcagcgacggcaccagcggctgcagcaccgacggcctgagcggcgacttcctgagagccggcagatacagcgcccacaccgtgaacggcgcctggagcgcctggaccagctggagccagtgcagcagagactgcagcagaggcatcagaaacagaaagagagtgtgcaacaaccccgagcccaagtacggcggcatgccctgcctgggccccagcctggagtaccaggagtgcaacatcctgccctgccccgtggacggcgtgtggagctgctggagcccctggaccaagtgcagcgccacctgcggcggcggccactacatgagaaccagaagctgcagcaaccccgcccccgcctacggcggcgacatctgcctgggcctgcacaccgaggaggccctgtgcaacacccagccctgccccgagagctggagcgagtggagcgactggagcgagtgcgaggccagcggcgtgcaggtgagagccagacagtgcatcctgctgttccccatgggcagccagtgcagcggcaacaccaccgagagcagaccctgcgtgttcgacagcaacttcatccccgaggtgagcgtggccagaagcagcagcgtggaggagaagagatgcggcgagttcaacatgttccacatgatcgccgtgggcctgagcagcagcatcctgggctgcctgctgaccctgctggtgtacacctactgccagagataccagcagcagagccacgacgccaccgtgatccaccccgtgagccccgcccccctgaacaccagcatcaccaaccacatcaacaagctggacaagtacgacagcgtggaggccatcaaggccttcaacaagaacaacctgatcctggaggagagaaacaagtacttcaacccccacctgaccggcaagacctacagcaacgcctacttcaccgacctgaacaactacgacgagtactag

SEQ ID NO: 98327 - DNA, 765 bp, Artificial Sequence
  Description of Artificial Sequence: Synthetic coding sequence
atgaagggcacctgcgtgatcgcctggctgttcagcagcctgggcctgtggagactggcccaccccgaggcccagggcaccacccagtgccagagaaccgagcaccccgtgatcagctacaaggagatcggcccctggctgagagagttcagagccaagaacgccgtggacttcagccagctgaccttcgaccccggccagaaggagctggtggtgggcgccagaaactacctgttcagactgcagctggaggacctgagcctgatccaggccgtggagtgggagtgcgacgaggccaccaagaaggcctgctacagcaagggcaagagcaaggaggagtgccagaactacatcagagtgctgctggtgggcggcgacagactgttcacctgcggcaccaacgccttcacccccgtgtgcaccaacagaagcctgagcaacctgaccgagatccacgaccagatcagcggcatggccagatgcccctacagcccccagcacaacagcaccgccctgctgaccgccggcggcgagctgtacgccgccaccgccatggacttccccggcagagaccccgccatctacagaagcctgggcatcctgccccccctgagaaccgcccagtacaacagcaagtggctgaacgagcccaacttcgtgagcagctacgacatcggcaacttcacctacttcttcttcagagagaacgccgtggagcacgactgcggcaagaccgtgttcagcagagccgccagagtgtgctag

SEQ ID NO: 98328 - DNA, 2001 bp, Artificial Sequence
  Description of Artificial Sequence: Synthetic coding sequence
atgaccccccccccccccggcagagccgcccccagcgcccccagagccagagtgcccggcccccccgccagactgggcctgcccctgagactgagactgctgctgctgctgtgggccgccgccgccagcgcccagggccacctgagaagcggccccagaatcttcgccgtgtggaagggccacgtgggccaggacagagtggacttcggccagaccgagccccacaccgtgctgttccacgagcccggcagcagcagcgtgtgggtgggcggcagaggcaaggtgtacctgttcgacttccccgagggcaagaacgccagcgtgagaaccgtgaacatcggcagcaccaagggcagctgcctggacaagagagactgcgagaactacatcaccctgctggagagaagaagcgagggcctgctggcctgcggcaccaacgccagacaccccagctgctggaacctggtgaacggcaccgtggtgcccctgggcgagatgagaggctacgcccccttcagccccgacgagaacagcctggtgctgttcgagggcgacgaggtgtacagcaccatcagaaagcaggagtacaacggcaagatccccagattcagaagaatcagaggcgagagcgagctgtacaccagcgacaccgtgatgcagaacccccagttcatcaaggccaccatcgtgcaccaggaccaggcctacgacgacaagatctactacttcttcagagaggacaaccccgacaagaaccccgaggcccccctgaacgtgagcagagtggcccagctgtgcagaggcgaccagggcggcgagagcagcctgagcgtgagcaagtggaacaccttcctgaaggccatgctggtgtgcagcgacgccgccaccaacaagaacttcaacagactgcaggacgtgttcctgctgcccgaccccagcggccagtggagagacaccagagtgtacggcgtgttcagcaacccctggaactacagcgccgtgtgcgtgtacagcctgggcgacatcgacaaggtgttcagaaccagcagcctgaagggctaccacagcagcctgcccaaccccagacccggcaagtgcctgcccgaccagcagcccatccccaccgagaccttccaggtggccgacagacaccccgaggtggcccagagagtggagcccatgggccccctgaagacccccctgttccacagcaagtaccactaccagaaggtggccgtgcacagaatgcaggccagccacggcgagaccttccacgtgctgtacctgaccaccgacagaggcaccatccacaaggtggtggagcccggcgagcaggagcacagcttcgccttcaacatcatggagatccagcccttcagaagagccgccgccatccagaccatgagcctggacgccgagagaagaaagctgtacgtgagcagccagtgggaggtgagccaggtgcccctggacctgtgcgaggtgtacggcggcggctgccacggctgcctgatgagcagagacccctactgcggctgggaccagggcagatgcatcagcatctacagcagcgagagaagcgtgctgcagagcatcaaccccgccgagccccacaaggagtgccccaaccccaagcccgacaaggcccccctgcagaaggtgagcctggcccccaacagcagatactacctgagctgccccatggagagcagacacgccacctacagctggagacacaaggagaacgtggagcagagctgcgagcccggccaccagagccccaactgcatcctgttcatcgagaacctgaccgcccagcagtacggccactacttctgcgaggcccaggagggcagctacttcagagaggcccagcactggcagctgctgcccgaggacggcatcatggccgagcacctgctgggccacgcctgcgccctggccgccagcctgtggctgggcgtgctgcccaccctgaccctgggcctgctggtgcactag

SEQ ID NO: 98329 - DNA, 1506 bp, Artificial Sequence
  Description of Artificial Sequence: Synthetic coding sequence
atgagaggctacgcccccttcagccccgacgagaacagcctggtgctgttcgagggcgacgaggtgtacagcaccatcagaaagcaggagtacaacggcaagatccccagattcagaagaatcagaggcgagagcgagctgtacaccagcgacaccgtgatgcagaacccccagttcatcaaggccaccatcgtgcaccaggaccaggcctacgacgacaagatctactacttcttcagagaggacaaccccgacaagaaccccgaggcccccctgaacgtgagcagagtggcccagctgtgcagaggcgaccagggcggcgagagcagcctgagcgtgagcaagtggaacaccttcctgaaggccatgctggtgtgcagcgacgccgccaccaacaagaacttcaacagactgcaggacgtgttcctgctgcccgaccccagcggccagtggagagacaccagagtgtacggcgtgttcagcaacccctggaactacagcgccgtgtgcgtgtacagcctgggcgacatcgacaaggtgttcagaaccagcagcctgaagggctaccacagcagcctgcccaaccccagacccggcaagtgcctgcccgaccagcagcccatccccaccgagaccttccaggtggccgacagacaccccgaggtggcccagagagtggagcccatgggccccctgaagacccccctgttccacagcaagtaccactaccagaaggtggccgtgcacagaatgcaggccagccacggcgagaccttccacgtgctgtacctgaccaccgacagaggcaccatccacaaggtggtggagcccggcgagcaggagcacagcttcgccttcaacatcatggagatccagcccttcagaagagccgccgccatccagaccatgagcctggacgccgagagaagaaagctgtacgtgagcagccagtgggaggtgagccaggtgcccctggacctgtgcgaggtgtacggcggcggctgccacggctgcctgatgagcagagacccctactgcggctgggaccagggcagatgcatcagcatctacagcagcgagagaagcgtgctgcagagcatcaaccccgccgagccccacaaggagtgccccaaccccaagcccgacaaggcccccctgcagaaggtgagcctggcccccaacagcagatactacctgagctgccccatggagagcagacacgccacctacagctggagacacaaggagaacgtggagcagagctgcgagcccggccaccagagccccaactgcatcctgttcatcgagaacctgaccgcccagcagtacggccactacttctgcgaggcccaggagggcagctacttcagagaggcccagcactggcagctgctgcccgaggacggcatcatggccgagcacctgctgggccacgcctgcgccctggccgccagcctgtggctgggcgtgctgcccaccctgaccctgggcctgctggtgcactag

SEQ ID NO: 98330 - DNA, 1959 bp, Artificial Sequence
  Description of Artificial Sequence: Synthetic coding sequence
atgaccccccccccccccggcagagccgcccccagcgcccccagagccagagtgcccggcccccccgccagactgggcctgcccctgagactgagactgctgctgctgctgtgggccgccgccgccagcgcccagggccacctgagaagcggccccagaatcttcgccgtgtggaagggccacgtgggccaggacagagtggacttcggccagaccgagccccacaccgtgctgttccacgagcccggcagcagcagcgtgtgggtgggcggcagaggcaaggtgtacctgttcgacttccccgagggcaagaacgccagcgtgagaaccgactgcgagaactacatcaccctgctggagagaagaagcgagggcctgctggcctgcggcaccaacgccagacaccccagctgctggaacctggtgaacggcaccgtggtgcccctgggcgagatgagaggctacgcccccttcagccccgacgagaacagcctggtgctgttcgagggcgacgaggtgtacagcaccatcagaaagcaggagtacaacggcaagatccccagattcagaagaatcagaggcgagagcgagctgtacaccagcgacaccgtgatgcagaacccccagttcatcaaggccaccatcgtgcaccaggaccaggcctacgacgacaagatctactacttcttcagagaggacaaccccgacaagaaccccgaggcccccctgaacgtgagcagagtggcccagctgtgcagaggcgaccagggcggcgagagcagcctgagcgtgagcaagtggaacaccttcctgaaggccatgctggtgtgcagcgacgccgccaccaacaagaacttcaacagactgcaggacgtgttcctgctgcccgaccccagcggccagtggagagacaccagagtgtacggcgtgttcagcaacccctggaactacagcgccgtgtgcgtgtacagcctgggcgacatcgacaaggtgttcagaaccagcagcctgaagggctaccacagcagcctgcccaaccccagacccggcaagtgcctgcccgaccagcagcccatccccaccgagaccttccaggtggccgacagacaccccgaggtggcccagagagtggagcccatgggccccctgaagacccccctgttccacagcaagtaccactaccagaaggtggccgtgcacagaatgcaggccagccacggcgagaccttccacgtgctgtacctgaccaccgacagaggcaccatccacaaggtggtggagcccggcgagcaggagcacagcttcgccttcaacatcatggagatccagcccttcagaagagccgccgccatccagaccatgagcctggacgccgagagaagaaagctgtacgtgagcagccagtgggaggtgagccaggtgcccctggacctgtgcgaggtgtacggcggcggctgccacggctgcctgatgagcagagacccctactgcggctgggaccagggcagatgcatcagcatctacagcagcgagagaagcgtgctgcagagcatcaaccccgccgagccccacaaggagtgccccaaccccaagcccgacaaggcccccctgcagaaggtgagcctggcccccaacagcagatactacctgagctgccccatggagagcagacacgccacctacagctggagacacaaggagaacgtggagcagagctgcgagcccggccaccagagccccaactgcatcctgttcatcgagaacctgaccgcccagcagtacggccactacttctgcgaggcccaggagggcagctacttcagagaggcccagcactggcagctgctgcccgaggacggcatcatggccgagcacctgctgggccacgcctgcgccctggccgccagcctgtggctgggcgtgctgcccaccctgaccctgggcctgctggtgcactag

SEQ ID NO: 98331 - DNA, 1209 bp, Artificial Sequence
  Description of Artificial Sequence: Synthetic coding sequence
atgaagcccaacatcatcttcgtgctgagcctgctgctgatcctggagaagcaggccgccgtgatgggccagaagggcggcagcaagggcagactgcccagcgagttcagccagttcccccacggccagaagggccagcactacagcggccagaagggcaagcagcagaccgagagcaagggcagcttcagcatccagtacacctaccacgtggacgccaacgaccacgaccagagcagaaagagccagcagtacgacctgaacgccctgcacaagaccaccaagagccagagacacctgggcggcagccagcagctgctgcacaacaagcaggagggcagagaccacgacaagagcaagggccacttccacagagtggtgatccaccacaagggcggcaaggcccacagaggcacccagaaccccagccaggaccagggcaacagccccagcggcaagggcatcagcagccagtacagcaacaccgaggagagactgtgggtgcacggcctgagcaaggagcagaccagcgtgagcggcgcccagaagggcagaaagcagggcggcagccagagcagctacgtgctgcagaccgaggagctggtggccaacaagcagcagagagagaccaagaacagccaccagaacaagggccactaccagaacgtggtggaggtgagagaggagcacagcagcaaggtgcagaccagcctgtgccccgcccaccaggacaagctgcagcacggcagcaaggacatcttcagcacccaggacgagctgctggtgtacaacaagaaccagcaccagaccaagaacctgaaccaggaccagcagcacggcagaaaggccaacaagatcagctaccagagcagcagcaccgaggagagaagactgcactacggcgagaacggcgtgcagaaggacgtgagccagagaagcatctacagccagaccgagaagctggtggccggcaagagccagatccaggcccccaaccccaagcaggagccctggcacggcgagaacgccaagggcgagagcggccagagcaccaacagagagcaggacctgctgagccacgagcagaagggcagacaccagcacggcagccacggcggcctggacatcgtgatcatcgagcaggaggacgacagcgacagacacctggcccagcacctgaacaacgacagaaaccccctgttcacctag

SEQ ID NO: 98332 - DNA, 1389 bp, Artificial Sequence
  Description of Artificial Sequence: Synthetic coding sequence
atgaagcccaacatcatcttcgtgctgagcctgctgctgatcctggagaagcaggccgccgtgatgggccagaagggcggcagcaagggcagactgcccagcgagttcagccagttcccccacggccagaagggccagcactacagcggccagaagggcaagcagcagaccgagagcaagggcagcttcagcatccagtacacctaccacgtggacgccaacgaccacgaccagagcagaaagagccagcagtacgacctgaacgccctgcacaagaccaccaagagccagagacacctgggcggcagccagcagctgctgcacaacaagcaggagggcagagaccacgacaagagcaagggccacttccacagagtggtgatccaccacaagggcggcaaggcccacagaggcacccagaaccccagccaggaccagggcaacagccccagcggcaagggcatcagcagccagtacagcaacaccgaggagagactgtgggtgcacggcctgagcaaggagcagaccagcgtgagcggcgcccagaagggcagaaagcagggcggcagccagagcagctacgtgctgcagaccgaggagctggtggccaacaagcagcagagagagaccaagaacagccaccagaacaagggccactaccagaacgtggtggaggtgagagaggagcacagcagcaaggtgcagaccagcctgtgccccgcccaccaggacaagctgcagcacggcagcaaggacatcttcagcacccaggacgagctgctggtgtacaacaagaaccagcaccagaccaagaacctgaaccaggaccagcagcacggcagaaaggccaacaagatcagctaccagagcagcagcaccgaggagagaagactgcactacggcgagaacggcgtgcagaaggacgtgagccagagcagcatctacagccagaccgaggagaaggcccagggcaagagccagaagcagatcaccatccccagccaggagcaggagcacagccagaaggccaacaagatcagctaccagagcagcagcaccgaggagagaagactgcactacggcgagaacggcgtgcagaaggacgtgagccagagaagcatctacagccagaccgagaagctggtggccggcaagagccagatccaggcccccaaccccaagcaggagccctggcacggcgagaacgccaagggcgagagcggccagagcaccaacagagagcaggacctgctgagccacgagcagaagggcagacaccagcacggcagccacggcggcctggacatcgtgatcatcgagcaggaggacgacagcgacagacacctggcccagcacctgaacaacgacagaaaccccctgttcacctag

SEQ ID NO: 98333 - DNA, 1749 bp, Artificial Sequence
  Description of Artificial Sequence: Synthetic coding sequence
atgaagagcatcatcctgttcgtgctgagcctgctgctgatcctggagaagcaggccgccgtgatgggccagaagggcggcagcaagggccagctgcccagcggcagcagccagttcccccacggccagaagggccagcactacttcggccagaaggaccagcagcacaccaagagcaagggcagcttcagcatccagcacacctaccacgtggacatcaacgaccacgactggaccagaaagagccagcagtacgacctgaacgccctgcacaaggccaccaagagcaagcagcacctgggcggcagccagcagctgctgaactacaagcaggagggcagagaccacgacaagagcaagggccacttccacatgatcgtgatccaccacaagggcggccaggcccaccacggcacccagaaccccagccaggaccagggcaacagccccagcggcaagggcctgagcagccagtgcagcaacaccgagaagagactgtgggtgcacggcctgagcaaggagcaggccagcgccagcggcgcccagaagggcagaacccagggcggcagccagagcagctacgtgctgcagaccgaggagctggtggtgaacaagcagcagagagagaccaagaacagccaccagaacaagggccactaccagaacgtggtggacgtgagagaggagcacagcagcaagctgcagaccagcctgcaccccgcccaccaggacagactgcagcacggccccaaggacatcttcaccacccaggacgagctgctggtgtacaacaagaaccagcaccagaccaagaacctgagccaggaccaggagcacggcagaaaggcccacaagatcagctaccccagcagcagaaccgaggagagacagctgcaccacggcgagaagagcgtgcagaaggacgtgagcaagggcagcatcagcatccagaccgaggagaagatccacggcaagagccagaaccaggtgaccatccacagccaggaccaggagcacggccacaaggagaacaagatcagctaccagagcagcagcaccgaggagagacacctgaactgcggcgagaagggcatccagaagggcgtgagcaagggcagcatcagcatccagaccgaggagcagatccacggcaagagccagaaccaggtgagaatccccagccaggcccaggagtacggccacaaggagaacaagatcagctaccagagcagcagcaccgaggagagaagactgaacagcggcgagaaggacgtgcagaagggcgtgagcaagggcagcatcagcatccagaccgaggagaagatccacggcaagagccagaaccaggtgaccatccccagccaggaccaggagcacggccacaaggagaacaagatgagctaccagagcagcagcaccgaggagagaagactgaactacggcggcaagagcacccagaaggacgtgagccagagcagcatcagcttccagatcgagaagctggtggagggcaagagccagatccagacccccaaccccaaccaggaccagtggagcggccagaacgccaagggcaagagcggccagagcgccgacagcaagcaggacctgctgagccacgagcagaagggcagatacaagcaggagagcagcgagagccacaacatcgtgatcaccgagcacgaggtggcccaggacgaccacctgacccagcagtacaacgaggacagaaaccccatcagcacctag

SEQ ID NO: 98334 - DNA, 447 bp, Artificial Sequence
  Description of Artificial Sequence: Synthetic coding sequence
atggccgagagcgactgggacaccgtgaccgtgctgagaaagaagggccccaccgccgcccaggccaagagcaagcaggccatcctggccgcccagagaagaggcgaggacgtggagaccagcaagaagtgggccgccggccagaacaagcagcacagcatcaccaagaacaccgccaagctggacagagagaccgaggagctgcaccacgacagagtgaccctggaggtgggcaaggtgatccagcagggcagacagagcaagggcctgacccagaaggacctggccaccaagatcaacgagaagccccaggtgatcgccgactacgagagcggcagagccatccccaacaaccaggtgctgggcaagatcgagagagccatcggcctgaagctgagaggcaaggacatcggcaagcccatcgagaagggccccagagccaagtag

SEQ ID NO: 98335 - DNA, 8121 bp, Artificial Sequence
  Description of Artificial Sequence: Synthetic coding sequence
atgagcacctgctgctggtgcacccccggcggcgccagcaccatcgacttcctgaagagatacgccagcaacacccccagcggcgagttccagaccgccgacgaggacctgtgctactgcctggagtgcgtggccgagtaccacaaggccagagacgagctgcccttcctgcacgaggtgctgtgggagctggagaccctgagactgatcaaccacttcgagaagagcatgaaggccgagatcggcgacgacgacgagctgtacatcgtggacaacaacggcgagatgcccctgttcgacatcaccggccaggacttcgagaacaagctgagagtgcccctgctggagatcctgaagtacccctacctgctgctgcacgagagagtgaacgagctgtgcgtggaggccctgtgcagaatggagcaggccaactgcagcttccaggtgttcgacaagcaccccggcatctacctgttcctggtgcaccccaacgagatggtgagaagatgggccatcctgaccgccagaaacctgggcaaggtggacagagacgactactacgacctgcaggaggtgctgctgtgcctgttcaaggtgatcgagctgggcctgctggagagccccgacatctacaccagcagcgtgctggagaagggcaagctgatcctgctgcccagccacatgtacgacaccaccaactacaagagctactggctgggcatctgcatgctgctgaccatcctggaggagcaggccatggacagcctgctgctgggcagcgacaagcagaacgacttcatgcagagcatcctgcacaccatggagagagaggccgacgacgacagcgtggaccccttctggcccgccctgcactgcttcatggtgatcctggacagactgggcagcaaggtgtggggccagctgatggaccccatcgtggccttccagaccatcatcaacaacgccagctacaacagagagatcagacacatcagaaacagcagcgtgagaaccaagctggagcccgagagctacctggacgacatggtgacctgcagccagatcgtgtacaactacaaccccgagaagaccaagaaggacagcggctggagaaccgccatctgccccgactactgccccaacatgtacgaggagatggagaccctggccagcgtgctgcagagcgacatcggccaggacatgagagtgcacaacagcaccttcctgtggttcatccccttcgtgcagagcctgatggacctgaaggacctgggcgtggcctacatcgcccaggtggtgaaccacctgtacagcgaggtgaaggaggtgctgaaccagaccgacgccgtgtgcgacaaggtgaccgagttcttcctgctgatcctggtgagcgtgatcgagctgcacagaaacaagaagtgcctgcacctgctgtgggtgagcagccagcagtgggtggaggccgtggtgaagtgcgccaagctgcccaccaccgccttcaccagaagcagcgagaagagcagcggcaactgcagcaagggcaccgccatgatcagcagcctgagcctgcacagcatgcccagcaacagcgtgcagctggcctacgtgcagctgatcagaagcctgctgaaggagggctaccagctgggccagcagagcctgtgcaagagattctgggacaagctgaacctgttcctgagaggcaacctgagcctgggctggcagctgaccagccaggagacccacgagctgcagagctgcctgaagcagatcatcagaaacatcaagttcaaggcccccccctgcaacaccttcgtggacctgaccagcgcctgcaagatcagccccgccagctacaacaaggaggagagcgagcagatgggcaagaccagcagaaaggacatgcactgcctggaggccagcagccccaccttcagcaaggagcccatgaaggtgcaggacagcgtgctgatcaaggccgacaacaccatcgagggcgacaacaacgagcagaactacatcaaggacgtgaagctggaggaccacctgctggccggcagctgcctgaagcagagcagcaagaacatcttcaccgagagagccgaggaccagatcaagatcagcaccagaaagcagaagagcgtgaaggagatcagcagctacacccccaaggactgcaccagcagaaacggccccgagagaggctgcgacagaggcatcatcgtgagcaccagactgctgaccgacagcagcaccgacgccctggagaaggtgagcaccagcaacgaggacttcagcctgaaggacgacgccctggccaagaccagcaagagaaagaccaaggtgcagaaggacgagatctgcgccaagctgagccacgtgatcaagaagcagcacagaaagagcaccctggtggacaacaccatcaacctggacgagaacctgaccgtgagcaacatcgagagcttctacagcagaaaggacaccggcgtgcagaagggcgacggcttcatccacaacctgagcctggaccccagcggcgtgctggacgacaagaacggcgagcagaagagccagaacaacgtgctgcccaaggagaagcagctgaagaacgaggagctggtgatcttcagcttccacgagaacaactgcaagatccaggagttccacgtggacggcaaggagctgatccccttcaccgagatgaccaacgccagcgagaagaagagcagccccttcaaggacctgatgaccgtgcccgagagcagagacgaggagatgagcaacagcaccagcgtgatctacagcaacctgaccagagagcaggcccccgacatcagccccaagagcgacaccctgaccgacagccagatcgacagagacctgcacaagctgagcctgctggcccaggccagcgtgatcaccttccccagcgacagcccccagaacagcagccagctgcagagaaaggtgaaggaggacaagagatgcttcaccgccaaccagaacaacgtgggcgacaccagcagaggccaggtgatcatcatcagcgacagcgacgacgacgacgacgagagaatcctgagcctggagaagctgaccaagcaggacaagatctgcctggagagagagcaccccgagcagcacgtgagcaccgtgaacagcaaggaggagaagaaccccgtgaaggaggagaagaccgagaccctgttccagttcgaggagagcgacagccagtgcttcgagttcgagagcagcagcgaggtgttcagcgtgtggcaggaccaccccgacgacaacaacagcgtgcaggacggcgagaagaagtgcctggcccccatcgccaacaccaccaacggccagggctgcaccgactacgtgagcgaggtggtgaagaagggcgccgagggcatcgaggagcacaccagacccagaagcatcagcgtggaggagttctgcgagatcgaggtgaagaagcccaagagaaagagaagcgagaagcccatggccgaggaccccgtgagacccagcagcagcgtgagaaacgagggccagagcgacaccaacaagagagacctggtgggcaacgacttcaagagcatcgacagaagaaccagcacccccaacagcagaatccagagagccaccaccgtgagccagaagaagagcagcaagctgtgcacctgcaccgagcccatcagaaaggtgcccgtgagcaagacccccaagaagacccacagcgacgccaagaagggccagaacagaagcagcaactacctgagctgcagaaccacccccgccatcgtgccccccaagaagttcagacagtgccccgagcccaccagcaccgccgagaagctgggcctgaagaagggccccagaaaggcctacgagctgagccagagaagcctggactacgtggcccagctgagagaccacggcaagaccgtgggcgtggtggacaccagaaagaagaccaagctgatcagcccccagaacctgagcgtgagaaacaacaagaagctgctgaccagccaggagctgcagatgcagagacagatcagacccaagagccagaagaacagaagaagactgagcgactgcgagagcaccgacgtgaagagagccggcagccacaccgcccagaacagcgacatcttcgtgcccgagagcgacagaagcgactacaactgcaccggcggcaccgaggtgctggccaacagcaacagaaagcagctgatcaagtgcatgcccagcgagcccgagaccatcaaggccaagcacggcagccccgccaccgacgacgcctgccccctgaaccagtgcgacagcgtggtgctgaacggcaccgtgcccaccaacgaggtgatcgtgagcaccagcgaggaccccctgggcggcggcgaccccaccgccagacacatcgagatggccgccctgaaggagggcgagcccgacagcagcagcgacgccgaggaggacaacctgttcctgacccagaacgaccccgaggacatggacctgtgcagccagatggagaacgacaactacaagctgatcgagctgatccacggcaaggacaccgtggaggtggaggaggacagcgtgagcagaccccagctggagagcctgagcggcaccaagtgcaagtacaaggactgcctggagaccaccaagaaccagggcgagtactgccccaagcacagcgaggtgaaggccgccgacgaggacgtgttcagaaagcccggcctgcccccccccgccagcaagcccctgagacccaccaccaagatcttcagcagcaagagcaccagcagaatcgccggcctgagcaagagcctggagaccagcagcgccctgagccccagcctgaagaacaagagcaagggcatccagagcatcctgaaggtgccccagcccgtgcccctgatcgcccagaagcccgtgggcgagatgaagaacagctgcaacgtgctgcacccccagagccccaacaacagcaacagacagggctgcaaggtgcccttcggcgagagcaagtacttccccagcagcagccccgtgaacatcctgctgagcagccagagcgtgagcgacaccttcgtgaaggaggtgctgaagtggaagtacgagatgttcctgaacttcggccagtgcggcccccccgccagcctgtgccagagcatcagcagacccgtgcccgtgagattccacaactacggcgactacttcaacgtgttcttccccctgatggtgctgaacaccttcgagaccgtggcccaggagtggctgaacagccccaacagagagaacttctaccagctgcaggtgagaaagttccccgccgactacatcaagtactgggagttcgccgtgtacctggaggagtgcgagctggccaagcagctgtaccccaaggagaacgacctggtgttcctggcccccgagagaatcaacgaggagaagaaggacaccgagagaaacgacatccaggacctgcacgagtaccacagcggctacgtgcacaagttcagaagaaccagcgtgatgagaaacggcaagaccgagtgctacctgagcatccagacccaggagaacttccccgccaacctgaacgagctggtgaactgcatcgtgatcagcagcctggtgaccacccagagaaagctgaaggccatgagcctgctgggcagcagaaaccagctggccagagccgtgctgaaccccaaccccatggacttctgcaccaaggacctgctgaccaccaccagcgagagaatcatcgcctacctgagagacttcaacgaggaccagaagaaggccatcgagaccgcctacgccatggtgaagcacagccccagcgtggccaagatctgcctgatccacggcccccccggcaccggcaagagcaagaccatcgtgggcctgctgtacagactgctgaccgagaaccagagaaagggccacagcgacgagaacagcaacgccaagatcaagcagaacagagtgctggtgtgcgcccccagcaacgccgccgtggacgagctgatgaagaagatcatcctggagttcaaggagaagtgcaaggacaagaagaaccccctgggcaactgcggcgacatcaacctggtgagactgggccccgagaagagcatcaacagcgaggtgctgaagttcagcctggacagccaggtgaaccacagaatgaagaaggagctgcccagccacgtgcaggccatgcacaagagaaaggagttcctggactaccagctggacgagctgagcagacagagagccctgtgcagaggcggcagagagatccagagacaggagctggacgagaacatcagcaaggtgagcaaggagagacaggagctggccagcaagatcaaggaggtgcagggcagaccccagaagacccagagcatcatcatcctggagagccacatcatctgctgcaccctgagcaccagcggcggcctgctgctggagagcgccttcagaggccagggcggcgtgcccttcagctgcgtgatcgtggacgaggccggccagagctgcgagatcgagaccctgacccccctgatccacagatgcaacaagctgatcctggtgggcgaccccaagcagctgccccccaccgtgatcagcatgaaggcccaggagtacggctacgaccagagcatgatggccagattctgcagactgctggaggagaacgtggagcacaacatgatcagcagactgcccatcctgcagctgaccgtgcagtacagaatgcaccccgacatctgcctgttccccagcaactacgtgtacaacagaaacctgaagaccaacagacagaccgaggccatcagatgcagcagcgactggcccttccagccctacctggtgttcgacgtgggcgacggcagcgagagaagagacaacgacagctacatcaacgtgcaggagatcaagctggtgatggagatcatcaagctgatcaaggacaagagaaaggacgtgagcttcagaaacatcggcatcatcacccactacaaggcccagaagaccatgatccagaaggacctggacaaggagttcgacagaaagggccccgccgaggtggacaccgtggacgccttccagggcagacagaaggactgcgtgatcgtgacctgcgtgagagccaacagcatccagggcagcatcggcttcctggccagcctgcagagactgaacgtgaccatcaccagagccaagtacagcctgttcatcctgggccacctgagaaccctgatgcagctgctgcccagaagcttctgcgtgcacgtgaaccacagccccttcttcagccccgagcccaagtacctgcactgggccctgaaggagaaccagcactggaaccagctgatccaggacgcccagaagagaggcgccatcatcaagacctgcgacaagaactacagacacgacgccgtgaagatcctgaagctgaagcccgtgctgcagagaagcctgacccacccccccaccatcgcccccgagggcagcagaccccagggcggcctgcccagcagcaagctggacagcggcttcgccaagaccagcgtggccgccagcctgtaccacacccccagcgacagcaaggagatcaccctgaccgtgaccagcaaggaccccgagagaccccccgtgcacgaccagctgcaggaccccagactgctgaagagaatgggcatcgaggtgaagggcggcatcttcctgtgggacccccagcccagcagcccccagcaccccggcgccaccccccccaccggcgagcccggcttccccgtggtgcaccaggacctgagccacatccagcagcccgccgccgtggtggccgccctgagcagccacaagccccccgtgagaggcgagccccccgccgccagccccgaggccagcacctgccagagcaagtgcgacgaccccgaggaggagctgtgccacagaagagaggccagagccttcagcgagggcgagcaggagaagtgcggcagcgagacccaccacaccagaagaaacagcagatgggacaagagaaccctggagcaggaggacagcagcagcaagaagagaaagctgctgtag

SEQ ID NO: 98336 - DNA, 7935 bp, Artificial Sequence
  Description of Artificial Sequence: Synthetic coding sequence
atgagcacctgctgctggtgcacccccggcggcgccagcaccatcgacttcctgaagagatacgccagcaacacccccagcggcgagttccagaccgccgacgaggacctgtgctactgcctggagtgcgtggccgagtaccacaaggccagagacgagctgcccttcctgcacgaggtgctgtgggagctggagaccctgagactgatcaaccacttcgagaagagcatgaaggccgagatcggcgacgacgacgagctgtacatcgtggacaacaacggcgagatgcccctgttcgacatcaccggccaggacttcgagaacaagctgagagtgcccctgctggagatcctgaagtacccctacctgctgctgcacgagagagtgaacgagctgtgcgtggaggccctgtgcagaatggagcaggccaactgcagcttccaggtgttcgacaagcaccccggcatctacctgttcctggtgcaccccaacgagatggtgagaagatgggccatcctgaccgccagaaacctgggcaaggtggacagagacgactactacgacctgcaggaggtgctgctgtgcctgttcaaggtgatcgagctgggcctgctggagagccccgacatctacaccagcagcgtgctggagaagggcaagctgatcctgctgcccagccacatgtacgacaccaccaactacaagagctactggctgggcatctgcatgctgctgaccatcctggaggagcaggccatggacagcctgctgctgggcagcgacaagcagaacgacttcatgcagagcatcctgcacaccatggagagagaggccgacgacgacagcgtggaccccttctggcccgccctgcactgcttcatggtgatcctggacagactgggcagcaaggtgtggggccagctgatggaccccatcgtggccttccagaccatcatcaacaacgccagctacaacagagagatcagacacatcagaaacagcagcgtgagaaccaagctggagcccgagagctacctggacgacatggtgacctgcagccagatcgtgtacaactacaaccccgagaagaccaagaaggacagcggctggagaaccgccatctgccccgactactgccccaacatgtacgaggagatggagaccctggccagcgtgctgcagagcgacatcggccaggacatgagagtgcacaacagcaccttcctgtggttcatccccttcgtgcagagcctgatggacctgaaggacctgggcgtggcctacatcgcccaggtggtgaaccacctgtacagcgaggtgaaggaggtgctgaaccagaccgacgccgtgtgcgacaaggtgaccgagttcttcctgctgatcctggtgagcgtgatcgagctgcacagaaacaagaagtgcctgcacctgctgtgggtgagcagccagcagtgggtggaggccgtggtgaagtgcgccaagctgcccaccaccgccttcaccagaagcagcgagaagagcagcggcaactgcagcaagggcaccgccatgatcagcagcctgagcctgcacagcatgcccagcaacagcgtgcagctggcctacgtgcagctgatcagaagcctgctgaaggagggctaccagctgggccagcagagcctgtgcaagagattctgggacaagctgaacctgttcctgagaggcaacctgagcctgggctggcagctgaccagccaggagacccacgagctgcagagctgcctgaagcagatcatcagaaacatcaagttcaaggcccccccctgcaacaccttcgtggacctgaccagcgcctgcaagatcagccccgccagctacaacaaggaggagagcgagcagatgggcaagaccagcagaaaggacatgcactgcctggaggccagcagccccaccttcagcaaggagcccatgaaggtgcaggacagcgtgctgatcaaggccgacaacaccatcgagggcgacaacaacgagcagaactacatcaaggacgtgaagctggaggaccacctgctggccggcagctgcctgaagcagagcagcaagaacatcttcaccgagagagccgaggaccagatcaagatcagcaccagaaagcagaagagcgtgaaggagatcagcagctacacccccaaggactgcaccagcagaaacggccccgagagaggctgcgacagaggcatcatcgtgagcaccagactgctgaccgacagcagcaccgacgccctggagaaggtgagcaccagcaacgaggacttcagcctgaaggacgacgccctggccaagaccagcaagagaaagaccaaggtgcagaaggacgagatctgcgccaagctgagccacgtgatcaagaagcagcacagaaagagcaccctggtggacaacaccatcaacctggacgagaacctgaccgtgagcaacatcgagagcttctacagcagaaaggacaccggcgtgcagaagggcgacggcttcatccacaacctgagcctggaccccagcggcgtgctggacgacaagaacggcgagcagaagagccagaacaacgtgctgcccaaggagaagcagctgaagaacgaggagctggtgatcttcagcttccacgagaacaactgcaagatccaggagttccacgtggacggcaaggagctgatccccttcaccgagatgaccaacgccagcgagaagaagagcagccccttcaaggacctgatgaccgtgcccgagagcagagacgaggagatgagcaacagcaccagcgtgatctacagcaacctgaccagagagcaggcccccgacatcagccccaagagcgacaccctgaccgacagccagatcgacagagacctgcacaagctgagcctgctggcccaggccagcgtgatcaccttccccagcgacagcccccagaacagcagccagctgcagagaaaggtgaaggaggacaagagatgcttcaccgccaaccagaacaacgtgggcgacaccagcagaggccaggtgatcatcatcagcgacagcgacgacgacgacgacgagagaatcctgagcctggagaagctgaccaagcaggacaagatctgcctggagagagagcaccccgagcagcacgtgagcaccgtgaacagcaaggaggagaagaaccccgtgaaggaggagaagaccgagaccctgttccagttcgaggagagcgacagccagtgcttcgagttcgagagcagcagcgaggtgttcagcgtgtggcaggaccaccccgacgacaacaacagcgtgcaggacggcgagaagaagtgcctggcccccatcgccaacaccaccaacggccagggctgcaccgactacgtgagcgaggtggtgaagaagggcgccgagggcatcgaggagcacaccagacccagaagcatcagcgtggaggagttctgcgagatcgaggtgaagaagcccaagagaaagagaagcgagaagcccatggccgaggaccccgtgagacccagcagcagcgtgagaaacgagggccagagcgacaccaacaagagagacctggtgggcaacgacttcaagagcatcgacagaagaaccagcacccccaacagcagaatccagagagccaccaccgtgagccagaagaagagcagcaagctgtgcacctgcaccgagcccatcagaaaggtgcccgtgagcaagacccccaagaagacccacagcgacgccaagaagggccagaacagaagcagcaactacctgagctgcagaaccacccccgccatcgtgccccccaagaagttcagacagtgccccgagcccaccagcaccgccgagaagctgggcctgaagaagggccccagaaaggcctacgagctgagccagagaagcctggactacgtggcccagctgagagaccacggcaagaccgtgggcgtggtggacaccagaaagaagaccaagctgatcagcccccagaacctgagcgtgagaaacaacaagaagctgctgaccagccaggagctgcagatgcagagacagatcagacccaagagccagaagaacagaagaagactgagcgactgcgagagcaccgacgtgaagagagccggcagccacaccgcccagaacagcgacatcttcgtgcccgagagcgacagaagcgactacaactgcaccggcggcaccgaggtgctggccaacagcaacagaaagcagctgatcaagtgcatgcccagcgagcccgagaccatcaaggccaagcacggcagccccgccaccgacgacgcctgccccctgaaccagtgcgacagcgtggtgctgaacggcaccgtgcccaccaacgaggtgatcgtgagcaccagcgaggaccccctgggcggcggcgaccccaccgccagacacatcgagatggccgccctgaaggagggcgagcccgacagcagcagcgacgccgaggaggacaacctgttcctgacccagaacgaccccgaggacatggacctgtgcagccagatggagaacgacaactacaagctgatcgagctgatccacggcaaggacaccgtggaggtggaggaggacagcgtgagcagaccccagctggagagcctgagcggcaccaagtgcaagtacaaggactgcctggagaccaccaagaaccagggcgagtactgccccaagcacagcgaggtgaaggccgccgacgaggacgtgttcagaaagcccggcctgcccccccccgccagcaagcccctgagacccaccaccaagatcttcagcagcaagagcaccagcagaatcgccggcctgagcaagagcctggagaccagcagcgccctgagccccagcctgaagaacaagagcaagggcatccagagcatcctgaaggtgccccagcccgtgcccctgatcgcccagaagcccgtgggcgagatgaagaacagctgcaacgtgctgcacccccagagccccaacaacagcaacagacagggctgcaaggtgcccttcggcgagagcaagtacttccccagcagcagccccgtgaacatcctgctgagcagccagagcgtgagcgacaccttcgtgaaggaggtgctgaagtggaagtacgagatgttcctgaacttcggccagtgcggcccccccgccagcctgtgccagagcatcagcagacccgtgcccgtgagattccacaactacggcgactacttcaacgtgttcttccccctgatggtgctgaacaccttcgagaccgtggcccaggagtggctgaacagccccaacagagagaacttctaccagctgcaggtgagaaagttccccgccgactacatcaagtactgggagttcgccgtgtacctggaggagtgcgagctggccaagcagctgtaccccaaggagaacgacctggtgttcctggcccccgagagaatcaacgaggagaagaaggacaccgagagaaacgacatccaggacctgcacgagtaccacagcggctacgtgcacaagttcagaagaaccagcgtgatgagaaacggcaagaccgagtgctacctgagcatccagacccaggagaacttccccgccaacctgaacgagctggtgaactgcatcgtgatcagcagcctggtgaccacccagagaaagctgaaggccatgagcctgctgggcagcagaaaccagctggccagagccgtgctgaaccccaaccccatggacttctgcaccaaggacctgctgaccaccaccagcgagagaatcatcgcctacctgagagacttcaacgaggaccagaagaaggccatcgagaccgcctacgccatggtgaagcacagccccagcgtggccaagatctgcctgatccacggcccccccggcaccggcaagagcaagaccatcgtgggcctgctgtacagactgctgaccgagaaccagagaaagggccacagcgacgagaacagcaacgccaagatcaagcagaacagagtgctggtgtgcgcccccagcaacgccgccgtggacgagctgatgaagaagatcatcctggagttcaaggagaagtgcaaggacaagaagaaccccctgggcaactgcggcgacatcaacctggtgagactgggccccgagaagagcatcaacagcgaggtgctgaagttcagcctggacagccaggtgaaccacagaatgaagaaggagctgcccagccacgtgcaggccatgcacaagagaaaggagttcctggactaccagctggacgagctgagcagacagagagccctgtgcagaggcggcagagagatccagagacaggagctggacgagaacatcagcaaggtgagcaaggagagacaggagctggccagcaagatcaaggaggtgcagggcagaccccagaagacccagagcatcatcatcctggagagccacatcatctgctgcaccctgagcaccagcggcggcctgctgctggagagcgccttcagaggccagggcggcgtgcccttcagctgcgtgatcgtggacgaggccggccagagctgcgagatcgagaccctgacccccctgatccacagatgcaacaagctgatcctggtgggcgaccccaagcagctgccccccaccgtgatcagcatgaaggcccaggagtacggctacgaccagagcatgatggccagattctgcagactgctggaggagaacgtggagcacaacatgatcagcagactgcccatcctgcagctgaccgtgcagtacagaatgcaccccgacatctgcctgttccccagcaactacgtgtacaacagaaacctgaagaccaacagacagaccgaggccatcagatgcagcagcgactggcccttccagccctacctggtgttcgacgtgggcgacggcagcgagagaagagacaacgacagctacatcaacgtgcaggagatcaagctggtgatggagatcatcaagctgatcaaggacaagagaaaggacgtgagcttcagaaacatcggcatcatcacccactacaaggcccagaagaccatgatccagaaggacctggacaaggagttcgacagaaagggcttcctggccagcctgcagagactgaacgtgaccatcaccagagccaagtacagcctgttcatcctgggccacctgagaaccctgatggagaaccagcactggaaccagctgatccaggacgcccagaagagaggcgccatcatcaagacctgcgacaagaactacagacacgacgccgtgaagatcctgaagctgaagcccgtgctgcagagaagcctgacccacccccccaccatcgcccccgagggcagcagaccccagggcggcctgcccagcagcaagctggacagcggcttcgccaagaccagcgtggccgccagcctgtaccacacccccagcgacagcaaggagatcaccctgaccgtgaccagcaaggaccccgagagaccccccgtgcacgaccagctgcaggaccccagactgctgaagagaatgggcatcgaggtgaagggcggcatcttcctgtgggacccccagcccagcagcccccagcaccccggcgccaccccccccaccggcgagcccggcttccccgtggtgcaccaggacctgagccacatccagcagcccgccgccgtggtggccgccctgagcagccacaagccccccgtgagaggcgagccccccgccgccagccccgaggccagcacctgccagagcaagtgcgacgaccccgaggaggagctgtgccacagaagagaggccagagccttcagcgagggcgagcaggagaagtgcggcagcgagacccaccacaccagaagaaacagcagatgggacaagagaaccctggagcaggaggacagcagcagcaagaagagaaagctgctgtag

SEQ ID NO: 98337 - DNA, 2847 bp, Artificial Sequence
  Description of Artificial Sequence: Synthetic coding sequence
gtggcccaggagtggctgaacagccccaacagagagaacttctaccagctgcaggtgagaaagttccccgccgactacatcaagtactgggagttcgccgtgtacctggaggagtgcgagctggccaagcagctgtaccccaaggagaacgacctggtgttcctggcccccgagagaatcaacgaggagaagaaggacaccgagagaaacgacatccaggacctgcacgagtaccacagcggctacgtgcacaagttcagaagaaccagcgtgatgagaaacggcaagaccgagtgctacctgagcatccagacccaggagaacttccccgccaacctgaacgagctggtgaactgcatcgtgatcagcagcctggtgaccacccagagaaagctgaaggccatgagcctgctgggcagcagaaaccagctggccagagccgtgctgaaccccaaccccatggacttctgcaccaaggacctgctgaccaccaccagcgagagaatcatcgcctacctgagagacttcaacgaggaccagaagaaggccatcgagaccgcctacgccatggtgaagcacagccccagcgtggccaagatctgcctgatccacggcccccccggcaccggcaagagcaagaccatcgtgggcctgctgtacagactgctgaccgagaaccagagaaagggccacagcgacgagaacagcaacgccaagatcaagcagaacagagtgctggtgtgcgcccccagcaacgccgccgtggacgagctgatgaagaagatcatcctggagttcaaggagaagtgcaaggacaagaagaaccccctgggcaactgcggcgacatcaacctggtgagactgggccccgagaagagcatcaacagcgaggtgctgaagttcagcctggacagccaggtgaaccacagaatgaagaaggagctgcccagccacgtgcaggccatgcacaagagaaaggagttcctggactaccagctggacgagctgagcagacagagagccctgtgcagaggcggcagagagatccagagacaggagctggacgagaacatcagcaaggtgagcaaggagagacaggagctggccagcaagatcaaggaggtgcagggcagaccccagaagacccagagcatcatcatcctggagagccacatcatctgctgcaccctgagcaccagcggcggcctgctgctggagagcgccttcagaggccagggcggcgtgcccttcagctgcgtgatcgtggacgaggccggccagagctgcgagatcgagaccctgacccccctgatccacagatgcaacaagctgatcctggtgggcgaccccaagcagctgccccccaccgtgatcagcatgaaggcccaggagtacggctacgaccagagcatgatggccagattctgcagactgctggaggagaacgtggagcacaacatgatcagcagactgcccatcctgcagctgaccgtgcagtacagaatgcaccccgacatctgcctgttccccagcaactacgtgtacaacagaaacctgaagaccaacagacagaccgaggccatcagatgcagcagcgactggcccttccagccctacctggtgttcgacgtgggcgacggcagcgagagaagagacaacgacagctacatcaacgtgcaggagatcaagctggtgatggagatcatcaagctgatcaaggacaagagaaaggacgtgagcttcagaaacatcggcatcatcacccactacaaggcccagaagaccatgatccagaaggacctggacaaggagttcgacagaaagggccccgccgaggtggacaccgtggacgccttccagggcagacagaaggactgcgtgatcgtgacctgcgtgagagccaacagcatccagggcagcatcggcttcctggccagcctgcagagactgaacgtgaccatcaccagagccaagtacagcctgttcatcctgggccacctgagaaccctgatgcagctgctgcccagaagcttctgcgtgcacgtgaaccacagccccttcttcagccccgagcccaagtacctgcactgggccctgaaggagaaccagcactggaaccagctgatccaggacgcccagaagagaggcgccatcatcaagacctgcgacaagaactacagacacgacgccgtgaagatcctgaagctgaagcccgtgctgcagagaagcctgacccacccccccaccatcgcccccgagggcagcagaccccagggcggcctgcccagcagcaagctggacagcggcttcgccaagaccagcgtggccgccagcctgtaccacacccccagcgacagcaaggagatcaccctgaccgtgaccagcaaggaccccgagagaccccccgtgcacgaccagctgcaggaccccagactgctgaagagaatgggcatcgaggtgaagggcggcatcttcctgtgggacccccagcccagcagcccccagcaccccggcgccaccccccccaccggcgagcccggcttccccgtggtgcaccaggacctgagccacatccagcagcccgccgccgtggtggccgccctgagcagccacaagccccccgtgagaggcgagccccccgccgccagccccgaggccagcacctgccagagcaagtgcgacgaccccgaggaggagctgtgccacagaagagaggccagagccttcagcgagggcgagcaggagaagtgcggcagcgagacccaccacaccagaagaaacagcagatgggacaagagaaccctggagcaggaggacagcagcagcaagaagagaaagctgctgtag

SEQ ID NO: 98338 - DNA, 1269 bp, Artificial Sequence
  Description of Artificial Sequence: Synthetic coding sequence
atgagcaccagctacggctgcttctggagaagattcatccacggcatcggcagaagcggcgacatcagcgccgtgcagcccaaggccgccggcagcagcctgctgaacaagatcaccaacagcctggtgctggacatcatcaagctggccggcgtgcacaccgtggccaactgcttcgtggtgcccatggccaccggcatgagcctgaccctgtgcttcctgaccctgagacacaagagacccaaggccaagtacatcatctggcccagaatcgaccagaagagctgcttcaagagcatgatcaccgccggcttcgagcccgtggtgatcgagaacgtgctggagggcgacgagctgagaaccgacctgaaggccgtggaggccaaggtgcaggagctgggccccgactgcatcctgtgcatccacagcaccaccagctgcttcgcccccagagtgcccgacagactggaggagctggccgtgatctgcgccaactacgacatcccccacatcgtgaacaacgcctacggcgtgcagagcagcaagtgcatgcacctgatccagcagggcgccagagtgggcagaatcgacgccttcgtgcagagcctggacaagaacttcatggtgcccgtgggcggcgccatcatcgccggcttcaacgacagcttcatccaggagatcagcaagatgtaccccggcagagccagcgccagccccagcctggacgtgctgatcaccctgctgagcctgggcagcaacggctacaagaagctgctgaaggagagaaaggagatgttcagctacctgagcaaccagatcaagaagctgagcgaggcctacaacgagagactgctgcacaccccccacaaccccatcagcctggccatgaccctgaagaccctggacgagcacagagacaaggccgtgacccagctgggcagcatgctgttcaccagacaggtgagcggcgccagagtggtgcccctgggcagcatgcagaccgtgagcggctacaccttcagaggcttcatgagccacaccaacaactacccctgcgcctacctgaacgccgccagcgccatcggcatgaagatgcaggacgtggacctgttcatcaagagactggacagatgcctgaaggccgtgagaaaggagagaagcaaggagagcgacgacaactacgacaagaccgaggacgtggacatcgaggagatggccctgaagctggacaacgtgctgctggacacctaccaggacgccagcagctag

SEQ ID NO: 98339 - DNA, 1506 bp, Artificial Sequence
  Description of Artificial Sequence: Synthetic coding sequence
atgaacagagagagcttcgccgccggcgagagactggtgagccccgcctacgtgagacagggctgcgaggccagaagaagccacgagcacctgatcagactgctgctggagaagggcaagtgccccgagaacggctgggacgagagcaccctggagctgttcctgcacgagctggccatcatggacagcaacaacttcctgggcaactgcggcgtgggcgagagagagggcagagtggccagcgccctggtggccagaagacactacagattcatccacggcatcggcagaagcggcgacatcagcgccgtgcagcccaaggccgccggcagcagcctgctgaacaagatcaccaacagcctggtgctggacatcatcaagctggccggcgtgcacaccgtggccaactgcttcgtggtgcccatggccaccggcatgagcctgaccctgtgcttcctgaccctgagacacaagagacccaaggccaagtacatcatctggcccagaatcgaccagaagagctgcttcaagagcatgatcaccgccggcttcgagcccgtggtgatcgagaacgtgctggagggcgacgagctgagaaccgacctgaaggccgtggaggccaaggtgcaggagctgggccccgactgcatcctgtgcatccacagcaccaccagctgcttcgcccccagagtgcccgacagactggaggagctggccgtgatctgcgccaactacgacatcccccacatcgtgaacaacgcctacggcgtgcagagcagcaagtgcatgcacctgatccagcagggcgccagagtgggcagaatcgacgccttcgtgcagagcctggacaagaacttcatggtgcccgtgggcggcgccatcatcgccggcttcaacgacagcttcatccaggagatcagcaagatgtaccccggcagagccagcgccagccccagcctggacgtgctgatcaccctgctgagcctgggcagcaacggctacaagaagctgctgaaggagagaaaggagatgttcagctacctgagcaaccagatcaagaagctgagcgaggcctacaacgagagactgctgcacaccccccacaaccccatcagcctggccatgaccctgaagaccctggacgagcacagagacaaggccgtgacccagctgggcagcatgctgttcaccagacaggtgagcggcgccagagtggtgcccctgggcagcatgcagaccgtgagcggctacaccttcagaggcttcatgagccacaccaacaactacccctgcgcctacctgaacgccgccagcgccatcggcatgaagatgcaggacgtggacctgttcatcaagagactggacagatgcctgaaggccgtgagaaaggagagaagcaaggagagcgacgacaactacgacaagaccgaggacgtggacatcgaggagatggccctgaagctggacaacgtgctgctggacacctaccaggacgccagcagctag

SEQ ID NO: 98340 - DNA, 903 bp, Artificial Sequence
  Description of Artificial Sequence: Synthetic coding sequence
atggagggcgtgctgtacaagtggaccaactacctgaccggctggcagcccagatggttcgtgctggacaacggcatcctgagctactacgacagccaggacgacgtgtgcaagggcagcaagggcagcatcaagatggccgtgtgcgagatcaaggtgcacagcgccgacaacaccagaatggagctgatcatccccggcgagcagcacttctacatgaaggccgtgaacgccgccgagagacagagatggctggtggccctgggcagcagcaaggcctgcctgaccgacaccagaaccaagaaggagaaggagatcagcgagaccagcgagagcctgaagaccaagatgagcgagctgagactgtactgcgacctgctgatgcagcaggtgcacaccatccaggagttcgtgcaccacgacgagaaccacagcagccccagcgccgagaacatgaacgaggccagcagcctgctgagcgccacctgcaacaccttcatcaccaccctggaggagtgcgtgaagatcgccaacgccaagttcaagcccgagatgttccagctgcaccaccccgaccccctggtgagccccgtgagccccagccccgtgcagatgatgaagagaagcgtgagccaccccggcagctgcagcagcgagagaagcagccacagcatcaaggagcccgtgagcaccctgcacagactgagccagagaagaagaagaacctacagcgacaccgacagctgcagcgacatccccctggaggaccccgacagacccgtgcactgcagcaagaacaccctgaacggcgacctggccagcgccaccatccccgaggagagcagactgatggccaagaagcagagcgagagcgaggacaccctgcccagcttcagcagctag

SEQ ID NO: 98341 - DNA, 1104 bp, Artificial Sequence
  Description of Artificial Sequence: Synthetic coding sequence
atggacaaggagtacgtgggcttcgccgccctgcccaaccagctgcacagaaagagcgtgaagaagggcttcgacttcaccctgatggtggccggcgagagcggcctgggcaagagcaccctgatcaacagcctgttcctgaccaacctgtacgaggacagacaggtgcccgaggccagcgccagactgacccagaccctggccatcgagagaagaggcgtggagatcgaggagggcggcgtgaaggtgaagctgaccctggtggacacccccggcttcggcgacagcgtggactgcagcgactgctggctgcccgtggtgaagttcatcgaggagcagttcgagcagtacctgagagacgagagcggcctgaacagaaagaacatccaggacagcagagtgcactgctgcctgtacttcatcagccccttcggcagaggcctgagacccctggacgtggccttcctgagagccgtgcacgagaaggtgaacatcatccccgtgatcggcaaggccgacgccctgatgccccaggagacccaggccctgaagcagaagatcagagaccagctgaaggaggaggagatccacatctaccagttccccgagtgcgacagcgacgaggacgaggacttcaagagacaggacgccgagatgaaggagagcatccccttcgccgtggtgggcagctgcgaggtggtgagagacggcggcaacagacccgtgagaggcagaagatacagctggggcaccgtggaggtggagaacccccaccactgcgacttcctgaacctgagaagaatgctggtgcagacccacctgcaggacctgaaggaggtgacccacgacctgctgtacgagggctacagagccagatgcctgcagagcctggccagacccggcgccagagacagagccagcagaagcaagctgagcagacagagcgccaccgagatccccctgcccatgctgcccctggccgacaccgagaagctgatcagagagaaggacgaggagctgagaagaatgcaggagatgctggagaagatgcaggcccagatgcagcagagccaggcccagggcgagcagagcgacgccctgtag

SEQ ID NO: 98342 - DNA, 1104 bp, Artificial Sequence; identical to SEQ ID NO: 98341
  Description of Artificial Sequence: Synthetic coding sequence

SEQ ID NO: 98343 - DNA, 966 bp, Artificial Sequence
  Description of Artificial Sequence: Synthetic coding sequence
atgatgaacagatactaccagcccatcgtggactacatcgacgcccagttcgaggcctacctgcaggaggagctgaagatcaagagaagcctgttcacctaccacgacagcagaatccacgtgtgcctgtacttcatcagccccaccggccacagcctgaagaccctggacctgctgaccatgaagaacctggacagcaaggtgaacatcatccccgtgatcgccaaggccgacaccgtgagcaagaccgagctgcagaagttcaagatcaagctgatgagcgagctggtgagcaacggcgtgcagatctaccagttccccaccgacgacgacaccatcgccaaggtgaacgccgccatgaacggccagctgcccttcgccgtggtgggcagcatggacgaggtgaaggtgggcaacaagatggtgaaggccagacagtacccctggggcgtggtgcaggtggagaacgagaaccactgcgacttcgtgaagctgagagagatgctgatctgcaccaacatggaggacctgagagagcagacccacaccagacactacgagctgtacagaagatgcaagctggaggagatgggcttcaccgacgtgggccccgagaacaagcccgtgagcgtgcaggagacctacgaggccaagagacacgagttccacggcgagagacagagaaaggaggaggagatgaagcagatgttcgtgcagagagtgaaggagaaggaggccatcctgaaggaggccgagagagagctgcaggccaagttcgagcacctgaagagactgcaccaggaggagagaatgaagctggaggagaagagaagactgctggaggaggagatcatcgccttcagcaagaagaaggccaccagcgagatcttccacagccagagcttcctggccaccggcagcaacctgagaaaggacaaggacagaaagaacagcaacttcctgtag

SEQ ID NO: 98344 - DNA, 954 bp, Artificial Sequence
  Description of Artificial Sequence: Synthetic coding sequence
atgagcggccacgtgggcttcgagagcctgcccgaccagctggtgaacagaagcatccagcagggcttctgcttcaacatcctgtgcgtgggcgagaccggcatcggcaagagcaccctgatcgacaccctgttcaacaccaacttcgaggactacgagagcagccacttctgccccaacgtgaagctgaaggcccagacctacgagctgcaggagagcaacgtgcagctgaagctgaccatcgtgaacaccgtgggcttcggcgaccagatcaacaaggaggagagctaccagcccatcgtggactacatcgacgcccagttcgaggcctacctgcaggaggagctgaagatcaagagaagcctgttcacctaccacgacagcagaatccacgtgtgcctgtacttcatcagccccaccggccacagcctgaagaccctggacctgctgaccatgaagaacctggacagcaaggtgaacatcatccccgtgatcgccaaggccgacaccgtgagcaagaccgagctgcagaagttcaagatcaagctgatgagcgagctggtgagcaacggcgtgcagatctaccagttccccaccgacgacgacaccatcgccaaggtgaacgccgccatgaacggccagctgcccttcgccgtggtgggcagcatggacgaggtgaaggtgggcaacaagatggtgaaggccagacagtacccctggggcgtggtgcaggtggagaacgagaaccactgcgacttcgtgaagctgagagagatgctgatctgcaccaacatggaggacctgagagagcagacccacaccagacactacgagctgtacagaagatgcaagctggaggagatgggcttcaccgacgtgggccccgagaacaagcccgtgagctacagacccaacctgagcaccctgagagacttcaccaagaagagagagtag

SEQ ID NO: 98345 - DNA, 1635 bp, Artificial Sequence
  Description of Artificial Sequence: Synthetic coding sequence
atggccagcagcgaggtggccagacacctgctgttccagagccacatggccaccaagaccacctgcatgagcagccagggcagcgacgacgagcagatcaagagagagaacatcagaagcctgaccatgagcggccacgtgggcttcgagagcctgcccgaccagctggtgaacagaagcatccagcagggcttctgcttcaacatcctgtgcgtgggcgagaccggcatcggcaagagcaccctgatcgacaccctgttcaacaccaacttcgaggactacgagagcagccacttctgccccaacgtgaagctgaaggcccagacctacgagctgcaggagagcaacgtgcagctgaagctgaccatcgtgaacaccgtgggcttcggcgaccagatcaacaaggaggagagctaccagcccatcgtggactacatcgacgcccagttcgaggcctacctgcaggaggagctgaagatcaagagaagcctgttcacctaccacgacagcagaatccacgtgtgcctgtacttcatcagccccaccggccacagcctgaagaccctggacctgctgaccatgaagaacctggacagcaaggtgaacatcatccccgtgatcgccaaggccgacaccgtgagcaagaccgagctgcagaagttcaagatcaagctgatgagcgagctggtgagcaacggcgtgcagatctaccagttccccaccgacgacgacaccatcgccaaggtgaacgccgccatgaacggccagctgcccttcgccgtggtgggcagcatggacgaggtgaaggtgggcaacaagatggtgaaggccagacagtacccctggggcgtggtgcaggtggagaacgagaaccactgcgacttcgtgaagctgagagagatgctgatctgcaccaacatggaggacctgagagagcagacccacaccagacactacgagctgtacagaagatgcaagctggaggagatgggcttcaccgacgtgggccccgagaacaagcccgtgagcgtgcaggagacctacgaggccaagagacacgagttccacggcgagagacagagaaaggaggaggagatgaagcagatgttcgtgcagagagtgaaggagaaggaggccatcctgaaggaggccgagagagagctgcaggccaagttcgagcacctgaagagactgcaccaggaggagagaatgaagctggaggagaagagaagactgctggaggaggagatcatcgccttcagcaagaagaaggccaccagcgagatcttccacagccagagcttcctggccaccggcagcaacctgagaaaggacaaggacagaaagaaggagcccggctgcagattcgagctgctgtgcatcgacgtgagagcctgcgagaccaacggcggcagaaaggacgccgagaaggcccccatcttctgcaagaccgaggtgcccgagcacagaagaagcagcagccaggccaacttcatcaagaagaagctggaggtgtgcttcgacttcgccgtgatctgcttcatcaccagcatcttcggcgagcagccccagctgctgatcttcatggagaagtacttccaggtgcagggccagtacatcagccagagcgagtag

SEQ ID NO: 98346 - DNA, 1365 bp, Artificial Sequence
  Description of Artificial Sequence: Synthetic coding sequence
atggccagcagcgaggtggccagacacctgctgttccagagccacatggccaccaagaccacctgcatgagcagccagggcagcgacgacgagcagatcaagagagagaacatcagaagcctgaccatgagcggccacgtgggcttcgagagcctgcccgaccagctggtgaacagaagcatccagcagggcttctgcttcaacatcctgtgcgtgggcgagaccggcatcggcaagagcaccctgatcgacaccctgttcaacaccaacttcgaggactacgagagcagccacttctgccccaacgtgaagctgaaggcccagacctacgagctgcaggagagcaacgtgcagctgaagctgaccatcgtgaacaccgtgggcttcggcgaccagatcaacaaggaggagagctaccagcccatcgtggactacatcgacgcccagttcgaggcctacctgcaggaggagctgaagatcaagagaagcctgttcacctaccacgacagcagaatccacgtgtgcctgtacttcatcagccccaccggccacagcctgaagaccctggacctgctgaccatgaagaacctggacagcaaggtgaacatcatccccgtgatcgccaaggccgacaccgtgagcaagaccgagctgcagaagttcaagatcaagctgatgagcgagctggtgagcaacggcgtgcagatctaccagttccccaccgacgacgacaccatcgccaaggtgaacgccgccatgaacggccagctgcccttcgccgtggtgggcagcatggacgaggtgaaggtgggcaacaagatggtgaaggccagacagtacccctggggcgtggtgcaggtggagaacgagaaccactgcgacttcgtgaagctgagagagatgctgatctgcaccaacatggaggacctgagagagcagacccacaccagacactacgagctgtacagaagatgcaagctggaggagatgggcttcaccgacgtgggccccgagaacaagcccgtgagcgtgcaggagacctacgaggccaagagacacgagttccacggcgagagacagagaaaggaggaggagatgaagcagatgttcgtgcagagagtgaaggagaaggaggccatcctgaaggaggccgagagagagctgcaggccaagttcgagcacctgaagagactgcaccaggaggagagaatgaagctggaggagaagagaagactgctggaggaggagatcatcgccttcagcaagaagaaggccaccagcgagatcttccacagccagagcttcctggccaccggcagcaacctgagaaaggacaaggacagaaagaacagcaacttcctgtag

SEQ ID NO: 98347 - DNA, 1296 bp, Artificial Sequence
  Description of Artificial Sequence: Synthetic coding sequence
atggccagcagcgaggtggccagacacctgaagagagagaacatcagaagcctgaccatgagcggccacgtgggcttcgagagcctgcccgaccagctggtgaacagaagcatccagcagggcttctgcttcaacatcctgtgcgtgggcgagaccggcatcggcaagagcaccctgatcgacaccctgttcaacaccaacttcgaggactacgagagcagccacttctgccccaacgtgaagctgaaggcccagacctacgagctgcaggagagcaacgtgcagctgaagctgaccatcgtgaacaccgtgggcttcggcgaccagatcaacaaggaggagagctaccagcccatcgtggactacatcgacgcccagttcgaggcctacctgcaggaggagctgaagatcaagagaagcctgttcacctaccacgacagcagaatccacgtgtgcctgtacttcatcagccccaccggccacagcctgaagaccctggacctgctgaccatgaagaacctggacagcaaggtgaacatcatccccgtgatcgccaaggccgacaccgtgagcaagaccgagctgcagaagttcaagatcaagctgatgagcgagctggtgagcaacggcgtgcagatctaccagttccccaccgacgacgacaccatcgccaaggtgaacgccgccatgaacggccagctgcccttcgccgtggtgggcagcatggacgaggtgaaggtgggcaacaagatggtgaaggccagacagtacccctggggcgtggtgcaggtggagaacgagaaccactgcgacttcgtgaagctgagagagatgctgatctgcaccaacatggaggacctgagagagcagacccacaccagacactacgagctgtacagaagatgcaagctggaggagatgggcttcaccgacgtgggccccgagaacaagcccgtgagcgtgcaggagacctacgaggccaagagacacgagttccacggcgagagacagagaaaggaggaggagatgaagcagatgttcgtgcagagagtgaaggagaaggaggccatcctgaaggaggccgagagagagctgcaggccaagttcgagcacctgaagagactgcaccaggaggagagaatgaagctggaggagaagagaagactgctggaggaggagatcatcgccttcagcaagaagaaggccaccagcgagatcttccacagccagagcttcctggccaccggcagcaacctgagaaaggacaaggacagaaagaacagcaacttcctgtag

SEQ ID NO: 98348 - DNA, 1353 bp, Artificial Sequence
  Description of Artificial Sequence: Synthetic coding sequence
atggccagcagcgaggtggccagacacctgctgttccagagccacatggccaccaagaccacctgcatgagcagccagggcagcgacgacgagcagatcaagagagagaacatcagaagcctgaccatgagcggccacgtgggcttcgagagcctgcccgaccagctggtgaacagaagcatccagcagggcttctgcttcaacatcctgtgcgtgggcgagaccggcatcggcaagagcaccctgatcgacaccctgttcaacaccaacttcgaggactacgagagcagccacttctgccccaacgtgaagctgaaggcccagacctacgagctgcaggagagcaacgtgcagctgaagctgaccatcgtgaacaccgtgggcttcggcgaccagatcaacaaggaggagagctaccagcccatcgtggactacatcgacgcccagttcgaggcctacctgcaggaggagctgaagatcaagagaagcctgttcacctaccacgacagcagaatccacgtgtgcctgtacttcatcagccccaccggccacagcctgaagaccctggacctgctgaccatgaagaacctggacagcaaggtgaacatcatccccgtgatcgccaaggccgacaccgtgagcaagaccgagctgcagaagttcaagatcaagctgatgagcgagctggtgagcaacggcgtgcagatctaccagttccccaccgacgacgacaccatcgccaaggtgaacgccgccatgaacggccagctgcccttcgccgtggtgggcagcatggacgaggtgaaggtgggcaacaagatggtgaaggccagacagtacccctggggcgtggtgcaggtggagaacgagaaccactgcgacttcgtgaagctgagagagatgctgatctgcaccaacatggaggacctgagagagcagacccacaccagacactacgagctgtacagaagatgcaagctggaggagatgggcttcaccgacgtgggccccgagaacaagcccgtgagcgtgcaggagacctacgaggccaagagacacgagttccacggcgagagacagagaaaggaggaggagatgaagcagatgttcgtgcagagagtgaaggagaaggaggccatcctgaaggaggccgagagagagctgcaggccaagttcgagcacctgaagagactgcaccaggaggagagaatgaagctggaggagaagagaagactgctggaggaggagatcatcgccttcagcaagaagaaggccaccagcgagatcttccacagccagagcttcctggccaccggcagcaacctgagaaaggacaaggacagaaagaagtag

SEQ ID NO: 98349 - DNA, 1422 bp, Artificial Sequence
  Description of Artificial Sequence: Synthetic coding sequence
atggccaccaagaccacctgcatgagcagccagggcagcgacgacgagcagatcaagagagagaacatcagaagcctgaccatgagcggccacgtgggcttcgagagcctgcccgaccagctggtgaacagaagcatccagcagggcttctgcttcaacatcctgtgcgtgggcgagaccggcatcggcaagagcaccctgatcgacaccctgttcaacaccaacttcgaggactacgagagcagccacttctgccccaacgtgaagctgaaggcccagacctacgagctgcaggagagcaacgtgcagctgaagctgaccatcgtgaacaccgtgggcttcggcgaccagatcaacaaggaggagagctaccagcccatcgtggactacatcgacgcccagttcgaggcctacctgcaggaggagctgaagatcaagagaagcctgttcacctaccacgacagcagaatccacgtgtgcctgtacttcatcagccccaccggccacagcctgaagaccctggacctgctgaccatgaagaacctggacagcaaggtgaacatcatccccgtgatcgccaaggccgacaccgtgagcaagaccgagctgcagaagttcaagatcaagctgatgagcgagctggtgagcaacggcgtgcagatctaccagttccccaccgacgacgacaccatcgccaaggtgaacgccgccatgaacggccagctgcccttcgccgtggtgggcagcatggacgaggtgaaggtgggcaacaagatggtgaaggccagacagtacccctggggcgtggtgcaggtggagaacgagaaccactgcgacttcgtgaagctgagagagatgctgatctgcaccaacatggaggacctgagagagcagacccacaccagacactacgagctgtacagaagatgcaagctggaggagatgggcttcaccgacgtgggccccgagaacaagcccgtgagcgtgcaggagacctacgaggccaagagacacgagttccacggcgagagacagagaaaggaggaggagatgaagcagatgttcgtgcagagagtgaaggagaaggaggccatcctgaaggaggccgagagagagctgcaggccaagttcgagcacctgaagagactgcaccaggaggagagaatgaagctggaggagaagagaagactgctggaggaggagatcatcgccttcagcaagaagaaggccaccagcgagatcttccacagccagagcttcctggccaccggcagcaacctgagaaaggacaaggacagaaagaaggagcccggctgcagattcgagctgctgtgcatcgacgtgagagcctgcgagaccaacggcggcagaaaggacgccgagaagggcagagagggccacagcgccagaggccagccctag

SEQ ID NO: 98350 - DNA, 852 bp, Artificial Sequence
  Description of Artificial Sequence: Synthetic coding sequence
atggccagcagcgaggtggccagacacctgctgttccagagccacatggccaccaagaccacctgcatgagcagccagggcagcgacgacgagcagatcgtgaacatcatccccgtgatcgccaaggccgacaccgtgagcaagaccgagctgcagaagttcaagatcaagctgatgagcgagctggtgagcaacggcgtgcagatctaccagttccccaccgacgacgacaccatcgccaaggtgaacgccgccatgaacggccagctgcccttcgccgtggtgggcagcatggacgaggtgaaggtgggcaacaagatggtgaaggccagacagtacccctggggcgtggtgcaggtggagaacgagaaccactgcgacttcgtgaagctgagagagatgctgatctgcaccaacatggaggacctgagagagcagacccacaccagacactacgagctgtacagaagatgcaagctggaggagatgggcttcaccgacgtgggccccgagaacaagcccgtgagcgtgcaggagacctacgaggccaagagacacgagttccacggcgagagacagagaaaggaggaggagatgaagcagatgttcgtgcagagagtgaaggagaaggaggccatcctgaaggaggccgagagagagctgcaggccaagttcgagcacctgaagagactgcaccaggaggagagaatgaagctggaggagaagagaagactgctggaggaggagatcatcgccttcagcaagaagaaggccaccagcgagatcttccacagccagagcttcctggccaccggcagcaacctgagaaaggacaaggacagaaagaagtag

SEQ ID NO: 98351 - DNA, 1290 bp, Artificial Sequence
  Description of Artificial Sequence: Synthetic coding sequence
atggccgtggccgtgggcagacccagcaacgaggagctgagaaacctgagcctgagcggccacgtgggcttcgacagcctgcccgaccagctggtgaacaagagcaccagccagggcttctgcttcaacatcctgtgcgtgggcgagaccggcatcggcaagagcaccctgatggacaccctgttcaacaccaagttcgagagcgaccccgccacccacaacgagcccggcgtgagactgaaggccagaagctacgagctgcaggagagcaacgtgagactgaagctgaccatcgtggacaccgtgggcttcggcgaccagatcaacaaggacgacagctacaagcccatcgtggagtacatcgacgcccagttcgaggcctacctgcaggaggagctgaagatcaagagaagcctgttcaactaccacgacaccagaatccacgcctgcctgtacttcatcgcccccaccggccacagcctgaagagcctggacctggtgaccatgaagaagctggacagcaaggtgaacatcatccccatcatcgccaaggccgacaccatcgccaagaacgagctgcacaagttcaagagcaagatcatgagcgagctggtgagcaacggcgtgcagatctaccagttccccaccgacgaggagaccgtggccgagatcaacgccaccatgagcgtgcacctgcccttcgccgtggtgggcagcaccgaggaggtgaagatcggcaacaagatggccaaggccagacagtacccctggggcgtggtgcaggtggagaacgagaaccactgcgacttcgtgaagctgagagagatgctgatcagagtgaacatggaggacctgagagagcagacccacaccagacactacgagctgtacagaagatgcaagctggaggagatgggcttcaaggacaccgaccccgacagcaagcccttcagcctgcaggagacctacgaggccaagagaaacgagttcctgggcgagctgcagaagaaggaggaggagatgagacagatgttcgtgatgagagtgaaggagaaggaggccgagctgaaggaggccgagaaggagctgcacgagaagttcgacctgctgaagagaacccaccaggaggagaagaagaaggtggaggacaagaagaaggagctggaggaggaggtgaacaacttccagaagaagaaggccgccgcccagctgctgcagagccaggcccagcagagcggcgcccagcagaccaagaaggacaaggacaagaagaacgccagcttcacctag

SEQ ID NO: 98352 - DNA, 1278 bp, Artificial Sequence
  Description of Artificial Sequence: Synthetic coding sequence
atggccgtggccgtgggcagacccagcaacgaggagctgagaaacctgagcctgagcggccacgtgggcttcgacagcctgcccgaccagctggtgaacaagagcaccagccagggcttctgcttcaacatcctgtgcgtgggcgagaccggcatcggcaagagcaccctgatggacaccctgttcaacaccaagttcgagagcgaccccgccacccacaacgagcccggcgtgagactgaaggccagaagctacgagctgcaggagagcaacgtgagactgaagctgaccatcgtggacaccgtgggcttcggcgaccagatcaacaaggacgacagctacaagcccatcgtggagtacatcgacgcccagttcgaggcctacctgcaggaggagctgaagatcaagagaagcctgttcaactaccacgacaccagaatccacgcctgcctgtacttcatcgcccccaccggccacagcctgaagagcctggacctggtgaccatgaagaagctggacagcaaggtgaacatcatccccatcatcgccaaggccgacaccatcgccaagaacgagctgcacaagttcaagagcaagatcatgagcgagctggtgagcaacggcgtgcagatctaccagttccccaccgacgaggagaccgtggccgagatcaacgccaccatgagcgtgcacctgcccttcgccgtggtgggcagcaccgaggaggtgaagatcggcaacaagatggccaaggccagacagtacccctggggcgtggtgcaggtggagaacgagaaccactgcgacttcgtgaagctgagagagatgctgatcagagtgaacatggaggacctgagagagcagacccacaccagacactacgagctgtacagaagatgcaagctggaggagatgggcttcaaggacaccgaccccgacagcaagcccttcagcctgcaggagacctacgaggccaagagaaacgagttcctgggcgagctgcagaagaaggaggaggagatgagacagatgttcgtgatgagagtgaaggagaaggaggccgagctgaaggaggccgagaaggagctgcacgagaagttcgacctgctgaagagaacccaccaggaggagaagaagaaggtggaggacaagaagaaggagctggaggaggaggtgaacaacttccagaagaagaaggccgccgcccagctgctgcagagccaggcccagcagagcggcgcccagcagaccaagaaggacaaggacaagaagaagtag

SEQ ID NO: 98353 - DNA, 1320 bp, Artificial Sequence
  Description of Artificial Sequence: Synthetic coding sequence
atggaggagagaaagcccgcccacgtgctgagaagcttcaagtacgccgccttcatgaacgaggagctgagaaacctgagcctgagcggccacgtgggcttcgacagcctgcccgaccagctggtgaacaagagcaccagccagggcttctgcttcaacatcctgtgcgtgggcgagaccggcatcggcaagagcaccctgatggacaccctgttcaacaccaagttcgagagcgaccccgccacccacaacgagcccggcgtgagactgaaggccagaagctacgagctgcaggagagcaacgtgagactgaagctgaccatcgtggacaccgtgggcttcggcgaccagatcaacaaggacgacagctacaagcccatcgtggagtacatcgacgcccagttcgaggcctacctgcaggaggagctgaagatcaagagaagcctgttcaactaccacgacaccagaatccacgcctgcctgtacttcatcgcccccaccggccacagcctgaagagcctggacctggtgaccatgaagaagctggacagcaaggtgaacatcatccccatcatcgccaaggccgacaccatcgccaagaacgagctgcacaagttcaagagcaagatcatgagcgagctggtgagcaacggcgtgcagatctaccagttccccaccgacgaggagaccgtggccgagatcaacgccaccatgagcgtgcacctgcccttcgccgtggtgggcagcaccgaggaggtgaagatcggcaacaagatggccaaggccagacagtacccctggggcgtggtgcaggtggagaacgagaaccactgcgacttcgtgaagctgagagagatgctgatcagagtgaacatggaggacctgagagagcagacccacaccagacactacgagctgtacagaagatgcaagctggaggagatgggcttcaaggacaccgaccccgacagcaagcccttcagcctgcaggagacctacgaggccaagagaaacgagttcctgggcgagctgcagaagaaggaggaggagatgagacagatgttcgtgatgagagtgaaggagaaggaggccgagctgaaggaggccgagaaggagctgcacgagaagttcgacctgctgaagagaacccaccaggaggagaagaagaaggtggaggacaagaagaaggagctggaggaggaggtgaacaacttccagaagaagaaggccgccgcccagctgctgcagagccaggcccagcagagcggcgcccagcagaccaagaaggacaaggacaagaagaacgccagcttcacctag

SEQ ID NO: 98354 - DNA, 1077 bp, Artificial Sequence
  Description of Artificial Sequence: Synthetic coding sequence
atggaccccctgagaagaagccccagcccctgcctgagcagccagcccagcagccccagcacccccccctgcgagatgctgggccccgtgggcatcgaggccgtgctggaccagctgaagatcaaggccatgaagatgggcttcgagttcaacatcatggtggtgggccagagcggcctgggcaagagcaccatggtgaacaccctgttcaagagcaaggtgtggaagagcaacccccccggcctgggcgtgcccaccccccagaccctgcagctgcacagcctgacccacgtgatcgaggagaagggcgtgaagctgaagctgaccgtgaccgacacccccggcttcggcgaccagatcaacaacgacaactgctgggaccccatcctgggctacatcaacgagcagtacgagcagtacctgcaggaggagatcctgatcaccagacagagacacatccccgacaccagagtgcactgctgcgtgtacttcgtgccccccaccggccactgcctgagacccctggacatcgagttcctgcagagactgtgcagaaccgtgaacgtggtgcccgtgatcgccagagccgacagcctgaccatggaggagagagaggccttcagaagaagaatccagcagaacctgagaacccactgcatcgacgtgtacccccagatgtgcttcgacgaggacatcaacgacaagatcctgaacagcaagctgagagacagaatccccttcgccgtggtgggcgccgaccaggagcacctggtgaacggcagatgcgtgctgggcagaaagaccaagtggggcatcatcgaggtggagaacatggcccactgcgagttccccctgctgagagacctgctgatcagaagccacctgcaggacctgaaggacatcacccacaacatccactacgagaactacagagtgatcagactgaacgagagccacctgctgcccagaggccccggctgggtgaacctggcccccgccagccccggccagctgaccacccccagaaccttcaaggtgtgcagaggcgcccacgacgacagcgacgacgagttctag

SEQ ID NO: 98355 - DNA, 939 bp, Artificial Sequence
  Description of Artificial Sequence: Synthetic coding sequence
atggaccccctgagaagaagccccagcccctgcctgagcagccagcccagcagccccagcacccccccctgcgagatgctgggccccgtgggcatcgaggccgtgctggaccagctgaagatcaaggccatgaagatgggcttcgagttcaacatcatggtggtgggccagagcggcctgggcaagagcaccatggtgaacaccctgttcaagagcaaggtgtggaagagcaacccccccggcctgggcgtgcccaccccccagaccctgcagctgcacagcctgacccacgtgatcgaggagaagggcgtgaagctgaagctgaccgtgaccgacacccccggcttcggcgaccagatcaacaacgacaactgcctgagacccctggacatcgagttcctgcagagactgtgcagaaccgtgaacgtggtgcccgtgatcgccagagccgacagcctgaccatggaggagagagaggccttcagaagaagaatccagcagaacctgagaacccactgcatcgacgtgtacccccagatgtgcttcgacgaggacatcaacgacaagatcctgaacagcaagctgagagacagaatccccttcgccgtggtgggcgccgaccaggagcacctggtgaacggcagatgcgtgctgggcagaaagaccaagtggggcatcatcgaggtggagaacatggcccactgcgagttccccctgctgagagacctgctgatcagaagccacctgcaggacctgaaggacatcacccacaacatccactacgagaactacagagtgatcagactgaacgagagccacctgctgcccagaggccccggctgggtgaacctggcccccgccagccccggccagctgaccacccccagaaccttcaaggtgtgcagaggcgcccacgacgacagcgacgacgagttctag

SEQ ID NO: 98356 - DNA, 1299 bp, Artificial Sequence
  Description of Artificial Sequence: Synthetic coding sequence
atggccgagagaaccatggccatgcccacccagatccccgccgacggcgacacccagaaggagaacaacatcagatgcctgaccaccatcggccacttcggcttcgagtgcctgcccaaccagctggtgagcagaagcatcagacagggcttcaccttcaacatcctgtgcgtgggcgagaccggcatcggcaagagcaccctgatcgacaccctgttcaacaccaacctgaaggacaacaagagcagccacttctacagcaacgtgggcctgcagatccagacctacgagctgcaggagagcaacgtgcagctgaagctgaccgtggtggagaccgtgggctacggcgaccagatcgacaaggaggccagctaccagcccatcgtggactacatcgacgcccagttcgaggcctacctgcaggaggagctgaagatcaagagaagcctgttcgagtaccacgacagcagagtgcacgtgtgcctgtacttcatcagccccaccggccacagcctgaagagcctggacctgctgaccatgaagaacctggacagcaaggtgaacatcatccccctgatcgccaaggccgacaccatcagcaagaacgacctgcagaccttcaagaacaagatcatgagcgagctgatcagcaacggcatccagatctaccagctgcccaccgacgaggagaccgccgcccaggccaacagcagcgtgagcggcctgctgcccttcgccgtggtgggcagcaccgacgaggtgaaggtgggcaagagaatggtgagaggcagacactacccctggggcgtgctgcaggtggagaacgagaaccactgcgacttcgtgaagctgagagacatgctgctgtgcaccaacatggagaacctgaaggagaagacccacacccagcactacgagtgctacagataccagaagctgcagaagatgggcttcaccgacgtgggccccaacaaccagcccgtgagcttccaggagatcttcgaggccaagagacaggagttctacgaccagtgccagagagaggaggaggagctgaagcagagattcatgcagagagtgaaggagaaggaggccaccttcaaggaggccgagaaggagctgcaggacaagttcgagcacctgaagatgatccagcaggaggagatcagaaagctggaggaggagaagaagcagctggagggcgagatcatcgacttctacaagatgaaggccgccagcgaggccctgcagacccagctgagcaccgacaccaagaaggacaagcacagaaagaagtag

SEQ ID NO: 98357 - DNA, 1086 bp, Artificial Sequence
  Description of Artificial Sequence: Synthetic coding sequence
atgagcaagcagcagcccacccagttcatcaaccccgagacccccggctacgtgggcttcgccaacctgcccaaccaggtgcacagaaagagcgtgaagaagggcttcgagttcaccctgatggtggtgggcgagagcggcctgggcaagagcaccctgatcaacagcctgttcctgaccgacctgtaccccgagagagtgatccccggcgccgccgagaagatcgagagaaccgtgcagatcgaggccagcaccgtggagatcgaggagagaggcgtgaagctgagactgaccgtggtggacacccccggctacggcgacgccatcaactgcagagactgcttcaagaccatcatcagctacatcgacgagcagttcgagagatacctgcacgacgagagcggcctgaacagaagacacatcatcgacaacagagtgcactgctgcttctacttcatcagccccttcggccacggcctgaagcccctggacgtggccttcatgaaggccatccacaacaaggtgaacatcgtgcccgtgatcgccaaggccgacaccctgaccctgaaggagagagagagactgaagaagagaatcctggacgagatcgaggagcacaacatcaagatctaccacctgcccgacgccgagagcgacgaggacgaggacttcaaggagcagaccagactgctgaaggccagcatccccttcagcgtggtgggcagcaaccagctgatcgaggccaagggcaagaaggtgagaggcagactgtacccctggggcgtggtggaggtggagaaccccgagcacaacgacttcctgaagctgagaaccatgctgatcacccacatgcaggacctgcaggaggtgacccaggacctgcactacgagaacttcagaagcgagagactgaagagaggcggcagaaaggtggagaacgaggacatgaacaaggaccagatcctgctggagaaggaggccgagctgagaagaatgcaggagatgatcgccagaatgcaggcccagatgcagatgcagatgcagggcggcgacggcgacggcggcgccctgggccaccacgtgtag

SEQ ID NO: 98358 - DNA, 1086 bp, Artificial Sequence; identical to SEQ ID NO: 98357
  Description of Artificial Sequence: Synthetic coding sequence

SEQ ID NO: 98359 - DNA, 1191 bp, Artificial Sequence
  Description of Artificial Sequence: Synthetic coding sequence
atgccctggatcagcgagggcagagccaccagaccctgcctgagagtgcccagcgccagaagaggcgacgagggcctgcaccagagagacgaggccagccagaagatgagcaagcagcagcccacccagttcatcaaccccgagacccccggctacgtgggcttcgccaacctgcccaaccaggtgcacagaaagagcgtgaagaagggcttcgagttcaccctgatggtggtgggcgagagcggcctgggcaagagcaccctgatcaacagcctgttcctgaccgacctgtaccccgagagagtgatccccggcgccgccgagaagatcgagagaaccgtgcagatcgaggccagcaccgtggagatcgaggagagaggcgtgaagctgagactgaccgtggtggacacccccggctacggcgacgccatcaactgcagagactgcttcaagaccatcatcagctacatcgacgagcagttcgagagatacctgcacgacgagagcggcctgaacagaagacacatcatcgacaacagagtgcactgctgcttctacttcatcagccccttcggccacggcctgaagcccctggacgtggccttcatgaaggccatccacaacaaggtgaacatcgtgcccgtgatcgccaaggccgacaccctgaccctgaaggagagagagagactgaagaagagaatcctggacgagatcgaggagcacaacatcaagatctaccacctgcccgacgccgagagcgacgaggacgaggacttcaaggagcagaccagactgctgaaggccagcatccccttcagcgtggtgggcagcaaccagctgatcgaggccaagggcaagaaggtgagaggcagactgtacccctggggcgtggtggaggtggagaaccccgagcacaacgacttcctgaagctgagaaccatgctgatcacccacatgcaggacctgcaggaggtgacccaggacctgcactacgagaacttcagaagcgagagactgaagagaggcggcagaaaggtggagaacgaggacatgaacaaggaccagatcctgctggagaaggaggccgagctgagaagaatgcaggagatgatcgccagaatgcaggcccagatgcagatgcagatgcagggcggcgacggcgacggcggcgccctgggccaccacgtgtag

SEQ ID NO: 98360 - DNA, 1086 bp, Artificial Sequence; identical to SEQ ID NO: 98357
  Description of Artificial Sequence: Synthetic coding sequence

SEQ ID NO: 98361 - DNA, 1086 bp, Artificial Sequence; identical to SEQ ID NO: 98357
  Description of Artificial Sequence: Synthetic coding sequence

SEQ ID NO: 98362 - DNA, 159 bp, Artificial Sequence
  Description of Artificial Sequence: Synthetic coding sequence
atgagcaagcagcagcccacccagttcatcaaccccgagacccccggctacgtgggcttcgccaacctgcccaaccaggtgcacagaaagagcgtgaagaagggcttcgagttcaccctgatggtggtgggcgagagcggcctgggcaagagcacctag

SEQ ID NO: 98363 - DNA, 153 bp, Artificial Sequence
  Description of Artificial Sequence: Synthetic coding sequence
atgagcaagcagcagcccacccagttcatcaaccccgagacccccggctacgtgggcttcgccaacctgcccaaccaggtgcacagaaagagcgtgaagaagggcttcgagttcaccctgatggtggtgggcgagagcggcctgggcaagtag

SEQ ID NO: 98364 - DNA, 72 bp, Artificial Sequence
  Description of Artificial Sequence: Synthetic coding sequence
atgagcaagcagcagcccacccagttcatcaaccccgagacccccggctacgtgggcttcgccaacctgtag

SEQ ID NO: 98365 - DNA, 447 bp, Artificial Sequence
  Description of Artificial Sequence: Synthetic coding sequence
atgagcaagcagcagcccacccagttcatcaaccccgagacccccggctacgtgggcttcgccaacctgcccaaccaggtgcacagaaagagcgtgaagaagggcttcgagttcaccctgatggtggtgggcgagagcggcctgggcaagagcaccctgatcaacagcctgttcctgaccgacctgtaccccgagagagtgatccccggcgccgccgagaagatcgagagaaccgtgcagatcgaggccagcaccgtggagatcgaggagagaggcgtgaagctgagactgaccgtggtggacacccccggctacggcgacgccatcaactgcagagactgcttcaagaccatcatcagctacatcgacgagcagttcgagagatacctgcacgacgagagcggcctgaacagaagacacatcatcgacaacagagtgcactgctag

SEQ ID NO: 98366 - DNA, 396 bp, Artificial Sequence
  Description of Artificial Sequence: Synthetic coding sequence
atgagcaagcagcagcccacccagttcatcaaccccgagacccccggctacgtgggcttcgccaacctgcccaaccaggtgcacagaaagagcgtgaagaagggcttcgagttcaccctgatggtggtgggcgagagcggcctgggcaagagcaccctgatcaacagcctgttcctgaccgacctgtaccccgagagagtgatccccggcgccgccgagaagatcgagagaaccgtgcagatcgaggccagcaccgtggagatcgaggagagaggcgtgaagctgagactgaccgtggtggacacccccggctacggcgacgccatcaactgcagagactgcttcaagaccatcatcagctacatcgacgagcagttcgagagatacctgcactag

SEQ ID NO: 98367 - DNA, 219 bp, Artificial Sequence
  Description of Artificial Sequence: Synthetic coding sequence
atgagcaagcagcagcccacccagttcatcaaccccgagacccccggctacgtgggcttcgccaacctgcccaaccaggtgcacagaaagagcgtgaagaagggcttcgagttcaccctgatggtggtgggcgagagcggcctgggcaagagcaccctgatcaacagcctgttcctgaccgacctgtaccccgagagagtgatccccggcgccgcctag

SEQ ID NO: 98368 - DNA, 219 bp, Artificial Sequence; identical to SEQ ID NO: 98367
  Description of Artificial Sequence: Synthetic coding sequence

SEQ ID NO: 98369 - DNA, 522 bp, Artificial Sequence
  Description of Artificial Sequence: Synthetic coding sequence
atgagcaagcagcagcccacccagttcatcaaccccgagacccccggctacgtgggcttcgccaacctgcccaaccaggtgcacagaaagagcgtgaagaagggcttcgagttcaccctgatggtggtgggcgagagcggcctgggcaagagcaccctgatcaacagcctgttcctgaccgacctgtaccccgagagagtgatccccggcgccgccgagaagatcgagagaaccgtgcagatcgaggccagcaccgtggagatcgaggagagaggcgtgaagctgagactgaccgtggtggacacccccggctacggcgacgccatcaactgcagagactgcttcaagaccatcatcagctacatcgacgagcagttcgagagatacctgcacgacgagagcggcctgaacagaagacacatcatcgacaacagagtgcactgctgcttctacttcatcagccccttcggccacggcctgaagcccctggacgtggccttcatgaaggccatccacaactag

SEQ ID NO: 98370 - DNA, 90 bp, Artificial Sequence
  Description of Artificial Sequence: Synthetic coding sequence
tgagagatgatcgccagaatgcaggcccagatgcagatgcagatgcagggcggcgacggcgacggcggcgccctgggccaccacgtgtag

SEQ ID NO: 98371 - DNA, 861 bp, Artificial Sequence
  Description of Artificial Sequence: Synthetic coding sequence
atgagcaagggccagagcggcctgggcaagagcaccctggtgaacaccctgttcaagagccaggtgagcagaaaggccagcagctggaacagagaggagaagatccccaagaccgtggagatcaaggccatcggccacgtgatcgaggagggcggcgtgaagatgaagctgaccgtgatcgacacccccggcttcggcgaccagatcaacaacgagaactgctgggagcccatcgagaagtacatcaacgagcagtacgagaagttcctgaaggaggaggtgaacatcgccagaaagaagagaatccccgacaccagagtgcactgctgcctgtacttcatcagccccaccggccacagcctgagacccctggacctggagttcatgaagcacctgagcaaggtggtgaacatcatccccgtgatcgccaaggccgacaccatgaccctggaggagaagagcgagttcaagcagagagtgagaaaggagctggaggtgaacggcatcgagttctacccccagaaggagttcgacgaggacctggaggacaagaccgagaacgacaagatcagacaggagagcatgcccttcgccgtggtgggcagcgacaaggagtaccaggtgaacggcaagagagtgctgggcagaaagaccccctggggcatcatcgaggtggagaacctgaaccactgcgagttcgccctgctgagagacttcgtgatcagaacccacctgcaggacctgaaggaggtgacccacaacatccactacgagacctacagagccaagagactgaacgacaacggcggcctgccccccgtgagcgtggacaccgaggagagccacgacagcaacccctag

SEQ ID NO: 98372 - DNA, 252 bp, Artificial Sequence
  Description of Artificial Sequence: Synthetic coding sequence
atgagcaagggcctgcccgagaccagaaccgacgccgccatgagcgagctggtgcccgagcccagacccaagcccgccgtgcccatgaagcccatgagcatcaacagcaacctgctgggctacatcggcatcgacaccatcatcgagcagatgagaaagaagaccatgaagaccggcttcgacttcaacatcatggtggtggccggcagccccctgagaagcaccagcatgagcagcaccagaagcagctag

SEQ ID NO: 98373 - DNA, 1053 bp, Artificial Sequence
  Description of Artificial Sequence: Synthetic coding sequence
atgagcaagggcctgcccgagaccagaaccgacgccgccatgagcgagctggtgcccgagcccagacccaagcccgccgtgcccatgaagcccatgagcatcaacagcaacctgctgggctacatcggcatcgacaccatcatcgagcagatgagaaagaagaccatgaagaccggcttcgacttcaacatcatggtggtgggccagagcggcctgggcaagagcaccctggtgaacaccctgttcaagagccaggtgagcagaaaggccagcagctggaacagagaggagaagatccccaagaccgtggagatcaaggccatcggccacgtgatcgaggagggcggcgtgaagatgaagctgaccgtgatcgacacccccggcttcggcgaccagatcaacaacgagaactgctgggagcccatcgagaagtacatcaacgagcagtacgagaagttcctgaaggaggaggtgaacatcgccagaaagaagagaatccccgacaccagagtgcactgctgcctgtacttcatcagccccaccggccacagcctgagacccctggacctggagttcatgaagcacctgagcaaggtggtgaacatcatccccgtgatcgccaaggccgacaccatgaccctggaggagaagagcgagttcaagcagagagtgagaaaggagctggaggtgaacggcatcgagttctacccccagaaggagttcgacgaggacctggaggacaagaccgagaacgacaagatcagacaggagagcatgcccttcgccgtggtgggcagcgacaaggagtaccaggtgaacggcaagagagtgctgggcagaaagaccccctggggcatcatcgaggtggagaacctgaaccactgcgagttcgccctgctgagagacttcgtgatcagaacccacctgcaggacctgaaggaggtgacccacaacatccactacgagacctacagagccaagagactgaacgacaacggcggcctgccccccgtgagcgtggacaccgaggagagccacgacagcaacccctag

SEQ ID NO: 98374 - DNA, 1077 bp, Artificial Sequence
  Description of Artificial Sequence: Synthetic coding sequence
atgagcaagggcctgcccgagaccagaaccgacgccgccatgagcgagctggtgcccgagcccagacccaagcccgccgtgcccatgaagcccatgagcatcaacagcaacctgctgggctacatcggcatcgacaccatcatcgagcagatgagaaagaagaccatgaagaccggcttcgacttcaacatcatggtggtgggccagagcggcctgggcaagagcaccctggtgaacaccctgttcaagagccaggtgagcagaaaggccagcagctggaacagagaggagaagatccccaagaccgtggagatcaaggccatcggccacgtgatcgaggagggcggcgtgaagatgaagctgaccgtgatcgacacccccggcttcggcgaccagatcaacaacgagaactgctgggagcccatcgagaagtacatcaacgagcagtacgagaagttcctgaaggaggaggtgaacatcgccagaaagaagagaatccccgacaccagagtgcactgctgcctgtacttcatcagccccaccggccacagcctgagacccctggacctggagttcatgaagcacctgagcaaggtggtgaacatcatccccgtgatcgccaaggccgacaccatgaccctggaggagaagagcgagttcaagcagagagtgagaaaggagctggaggtgaacggcatcgagttctacccccagaaggagttcgacgaggacctggaggacaagaccgagaacgacaagatcagacaggagagcatgcccttcgccgtggtgggcagcgacaaggagtaccaggtgaacggcaagagagtgctgggcagaaagaccccctggggcatcatcgaggtggagaacctgaaccactgcgagttcgccctgctgagagacttcgtgatcagaacccacctgcaggacctgaaggaggtgacccacaacatccactacgagacctacagagccaagagactgaacgacaacggcggcctgccccccggcgagggcctgctgggcaccgtgctgccccccgtgcccgccaccccctgccccaccgccgagtag

SEQ ID NO: 98375 - DNA, 885 bp, Artificial Sequence
  Description of Artificial Sequence: Synthetic coding sequence
atgagcaagggccagagcggcctgggcaagagcaccctggtgaacaccctgttcaagagccaggtgagcagaaaggccagcagctggaacagagaggagaagatccccaagaccgtggagatcaaggccatcggccacgtgatcgaggagggcggcgtgaagatgaagctgaccgtgatcgacacccccggcttcggcgaccagatcaacaacgagaactgctgggagcccatcgagaagtacatcaacgagcagtacgagaagttcctgaaggaggaggtgaacatcgccagaaagaagagaatccccgacaccagagtgcactgctgcctgtacttcatcagccccaccggccacagcctgagacccctggacctggagttcatgaagcacctgagcaaggtggtgaacatcatccccgtgatcgccaaggccgacaccatgaccctggaggagaagagcgagttcaagcagagagtgagaaaggagctggaggtgaacggcatcgagttctacccccagaaggagttcgacgaggacctggaggacaagaccgagaacgacaagatcagacaggagagcatgcccttcgccgtggtgggcagcgacaaggagtaccaggtgaacggcaagagagtgctgggcagaaagaccccctggggcatcatcgaggtggagaacctgaaccactgcgagttcgccctgctgagagacttcgtgatcagaacccacctgcaggacctgaaggaggtgacccacaacatccactacgagacctacagagccaagagactgaacgacaacggcggcctgccccccggcgagggcctgctgggcaccgtgctgccccccgtgcccgccaccccctgccccaccgccgagtag

SEQ ID NO: 98376 - DNA, 537 bp, Artificial Sequence
  Description of Artificial Sequence: Synthetic coding sequence
atgagcgagctggtgcccgagcccagacccaagcccgccgtgcccatgaagcccatgagcatcaacagcaacctgctgggctacatcggcatcgacaccatcatcgagcagatgagaaagaagaccatgaagaccggcttcgacttcaacatcatggtggtgggccagagcggcctgggcaagagcaccctggtgaacaccctgttcaagagccaggtgagcagaaaggccagcagctggaacagagaggagaagatccccaagaccgtggagatcaaggccatcggccacgtgatcgaggagggcggcgtgaagatgaagctgaccgtgatcgacacccccggcttcggcgaccagatcaacaacgagaactgctgggagcccatcgagaagtacatcaacgagcagtacgagaagttcctgaaggaggaggtgaacatcgccagaaagaagagaatccccgacaccagagtgcactgctgcctgtacttcatcagccccaccggccacagcctgagacccctggacctggagtag

SEQ ID NO: 98377 - DNA, 1137 bp, Artificial Sequence
  Description of Artificial Sequence: Synthetic coding sequence
atggacagcctggccgccccccaggacagactggtggagcagctgctgagccccagaacccaggcccagagaagactgaaggacatcgacaagcagtacgtgggcttcgccaccctgcccaaccaggtgcacagaaagagcgtgaagaagggcttcgacttcaccctgatggtggccggcgagagcggcctgggcaagagcaccctggtgcacagcctgttcctgaccgacctgtacaaggacagaaagctgctgagcgccgaggagagaatcagccagaccgtggagatcctgaagcacaccgtggacatcgaggagaagggcgtgaagctgaagctgaccatcgtggacacccccggcttcggcgacgccgtgaacaacaccgagtgctggaagcccatcaccgactacgtggaccagcagttcgagcagtacttcagagacgagagcggcctgaacagaaagaacatccaggacaacagagtgcactgctgcctgtacttcatcagccccttcggccacggcctgagacccgtggacgtgggcttcatgaaggccctgcacgagaaggtgaacatcgtgcccctgatcgccaaggccgactgcctggtgcccagcgagatcagaaagctgaaggagagaatcagagaggagatcgacaagttcggcatccacgtgtaccagttccccgagtgcgacagcgacgaggacgaggacttcaagcagcaggacagagagctgaaggagagcgcccccttcgccgtgatcggcagcaacaccgtggtggaggccaagggccagagagtgagaggcagactgtacccctggggcatcgtggaggtggagaaccaggcccactgcgacttcgtgaagctgagaaacatgctgatcagaacccacatgcacgacctgaaggacgtgacctgcgacgtgcactacgagaactacagagcccactgcatccagcagatgaccagcaagctgacccaggacagcagaatggagagccccatccccatcctgcccctgcccacccccgacgccgagaccgagaagctgatcagaatgaaggacgaggagctgagaagaatgcaggagatgctgcagagaatgaagcagcagatgcaggaccagtag

SEQ ID NO: 98378 - DNA, 969 bp, Artificial Sequence
  Description of Artificial Sequence: Synthetic coding sequence
atggtggccggcgagagcggcctgggcaagagcaccctggtgcacagcctgttcctgaccgacctgtacaaggacagaaagctgctgagcgccgaggagagaatcagccagaccgtggagatcctgaagcacaccgtggacatcgaggagaagggcgtgaagctgaagctgaccatcgtggacacccccggcttcggcgacgccgtgaacaacaccgagtgctggaagcccatcaccgactacgtggaccagcagttcgagcagtacttcagagacgagagcggcctgaacagaaagaacatccaggacaacagagtgcactgctgcctgtacttcatcagccccttcggccacggcctgagacccgtggacgtgggcttcatgaaggccctgcacgagaaggtgaacatcgtgcccctgatcgccaaggccgactgcctggtgcccagcgagatcagaaagctgaaggagagaatcagagaggagatcgacaagttcggcatccacgtgtaccagttccccgagtgcgacagcgacgaggacgaggacttcaagcagcaggacagagagctgaaggagagcgcccccttcgccgtgatcggcagcaacaccgtggtggaggccaagggccagagagtgagaggcagactgtacccctggggcatcgtggaggtggagaaccaggcccactgcgacttcgtgaagctgagaaacatgctgatcagaacccacatgcacgacctgaaggacgtgacctgcgacgtgcactacgagaactacagagcccactgcatccagcagatgaccagcaagctgacccaggacagcagaatggagagccccatccccatcctgcccctgcccacccccgacgccgagaccgagaagctgatcagaatgaaggacgaggagctgagaagaatgcaggagatgctgcagagaatgaagcagcagatgcaggaccagtag

SEQ ID NO: 98379 - DNA, 1041 bp, Artificial Sequence
  Description of Artificial Sequence: Synthetic coding sequence
atggacagcctggccgccccccaggacagactggtggagcagctgctgagccccagaacccaggcccagagaagactgaaggacatcgacaagcagtacgtgggcttcgccaccctgcccaaccaggtgcacagaaagagcgtgaagaagggcttcgacttcaccctgatggtggccggcgagagcggcctgggcaagagcaccctggtgcacagcctgttcctgaccgacctgtacaaggacagaaagctgctgagcgccgaggagagaatcagccagaccgtggagatcctgaagcacaccgtggacatcgaggagaagggcgtgaagctgaagctgaccatcgtggacacccccggcttcggcgacgccgtgaacaacaccgagtgctggaagcccatcaccgactacgtggaccagcagttcgagcagtacttcagagacgagagcggcctgaacagaaagaacatccaggacaacagagtgcactgctgcctgtacttcatcagccccttcggccacggcctgagacccgtggacgtgggcttcatgaaggccctgcacgagaaggtgaacatcgtgcccctgatcgccaaggccgactgcctggtgcccagcgagatcagaaagctgaaggagagaatcagagaggagatcgacaagttcggcatccacgtgtaccagttccccgagtgcgacagcgacgaggacgaggacttcaagcagcaggacagagagctgaaggagagcgcccccttcgccgtgatcggcagcaacaccgtggtggaggccaagggccagagagtgagaggcagactgtacccctggggcatcgtggagggcgccctgagactgagagaggccgcccagcacgcccacccccacgcctacgccagaccccagggcagagacgtgagaagagccctgagagagctgcccagagccctgcaccccgccgacgaccagcagaccgaccccggccagccccacggcgagccccaccccgaccccgccgccgcccaccccggcagaagagactag

SEQ ID NO: 98380 - DNA, 450 bp, Artificial Sequence
  Description of Artificial Sequence: Synthetic coding sequence
ctgcccaaccaggtgcacagaaagagcgtgaagaagggcttcgacttcaccctgatggtggccggcgagagcggcctgggcaagagcaccctggtgcacagcctgttcctgaccgacctgtacaaggacagaaagctgctgagcgccgaggagagaatcagccagaccgtggagatcctgaagcacaccgtggacatcgaggagaagggcgtgaagctgaagctgaccatcgtggacacccccggcttcggcgacgccgtgaacaacaccgagtgctggaagcccatcaccgactacgtggaccagcagttcgagcagtacttcagagacgagagcggcctgaacagaaagaacatccaggacaacagagtgcactgctgcctgtacttcatcagccccttcggccacggcctgagacccgtggacggcttccacgagggcatcgcctag

SEQ ID NO: 98381 - DNA, 1110 bp, Artificial Sequence
  Description of Artificial Sequence: Synthetic coding sequence
atgagcaccggcctgagatacaagagcaagctggccacccccgaggacaagcaggacatcgacaagcagtacgtgggcttcgccaccctgcccaaccaggtgcacagaaagagcgtgaagaagggcttcgacttcaccctgatggtggccggcgagagcggcctgggcaagagcaccctggtgcacagcctgttcctgaccgacctgtacaaggacagaaagctgctgagcgccgaggagagaatcagccagaccgtggagatcctgaagcacaccgtggacatcgaggagaagggcgtgaagctgaagctgaccatcgtggacacccccggcttcggcgacgccgtgaacaacaccgagtgctggaagcccatcaccgactacgtggaccagcagttcgagcagtacttcagagacgagagcggcctgaacagaaagaacatccaggacaacagagtgcactgctgcctgtacttcatcagccccttcggccacggcctgagacccgtggacgtgggcttcatgaaggccctgcacgagaaggtgaacatcgtgcccctgatcgccaaggccgactgcctggtgcccagcgagatcagaaagctgaaggagagaatcagagaggagatcgacaagttcggcatccacgtgtaccagttccccgagtgcgacagcgacgaggacgaggacttcaagcagcaggacagagagctgaaggagagcgcccccttcgccgtgatcggcagcaacaccgtggtggaggccaagggccagagagtgagaggcagactgtacccctggggcatcgtggaggtggagaaccaggcccactgcgacttcgtgaagctgagaaacatgctgatcagaacccacatgcacgacctgaaggacgtgacctgcgacgtgcactacgagaactacagagcccactgcatccagcagatgaccagcaagctgacccaggacagcagaatggagagccccatccccatcctgcccctgcccacccccgacgccgagaccgagaagctgatcagaatgaaggacgaggagctgagaagaatgcaggagatgctgcagagaatgaagcagcagatgcaggaccagtag

SEQ ID NO: 98382 - DNA, 1137 bp, Artificial Sequence; identical to SEQ ID NO: 98377
  Description of Artificial Sequence: Synthetic coding sequence

SEQ ID NO: 98383 - DNA, 1305 bp, Artificial Sequence
  Description of Artificial Sequence: Synthetic coding sequence
atggccgccaccgacatcgccagacaggtgggcgagggctgcagaaccgtgcccctggccggccacgtgggcttcgacagcctgcccgaccagctggtgaacaagagcgtgagccagggcttctgcttcaacatcctgtgcgtgggcgagaccggcctgggcaagagcaccctgatggacaccctgttcaacaccaagttcgagggcgagcccgccacccacacccagcccggcgtgcagctgcagagcaacacctacgacctgcaggagagcaacgtgagactgaagctgaccatcgtgagcaccgtgggcttcggcgaccagatcaacaaggaggacagctacaagcccatcgtggagttcatcgacgcccagttcgaggcctacctgcaggaggagctgaagatcagaagagtgctgcacacctaccacgacagcagaatccacgtgtgcctgtacttcatcgcccccaccggccacagcctgaagagcctggacctggtgaccatgaagaagctggacagcaaggtgaacatcatccccatcatcgccaaggccgacgccatcagcaagagcgagctgaccaagttcaagatcaagatcaccagcgagctggtgagcaacggcgtgcagatctaccagttccccaccgacgacgagagcgtggccgagatcaacggcaccatgaacgcccacctgcccttcgccgtgatcggcagcaccgaggagctgaagatcggcaacaagatgatgagagccagacagtacccctggggcaccgtgcaggtggagaacgaggcccactgcgacttcgtgaagctgagagagatgctgatcagagtgaacatggaggacctgagagagcagacccacaccagacactacgagctgtacagaagatgcaagctggaggagatgggcttcaaggacaccgaccccgacagcaagcccttcagcctgcaggagacctacgaggccaagagaaacgagttcctgggcgagctgcagaagaaggaggaggagatgagacagatgttcgtgcagagagtgaaggagaaggaggccgagctgaaggaggccgagaaggagctgcacgagaagttcgacagactgaagaagctgcaccaggacgagaagaagaagctggaggacaagaagaagagcctggacgacgaggtgaacgccttcaagcagagaaagaccgccgccgagctgctgcagagccagggcagccaggccggcggcagccagaccctgaagagagacaaggagaagaagaacaacccctggctgtgcaccgagtag

SEQ ID NO: 98384 - DNA, 1290 bp, Artificial Sequence
  Description of Artificial Sequence: Synthetic coding sequence
atggccgccaccgacatcgccagacaggtgggcgagggctgcagaaccgtgcccctggccggccacgtgggcttcgacagcctgcccgaccagctggtgaacaagagcgtgagccagggcttctgcttcaacatcctgtgcgtgggcgagaccggcctgggcaagagcaccctgatggacaccctgttcaacaccaagttcgagggcgagcccgccacccacacccagcccggcgtgcagctgcagagcaacacctacgacctgcaggagagcaacgtgagactgaagctgaccatcgtgagcaccgtgggcttcggcgaccagatcaacaaggaggacagctacaagcccatcgtggagttcatcgacgcccagttcgaggcctacctgcaggaggagctgaagatcagaagagtgctgcacacctaccacgacagcagaatccacgtgtgcctgtacttcatcgcccccaccggccacagcctgaagagcctggacctggtgaccatgaagaagctggacagcaaggtgaacatcatccccatcatcgccaaggccgacgccatcagcaagagcgagctgaccaagttcaagatcaagatcaccagcgagctggtgagcaacggcgtgcagatctaccagttccccaccgacgacgagagcgtggccgagatcaacggcaccatgaacgcccacctgcccttcgccgtgatcggcagcaccgaggagctgaagatcggcaacaagatgatgagagccagacagtacccctggggcaccgtgcaggtggagaacgaggcccactgcgacttcgtgaagctgagagagatgctgatcagagtgaacatggaggacctgagagagcagacccacaccagacactacgagctgtacagaagatgcaagctggaggagatgggcttcaaggacaccgaccccgacagcaagcccttcagcctgcaggagacctacgaggccaagagaaacgagttcctgggcgagctgcagaagaaggaggaggagatgagacagatgttcgtgcagagagtgaaggagaaggaggccgagctgaaggaggccgagaaggagctgcacgagaagttcgacagactgaagaagctgcaccaggacgagaagaagaagctggaggacaagaagaagagcctggacgacgaggtgaacgccttcaagcagagaaagaccgccgccgagctgctgcagagccagggcagccaggccggcggcagccagaccctgaagagagacaaggagaagaagaacttcttctag

SEQ ID NO: 98385 - DNA, 1296 bp, Artificial Sequence
  Description of Artificial Sequence: Synthetic coding sequence
atggccgccaccgacatcgccagacaggtgggcgagggctgcagaaccgtgcccctggccggccacgtgggcttcgacagcctgcccgaccagctggtgaacaagagcgtgagccagggcttctgcttcaacatcctgtgcgtgggcgagaccggcctgggcaagagcaccctgatggacaccctgttcaacaccaagttcgagggcgagcccgccacccacacccagcccggcgtgcagctgcagagcaacacctacgacctgcaggagagcaacgtgagactgaagctgaccatcgtgagcaccgtgggcttcggcgaccagatcaacaaggaggacagctacaagcccatcgtggagttcatcgacgcccagttcgaggcctacctgcaggaggagctgaagatcagaagagtgctgcacacctaccacgacagcagaatccacgtgtgcctgtacttcatcgcccccaccggccacagcctgaagagcctggacctggtgaccatgaagaagctggacagcaaggtgaacatcatccccatcatcgccaaggccgacgccatcagcaagagcgagctgaccaagttcaagatcaagatcaccagcgagctggtgagcaacggcgtgcagatctaccagttccccaccgacgacgagagcgtggccgagatcaacggcaccatgaacgcccacctgcccttcgccgtgatcggcagcaccgaggagctgaagatcggcaacaagatgatgagagccagacagtacccctggggcaccgtgcaggtggagaacgaggcccactgcgacttcgtgaagctgagagagatgctgatcagagtgaacatggaggacctgagagagcagacccacaccagacactacgagctgtacagaagatgcaagctggaggagatgggcttcaaggacaccgaccccgacagcaagcccttcagcctgcaggagacctacgaggccaagagaaacgagttcctgggcgagctgcagaagaaggaggaggagatgagacagatgttcgtgcagagagtgaaggagaaggaggccgagctgaaggaggccgagaaggagctgcacgagaagttcgacagactgaagaagctgcaccaggacgagaagaagaagctggaggacaagaagaagagcctggacgacgaggtgaacgccttcaagcagagaaagaccgccgccgagctgctgcagagccagggcagccaggccggcggcagccagaccctgaagagagacaaggagaagaagaacctgggcttcctgtag

SEQ ID NO: 98386 - DNA, 1284 bp, Artificial Sequence
  Description of Artificial Sequence: Synthetic coding sequence
atggccgccaccgacatcgccagacaggtgggcgagggctgcagaaccgtgcccctggccggccacgtgggcttcgacagcctgcccgaccagctggtgaacaagagcgtgagccagggcttctgcttcaacatcctgtgcgtgggcgagaccggcctgggcaagagcaccctgatggacaccctgttcaacaccaagttcgagggcgagcccgccacccacacccagcccggcgtgcagctgcagagcaacacctacgacctgcaggagagcaacgtgagactgaagctgaccatcgtgagcaccgtgggcttcggcgaccagatcaacaaggaggacagctacaagcccatcgtggagttcatcgacgcccagttcgaggcctacctgcaggaggagctgaagatcagaagagtgctgcacacctaccacgacagcagaatccacgtgtgcctgtacttcatcgcccccaccggccacagcctgaagagcctggacctggtgaccatgaagaagctggacagcaaggtgaacatcatccccatcatcgccaaggccgacgccatcagcaagagcgagctgaccaagttcaagatcaagatcaccagcgagctggtgagcaacggcgtgcagatctaccagttccccaccgacgacgagagcgtggccgagatcaacggcaccatgaacgcccacctgcccttcgccgtgatcggcagcaccgaggagctgaagatcggcaacaagatgatgagagccagacagtacccctggggcaccgtgcaggtggagaacgaggcccactgcgacttcgtgaagctgagagagatgctgatcagagtgaacatggaggacctgagagagcagacccacaccagacactacgagctgtacagaagatgcaagctggaggagatgggcttcaaggacaccgaccccgacagcaagcccttcagcctgcaggagacctacgaggccaagagaaacgagttcctgggcgagctgcagaagaaggaggaggagatgagacagatgttcgtgcagagagtgaaggagaaggaggccgagctgaaggaggccgagaaggagctgcacgagaagttcgacagactgaagaagctgcaccaggacgagaagaagaagctggaggacaagaagaagagcctggacgacgaggtgaacgccttcaagcagagaaagaccgccgccgagctgctgcagagccagggcagccaggccggcggcagccagaccctgaagagagacaaggagaagaagaactag

SEQ ID NO: 98387 - DNA, 1284 bp, Artificial Sequence; identical to SEQ ID NO: 98386
  Description of Artificial Sequence: Synthetic coding sequence

SEQ ID NO: 98388 - DNA, 1110 bp, Artificial Sequence
  Description of Artificial Sequence: Synthetic coding sequence
atggacaccctgttcaacaccaagttcgagggcgagcccgccacccacacccagcccggcgtgcagctgcagagcaacacctacgacctgcaggagagcaacgtgagactgaagctgaccatcgtgagcaccgtgggcttcggcgaccagatcaacaaggaggacagctacaagcccatcgtggagttcatcgacgcccagttcgaggcctacctgcaggaggagctgaagatcagaagagtgctgcacacctaccacgacagcagaatccacgtgtgcctgtacttcatcgcccccaccggccacagcctgaagagcctggacctggtgaccatgaagaagctggacagcaaggtgaacatcatccccatcatcgccaaggccgacgccatcagcaagagcgagctgaccaagttcaagatcaagatcaccagcgagctggtgagcaacggcgtgcagatctaccagttccccaccgacgacgagagcgtggccgagatcaacggcaccatgaacgcccacctgcccttcgccgtgatcggcagcaccgaggagctgaagatcggcaacaagatgatgagagccagacagtacccctggggcaccgtgcaggtggagaacgaggcccactgcgacttcgtgaagctgagagagatgctgatcagagtgaacatggaggacctgagagagcagacccacaccagacactacgagctgtacagaagatgcaagctggaggagatgggcttcaaggacaccgaccccgacagcaagcccttcagcctgcaggagacctacgaggccaagagaaacgagttcctgggcgagctgcagaagaaggaggaggagatgagacagatgttcgtgcagagagtgaaggagaaggaggccgagctgaaggaggccgagaaggagctgcacgagaagttcgacagactgaagaagctgcaccaggacgagaagaagaagctggaggacaagaagaagagcctggacgacgaggtgaacgccttcaagcagagaaagaccgccgccgagctgctgcagagccagggcagccaggccggcggcagccagaccctgaagagagacaaggagaagaagaagtag

SEQ ID NO: 98389 - DNA, 1374 bp, Artificial Sequence
  Description of Artificial Sequence: Synthetic coding sequence
atggccgccaccgacatcgccagacaggtgttcggcagaagaagactgctgctgctgggcttcgagaccgtgggcttcagcgccgcctgcaccgaggagggcggccacatgctgagaagaggcgagggctgcagaaccgtgcccctggccggccacgtgggcttcgacagcctgcccgaccagctggtgaacaagagcgtgagccagggcttctgcttcaacatcctgtgcgtgggcgagaccggcctgggcaagagcaccctgatggacaccctgttcaacaccaagttcgagggcgagcccgccacccacacccagcccggcgtgcagctgcagagcaacacctacgacctgcaggagagcaacgtgagactgaagctgaccatcgtgagcaccgtgggcttcggcgaccagatcaacaaggaggacagctacaagcccatcgtggagttcatcgacgcccagttcgaggcctacctgcaggaggagctgaagatcagaagagtgctgcacacctaccacgacagcagaatccacgtgtgcctgtacttcatcgcccccaccggccacagcctgaagagcctggacctggtgaccatgaagaagctggacagcaaggtgaacatcatccccatcatcgccaaggccgacgccatcagcaagagcgagctgaccaagttcaagatcaagatcaccagcgagctggtgagcaacggcgtgcagatctaccagttccccaccgacgacgagagcgtggccgagatcaacggcaccatgaacgcccacctgcccttcgccgtgatcggcagcaccgaggagctgaagatcggcaacaagatgatgagagccagacagtacccctggggcaccgtgcaggtggagaacgaggcccactgcgacttcgtgaagctgagagagatgctgatcagagtgaacatggaggacctgagagagcagacccacaccagacactacgagctgtacagaagatgcaagctggaggagatgggcttcaaggacaccgaccccgacagcaagcccttcagcctgcaggagacctacgaggccaagagaaacgagttcctgggcgagctgcagaagaaggaggaggagatgagacagatgttcgtgcagagagtgaaggagaaggaggccgagctgaaggaggccgagaaggagctgcacgagaagttcgacagactgaagaagctgcaccaggacgagaagaagaagctggaggacaagaagaagagcctggacgacgaggtgaacgccttcaagcagagaaagaccgccgccgagctgctgcagagccagggcagccaggccggcggcagccagaccctgaagagagacaaggagaagaagaagtag

SEQ ID NO: 98390 - DNA, 1284 bp, Artificial Sequence; identical to SEQ ID NO: 98386
  Description of Artificial Sequence: Synthetic coding sequence

SEQ ID NO: 98391 - DNA, 804 bp, Artificial Sequence
  Description of Artificial Sequence: Synthetic coding sequence
atggccgccaccgacatcgccagacaggtgggcgagggctgcagaaccgtgcccctggccggccacgtgggcttcgacagcctgcccgaccagctggtgaacaagagcgtgagccagggcttctgcttcaacatcctgtgcgtgggcgagaccggcctgggcaagagcaccctgatggacaccctgttcaacaccaagttcgagggcgagcccgccacccacacccagcccggcgtgcagctgcagagcaacacctacgacctgcaggagagcaacgtgagactgaagctgaccatcgtgagcaccgtgggcttcggcgaccagatcaacaaggaggacagctacaagcccatcgtggagttcatcgacgcccagttcgaggcctacctgcaggaggagctgaagatcagaagagtgctgcacacctaccacgacagcagaatccacgtgtgcctgtacttcatcgcccccaccggccacagcctgaagagcctggacctggtgaccatgaagaagctggacagcaaggtgaacatcatccccatcatcgccaaggccgacgccatcagcaagagcgagctgaccaagttcaagatcaagatcaccagcgagctggtgagcaacggcgtgcagatctaccagttccccaccgacgacgagagcgtggccgagatcaacggcaccatgaacgcccacctgcccttcgccgtgatcggcagcaccgaggagctgaagatcggcaacaagatgatgagagccagacagtacccctggggcaccgtgcagggcagcagccaggtgtag

SEQ ID NO: 98392 - DNA, 1452 bp, Artificial Sequence
  Description of Artificial Sequence: Synthetic coding sequence
atggccgccaccgacctggagagattcagcaacgccgagcccgagcccagaagcctgagcctgggcggccacgtgggcttcgacagcctgcccgaccagctggtgagcaagagcgtgacccagggcttcagcttcaacatcctgtgcgtgggcgagaccggcatcggcaagagcaccctgatgaacaccctgttcaacaccaccttcgagaccgaggaggccagccaccacgaggcctgcgtgagactgagaccccagacctacgacctgcaggagagcaacgtgcagctgaagctgaccatcgtggacgccgtgggcttcggcgaccagatcaacaaggacgagagctacagacccatcgtggactacatcgacgcccagttcgagaactacctgcaggaggagctgaagatcagaagaagcctgttcgactaccacgacaccagaatccacgtgtgcctgtacttcatcacccccaccggccacagcctgaagagcctggacctggtgaccatgaagaagctggacagcaaggtgaacatcatccccatcatcgccaaggccgacaccatcagcaagagcgagctgcacaagttcaagatcaagatcatgggcgagctggtgagcaacggcgtgcagatctaccagttccccaccgacgacgaggccgtggccgagatcaacgccgtgatgaacgcccacctgcccttcgccgtggtgggcagcaccgaggaggtgaaggtgggcaacaagctggtgagagccagacagtacccctggggcgtggtgcaggtggagaacgagaaccactgcgacttcgtgaagctgagagagatgctgatcagagtgaacatggaggacctgagagagcagacccacagcagacactacgagctgtacagaagatgcaagctggaggagatgggcttccaggacagcgacggcgacagccagcccttcagcctgcaggagacctacgaggccaagagaaaggagttcctgagcgagctgcagagaaaggaggaggagatgagacagatgttcgtgaacaaggtgaaggagaccgagctggagctgaaggagaaggagagagagctgcacgagaagttcgagcacctgaagagagtgcaccaggaggagaagagaaaggtggaggagaagagaagagagctggaggaggagaccaacgccttcaacagaagaaaggccgccgtggaggccctgcagagccaggccctgcacgccaccagccagcagcccctgagaaaggacaaggacaagaagaacagaagcgacatcggcgcccaccagcccggcatgagcctgagcagcagcaaggtgatgatgaccaaggccagcgtggagcccctgaactgcagcagctggtggcccgccatccagtgctgcagctgcctggtgagagacgccacctggagagagggcttcctgtag

SEQ ID NO: 98393 - DNA, 1110 bp, Artificial Sequence
  Description of Artificial Sequence: Synthetic coding sequence
atgaacaccctgttcaacaccaccttcgagaccgaggaggccagccaccacgaggcctgcgtgagactgagaccccagacctacgacctgcaggagagcaacgtgcagctgaagctgaccatcgtggacgccgtgggcttcggcgaccagatcaacaaggacgagagctacagacccatcgtggactacatcgacgcccagttcgagaactacctgcaggaggagctgaagatcagaagaagcctgttcgactaccacgacaccagaatccacgtgtgcctgtacttcatcacccccaccggccacagcctgaagagcctggacctggtgaccatgaagaagctggacagcaaggtgaacatcatccccatcatcgccaaggccgacaccatcagcaagagcgagctgcacaagttcaagatcaagatcatgggcgagctggtgagcaacggcgtgcagatctaccagttccccaccgacgacgaggccgtggccgagatcaacgccgtgatgaacgcccacctgcccttcgccgtggtgggcagcaccgaggaggtgaaggtgggcaacaagctggtgagagccagacagtacccctggggcgtggtgcaggtggagaacgagaaccactgcgacttcgtgaagctgagagagatgctgatcagagtgaacatggaggacctgagagagcagacccacagcagacactacgagctgtacagaagatgcaagctggaggagatgggcttccaggacagcgacggcgacagccagcccttcagcctgcaggagacctacgaggccaagagaaaggagttcctgagcgagctgcagagaaaggaggaggagatgagacagatgttcgtgaacaaggtgaaggagaccgagctggagctgaaggagaaggagagagagctgcacgagaagttcgagcacctgaagagagtgcaccaggaggagaagagaaaggtggaggagaagagaagagagctggaggaggagaccaacgccttcaacagaagaaaggccgccgtggaggccctgcagagccaggccctgcacgccaccagccagcagcccctgagaaaggacaaggacaagaagaactag

SEQ ID NO: 98394 - DNA, 1290 bp, Artificial Sequence
  Description of Artificial Sequence: Synthetic coding sequence
atggccgccaccgacctggagagattcagcaacgccgagcccgagcccagaagcctgagcctgggcggccacgtgggcttcgacagcctgcccgaccagctggtgagcaagagcgtgacccagggcttcagcttcaacatcctgtgcgtgggcgagaccggcatcggcaagagcaccctgatgaacaccctgttcaacaccaccttcgagaccgaggaggccagccaccacgaggcctgcgtgagactgagaccccagacctacgacctgcaggagagcaacgtgcagctgaagctgaccatcgtggacgccgtgggcttcggcgaccagatcaacaaggacgagagctacagacccatcgtggactacatcgacgcccagttcgagaactacctgcaggaggagctgaagatcagaagaagcctgttcgactaccacgacaccagaatccacgtgtgcctgtacttcatcacccccaccggccacagcctgaagagcctggacctggtgaccatgaagaagctggacagcaaggtgaacatcatccccatcatcgccaaggccgacaccatcagcaagagcgagctgcacaagttcaagatcaagatcatgggcgagctggtgagcaacggcgtgcagatctaccagttccccaccgacgacgaggccgtggccgagatcaacgccgtgatgaacgcccacctgcccttcgccgtggtgggcagcaccgaggaggtgaaggtgggcaacaagctggtgagagccagacagtacccctggggcgtggtgcaggtggagaacgagaaccactgcgacttcgtgaagctgagagagatgctgatcagagtgaacatggaggacctgagagagcagacccacagcagacactacgagctgtacagaagatgcaagctggaggagatgggcttccaggacagcgacggcgacagccagcccttcagcctgcaggagacctacgaggccaagagaaaggagttcctgagcgagctgcagagaaaggaggaggagatgagacagatgttcgtgaacaaggtgaaggagaccgagctggagctgaaggagaaggagagagagctgcacgagaagttcgagcacctgaagagagtgcaccaggaggagaagagaaaggtggaggagaagagaagagagctggaggaggagaccaacgccttcaacagaagaaaggccgccgtggaggccctgcagagccaggccctgcacgccaccagccagcagcccctgagaaaggacaaggacaagaagaactag

SEQ ID NO: 98395 - DNA, 1329 bp, Artificial Sequence
  Description of Artificial Sequence: Synthetic coding sequence
atggccgccaccgacctggagagattcagcaacgccgagcccgagcccagaagcctgagcctgggcggccacgtgggcttcgacagcctgcccgaccagctggtgagcaagagcgtgacccagggcttcagcttcaacatcctgtgcgtgggcgagaccggcatcggcaagagcaccctgatgaacaccctgttcaacaccaccttcgagaccgaggaggccagccaccacgaggcctgcgtgagactgagaccccagacctacgacctgcaggagagcaacgtgcagctgaagctgaccatcgtggacgccgtgggcttcggcgaccagatcaacaaggacgagagctacagacccatcgtggactacatcgacgcccagttcgagaactacctgcaggaggagctgaagatcagaagaagcctgttcgactaccacgacaccagaatccacgtgtgcctgtacttcatcacccccaccggccacagcctgaagagcctggacctggtgaccatgaagaagctggacagcaaggtgaacatcatccccatcatcgccaaggccgacaccatcagcaagagcgagctgcacaagttcaagatcaagatcatgggcgagctggtgagcaacggcgtgcagatctaccagttccccaccgacgacgaggccgtggccgagatcaacgccgtgatgaacgcccacctgcccttcgccgtggtgggcagcaccgaggaggtgaaggtgggcaacaagctggtgagagccagacagtacccctggggcgtggtgcaggtggagaacgagaaccactgcgacttcgtgaagctgagagagatgctgatcagagtgaacatggaggacctgagagagcagacccacagcagacactacgagctgtacagaagatgcaagctggaggagatgggcttccaggacagcgacggcgacagccagcccttcagcctgcaggagacctacgaggccaagagaaaggagttcctgagcgagctgcagagaaaggaggaggagatgagacagatgttcgtgaacaaggtgaaggagaccgagctggagctgaaggagaaggagagagagctgcacgagaagttcgagcacctgaagagagtgcaccaggaggagaagagaaaggtggaggagaagagaagagagctggaggaggagaccaacgccttcaacagaagaaaggccgccgtggaggccctgcagagccaggccctgcacgccaccagccagcagcccctgagaaaggacaaggacaagaagaaggccagcggctggagcagcatctacagcgtgaccatcccctag

SEQ ID NO: 98396 - DNA, 1707 bp, Artificial Sequence
  Description of Artificial Sequence: Synthetic coding sequence
atggagagagacagaatcagcgccctgaagagaagcttcgaggtggaggaggtggagacccccaacagcaccccccccagaagagtgcagacccccctgctgagagccaccgtggccagcagcacccagaagttccaggacctgggcgtgaagaacagcgagcccagcgccagacacgtggacagcctgagccagagaagccccaaggccagcctgagaagagtggagctgagcggccccaaggccgccgagcccgtgagcagaagaaccgagctgagcatcgacatcagcagcaagcaggtggagaacgccggcgccatcggccccagcagattcggcctgaagagagccgaggtgctgggccacaagacccccgagcccgcccccagaagaaccgagatcaccatcgtgaagccccaggagagcgcccacagaagaatggagccccccgccagcaaggtgcccgaggtgcccaccgcccccgccaccgacgccgcccccaagagagtggagatccagatgcccaagcccgccgaggcccccaccgcccccagccccgcccagaccctggagaacagcgagcccgcccccgtgagccagctgcagagcagactggagcccaagccccagccccccgtggccgaggccacccccagaagccaggaggccaccgaggccgcccccagctgcgtgggcgacatggccgacacccccagagacgccggcctgaagcaggcccccgccagcagaaacgagaaggcccccgtggacttcggctacgtgggcatcgacagcatcctggagcagatgagaagaaaggccatgaagcagggcttcgagttcaacatcatggtggtgggccagagcggcctgggcaagagcaccctgatcaacaccctgttcaagagcaagatcagcagaaagagcgtgcagcccaccagcgaggagagaatccccaagaccatcgagatcaagagcatcacccacgacatcgaggagaagggcgtgagaatgaagctgaccgtgatcgacacccccggcttcggcgaccacatcaacaacgagaactgctggcagcccatcatgaagttcatcaacgaccagtacgagaagtacctgcaggaggaggtgaacatcaacagaaagaagagaatccccgacaccagagtgcactgctgcctgtacttcatccccgccaccggccacagcctgagacccctggacatcgagttcatgaagagactgagcaaggtggtgaacatcgtgcccgtgatcgccaaggccgacaccctgaccctggaggagagagtgcacttcaagcagagaatcaccgccgacctgctgagcaacggcatcgacgtgtacccccagaaggagttcgacgaggacagcgaggacagactggtgaacgagaagttcagagagatgatccccttcgccgtggtgggcagcgaccacgagtaccaggtgaacggcaagagaatcctgggcagaaagaccaagtggggcaccatcgaggtggagaacaccacccactgcgagttcgcctacctgagagacctgctgatcagaacccacatgcagaacatcaaggacatcaccagcagcatccacttcgaggcctacagagtgaagagactgaacgagggcagcagcgccatggccaacggcatggaggagaaggagcccgaggcccccgagatgtag

SEQ ID NO: 98397 - DNA, 591 bp, Artificial Sequence
  Description of Artificial Sequence: Synthetic coding sequence
atggccgacacccccagagacgccggcctgaagcaggcccccgccagcagaaacgagaaggcccccgtggacttcggctacgtgggcatcgacagcatcctggagcagatgagaagaaaggccatgaagcagggcttcgagttcaacatcatggtggtgggccagagcggcctgggcaagagcaccctgatcaacaccctgttcaagagcaagatcagcagaaagagcgtgcagcccaccagcgaggagagaatccccaagaccatcgagatcaagagcatcacccacgacatcgaggagaagggcgtgagaatgaagctgaccgtgatcgacacccccggcttcggcgaccacatcaacaacgagaactgctggcagcccatcatgaagttcatcaacgaccagtacgagaagtacctgcaggaggaggtgaacatcaacagaaagaagagaatccccgacaccagagtgcactgctgcctgtacttcatccccgccaccggccacagcctgcccctgctggagcagaaggtgcccctgagccagcccagcgccgactgcctggccagatgcggcgacagactggagtag

SEQ ID NO: 98398 - DNA, 1740 bp, Artificial Sequence
  Description of Artificial Sequence: Synthetic coding sequence
atgagcgaccccgccgtgaacgcccagctggacggcatcatcagcgacttcgaggccctgaagagaagcttcgaggtggaggaggtggagacccccaacagcaccccccccagaagagtgcagacccccctgctgagagccaccgtggccagcagcacccagaagttccaggacctgggcgtgaagaacagcgagcccagcgccagacacgtggacagcctgagccagagaagccccaaggccagcctgagaagagtggagctgagcggccccaaggccgccgagcccgtgagcagaagaaccgagctgagcatcgacatcagcagcaagcaggtggagaacgccggcgccatcggccccagcagattcggcctgaagagagccgaggtgctgggccacaagacccccgagcccgcccccagaagaaccgagatcaccatcgtgaagccccaggagagcgcccacagaagaatggagccccccgccagcaaggtgcccgaggtgcccaccgcccccgccaccgacgccgcccccaagagagtggagatccagatgcccaagcccgccgaggcccccaccgcccccagccccgcccagaccctggagaacagcgagcccgcccccgtgagccagctgcagagcagactggagcccaagccccagccccccgtggccgaggccacccccagaagccaggaggccaccgaggccgcccccagctgcgtgggcgacatggccgacacccccagagacgccggcctgaagcaggcccccgccagcagaaacgagaaggcccccgtggacttcggctacgtgggcatcgacagcatcctggagcagatgagaagaaaggccatgaagcagggcttcgagttcaacatcatggtggtgggccagagcggcctgggcaagagcaccctgatcaacaccctgttcaagagcaagatcagcagaaagagcgtgcagcccaccagcgaggagagaatccccaagaccatcgagatcaagagcatcacccacgacatcgaggagaagggcgtgagaatgaagctgaccgtgatcgacacccccggcttcggcgaccacatcaacaacgagaactgctggcagcccatcatgaagttcatcaacgaccagtacgagaagtacctgcaggaggaggtgaacatcaacagaaagaagagaatccccgacaccagagtgcactgctgcctgtacttcatccccgccaccggccacagcctgagacccctggacatcgagttcatgaagagactgagcaaggtggtgaacatcgtgcccgtgatcgccaaggccgacaccctgaccctggaggagagagtgcacttcaagcagagaatcaccgccgacctgctgagcaacggcatcgacgtgtacccccagaaggagttcgacgaggacagcgaggacagactggtgaacgagaagttcagagagatgatccccttcgccgtggtgggcagcgaccacgagtaccaggtgaacggcaagagaatcctgggcagaaagaccaagtggggcaccatcgaggtggagaacaccacccactgcgagttcgcctacctgagagacctgctgatcagaacccacatgcagaacatcaaggacatcaccagcagcatccacttcgaggcctacagagtgaagagactgaacgagggcagcagcgccatggccaacggcatggaggagaaggagcccgaggcccccgagatgtag

SEQ ID NO: 98399 - DNA, 1761 bp, Artificial Sequence
  Description of Artificial Sequence: Synthetic coding sequence
atgaagaagagctacagcggcggcaccagaaccagcagcggcagactgagaagactgggcgacagcagcggccccgccctgaagagaagcttcgaggtggaggaggtggagacccccaacagcaccccccccagaagagtgcagacccccctgctgagagccaccgtggccagcagcacccagaagttccaggacctgggcgtgaagaacagcgagcccagcgccagacacgtggacagcctgagccagagaagccccaaggccagcctgagaagagtggagctgagcggccccaaggccgccgagcccgtgagcagaagaaccgagctgagcatcgacatcagcagcaagcaggtggagaacgccggcgccatcggccccagcagattcggcctgaagagagccgaggtgctgggccacaagacccccgagcccgcccccagaagaaccgagatcaccatcgtgaagccccaggagagcgcccacagaagaatggagccccccgccagcaaggtgcccgaggtgcccaccgcccccgccaccgacgccgcccccaagagagtggagatccagatgcccaagcccgccgaggcccccaccgcccccagccccgcccagaccctggagaacagcgagcccgcccccgtgagccagctgcagagcagactggagcccaagccccagccccccgtggccgaggccacccccagaagccaggaggccaccgaggccgcccccagctgcgtgggcgacatggccgacacccccagagacgccggcctgaagcaggcccccgccagcagaaacgagaaggcccccgtggacttcggctacgtgggcatcgacagcatcctggagcagatgagaagaaaggccatgaagcagggcttcgagttcaacatcatggtggtgggccagagcggcctgggcaagagcaccctgatcaacaccctgttcaagagcaagatcagcagaaagagcgtgcagcccaccagcgaggagagaatccccaagaccatcgagatcaagagcatcacccacgacatcgaggagaagggcgtgagaatgaagctgaccgtgatcgacacccccggcttcggcgaccacatcaacaacgagaactgctggcagcccatcatgaagttcatcaacgaccagtacgagaagtacctgcaggaggaggtgaacatcaacagaaagaagagaatccccgacaccagagtgcactgctgcctgtacttcatccccgccaccggccacagcctgagacccctggacatcgagttcatgaagagactgagcaaggtggtgaacatcgtgcccgtgatcgccaaggccgacaccctgaccctggaggagagagtgcacttcaagcagagaatcaccgccgacctgctgagcaacggcatcgacgtgtacccccagaaggagttcgacgaggacagcgaggacagactggtgaacgagaagttcagagagatgatccccttcgccgtggtgggcagcgaccacgagtaccaggtgaacggcaagagaatcctgggcagaaagaccaagtggggcaccatcgaggtggagaacaccacccactgcgagttcgcctacctgagagacctgctgatcagaacccacatgcagaacatcaaggacatcaccagcagcatccacttcgaggcctacagagtgaagagactgaacgagggcagcagcgccatggccaacggcatggaggagaaggagcccgaggcccccgagatgtag

SEQ ID NO: 98400 - DNA, 1425 bp, Artificial Sequence
  Description of Artificial Sequence: Synthetic coding sequence
atgggcagcagcttctgggagggcctgcaggtggccgtgggcctgccccagggctgctggccccagggcctggacagcggcgagcccgccgagggcggccagctggaggccgcccccgtgtgcatcgtgaccagacagagcaaggagaccgccggccccaccctgggcagaggcggctggagacagggcagcctgagaagaggcaagggcaccagctgcagatgcagacagctgagccccggccacggccccggcagactgaccggctgcggcgagtgccacagactgccctgcagaggcctggtgagcggcttcaccggcctgagaggccaggaggaggacgacctggccttctgcctggccaccatcggcagcgacagacaggccaccgaggccgcccccagctgcgtgggcgacatggccgacacccccagagacgccggcctgaagcaggcccccgccagcagaaacgagaaggcccccgtggacttcggctacgtgggcatcgacagcatcctggagcagatgagaagaaaggccatgaagcagggcttcgagttcaacatcatggtggtgggccagagcggcctgggcaagagcaccctgatcaacaccctgttcaagagcaagatcagcagaaagagcgtgcagcccaccagcgaggagagaatccccaagaccatcgagatcaagagcatcacccacgacatcgaggagaagggcgtgagaatgaagctgaccgtgatcgacacccccggcttcggcgaccacatcaacaacgagaactgctggcagcccatcatgaagttcatcaacgaccagtacgagaagtacctgcaggaggaggtgaacatcaacagaaagaagagaatccccgacaccagagtgcactgctgcctgtacttcatccccgccaccggccacagcctgagacccctggacatcgagttcatgaagagactgagcaaggtggtgaacatcgtgcccgtgatcgccaaggccgacaccctgaccctggaggagagagtgcacttcaagcagagaatcaccgccgacctgctgagcaacggcatcgacgtgtacccccagaaggagttcgacgaggacagcgaggacagactggtgaacgagaagttcagagagatgatccccttcgccgtggtgggcagcgaccacgagtaccaggtgaacggcaagagaatcctgggcagaaagaccaagtggggcaccatcgaggtggagaacaccacccactgcgagttcgcctacctgagagacctgctgatcagaacccacatgcagaacatcaaggacatcaccagcagcatccacttcgaggcctacagagtgaagagactgaacgagggcagcagcgccatggccaacggcatggaggagaaggagcccgaggcccccgagatgtag

SEQ ID NO: 98401 - DNA, 1269 bp, Artificial Sequence
  Description of Artificial Sequence: Synthetic coding sequence
atggagccccccgccagcaaggtgcccgaggtgcccaccgcccccgccaccgacgccgcccccaagagagtggagatccagatgcccaagcccgccgaggcccccaccgcccccagccccgcccagaccctggagaacagcgagcccgcccccgtgagccagctgcagagcagactggagcccaagccccagccccccgtggccgaggccacccccagaagccaggaggccaccgaggccgcccccagctgcgtgggcgacatggccgacacccccagagacgccggcctgaagcaggcccccgccagcagaaacgagaaggcccccgtggacttcggctacgtgggcatcgacagcatcctggagcagatgagaagaaaggccatgaagcagggcttcgagttcaacatcatggtggtgggccagagcggcctgggcaagagcaccctgatcaacaccctgttcaagagcaagatcagcagaaagagcgtgcagcccaccagcgaggagagaatccccaagaccatcgagatcaagagcatcacccacgacatcgaggagaagggcgtgagaatgaagctgaccgtgatcgacacccccggcttcggcgaccacatcaacaacgagaactgctggcagcccatcatgaagttcatcaacgaccagtacgagaagtacctgcaggaggaggtgaacatcaacagaaagaagagaatccccgacaccagagtgcactgctgcctgtacttcatccccgccaccggccacagcctgagacccctggacatcgagttcatgaagagactgagcaaggtggtgaacatcgtgcccgtgatcgccaaggccgacaccctgaccctggaggagagagtgcacttcaagcagagaatcaccgccgacctgctgagcaacggcatcgacgtgtacccccagaaggagttcgacgaggacagcgaggacagactggtgaacgagaagttcagagagatgatccccttcgccgtggtgggcagcgaccacgagtaccaggtgaacggcaagagaatcctgggcagaaagaccaagtggggcaccatcgaggtggagaacaccacccactgcgagttcgcctacctgagagacctgctgatcagaacccacatgcagaacatcaaggacatcaccagcagcatccacttcgaggcctacagagtgaagagactgaacgagggcagcagcgccatggccaacggcatggaggagaaggagcccgaggcccccgagatgtag

SEQ ID NO: 98402 - DNA, 1008 bp, Artificial Sequence
  Description of Artificial Sequence: Synthetic coding sequence
atggccgacacccccagagacgccggcctgaagcaggcccccgccagcagaaacgagaaggcccccgtggacttcggctacgtgggcatcgacagcatcctggagcagatgagaagaaaggccatgaagcagggcttcgagttcaacatcatggtggtgggccagagcggcctgggcaagagcaccctgatcaacaccctgttcaagagcaagatcagcagaaagagcgtgcagcccaccagcgaggagagaatccccaagaccatcgagatcaagagcatcacccacgacatcgaggagaagggcgtgagaatgaagctgaccgtgatcgacacccccggcttcggcgaccacatcaacaacgagaactgctggcagcccatcatgaagttcatcaacgaccagtacgagaagtacctgcaggaggaggtgaacatcaacagaaagaagagaatccccgacaccagagtgcactgctgcctgtacttcatccccgccaccggccacagcctgagacccctggacatcgagttcatgaagagactgagcaaggtggtgaacatcgtgcccgtgatcgccaaggccgacaccctgaccctggaggagagagtgcacttcaagcagagaatcaccgccgacctgctgagcaacggcatcgacgtgtacccccagaaggagttcgacgaggacagcgaggacagactggtgaacgagaagttcagagagatgatccccttcgccgtggtgggcagcgaccacgagtaccaggtgaacggcaagagaatcctgggcagaaagaccaagtggggcaccatcgaggtggagaacaccacccactgcgagttcgcctacctgagagacctgctgatcagaacccacatgcagaacatcaaggacatcaccagcagcatccacttcgaggcctacagagtgaagagactgaacgagggcagcagcgccatggccaacggcatggaggagaaggagcccgaggcccccgagatgtag

SEQ ID NO: 98403 - DNA, 1269 bp, Artificial Sequence; identical to SEQ ID NO: 98401
  Description of Artificial Sequence: Synthetic coding sequence

SEQ ID NO: 98404 - DNA, 1089 bp, Artificial Sequence
  Description of Artificial Sequence: Synthetic coding sequence
atggccggcgccggctgcaccggcacctggagctggctgtggggcaccgccaccgaggccgcccccagctgcgtgggcgacatggccgacacccccagagacgccggcctgaagcaggcccccgccagcagaaacgagaaggcccccgtggacttcggctacgtgggcatcgacagcatcctggagcagatgagaagaaaggccatgaagcagggcttcgagttcaacatcatggtggtgggccagagcggcctgggcaagagcaccctgatcaacaccctgttcaagagcaagatcagcagaaagagcgtgcagcccaccagcgaggagagaatccccaagaccatcgagatcaagagcatcacccacgacatcgaggagaagggcgtgagaatgaagctgaccgtgatcgacacccccggcttcggcgaccacatcaacaacgagaactgctggcagcccatcatgaagttcatcaacgaccagtacgagaagtacctgcaggaggaggtgaacatcaacagaaagaagagaatccccgacaccagagtgcactgctgcctgtacttcatccccgccaccggccacagcctgagacccctggacatcgagttcatgaagagactgagcaaggtggtgaacatcgtgcccgtgatcgccaaggccgacaccctgaccctggaggagagagtgcacttcaagcagagaatcaccgccgacctgctgagcaacggcatcgacgtgtacccccagaaggagttcgacgaggacagcgaggacagactggtgaacgagaagttcagagagatgatccccttcgccgtggtgggcagcgaccacgagtaccaggtgaacggcaagagaatcctgggcagaaagaccaagtggggcaccatcgaggtggagaacaccacccactgcgagttcgcctacctgagagacctgctgatcagaacccacatgcagaacatcaaggacatcaccagcagcatccacttcgaggcctacagagtgaagagactgaacgagggcagcagcgccatggccaacggcatggaggagaaggagcccgaggcccccgagatgtag

SEQ ID NO: 98405 - DNA, 582 bp, Artificial Sequence
  Description of Artificial Sequence: Synthetic coding sequence
atgaccctgtgcccccaggcctggctgcccgagggcagcgaggagcagctgagatgcgccgaccaccccagctgcggcgtgctgagcgccggcccctggggcggcggccaggccagccacctgcagagaagccccgtgggctgcaccctgcccagcatccccatcggccccgtgccctggagcgtgagcgagcccagaggcgagtgcagcccccccggcgcccccggcccccccgccagacacatggtgtggcccagcctgagcccctacccctgccccgcccccaagggcagaaagctgcagggccccctgccccccaccgcccagcccctgcaggccccctggcagctgcccctgctggagcagaaggtgcccctgagccagcccagcgccgactgctggcccgacgccggcaccggctggaacgagggcggcgtgttcatcagcctgcccagccccagccacgccacccccgcccccaccggcctgcaggtgctgctgatgagatgggacctgatcgaggacaagaaggagggcgagatgacccccacccccagcagccccagcttcgagaaggtgtag

SEQ ID NO: 98406 - DNA, 1071 bp, Artificial Sequence
  Description of Artificial Sequence: Synthetic coding sequence
atggccatgagctacgtgaaggacgacatcttcagaatctacatcaaggagaagaaggagtgcagaagagaccacagacccccctgcgcccaggaggcccccagaaacatggtgcaccccaacgtgatctgcgacggctgcaacggccccgtggtgggcaccagatacaagtgcagcgtgtgccccgactacgacctgtgcagcgtgtgcgagggcaagggcctgcacagaggccacaccaagctggccttccccagccccttcggccacctgagcgagggcttcagccacagcagatggctgagaaaggtgaagcacggccacttcggctggcccggctgggagatgggcccccccggcaactggagccccagaccccccagagccggcgaggccagacccggccccaccgccgagagcgccagcggccccagcgaggaccccagcgtgaacttcctgaagaacgtgggcgagagcgtggccgccgccctgagccccctgggcatcgaggtggacatcgacgtggagcacggcggcaagagaagcagactgacccccgtgagccccgagagcagcagcaccgaggagaagagcagcagccagcccagcagctgctgcagcgaccccagcaagcccggcggcaacgtggagggcgccacccagagcctggccgagcagatgagaaagatcgccctggagagcgagggcagacccgaggagcagatggagagcgacaactgcagcggcggcgacgacgactggacccacctgagcagcaaggaggtggaccccagcaccggcgagctgcagagcctgcagatgcccgagagcgagggccccagcagcctggaccccagccaggagggccccaccggcctgaaggaggccgccctgtacccccacctgccccccgaggccgaccccagactgatcgagagcctgagccagatgctgagcatgggcttcagcgacgagggcggctggctgaccagactgctgcagaccaagaactacgacatcggcgccgccctggacaccatccagtacagcaagcaccccccccccctgtag

SEQ ID NO: 98407 - DNA, 1071 bp, Artificial Sequence; identical to SEQ ID NO: 98406
  Description of Artificial Sequence: Synthetic coding sequence

SEQ ID NO: 98408 - DNA, 1323 bp, Artificial Sequence
  Description of Artificial Sequence: Synthetic coding sequence
atggccagcctgaccgtgaaggcctacctgctgggcaaggaggacgccgccagagagatcagaagattcagcttctgctgcagccccgagcccgaggccgaggccgaggccgccgccggccccggcccctgcgagagactgctgagcagagtggccgccctgttccccgccctgagacccggcggcttccaggcccactacagagacgaggacggcgacctggtggccttcagcagcgacgaggagctgaccatggccatgagctacgtgaaggacgacatcttcagaatctacatcaaggagaagaaggagtgcagaagagaccacagacccccctgcgcccaggaggcccccagaaacatggtgcaccccaacgtgatctgcgacggctgcaacggccccgtggtgggcaccagatacaagtgcagcgtgtgccccgactacgacctgtgcagcgtgtgcgagggcaagggcctgcacagaggccacaccaagctggccttccccagccccttcggccacctgagcgagggcttcagccacagcagatggctgagaaaggtgaagcacggccacttcggctggcccggctgggagatgggcccccccggcaactggagccccagaccccccagagccggcgaggccagacccggccccaccgccgagagcgccagcggccccagcgaggaccccagcgtgaacttcctgaagaacgtgggcgagagcgtggccgccgccctgagccccctgggcatcgaggtggacatcgacgtggagcacggcggcaagagaagcagactgacccccgtgagccccgagagcagcagcaccgaggagaagagcagcagccagcccagcagctgctgcagcgaccccagcaagcccggcggcaacgtggagggcgccacccagagcctggccgagcagatgagaaagatcgccctggagagcgagggcagacccgaggagcagatggagagcgacaactgcagcggcggcgacgacgactggacccacctgagcagcaaggaggtggaccccagcaccggcgagctgcagagcctgcagatgcccgagagcgagggccccagcagcctggaccccagccaggagggccccaccggcctgaaggaggccgccctgtacccccacctgccccccgaggccgaccccagactgatcgagagcctgagccagatgctgagcatgggcttcagcgacgagggcggctggctgaccagactgctgcagaccaagaactacgacatcggcgccgccctggacaccatccagtacagcaagcaccccccccccctgtag

SEQ ID NO: 98409 - DNA, 1071 bp, Artificial Sequence; identical to SEQ ID NO: 98406
  Description of Artificial Sequence: Synthetic coding sequence

SEQ ID NO: 98410 - DNA, 423 bp, Artificial Sequence
  Description of Artificial Sequence: Synthetic coding sequence
atggccatgagctacgtgaaggacgacatcttcagaatctacatcaaggagaagaaggagtgcagaagagaccacagacccccctgcgcccaggaggcccccagaaacatggtgcaccccaacgtgatctgcgacggctgcaacggccccgtggtgggcaccagatacaagtgcagcgtgtgccccgactacgacctgtgcagcgtgtgcgagggcaagggcctgcacagaggccacaccaagctggccttccccagccccttcggccacctgagcgagggcttcagccacagcagatggctgagaaaggtgaagcacggccacttcggctggcccggctgggagatgggcccccccggcaactggagccccagaccccccagagccggcgaggccagacccggccccaccgccgagagctag

SEQ ID NO: 98411 - DNA, 891 bp, Artificial Sequence
  Description of Artificial Sequence: Synthetic coding sequence
atgaccagcagcgagagcaccctgaagagaaagaagagcgccggcggcaccaccgcccacagagtgctgagaagaagacccttcggccacctgagcgagggcttcagccacagcagatggctgagaaaggtgaagcacggccacttcggctggcccggctgggagatgggcccccccggcaactggagccccagaccccccagagccggcgaggccagacccggccccaccgccgagagcgccagcggccccagcgaggaccccagcgtgaacttcctgaagaacgtgggcgagagcgtggccgccgccctgagccccctgggcatcgaggtggacatcgacgtggagcacggcggcaagagaagcagactgacccccgtgagccccgagagcagcagcaccgaggagaagagcagcagccagcccagcagctgctgcagcgaccccagcaagcccggcggcaacgtggagggcgccacccagagcctggccgagcagatgagaaagatcgccctggagagcgagggcagacccgaggagcagatggagagcgacaactgcagcggcggcgacgacgactggacccacctgagcagcaaggaggtggaccccagcaccggcgagctgcagagcctgcagatgcccgagagcgagggccccagcagcctggaccccagccaggagggccccaccggcctgaaggaggccgccctgtacccccacctgccccccgaggccgaccccagactgatcgagagcctgagccagatgctgagcatgggcttcagcgacgagggcggctggctgaccagactgctgcagaccaagaactacgacatcggcgccgccctggacaccatccagtacagcaagcaccccccccccctgtag

SEQ ID NO: 98412 - DNA, 504 bp, Artificial Sequence
  Description of Artificial Sequence: Synthetic coding sequence
atggccatgagctacgtgaaggacgacatcttcagaatctacatcaaggagaagaaggagtgcagaagagaccacagacccccctgcgcccaggaggcccccagaaacatggtgcaccccaacgtgatctgcgacggctgcaacggccccgtggtgggcaccagatacaagtgcagcgtgtgccccgactacgacctgtgcagcgtgtgcgagggcaagggcctgcacagaggccacaccaagctggccttccccagccccttcggccacctgagcgagggcttcagccacagcagatggctgagaaaggtgaagcacggccacttcggctggcccggctgggagatgggcccccccggcaactggagccccagaccccccagagccggcgaggccagacccggccccaccgccgagagcgccagcggccccagcgaggaccccagcgtgaacttcctgaagaacgtgggcgagagcgtggccgccgccctgagccccctgtag

SEQ ID NO: 98413 - DNA, 477 bp, Artificial Sequence
  Description of Artificial Sequence: Synthetic coding sequence
atgatgcagaagctgctgaagtgcagcagactggtgctggccctggccctgatcctggtgctggagagcagcgtgcagggctaccccaccagaagagccagataccagtgggtgagatgcaaccccgacagcaacagcgccaactgcctggaggagaagggccccatgttcgagctgctgcccggcgagagcaacaagatccccagactgagaaccgacctgttccccaagaccagaatccaggacctgaacagaatcttccccctgagcgaggactacagcggcagcggcttcggcagcggcagcggcagcggcagcggcagcggcagcggcttcctgaccgagatggagcaggactaccagctggtggacgagagcgacgccttccacgacaacctgagaagcctggacagaaacctgcccagcgacagccaggacctgggccagcacggcctggaggaggacttcatgctgtag

SEQ ID NO: 98414 - DNA, 987 bp, Artificial Sequence
  Description of Artificial Sequence: Synthetic coding sequence
atgatgagcggcgagcccctgcacgtgaagacccccatcagagacagcatggccctgagcaagatggccggcaccagcgtgtacctgaagatggacagcgcccagcccagcggcagcttcaagatcagaggcatcggccacttctgcaagagatgggccaagcagggctgcgcccacttcgtgtgcagcagcgccggcaacgccggcatggccgccgcctacgccgccagacagctgggcgtgcccgccaccatcgtggtgcccagcaccacccccgccctgaccatcgagagactgaagaacgagggcgccaccgtgaaggtggtgggcgagctgctggacgaggccttcgagctggccaaggccctggccaagaacaaccccggctgggtgtacatcccccccttcgacgaccccctgatctgggagggccacgccagcatcgtgaaggagctgaaggagaccctgtgggagaagcccggcgccatcgccctgagcgtgggcggcggcggcctgctgtgcggcgtggtgcagggcctgcaggaggtgggctggggcgacgtgcccgtgatcgccatggagaccttcggcgcccacagcttccacgccgccaccaccgccggcaagctggtgagcctgcccaagatcaccagcgtggccaaggccctgggcgtgaagaccgtgggcgcccaggccctgaagctgttccaggagcaccccatcttcagcgaggtgatcagcgaccaggaggccgtggccgccatcgagaagttcgtggacgacgagaagatcctggtggagcccgcctgcggcgccgccctggccgccgtgtacagccacgtgatccagaagctgcagctggagggcaacctgagaacccccctgcccagcctggtggtgatcgtgtgcggcggcagcaacatcagcctggcccagctgagagccctgaaggagcagctgggcatgaccaacagactgcccaagtag

SEQ ID NO: 98415 - DNA, 657 bp, Artificial Sequence
  Description of Artificial Sequence: Synthetic coding sequence
atgatgagcggcgagcccctgcacgtgaagacccccatcagagacagcatggccctgagcaagatggccggcaccagcgtgtacctgaagatggacagcgcccagcccagcggcagcttcaagatcagaggcatcggccacttctgcaagagatgggccaagcagggctgcgcccacttcgtgtgcagcagcgccggcaacgccggcatggccgccgcctacgccgccagacagctgggcgtgcccgccaccatcgtggtgcccagcaccacccccgccctgaccatcgagagactgaagaacgagggcgccaccgtgaaggtggtgggcgagctgctggacgaggccttcgagctggccaaggccctggccaagaacaaccccggctgggtgtacatcccccccttcgacgaccccctgatctgggagggccacgccagcatcgtgaaggagctgaaggagaccctgtgggagaagcccggcgccatcgccctgagcgtgggcggcggcggcctgctgtgcggcgtggtgcagggcctgcaggaggtgggctggggcgacgtgcccgtgatcgccatggagaccttcggcgcccacagcttccacgccgccaccaccgccggcaagctggtgagcctgcccaagatcaccagatag

SEQ ID NO: 98416 - DNA, 1452 bp, Artificial Sequence
  Description of Artificial Sequence: Synthetic coding sequence
atgaccatgcccgtgaacggcgcccacaaggacgccgacctgtggagcagccacgacaagatgctggcccagcccctgaaggacagcgacgtggaggtgtacaacatcatcaagaaggagagcaacagacagagagtgggcctggagctgatcgccagcgagaacttcgccagcagagccgtgctggaggccctgggcagctgcctgaacaacaagtacagcgagggctaccccggccagagatactacggcggcaccgagttcatcgacgagctggagaccctgtgccagaagagagccctgcaggcctacaagctggacccccagtgctggggcgtgaacgtgcagccctacagcggcagccccgccaacttcgccgtgtacaccgccctggtggagccccacggcagaatcatgggcctggacctgcccgacggcggccacctgacccacggcttcatgaccgacaagaagaagatcagcgccaccagcatcttcttcgagagcatgccctacaaggtgaaccccgacaccggctacatcaactacgaccagctggaggagaacgccagactgttccaccccaagctgatcatcgccggcaccagctgctacagcagaaacctggagtacgccagactgagaaagatcgccgacgagaacggcgcctacctgatggccgacatggcccacatcagcggcctggtggccgccggcgtggtgcccagccccttcgagcactgccacgtggtgaccaccaccacccacaagaccctgagaggctgcagagccggcatgatcttctacagaaagggcgtgaagagcgtggaccccaagaccggcaaggagatcctgtacaacctggagagcctgatcaacagcgccgtgttccccggcctgcagggcggcccccacaaccacgccatcgccggcgtggccgtggccctgaagcaggccatgaccctggagttcaaggtgtaccagcaccaggtggtggccaactgcagagccctgagcgaggccctgaccgagctgggctacaagatcgtgaccggcggcagcgacaaccacctgatcctggtggacctgagaagcaagggcaccgacggcggcagagccgagaaggtgctggaggcctgcagcatcgcctgcaacaagaacacctgccccggcgacagaagcgccctgagacccagcggcctgagactgggcacccccgccctgaccagcagaggcctgctggagaaggacttccagaaggtggcccacttcatccacagaggcatcgagctgaccctgcagatccagagcgacaccggcgtgagagccaccctgaaggagttcaaggagagactggccggcgacaagtaccaggccgccgtgcaggccctgagagaggaggtggagagcttcgccagcctgttccccctgcccggcctgcccgacttctag

SEQ ID NO: 98417 - DNA, 378 bp, Artificial Sequence
  Description of Artificial Sequence: Synthetic coding sequence
atgagatacctgctgcaggtggcccagctggtgtggctgaccgtggacagcagaggcatcggcggcaccctggaccacgccggcttcagcatctgcatcttcaccgtgccccccctgagcttcttcggcctgtgcgaggcccagaccttcggcctgagcggcagcaagagccccgccctgcacagatactacggcggcaccgagttcatcgacgagctggagaccctgtgccagaagagagccctgcaggcctacaagctggacccccagtgctggggcgtgaacgtgcccacccaggtgctggtgagcagcatctggcccggcgccgccagcagctgcgccagccccagagccgacatgcaccaggaggagagctag

SEQ ID NO: 98418 - DNA, 1212 bp, Artificial Sequence
  Description of Artificial Sequence: Synthetic coding sequence
atgaccatgcccgtgaacggcgcccacaaggacgccgacctgtggagcagccacgacaagatgctggcccagcccctgaaggacagcgacgtggaggtgtacaacatcatcaagaaggagagcaacagacagagagtgggcctggagctgatcgccagcgagaacttcgccagcagagccgtgctggaggccctgggcagctgcctgaacaacaagtacagcgagggctaccccggccagagatactacggcggcaccgagttcatcgacgagctggagaccctgtgccagaagagagccctgcaggcctacaagctggacccccagtgctggggcgtgaacgtgcagccctacagcggcagccccgccaacttcgccgtgtacaccgccctggtggagccccacggcagaatcatgggcctggacctgcccgacggcggccacctgacccacggcttcatgaccgacaagaagaagatcagcgccaccagcatcttcttcgagagcatgccctacaaggtgaaccccgacaccggctacatcaactacgaccagctggaggagaacgccagactgttccaccccaagctgatcatcgccggcaccagctgctacagcagaaacctggagtacgccagactgagaaagatcgccgacgagaacggcgcctacctgatggccgacatggcccacatcagcggcctggtggccgccggcgtggtgcccagccccttcgagcactgccacgtggtgaccaccaccacccacaagaccctgagaggctgcagagccggcatgatcttctacagaaagggcggcagcgacaaccacctgatcctggtggacctgagaagcaagggcaccgacggcggcagagccgagaaggtgctggaggcctgcagcatcgcctgcaacaagaacacctgccccggcgacagaagcgccctgagacccagcggcctgagactgggcacccccgccctgaccagcagaggcctgctggagaaggacttccagaaggtggcccacttcatccacagaggcatcgagctgaccctgcagatccagagcgacaccggcgtgagagccaccctgaaggagttcaaggagagactggccggcgacaagtaccaggccgccgtgcaggccctgagagaggaggtggagagcttcgccagcctgttccccctgcccggcctgcccgacttctag

SEQ ID NO: 98419 - DNA, 1335 bp, Artificial Sequence
  Description of Artificial Sequence: Synthetic coding sequence
atgaccatgcccgtgaacggcgcccacaaggacgccgacctgtggagcagccacgacaagatgctggcccagcccctgaaggacagcgacgtggaggtgtacaacatcatcaagaaggagagcaacagacagagagtgggcctggagctgatcgccagcgagaacttcgccagcagagccgtgctggaggccctgggcagctgcctgaacaacaagtacagcgagggctaccccggccagagatactacggcggcaccgagttcatcgacgagctggagaccctgtgccagaagagagccctgcaggcctacaagctggacccccagtgctggggcgtgaacgtgcagccctacagcggcagccccgccaacttcgccgtgtacaccgccctggtggagccccacggcagaatcatgggcctggacctgcccgacggcggccacctgacccacggcttcatgaccgacaagaagaagatcagcgccaccagcatcttcttcgagagcatgccctacaaggtgaaccccgacaccggctacatcaactacgaccagctggaggagaacgccagactgttccaccccaagctgatcatcgccggcaccagctgctacagcagaaacctggagtacgccagactgagaaagatcgccgacgagaacggcgcctacctgatggccgacatggcccacatcagcggcctggtggccgccggcgtggtgcccagccccttcgagcactgccacgtggtgaccaccaccacccacaagaccctgagaggctgcagagccggcatgatcttctacagaaagggcgtggccgtggccctgaagcaggccatgaccctggagttcaaggtgtaccagcaccaggtggtggccaactgcagagccctgagcgaggccctgaccgagctgggctacaagatcgtgaccggcggcagcgacaaccacctgatcctggtggacctgagaagcaagggcaccgacggcggcagagccgagaaggtgctggaggcctgcagcatcgcctgcaacaagaacacctgccccggcgacagaagcgccctgagacccagcggcctgagactgggcacccccgccctgaccagcagaggcctgctggagaaggacttccagaaggtggcccacttcatccacagaggcatcgagctgaccctgcagatccagagcgacaccggcgtgagagccaccctgaaggagttcaaggagagactggccggcgacaagtaccaggccgccgtgcaggccctgagagaggaggtggagagcttcgccagcctgttccccctgcccggcctgcccgacttctag

SEQ ID NO: 98420 - DNA, 285 bp, Artificial Sequence
  Description of Artificial Sequence: Synthetic coding sequence
atgaccatgcccgtgaacggcgcccacaaggacgccgacctgtggagcagccacgacaagatgctggcccagcccctgaaggacagcgacgtggaggtgtacaacatcatcaagaaggagagcaacagacagagagtgggcctggagctgatcgccagcgagaacttcgccagcagagccgtgctggaggccctgggcagctgcctgaacaacaagtacagcgagggctaccccggccagagatacgtgaacatcttcaagggcctggtgctgacccagagctag

SEQ ID NO: 98421 - DNA, 777 bp, Artificial Sequence
  Description of Artificial Sequence: Synthetic coding sequence
atggccgacatggcccacatcagcggcctggtggccgccggcgtggtgcccagccccttcgagcactgccacgtggtgaccaccaccacccacaagaccctgagaggctgcagagccggcatgatcttctacagaaagggcgtgaagagcgtggaccccaagaccggcaaggagatcctgtacaacctggagagcctgatcaacagcgccgtgttccccggcctgcagggcggcccccacaaccacgccatcgccggcgtggccgtggccctgaagcaggccatgaccctggagttcaaggtgtaccagcaccaggtggtggccaactgcagagccctgagcgaggccctgaccgagctgggctacaagatcgtgaccggcggcagcgacaaccacctgatcctggtggacctgagaagcaagggcaccgacggcggcagagccgagaaggtgctggaggcctgcagcatcgcctgcaacaagaacacctgccccggcgacagaagcgccctgagacccagcggcctgagactgggcacccccgccctgaccagcagaggcctgctggagaaggacttccagaaggtggcccacttcatccacagaggcatcgagctgaccctgcagatccagagcgacaccggcgtgagagccaccctgaaggagttcaaggagagactggccggcgacaagtaccaggccgccgtgcaggccctgagagaggaggtggagagcttcgccagcctgttccccctgcccggcctgcccgacttctag

SEQ ID NO: 98422 - DNA, 1341 bp, Artificial Sequence
  Description of Artificial Sequence: Synthetic coding sequence
atgaccatgcccgtgaacggcgcccacaaggacgccgacctgtggagcagccacgacaagatgctggcccagcccctgaaggacagcgacgtggaggtgtacaacatcatcaagaaggagagcaacagacagagagtgggcctggagctgatcgccagcgagaacttcgccagcagagccgtgctggaggccctgggcagctgcctgaacaacaagtacagcgagggctaccccggccagagatactacggcggcaccgagttcatcgacgagctggagaccctgtgccagaagagagccctgcaggcctacaagctggacccccagtgctggggcgtgaacgtgcagccctacagcggcagccccgccaacttcgccgtgtacaccgccctggtggagccccacggcagaatcatgggcctggacctgcccgacggcggccacctgacccacggcttcatgaccgacaagaagaagatcagcgccaccagcatcttcttcgagagcatgccctacaaggtgaaccccgacaccggctacatcaactacgaccagctggaggagaacgccagactgttccaccccaagctgatcatcgccggcaccagctgctacagcagaaacctggagtacgccagactgagaaagatcgccgacgagaacggcgcctacctgatggccgacatggcccacatcagcggcctggtggccgccggcgtggtgcccagccccttcgagcactgccacgtggtgaccaccaccacccacaagaccctgagaggctgcagagccggcatgatcttctacagaaagggcgtgaagagcgtggaccccaagaccggcaaggagatcctgtacaacctggagagcctgatcaacagcgccgtgttccccggcctgcagggcggcccccacaaccacgccatcgccggcgtggccgtggccctgaagcaggccatgaccctggagttcaaggtgtaccagcaccaggtggtggccaactgcagagccctgagcgaggccctgaccgagctgggctacaagatcgtgaccggcggcagcgacaaccacctgatcctggtggacctgagaagcaagggcaccgacggcggcagagccgagaaggtgctggaggcctgcagcatcgcctgcaacaagaacacctgccccggcatcgagctgaccctgcagatccagagcgacaccggcgtgagagccaccctgaaggagttcaaggagagactggccggcgacaagtaccaggccgccgtgcaggccctgagagaggaggtggagagcttcgccagcctgttccccctgcccggcctgcccgacttctag

SEQ ID NO: 98423 - DNA, 1038 bp, Artificial Sequence
  Description of Artificial Sequence: Synthetic coding sequence
atgggcctggacctgcccgacggcggccacctgacccacggcttcatgaccgacaagaagaagatcagcgccaccagcatcttcttcgagagcatgccctacaaggtgaaccccgacaccggctacatcaactacgaccagctggaggagaacgccagactgttccaccccaagctgatcatcgccggcaccagctgctacagcagaaacctggagtacgccagactgagaaagatcgccgacgagaacggcgcctacctgatggccgacatggcccacatcagcggcctggtggccgccggcgtggtgcccagccccttcgagcactgccacgtggtgaccaccaccacccacaagaccctgagaggctgcagagccggcatgatcttctacagaaagggcgtgaagagcgtggaccccaagaccggcaaggagatcctgtacaacctggagagcctgatcaacagcgccgtgttccccggcctgcagggcggcccccacaaccacgccatcgccggcgtggccgtggccctgaagcaggccatgaccctggagttcaaggtgtaccagcaccaggtggtggccaactgcagagccctgagcgaggccctgaccgagctgggctacaagatcgtgaccggcggcagcgacaaccacctgatcctggtggacctgagaagcaagggcaccgacggcggcagagccgagaaggtgctggaggcctgcagcatcgcctgcaacaagaacacctgccccggcgacagaagcgccctgagacccagcggcctgagactgggcacccccgccctgaccagcagaggcctgctggagaaggacttccagaaggtggcccacttcatccacagaggcatcgagctgaccctgcagatccagagcgacaccggcgtgagagccaccctgaaggagttcaaggagagactggccggcgacaagtaccaggccgccgtgcaggccctgagagaggaggtggagagcttcgccagcctgttccccctgcccggcctgcccgacttctag

SEQ ID NO: 98424 - DNA, 1515 bp, Artificial Sequence
  Description of Artificial Sequence: Synthetic coding sequence
atgctgtacttcagcctgttctgggccgccagacccctgcagagatgcggccagctggtgagaatggccatcagagcccagcacagcaacgccgcccagacccagaccggcgaggccaacagaggctggaccggccaggagagcctgagcgacagcgaccccgagatgtgggagctgctgcagagagagaaggacagacagtgcagaggcctggagctgatcgccagcgagaacttctgcagcagagccgccctggaggccctgggcagctgcctgaacaacaagtacagcgagggctaccccggcaagagatactacggcggcgccgaggtggtggacgagatcgagctgctgtgccagagaagagccctggaggccttcgacctggaccccgcccagtggggcgtgaacgtgcagccctacagcggcagccccgccaacctggccgtgtacaccgccctgctgcagccccacgacagaatcatgggcctggacctgcccgacggcggccacctgacccacggctacatgagcgacgtgaagagaatcagcgccaccagcatcttcttcgagagcatgccctacaagctgaaccccaagaccggcctgatcgactacaaccagctggccctgaccgccagactgttcagacccagactgatcatcgccggcaccagcgcctacgccagactgatcgactacgccagaatgagagaggtgtgcgacgaggtgaaggcccacctgctggccgacatggcccacatcagcggcctggtggccgccaaggtgatccccagccccttcaagcacgccgacatcgtgaccaccaccacccacaagaccctgagaggcgccagaagcggcctgatcttctacagaaagggcgtgaaggccgtggaccccaagaccggcagagagatcccctacaccttcgaggacagaatcaacttcgccgtgttccccagcctgcagggcggcccccacaaccacgccatcgccgccgtggccgtggccctgaagcaggcctgcacccccatgttcagagagtacagcctgcaggtgctgaagaacgccagagccatggccgacgccctgctggagagaggctacagcctggtgagcggcggcaccgacaaccacctggtgctggtggacctgagacccaagggcctggacggcgccagagccgagagagtgctggagctggtgagcatcaccgccaacaagaacacctgccccggcgacagaagcgccatcacccccggcggcctgagactgggcgcccccgccctgaccagcagacagttcagagaggacgacttcagaagagtggtggacttcatcgacgagggcgtgaacatcggcctggaggtgaagagcaagaccgccaagctgcaggacttcaagagcttcctgctgaaggacagcgagaccagccagagactggccaacctgagacagagagtggagcagttcgccagagccttccccatgcccggcttcgacgagcactag

SEQ ID NO: 98425 - DNA, 1227 bp, Artificial Sequence
  Description of Artificial Sequence: Synthetic coding sequence
atgggcgagcagagatggtggatgaagctgagctgctgcgccagcgccggcccctggaagcccctgacctggatcctgcacagcggcgagagcatgagcagccccacccccggcccccagcccacctggcccagcacccagcccttctgcaacctgaccaccggcagctggggctggacctgccccatgggcgccatcagccccaccgccacctgcctgaccagcagcggctaccagcccagacccagcagcagcagcctgtgccccatcagcagcaccgccctggccgtgtgcgtgagcgtgcagcccaagaccggcctgatcgactacaaccagctggccctgaccgccagactgttcagacccagactgatcatcgccggcaccagcgcctacgccagactgatcgactacgccagaatgagagaggtgtgcgacgaggtgaaggcccacctgctggccgacatggcccacatcagcggcctggtggccgccaaggtgatccccagccccttcaagcacgccgacatcgtgaccaccaccacccacaagaccctgagaggcgccagaagcggcctgatcttctacagaaagggcgtgaaggccgtggaccccaagaccggcagagagatcccctacaccttcgaggacagaatcaacttcgccgtgttccccagcctgcagggcggcccccacaaccacgccatcgccgccgtggccgtggccctgaagcaggcctgcacccccatgttcagagagtacagcctgcaggtgctgaagaacgccagagccatggccgacgccctgctggagagaggctacagcctggtgagcggcggcaccgacaaccacctggtgctggtggacctgagacccaagggcctggacggcgccagagccgagagagtgctggagctggtgagcatcaccgccaacaagaacacctgccccggcgacagaagcgccatcacccccggcggcctgagactgggcgcccccgccctgaccagcagacagttcagagaggacgacttcagaagagtggtggacttcatcgacgagggcgtgaacatcggcctggaggtgaagagcaagaccgccaagctgcaggacttcaagagcttcctgctgaaggacagcgagaccagccagagactggccaacctgagacagagagtggagcagttcgccagagccttccccatgcccggcttcgacgagcactag

SEQ ID NO: 98426 - DNA, 1452 bp, Artificial Sequence
  Description of Artificial Sequence: Synthetic coding sequence
atggccatcagagcccagcacagcaacgccgcccagacccagaccggcgaggccaacagaggctggaccggccaggagagcctgagcgacagcgaccccgagatgtgggagctgctgcagagagagaaggacagacagtgcagaggcctggagctgatcgccagcgagaacttctgcagcagagccgccctggaggccctgggcagctgcctgaacaacaagtacagcgagggctaccccggcaagagatactacggcggcgccgaggtggtggacgagatcgagctgctgtgccagagaagagccctggaggccttcgacctggaccccgcccagtggggcgtgaacgtgcagccctacagcggcagccccgccaacctggccgtgtacaccgccctgctgcagccccacgacagaatcatgggcctggacctgcccgacggcggccacctgacccacggctacatgagcgacgtgaagagaatcagcgccaccagcatcttcttcgagagcatgccctacaagctgaaccccaagaccggcctgatcgactacaaccagctggccctgaccgccagactgttcagacccagactgatcatcgccggcaccagcgcctacgccagactgatcgactacgccagaatgagagaggtgtgcgacgaggtgaaggcccacctgctggccgacatggcccacatcagcggcctggtggccgccaaggtgatccccagccccttcaagcacgccgacatcgtgaccaccaccacccacaagaccctgagaggcgccagaagcggcctgatcttctacagaaagggcgtgaaggccgtggaccccaagaccggcagagagatcccctacaccttcgaggacagaatcaacttcgccgtgttccccagcctgcagggcggcccccacaaccacgccatcgccgccgtggccgtggccctgaagcaggcctgcacccccatgttcagagagtacagcctgcaggtgctgaagaacgccagagccatggccgacgccctgctggagagaggctacagcctggtgagcggcggcaccgacaaccacctggtgctggtggacctgagacccaagggcctggacggcgccagagccgagagagtgctggagctggtgagcatcaccgccaacaagaacacctgccccggcgacagaagcgccatcacccccggcggcctgagactgggcgcccccgccctgaccagcagacagttcagagaggacgacttcagaagagtggtggacttcatcgacgagggcgtgaacatcggcctggaggtgaagagcaagaccgccaagctgcaggacttcaagagcttcctgctgaaggacagcgagaccagccagagactggccaacctgagacagagagtggagcagttcgccagagccttccccatgcccggcttcgacgagcactag

SEQ ID NO: 98427 - DNA, 1452 bp, Artificial Sequence; identical to SEQ ID NO: 98426
  Description of Artificial Sequence: Synthetic coding sequence

SEQ ID NO: 98428 - DNA, 1452 bp, Artificial Sequence; identical to SEQ ID NO: 98426
  Description of Artificial Sequence: Synthetic coding sequence

SEQ ID NO: 98429 - DNA, 1485 bp, Artificial Sequence
  Description of Artificial Sequence: Synthetic coding sequence
atgctgtacttcagcctgttctgggccgccagacccctgcagagatgcggccagctggtgagaatggccatcagagcccagcacagcaacgccgcccagacccagaccggcgaggccaacagaggctggaccggccaggagagcctgagcgacagcgaccccgagatgtgggagctgctgcagagagagaaggacagacagtgcagaggcctggagctgatcgccagcgagaacttctgcagcagagccgccctggaggccctgggcagctgcctgaacaacaagtacagcgagggctaccccggcaagagatactacggcggcgccgaggtggtggacgagatcgagctgctgtgccagagaagagccctggaggccttcgacctggaccccgcccagtggggcgtgaacgtgcagccctacagcggcagccccgccaacctggccgtgtacaccgccctgctgcagccccacgacagaatcatgggcctggacctgcccgacggcggccacctgacccacggctacatgagcgacgtgaagagaatcagcgccaccagcatcttcttcgagagcatgccctacaagctgaacctggccctgaccgccagactgttcagacccagactgatcatcgccggcaccagcgcctacgccagactgatcgactacgccagaatgagagaggtgtgcgacgaggtgaaggcccacctgctggccgacatggcccacatcagcggcctggtggccgccaaggtgatccccagccccttcaagcacgccgacatcgtgaccaccaccacccacaagaccctgagaggcgccagaagcggcctgatcttctacagaaagggcgtgaaggccgtggaccccaagaccggcagagagatcccctacaccttcgaggacagaatcaacttcgccgtgttccccagcctgcagggcggcccccacaaccacgccatcgccgccgtggccgtggccctgaagcaggcctgcacccccatgttcagagagtacagcctgcaggtgctgaagaacgccagagccatggccgacgccctgctggagagaggctacagcctggtgagcggcggcaccgacaaccacctggtgctggtggacctgagacccaagggcctggacggcgccagagccgagagagtgctggagctggtgagcatcaccgccaacaagaacacctgccccggcgacagaagcgccatcacccccggcggcctgagactgggcgcccccgccctgaccagcagacagttcagagaggacgacttcagaagagtggtggacttcatcgacgagggcgtgaacatcggcctggaggtgaagagcaagaccgccaagctgcaggacttcaagagcttcctgctgaaggacagcgagaccagccagagactggccaacctgagacagagagtggagcagttcgccagagccttccccatgcccggcttcgacgagcactag

SEQ ID NO: 98430 - DNA, 1422 bp, Artificial Sequence
  Description of Artificial Sequence: Synthetic coding sequence
atgggcgccgtgctgggcgtgttcagcctggccagctgggtgccctgcctgtgcagcggcgccagctgcctgctgtgcagctgctgccccaacagcaagaacagcaccgtgaccagactgatctacgccttcatcctgctgctgagcaccgtggtgagctacatcatgcagagaaaggagatggagacctacctgaagaagatccccggcttctgcgagggcggcttcaagatccacgaggccgacatcaacgccgacaaggactgcgacgtgctggtgggctacaaggccgtgtacagaatcagcttcgccatggccatcttcttcttcgtgttcagcctgctgatgttcaaggtgaagaccagcaaggacctgagagccgccgtgcacaacggcttctggttcttcaagatcgccgccctgatcggcatcatggtgggcagcttctacatccccggcggctacttcagcagcgtgtggttcgtggtgggcatgatcggcgccgccctgttcatcctgatccagctggtgctgctggtggacttcgcccacagctggaacgagagctgggtgaacagaatggaggagggcaaccccagactgtggtacgccgccctgctgagcttcaccagcgccttctacatcctgagcatcatctgcgtgggcctgctgtacacctactacaccaagcccgacggctgcaccgagaacaagttcttcatcagcatcaacctgatcctgtgcgtggtggccagcatcatcagcatccaccccaagatccaggagcaccagcccagaagcggcctgctgcagagcagcctgatcaccctgtacaccatgtacctgacctggagcgccatgagcaacgagcccgacagaagctgcaaccccaacctgatgagcttcatcaccagaatcaccgcccccaccctggcccccggcaacagcaccgccgtggtgcccacccccaccccccccagcaagagcggcagcctgctggacagcgacaacttcatcggcctgttcgtgttcgtgctgtgcctgctgtacagcagcatcagaaccagcaccaacagccaggtggacaagctgaccctgagcggcagcgacagcgtgatcctgggcgacaccaccaccagcggcgccagcgacgaggaggacggccagcccagaagagccgtggacaacgagaaggagggcgtgcagtacagctacagcctgttccacctgatgctgtgcctggccagcctgtacatcatgatgaccctgaccagctggtacagccccgacgccaagttccagagcatgaccagcaagtggcccgccgtgtgggtgaagatcagcagcagctgggtgtgcctgctgctgtacgtgtggaccctggtggcccccctggtgctgaccagcagagacttcagctag

SEQ ID NO: 98431 - DNA, 1422 bp, Artificial Sequence; identical to SEQ ID NO: 98430
  Description of Artificial Sequence: Synthetic coding sequence

SEQ ID NO: 98432 - DNA, 639 bp, Artificial Sequence
  Description of Artificial Sequence: Synthetic coding sequence
gagcaccagcccagaagcggcctgctgcagagcagcctgatcaccctgtacaccatgtacctgacctggagcgccatgagcaacgagcccgacagaagctgcaaccccaacctgatgagcttcatcaccagaatcaccgcccccaccctggcccccggcaacagcaccgccgtggtgcccacccccaccccccccagcaagagcggcagcctgctggacagcgacaacttcatcggcctgttcgtgttcgtgctgtgcctgctgtacagcagcatcagaaccagcaccaacagccaggtggacaagctgaccctgagcggcagcgacagcgtgatcctgggcgacaccaccaccagcggcgccagcgacgaggaggacggccagcccagaagagccgtggacaacgagaaggagggcgtgcagtacagctacagcctgttccacctgatgctgtgcctggccagcctgtacatcatgatgaccctgaccagctggtacagccccgacgccaagttccagagcatgaccagcaagtggcccgccgtgtgggtgaagatcagcagcagctgggtgtgcctgctgctgtacgtgtggaccctggtggcccccctggtgctgaccagcagagacttcagctag

SEQ ID NO: 98433 - DNA, 1323 bp, Artificial Sequence
  Description of Artificial Sequence: Synthetic coding sequence
atgcccctgcagagatgcctgatctacgccttcatcctgctgctgagcaccgtggtgagctacatcatgcagagaaaggagatggagacctacctgaagaagatccccggcttctgcgagggcggcttcaagatccacgaggccgacatcaacgccgacaaggactgcgacgtgctggtgggctacaaggccgtgtacagaatcagcttcgccatggccatcttcttcttcgtgttcagcctgctgatgttcaaggtgaagaccagcaaggacctgagagccgccgtgcacaacggcttctggttcttcaagatcgccgccctgatcggcatcatggtgggcagcttctacatccccggcggctacttcagcagcgtgtggttcgtggtgggcatgatcggcgccgccctgttcatcctgatccagctggtgctgctggtggacttcgcccacagctggaacgagagctgggtgaacagaatggaggagggcaaccccagactgtggtacgccgccctgctgagcttcaccagcgccttctacatcctgagcatcatctgcgtgggcctgctgtacacctactacaccaagcccgacggctgcaccgagaacaagttcttcatcagcatcaacctgatcctgtgcgtggtggccagcatcatcagcatccaccccaagatccaggagcaccagcccagaagcggcctgctgcagagcagcctgatcaccctgtacaccatgtacctgacctggagcgccatgagcaacgagcccgacagaagctgcaaccccaacctgatgagcttcatcaccagaatcaccgcccccaccctggcccccggcaacagcaccgccgtggtgcccacccccaccccccccagcaagagcggcagcctgctggacagcgacaacttcatcggcctgttcgtgttcgtgctgtgcctgctgtacagcagcatcagaaccagcaccaacagccaggtggacaagctgaccctgagcggcagcgacagcgtgatcctgggcgacaccaccaccagcggcgccagcgacgaggaggacggccagcccagaagagccgtggacaacgagaaggagggcgtgcagtacagctacagcctgttccacctgatgctgtgcctggccagcctgtacatcatgatgaccctgaccagctggtacagccccgacgccaagttccagagcatgaccagcaagtggcccgccgtgtgggtgaagatcagcagcagctgggtgtgcctgctgctgtacgtgtggaccctggtggcccccctggtgctgaccagcagagacttcagctag

SEQ ID NO: 98434 - DNA, 1257 bp, Artificial Sequence
  Description of Artificial Sequence: Synthetic coding sequence
atgcagagaaaggagatggagacctacctgaagaagatccccggcttctgcgagggcggcttcaagatccacgaggccgacatcaacgccgacaaggactgcgacgtgctggtgggctacaaggccgtgtacagaatcagcttcgccatggccatcttcttcttcgtgttcagcctgctgatgttcaaggtgaagaccagcaaggacctgagagccgccgtgcacaacggcttctggttcttcaagatcgccgccctgatcggcatcatggtgggcagcttctacatccccggcggctacttcagcagcgtgtggttcgtggtgggcatgatcggcgccgccctgttcatcctgatccagctggtgctgctggtggacttcgcccacagctggaacgagagctgggtgaacagaatggaggagggcaaccccagactgtggtacgccgccctgctgagcttcaccagcgccttctacatcctgagcatcatctgcgtgggcctgctgtacacctactacaccaagcccgacggctgcaccgagaacaagttcttcatcagcatcaacctgatcctgtgcgtggtggccagcatcatcagcatccaccccaagatccaggagcaccagcccagaagcggcctgctgcagagcagcctgatcaccctgtacaccatgtacctgacctggagcgccatgagcaacgagcccgacagaagctgcaaccccaacctgatgagcttcatcaccagaatcaccgcccccaccctggcccccggcaacagcaccgccgtggtgcccacccccaccccccccagcaagagcggcagcctgctggacagcgacaacttcatcggcctgttcgtgttcgtgctgtgcctgctgtacagcagcatcagaaccagcaccaacagccaggtggacaagctgaccctgagcggcagcgacagcgtgatcctgggcgacaccaccaccagcggcgccagcgacgaggaggacggccagcccagaagagccgtggacaacgagaaggagggcgtgcagtacagctacagcctgttccacctgatgctgtgcctggccagcctgtacatcatgatgaccctgaccagctggtacagccccgacgccaagttccagagcatgaccagcaagtggcccgccgtgtgggtgaagatcagcagcagctgggtgtgcctgctgctgtacgtgtggaccctggtggcccccctggtgctgaccagcagagacttcagctag

SEQ ID NO: 98435 - DNA, 1422 bp, Artificial Sequence
  Description of Artificial Sequence: Synthetic coding sequence
atggccaccgccaccgagcagtgggtgctggtggagatggtgcaggccctgtacgaggcccccgcctaccacctgatcctggagggcatcctgatcctgtggatcatcagactgctgttcagcaagacctacaagctgcaggagagaagcgacctgaccgtgaaggagaaggaggagctgatcgaggagtggcagcccgagcccctggtgccccccgtgcccaaggaccaccccgccctgaactacaacatcgtgagcggcccccccagccacaagaccgtggtgaacggcaaggagtgcatcaacttcgccagcttcaacttcctgggcctgctggacaaccccagagtgaaggccgccgccctggccagcctgaagaagtacggcgtgggcacctgcggccccagaggcttctacggcaccttcgacgtgcacctggacctggaggacagactggccaagttcatgaagaccgaggaggccatcatctacagctacggcttcgccaccatcgccagcgccatccccgcctacagcaagagaggcgacatcgtgttcgtggacagagccgcctgcttcgccatccagaagggcctgcaggccagcagaagcgacatcaagctgttcaagcacaacgacatggccgacctggagagactgctgaaggagcaggagatcgaggaccagaagaaccccagaaaggccagagtgaccagaagattcatcgtggtggagggcctgtacatgaacaccggcaccatctgccccctgcccgagctggtgaagctgaagtacaagtacaaggccagaatcttcctggaggagagcctgagcttcggcgtgctgggcgagcacggcagaggcgtgaccgagcactacggcatcaacatcgacgacatcgacctgatcagcgccaacatggagaacgccctggccagcatcggcggcttctgctgcggcagaagcttcgtgatcgaccaccagagactgagcggccagggctactgcttcagcgccagcctgccccccctgctggccgccgccgccatcgaggccctgaacatcatggaggagaaccccggcatcttcgccgtgctgaaggagaagtgcggccagatccacaaggccctgcagggcatcagcggcctgaaggtggtgggcgagagcctgagccccgccttccacctgcagctggaggagagcaccggcagcagagagcaggacgtgagactgctgcaggagatcgtggaccagtgcatgaacagaagcatcgccctgacccaggccagatacctggagaaggaggagaagtgcctgcccccccccagcatcagagtggtggtgaccgtggagcagaccgaggaggagctggagagagccgccagcaccatcaaggaggtggcccaggccgtgctgctgtag

SEQ ID NO: 98436 - DNA, 432 bp, Artificial Sequence
  Description of Artificial Sequence: Synthetic coding sequence
atggccaccgccaccgagcagtgggtgctggtggagatggtgcaggccctgtacgaggcccccgcctaccacctgatcctggagggcatcctgatcctgtggatcatcagactgctgttcagcaagacctacaagctgcaggagagaagcgacctgaccgtgaaggagaaggaggagctgatcgaggagtggcagcccgagcccctggtgccccccgtgcccaaggaccaccccgccctgaactacaacatcgtgagcggcccccccagccacaagaccgtggtgaacggcaaggagtgcatcaacttcgccagcttcaacttcctgggcctgctggacaaccccagagtgaaggccgccgccctggccagcctgaagaagtacggcgtgggcacctgcggccccagaggcttctacggcaccttcgagtag

SEQ ID NO: 98437 - DNA, 1017 bp, Artificial Sequence
  Description of Artificial Sequence: Synthetic coding sequence
atggccaagtggggcgagggcgaccccagatggatcgtggaggagagagccgacgccaccaacgtgaacaactggcactggaccgagagagacgccagcaactggagcaccgacaagctgaagaccctgttcctggccgtgcaggtgcagaacgaggagggcaagtgcgaggtgaccgaggtgagcaagctggacggcgaggccagcatcaacaacagaaagggcaagctgatcttcttctacgagtggagcgtgaagctgaactggaccggcaccagcaagagcggcgtgcagtacaagggccacgtggagatccccaacctgagcgacgagaacagcgtggacgaggtggagatcagcgtgagcctggccaaggacgagcccgacaccaacctggtggccctgatgaaggaggagggcgtgaagctgctgagagaggccatgggcatctacatcagcaccctgaagaccgagttcacccagggcatgatcctgcccaccatgaacggcgagagcgtggaccccgtgggccagcccgccctgaagaccgaggagagaaaggccaagcccgcccccagcaagacccaggccagacccgtgggcgtgaagatccccacctgcaagatcaccctgaaggagaccttcctgaccagccccgaggagctgtacagagtgttcaccacccaggagctggtgcaggccttcacccacgcccccgccaccctggaggccgacagaggcggcaagttccacatggtggacggcaacgtgagcggcgagttcaccgacctggtgcccgagaagcacatcgtgatgaagtggagattcaagagctggcccgagggccacttcgccaccatcaccctgaccttcatcgacaagaacggcgagaccgagctgtgcatggagggcagaggcatccccgcccccgaggaggagagaaccagacagggctggcagagatactacttcgagggcatcaagcagaccttcggctacggcgccagactgttctag

SEQ ID NO: 98438 - DNA, 990 bp, Artificial Sequence
  Description of Artificial Sequence: Synthetic coding sequence
atggccaaccccggcggcggcgccgtgtgcaacggcaagctgcacaaccacaagaagcagagcaacggcagccagagcagaaactgcaccaagaacggcatcgtgaaggaggcccagcagaacggcaagccccacttctacgacaagctgatcgtggagagcttcgaggaggcccccctgcacgtgatggtgttcacctacatgggctacggcatcggcaccctgttcggctacctgagagacttcctgagaaactggggcatcgagaagtgcaacgccgccgtggagagaaaggagcagaaggacttcgtgcccctgtaccaggacttcgagaacttctacaccagaaacctgtacatgagaatcagagacaactggaacagacccatctgcagcgcccccggccccctgttcgacctgatggagagagtgagcgacgactacaactggaccttcagattcaccggcagagtgatcaaggacgtgatcaacatgggcagctacaacttcctgggcctggccgccaagtacgacgagagcatgagaaccatcaaggacgtgctggaggtgtacggcaccggcgtggccagcaccagacacgagatgggcaccctggacaagcacaaggagctggaggacctggtggccaagttcctgaacgtggaggccgccatggtgttcggcatgggcttcgccaccaacagcatgaacatccccgccctggtgggcaagggctgcctgatcctgagcgacgagctgaaccacaccagcctggtgctgggcgccagactgagcggcgccaccatcagaatcttcaagcacaacaacacccagagcctggagaagctgctgagagacgccgtgatctacggccagcccagaaccagaagagcctggaagaagatcctgatcctggtggagggcgtgtacagaaccagctggatcatctacggcttcaccagaatcgtgctgttcatgctgcacccctag

SEQ ID NO: 98439 - DNA, 1659 bp, Artificial Sequence
  Description of Artificial Sequence: Synthetic coding sequence
atggccaaccccggcggcggcgccgtgtgcaacggcaagctgcacaaccacaagaagcagagcaacggcagccagagcagaaactgcaccaagaacggcatcgtgaaggaggcccagcagaacggcaagccccacttctacgacaagctgatcgtggagagcttcgaggaggcccccctgcacgtgatggtgttcacctacatgggctacggcatcggcaccctgttcggctacctgagagacttcctgagaaactggggcatcgagaagtgcaacgccgccgtggagagaaaggagcagaaggacttcgtgcccctgtaccaggacttcgagaacttctacaccagaaacctgtacatgagaatcagagacaactggaacagacccatctgcagcgcccccggccccctgttcgacctgatggagagagtgagcgacgactacaactggaccttcagattcaccggcagagtgatcaaggacgtgatcaacatgggcagctacaacttcctgggcctggccgccaagtacgacgagagcatgagaaccatcaaggacgtgctggaggtgtacggcaccggcgtggccagcaccagacacgagatgggcaccctggacaagcacaaggagctggaggacctggtggccaagttcctgaacgtggaggccgccatggtgttcggcatgggcttcgccaccaacagcatgaacatccccgccctggtgggcaagggctgcctgatcctgagcgacgagctgaaccacaccagcctggtgctgggcgccagactgagcggcgccaccatcagaatcttcaagcacaacaacacccagagcctggagaagctgctgagagacgccgtgatctacggccagcccagaaccagaagagcctggaagaagatcctgatcctggtggagggcgtgtacagcatggagggcagcatcgtgcacctgccccagatcatcgccctgaagaagaagtacaaggcctacctgtacatcgacgaggcccacagcatcggcgccgtgggccccaccggcagaggcgtgaccgagttcttcggcctggacccccacgaggtggacgtgctgatgggcaccttcaccaagagcttcggcgccagcggcggctacatcgccggcagaaaggacctggtggactacctgagagtgcacagccacagcgccgtgtacgccagcagcatgagcccccccatcgccgagcagatcatcagaagcctgaagctgatcatgggcctggacggcaccacccagggcctgcagagagtgcagcagctggccaagaacaccagatacttcagacagagactgcaggagatgggcttcatcatctacggcaacgagaacgccagcgtggtgcccctgctgctgtacatgcccggcaaggtggccgccttcgccagacacatgctggagaagaagatcggcgtggtggtggtgggcttccccgccacccccctggccgaggccagagccagattctgcgtgagcgccgcccacaccagagagatgctggacaccgtgctggaggccctggacgagatgggcgacctgctgcagctgaagtacagcagacacaagaagagcgccagacccgagctgtacgacgagaccagcttcgagctggaggactag

SEQ ID NO: 98440 - DNA, 366 bp, Artificial Sequence
  Description of Artificial Sequence: Synthetic coding sequence
tgaagcccccccatcgccgagcagatcatcagaagcctgaagctgatcatgggcctggacggcaccacccagggcctgcagagagtgcagcagctggccaagaacaccagatacttcagacagagactgcaggagatgggcttcatcatctacggcaacgagaacgccagcgtggtgcccctgctgctgtacatgcccggcaaggtggccgccttcgccagacacatgctggagaagaagatcggcgtggtggtggtgggcttccccgccacccccctggccgaggccagagccagattctgcgtgagcgccgcccacaccagagagatgctggacaccgtgatctgctgcgtgatgaagatctag

SEQ ID NO: 98441 - DNA, 420 bp, Artificial Sequence
  Description of Artificial Sequence: Synthetic coding sequence
atggccaaccccggcggcggcgccgtgtgcaacggcaagctgcacaaccacaagaagcagagcaacggcagccagagcagaaactgcaccaagaacggcatcgtgaaggaggcccagcagaacggcaagccccacttctacgacaagctgatcgtggagagcttcgaggaggcccccctgcacgtgatggtgttcacctacatgggctacggcatcggcaccctgttcggctacctgagagacttcctgagaaactggggcatcgagaagtgcaacgccgccgtggagagaaaggagcagaaggacttcgtgcccctgtaccaggacttcgagaacttctacaccagaaacctgtacatgagaatcagagacaactggaacagacccatctgcagcgcccccggccccctgttcgactag

SEQ ID NO: 98442 - DNA, 648 bp, Artificial Sequence
  Description of Artificial Sequence: Synthetic coding sequence
aactgcaccaagaacggcatcgtgaaggaggcccagcagaacggcaagccccacttctacgacaagctgatcgtggagagcttcgaggaggcccccctgcacgtgatggtgttcacctacatgggctacggcatcggcaccctgttcggctacctgagagacttcctgagaaactggggcatcgagaagtgcaacgccgccgtggagagaaaggagcagaaggacttcgtgcccctgtaccaggacttcgagaacttctacaccagaaacctgtacatgagaatcagagacaactggaacagacccatctgcagcgcccccggccccctgttcgacctgatggagagagtgagcgacgactacaactggaccttcagattcaccggcagagtgatcaaggacgtgatcaacatgggcagctacaacttcctgggcctggccgccaagtacgacgagagcatgagaaccatcaaggacgtgctggaggtgtacggcaccggcgtggccagcaccagacacgagatgggcgagttcaccagcagctggcagaacgccctgtgcgtgggcggcgtgctgcaggccgacagcgtgccccagggccccccctggagctggaagatgggcagacacagcagcctgctggagtag

SEQ ID NO: 98443 - DNA, 360 bp, Artificial Sequence
  Description of Artificial Sequence: Synthetic coding sequence
atggccctgagcgtgctgagactggccctgctgctgctggccgtgaccttcgccggcagcgccagaagcggccccggcgagagaggcccccccgagaagagcggcttcggcagccagaccggcggcggcccctgccccgcccccggcggcctgggcgacgccagcctgatcccccagttcggcctgttcagcaagtacagaacccccaactgcagccagtacagactgcccggctgccccagacacttcaaccccgtgtgcggcagcgacatgagcacctacgccaacgagtgcaccctgtgcatgaagatcagagagggcggccacaacatcaagatcatcagaaacggcccctgctag

SEQ ID NO: 98444 - DNA, 405 bp, Artificial Sequence
  Description of Artificial Sequence: Synthetic coding sequence
atggccctgagcgtgctgagactggccctgctgctgctggccgtgaccttcgccggcagcgccagaagcggccccggcgagagaggcccccccgagaagagcggcttcggcagccagaccggcggcggcccctgccccgcccccggcggcctgggcgacggcaccagagcccccgtgaccggcggcagccccgaggacctgcccgccagcctgatcccccagttcggcctgttcagcaagtacagaacccccaactgcagccagtacagactgcccggctgccccagacacttcaaccccgtgtgcggcagcgacatgagcacctacgccaacgagtgcaccctgtgcatgaagatcagagagggcggccacaacatcaagatcatcagaaacggcccctgctag

SEQ ID NO: 98445 - DNA, 240 bp, Artificial Sequence
  Description of Artificial Sequence: Synthetic coding sequence
atgaaggtgaccggcatcttcctgctgagcgccctggccctgctgagcctgagcggcaacaccggcgccgacagcctgggcagagaggccaagtgctacaacgagctgaacggctgcaccaagatctacgaccccgtgtgcggcaccgacggcaacacctaccccaacgagtgcgtgctgtgcttcgagaacagaaagagacagaccagcatcctgatccagaagagcggcccctgctag

SEQ ID NO: 98446 - DNA, 255 bp, Artificial Sequence
  Description of Artificial Sequence: Synthetic coding sequence
atggccctgagcgtgctgagactggccctgctgctgctggccgtgaccttcgccgccagcctgatcccccagttcggcctgttcagcaagtacagaacccccaactgcagccagtacagactgcccggctgccccagacacttcaaccccgtgtgcggcagcgacatgagcacctacgccaacgagtgcaccctgtgcatgaagatcagagagggcggccacaacatcaagatcatcagaaacggcccctgctag

SEQ ID NO: 98447 - DNA, 261 bp, Artificial Sequence
  Description of Artificial Sequence: Synthetic coding sequence
atggccgtgagacagtgggtgatcgccctggccctggccgccctgctggtggtggacagagaggtgcccgtggccgccggcaagctgcccttcagcagaatgcccatctgcgagcacatggtggagagccccacctgcagccagatgagcaacctggtgtgcggcaccgacggcctgacctacaccaacgagtgccagctgtgcctggccagaatcaagaccaagcaggacatccagatcatgaaggacggcaagtgctag

SEQ ID NO: 98448 - DNA, 330 bp, Artificial Sequence
  Description of Artificial Sequence: Synthetic coding sequence
atgatcctgggcatcggcagcagcccccacctgctgtggaccctggagggcacccacatctggagcctgctgggcgacgccagccacaccgacagactgcccgaggccggcgccggcaagctgctgagcgaggtgcccgtggccgccggcaagctgcccttcagcagaatgcccatctgcgagcacatggtggagagccccacctgcagccagatgagcaacctggtgtgcggcaccgacggcctgacctacaccaacgagtgccagctgtgcctggccagaatcaagaccaagcaggacatccagatcatgaaggacggcaagtgctag

SEQ ID NO: 98449 - DNA, 330 bp, Artificial Sequence; identical to SEQ ID NO: 98448
  Description of Artificial Sequence: Synthetic coding sequence

SEQ ID NO: 98450 - DNA, 3195 bp, Artificial Sequence
  Description of Artificial Sequence: Synthetic coding sequence
atgaagatcgccaccgtgagcgtgctgctgcccctggccctgtgcctgatccaggacgccgccagcaagaacgaggaccaggagatgtgccacgagttccaggccttcatgaagaacggcaagctgttctgcccccaggacaagaagttcttccagagcctggacggcatcatgttcatcaacaagtgcgccacctgcaagatgatcctggagaaggaggccaagagccagaagagagccagacacctggccagagcccccaaggccaccgcccccaccgagctgaactgcgacgacttcaagaagggcgagagagacggcgacttcatctgccccgactactacgaggccgtgtgcggcaccgacggcaagacctacgacaacagatgcgccctgtgcgccgagaacgccaagaccggcagccagatcggcgtgaagagcgagggcgagtgcaagagcagcaaccccgagcaggacgtgtgcagcgccttcagacccttcgtgagagacggcagactgggctgcaccagagagaacgaccccgtgctgggccccgacggcaagacccacggcaacaagtgcgccatgtgcgccgagctgttcctgaaggaggccgagaacgccaagagagagggcgagaccagaatcagaagaaacgccgagaaggacttctgcaaggagtacgagaagcaggtgagaaacggcagactgttctgcaccagagagagcgaccccgtgagaggccccgacggcagaatgcacggcaacaagtgcgccctgtgcgccgagatcttcaagcagagattcagcgaggagaacagcaagaccgaccagaacctgggcaaggccgaggagaagaccaaggtgaagagagagatcgtgaagctgtgcagccagtaccagaaccaggccaagaacggcatcctgttctgcaccagagagaacgaccccatcagaggccccgacggcaagatgcacggcaacctgtgcagcatgtgccaggcctacttccaggccgagaacgaggagaagaagaaggccgaggccagagccagaaacaagagagagagcggcaaggccaccagctacgccgagctgtgcagcgagtacagaaagctggtgagaaacggcaagctggcctgcaccagagagaacgaccccatccagggccccgacggcaaggtgcacggcaacacctgcagcatgtgcgaggtgttcttccaggccgaggaggaggagaagaagaagaaggagggcaagagcagaaacaagagacagagcaagagcaccgccagcttcgaggagctgtgcagcgagtacagaaagagcagaaagaacggcagactgttctgcaccagagagaacgaccccatccagggccccgacggcaagatgcacggcaacacctgcagcatgtgcgaggccttcttccagcaggaggagagagccagagccaaggccaagagagaggccgccaaggagatctgcagcgagttcagagaccaggtgagaaacggcaccctgatctgcaccagagagcacaaccccgtgagaggccccgacggcaagatgcacggcaacaagtgcgccatgtgcgccagcgtgttcaagctggaggaggaggagaagaagaacgacaaggaggagaagggcaaggtggaggccgagaaggtgaagagagaggccgtgcaggagctgtgcagcgagtacagacactacgtgagaaacggcagactgccctgcaccagagagaacgaccccatcgagggcctggacggcaagatccacggcaacacctgcagcatgtgcgaggccttcttccagcaggaggccaaggagaaggagagagccgagcccagagccaaggtgaagagagaggccgagaaggagacctgcgacgagttcagaagactgctgcagaacggcaagctgttctgcaccagagagaacgaccccgtgagaggccccgacggcaagacccacggcaacaagtgcgccatgtgcaaggccgtgttccagaaggagaacgaggagagaaagagaaaggaggaggaggaccagagaaacgccgccggccacggcagcagcggcggcggcggcggcaacacccaggacgagtgcgccgagtacagagagcagatgaagaacggcagactgagctgcaccagagagagcgaccccgtgagagacgccgacggcaagagctacaacaaccagtgcaccatgtgcaaggccaagctggagagagaggccgagagaaagaacgagtacagcagaagcagaagcaacggcaccggcagcgagagcggcaaggacacctgcgacgagttcagaagccagatgaagaacggcaagctgatctgcaccagagagagcgaccccgtgagaggccccgacggcaagacccacggcaacaagtgcaccatgtgcaaggagaagctggagagagaggccgccgagaagaagaagaaggaggacgaggacagaagcaacaccggcgagagaagcaacaccggcgagagaagcaacgacaaggaggacctgtgcagagagttcagaagcatgcagagaaacggcaagctgatctgcaccagagagaacaaccccgtgagaggcccctacggcaagatgcacatcaacaagtgcgccatgtgccagagcatcttcgacagagaggccaacgagagaaagaagaaggacgaggagaagagcagcagcaagcccagcaacaacgccaaggacgagtgcagcgagttcagaaactacatcagaaacaacgagctgatctgccccagagagaacgaccccgtgcacggcgccgacggcaagttctacaccaacaagtgctacatgtgcagagccgtgttcctgaccgaggccctggagagagccaagctgcaggagaagcccagccacgtgagagccagccaggaggaggacagccccgacagcttcagcagcctggacagcgagatgtgcaaggactacagagtgctgcccagaatcggctacctgtgccccaaggacctgaagcccgtgtgcggcgacgacggccagacctacaacaacccctgcatgctgtgccacgagaacctgatcagacagaccaacacccacatcagaagcaccggcaagtgcgaggagagcagcacccccggcaccaccgccgccagcatgccccccagcgacgagtag

SEQ ID NO: 98451 - DNA, 3285 bp, Artificial Sequence
  Description of Artificial Sequence: Synthetic coding sequence
atgaagatcgccaccgtgagcgtgctgctgcccctggccctgtgcctgatccaggacgccgccagcaagaacgaggaccaggagatgtgccacgagttccaggccttcatgaagaacggcaagctgttctgcccccaggacaagaagttcttccagagcctggacggcatcatgttcatcaacaagtgcgccacctgcaagatgatcctggagaaggaggccaagagccagaagagagccagacacctggccagagcccccaaggccaccgcccccaccgagctgaactgcgacgacttcaagaagggcgagagagacggcgacttcatctgccccgactactacgaggccgtgtgcggcaccgacggcaagacctacgacaacagatgcgccctgtgcgccgagaacgccaagaccggcagccagatcggcgtgaagagcgagggcgagtgcaagagcagcaaccccgagcaggacgtgtgcagcgccttcagacccttcgtgagagacggcagactgggctgcaccagagagaacgaccccgtgctgggccccgacggcaagacccacggcaacaagtgcgccatgtgcgccgagctgttcctgaaggaggccgagaacgccaagagagagggcgagaccagaatcagaagaaacgccgagaaggacttctgcaaggagtacgagaagcaggtgagaaacggcagactgttctgcaccagagagagcgaccccgtgagaggccccgacggcagaatgcacggcaacaagtgcgccctgtgcgccgagatcttcaagcagagattcagcgaggagaacagcaagaccgaccagaacctgggcaaggccgaggagaagaccaaggtgaagagagagatcgtgaagctgtgcagccagtaccagaaccaggccaagaacggcatcctgttctgcaccagagagaacgaccccatcagaggccccgacggcaagatgcacggcaacctgtgcagcatgtgccaggcctacttccaggccgagaacgaggagaagaagaaggccgaggccagagccagaaacaagagagagagcggcaaggccaccagctacgccgagctgtgcagcgagtacagaaagctggtgagaaacggcaagctggcctgcaccagagagaacgaccccatccagggccccgacggcaaggtgcacggcaacacctgcagcatgtgcgaggtgttcttccaggccgaggaggaggagaagaagaagaaggagggcaagagcagaaacaagagacagagcaagagcaccgccagcttcgaggagctgtgcagcgagtacagaaagagcagaaagaacggcagactgttctgcaccagagagaacgaccccatccagggccccgacggcaagatgcacggcaacacctgcagcatgtgcgaggccttcttccagcaggaggagagagccagagccaaggccaagagagaggccgccaaggagatctgcagcgagttcagagaccaggtgagaaacggcaccctgatctgcaccagagagcacaaccccgtgagaggccccgacggcaagatgcacggcaacaagtgcgccatgtgcgccagcgtgttcaagctggaggaggaggagaagaagaacgacaaggaggagaagggcaaggtggaggccgagaaggtgaagagagaggccgtgcaggagctgtgcagcgagtacagacactacgtgagaaacggcagactgccctgcaccagagagaacgaccccatcgagggcctggacggcaagatccacggcaacacctgcagcatgtgcgaggccttcttccagcaggaggccaaggagaaggagagagccgagcccagagccaaggtgaagagagaggccgagaaggagacctgcgacgagttcagaagactgctgcagaacggcaagctgttctgcaccagagagaacgaccccgtgagaggccccgacggcaagacccacggcaacaagtgcgccatgtgcaaggccgtgttccagaaggagaacgaggagagaaagagaaaggaggaggaggaccagagaaacgccgccggccacggcagcagcggcggcggcggcggcaacacccaggacgagtgcgccgagtacagagagcagatgaagaacggcagactgagctgcaccagagagagcgaccccgtgagagacgccgacggcaagagctacaacaaccagtgcaccatgtgcaaggccaagctggagagagaggccgagagaaagaacgagtacagcagaagcagaagcaacggcaccggcagcgagagcggcaaggacacctgcgacgagttcagaagccagatgaagaacggcaagctgatctgcaccagagagagcgaccccgtgagaggccccgacggcaagacccacggcaacaagtgcaccatgtgcaaggagaagctggagagagaggccgccgagaagaagaagaaggaggacgaggacagaagcaacaccggcgagagaagcaacaccggcgagagaagcaacgacaaggaggacctgtgcagagagttcagaagcatgcagagaaacggcaagctgatctgcaccagagagaacaaccccgtgagaggcccctacggcaagatgcacatcaacaagtgcgccatgtgccagagcatcttcgacagagaggccaacgagagaaagaagaaggacgaggagaagagcagcagcaagcccagcaacaacgccaaggaccagtgcagacaggtgcagaacgaggccgaggacgccaagttcagacagcccggcagaagcctggccagcgtggccagaatgagcaccgacgagtgcagcgagttcagaaactacatcagaaacaacgagctgatctgccccagagagaacgaccccgtgcacggcgccgacggcaagttctacaccaacaagtgctacatgtgcagagccgtgttcctgaccgaggccctggagagagccaagctgcaggagaagcccagccacgtgagagccagccaggaggaggacagccccgacagcttcagcagcctggacagcgagatgtgcaaggactacagagtgctgcccagaatcggctacctgtgccccaaggacctgaagcccgtgtgcggcgacgacggccagacctacaacaacccctgcatgctgtgccacgagaacctgatcagacagaccaacacccacatcagaagcaccggcaagtgcgaggagagcagcacccccggcaccaccgccgccagcatgccccccagcgacgagtag

SEQ ID NO: 98452 - DNA, 2751 bp, Artificial Sequence
  Description of Artificial Sequence: Synthetic coding sequence
atgaagatcgccaccgtgagcgtgctgctgcccctggccctgtgcctgatccaggacgccgccagcaagaacgaggaccaggagatgtgccacgagttccaggccttcatgaagaacggcaagctgttctgcccccaggacaagaagttcttccagagcctggacggcatcatgttcatcaacaagtgcgccacctgcaagatgatcctggagaaggaggccaagagccagaagagagccagacacctggccagagcccccaaggccaccgcccccaccgagctgaactgcgacgacttcaagaagggcgagagagacggcgacttcatctgccccgactactacgaggccgtgtgcggcaccgacggcaagacctacgacaacagatgcgccctgtgcgccgagaacgccaagaccggcagccagatcggcgtgaagagcgagggcgagtgcaagagcagcaaccccgagcaggacgtgtgcagcgccttcagacccttcgtgagagacggcagactgggctgcaccagagagaacgaccccgtgctgggccccgacggcaagacccacggcaacaagtgcgccatgtgcgccgagctgttcctgaaggaggccgagaacgccaagagagagggcgagaccagaatcagaagaaacgccgagaaggacttctgcaaggagtacgagaagcaggtgagaaacggcagactgttctgcaccagagagagcgaccccgtgagaggccccgacggcagaatgcacggcaacaagtgcgccctgtgcgccgagatcttcaagcagagattcagcgaggagaacagcaagaccgaccagaacctgggcaaggccgaggagaagaccaaggtgaagagagagatcgtgaagctgtgcagccagtaccagaaccaggccaagaacggcatcctgttctgcaccagagagaacgaccccatcagaggccccgacggcaagatgcacggcaacctgtgcagcatgtgccaggcctacttccaggccgagaacgaggagaagaagaaggccgaggccagagccagaaacaagagagagagcggcaaggccaccagctacgccgagctgtgcagcgagtacagaaagctggtgagaaacggcaagctggcctgcaccagagagaacgaccccatccagggccccgacggcaaggtgcacggcaacacctgcagcatgtgcgaggtgttcttccaggccgaggaggaggagaagaagaagaaggagggcaagagcagaaacaagagacagagcaagagcaccgccagcttcgaggagctgtgcagcgagtacagaaagagcagaaagaacggcagactgttctgcaccagagagaacgaccccatccagggccccgacggcaagatgcacggcaacacctgcagcatgtgcgaggccttcttccagcaggaggagagagccagagccaaggccaagagagaggccgccaaggagatctgcagcgagttcagagaccaggtgagaaacggcaccctgatctgcaccagagagcacaaccccgtgagaggccccgacggcaagatgcacggcaacaagtgcgccatgtgcgccagcgtgttcaagctggaggaggaggagaagaagaacgacaaggaggagaagggcaaggtggaggccgagaaggtgaagagagaggccgtgcaggagctgtgcagcgagtacagacactacgtgagaaacggcagactgccctgcaccagagagaacgaccccatcgagggcctggacggcaagatccacggcaacacctgcagcatgtgcgaggccttcttccagcaggaggccaaggagaaggagagagccgagcccagagccaaggtgaagagagaggccgagaaggagacctgcgacgagttcagaagactgctgcagaacggcaagctgttctgcaccagagagaacgaccccgtgagaggccccgacggcaagacccacggcaacaagtgcgccatgtgcaaggccgtgttccagaaggagaacgaggagagaaagagaaaggaggaggaggaccagagaaacgccgccggccacggcagcagcggcggcggcggcggcaacacccaggacgagtgcgccgagtacagagagcagatgaagaacggcagactgagctgcaccagagagagcgaccccgtgagagacgccgacggcaagagctacaacaaccagtgcaccatgtgcaaggccaagctggagagagaggccgagagaaagaacgagtacagcagaagcagaagcaacggcaccggcagcgagagcggcaaggacacctgcgacgagttcagaagccagatgaagaacggcaagctgatctgcaccagagagagcgaccccgtgagaggccccgacggcaagacccacggcaacaagtgcaccatgtgcaaggagaagctggagagagaggccgccgagaagaagaagaaggaggacgaggacagaagcaacaccggcgagagaagcaacaccggcgagagaagcaacgacaaggaggacctgtgcagagagttcagaagcatgcagagaaacggcaagctgatctgcaccagagagaacaaccccgtgagaggcccctacggcaagatgcacatcaacaagtgcgccatgtgccagagcatcttcgacagagaggccaacgagagaaagaagaaggacgaggagaagagcagcagcaagcccagcaacaacgccaaggtgatctactag

SEQ ID NO: 98453 - DNA, 261 bp, Artificial Sequence
  Description of Artificial Sequence: Synthetic coding sequence
atgagagccaccgccatcgtgctgctgctggccctgaccctggccaccatgttcagcatcgagtgcgccaagcagaccaagcagatggtggactgcagccactacaagaagctgccccccggccagcagagattctgccaccacatgtacgaccccatctgcggcagcgacggcaagacctacaagaacgactgcttcttctgcagcaaggtgaagaagaccgacggcaccctgaagttcgtgcacttcggcaagtgctag

SEQ ID NO: 98454 - DNA, 759 bp, Artificial Sequence
  Description of Artificial Sequence: Synthetic coding sequence
atggcccagctgtgcggcctgagaagaagcagagccttcctggccctgctgggcagcctgctgctgagcggcgtgctggccgccgacagagagagaagcatccacgacttctgcctggtgagcaaggtggtgggcagatgcagagccagcatgcccagatggtggtacaacgtgaccgacggcagctgccagctgttcgtgtacggcggctgcgacggcaacagcaacaactacctgaccaaggaggagtgcctgaagaagtgcgccaccgtgaccgagaacgccaccggcgacctggccaccagcagaaacgccgccgacagcagcgtgcccagcgcccccagaagacaggacagcgaggaccacagcagcgacatgttcaactacgaggagtactgcaccgccaacgccgtgaccggcccctgcagagccagcttccccagatggtacttcgacgtggagagaaacagctgcaacaacttcatctacggcggctgcagaggcaacaagaacagctacagaagcgaggaggcctgcatgctgagatgcttcagacagcaggagaacccccccctgcccctgggcagcaaggtggtggtgctggccggcctgttcgtgatggtgctgatcctgttcctgggcgccagcatggtgtacctgatcagagtggccagaagaaaccaggagagagccctgagaaccgtgtggagcagcggcgacgacaaggagcagctggtgaagaacacctacgtgctgtag

SEQ ID NO: 98455 - DNA, 588 bp, Artificial Sequence
  Description of Artificial Sequence: Synthetic coding sequence
atggcccagctgtgcggcctgagaagaagcagagccttcctggccctgctgggcagcctgctgctgagcggcgtgctggccgccgacagagagagaagcatccacgagaacgccaccggcgacctggccaccagcagaaacgccgccgacagcagcgtgcccagcgcccccagaagacaggacagcgaggaccacagcagcgacatgttcaactacgaggagtactgcaccgccaacgccgtgaccggcccctgcagagccagcttccccagatggtacttcgacgtggagagaaacagctgcaacaacttcatctacggcggctgcagaggcaacaagaacagctacagaagcgaggaggcctgcatgctgagatgcttcagacagcaggagaacccccccctgcccctgggcagcaaggtggtggtgctggccggcctgttcgtgatggtgctgatcctgttcctgggcgccagcatggtgtacctgatcagagtggccagaagaaaccaggagagagccctgagaaccgtgtggagcagcggcgacgacaaggagcagctggtgaagaacacctacgtgctgtag

SEQ ID NO: 98456 - DNA, 1299 bp, Artificial Sequence
  Description of Artificial Sequence: Synthetic coding sequence
atgagcgacaagctgccctacaaggtggccgacatcggcctggccgcctggggcagaaaggccctggacatcgccgagaacgagatgcccggcctgatgagaatgagagagagatacagcgccagcaagcccctgaagggcgccagaatcgccggctgcctgcacatgaccgtggagaccgccgtgctgatcgagaccctggtgaccctgggcgccgaggtgcagtggagcagctgcaacatcttcagcacccaggaccacgccgccgccgccatcgccaaggccggcatccccgtgtacgcctggaagggcgagaccgacgaggagtacctgtggtgcatcgagcagaccctgtacttcaaggacggccccctgaacatgatcctggacgacggcggcgacctgaccaacctgatccacaccaagtacccccagctgctgcccggcatcagaggcatcagcgaggagaccaccaccggcgtgcacaacctgtacaagatgatggccaacggcatcctgaaggtgcccgccatcaacgtgaacgacagcgtgaccaagagcaagttcgacaacctgtacggctgcagagagagcctgatcgacggcatcaagagagccaccgacgtgatgatcgccggcaaggtggccgtggtggccggctacggcgacgtgggcaagggctgcgcccaggccctgagaggcttcggcgccagagtgatcatcaccgagatcgaccccatcaacgccctgcaggccgccatggagggctacgaggtgaccaccatggacgaggcctgccaggagggcaacatcttcgtgaccaccaccggctgcatcgacatcatcctgggcagacacttcgagcagatgaaggacgacgccatcgtgtgcaacatcggccacttcgacgtggagatcgacgtgaagtggctgaacgagaacgccgtggagaaggtgaacatcaagccccaggtggacagatacagactgaagaacggcagaagaatcatcctgctggccgagggcagactggtgaacctgggctgcgccatgggccaccccagcttcgtgatgagcaacagcttcaccaaccaggtgatggcccagatcgagctgtggacccaccccgacaagtaccccgtgggcgtgcacttcctgcccaagaagctggacgaggccgtggccgaggcccacctgggcaagctgaacgtgaagctgaccaagctgaccgagaagcaggcccagtacctgggcatgagctgcgacggccccttcaagcccgaccactacagatactag

SEQ ID NO: 98457 - DNA, 1023 bp, Artificial Sequence
  Description of Artificial Sequence: Synthetic coding sequence
atgtgcgcccagtactgcatcagcttcgccgacgtggagaaggcccacatcaacatcagagacagcatccacctgacccccgtgctgaccagcagcatcctgaaccagctgaccggcagaaacctgttcttcaagtgcgagctgttccagaagaccggcagcttcaagatcagaggcgccctgaacgccgtgagaagcctggtgcccgacgccctggagagaaagcccaaggccgtggtgacccacagcagcggcaaccacggccaggccctgacctacgccgccaagctggagggcatccccgcctacatcgtggtgccccagaccgcccccgactgcaagaagctggccatccaggcctacggcgccagcatcgtgtactgcgagcccagcgacgagagcagagagaacgtggccaagagagtgaccgaggagaccgagggcatcatggtgcaccccaaccaggagcccgccgtgatcgccggccagggcaccatcgccctggaggtgctgaaccaggtgcccctggtggacgccctggtggtgcccgtgggcggcggcggcatgctggccggcatcgccatcaccgtgaaggccctgaagcccagcgtgaaggtgtacgccgccgagcccagcaacgccgacgactgctaccagagcaagctgaagggcaagctgatgcccaacctgtacccccccgagaccatcgccgacggcgtgaagagcagcatcggcctgaacacctggcccatcatcagagacctggtggacgacatcttcaccgtgaccgaggacgagatcaagtgcgccacccagctggtgtgggagagaatgaagctgctgatcgagcccaccgccggcgtgggcgtggccgccgtgctgagccagcacttccagaccgtgagccccgaggtgaagaacatctgcatcgtgctgagcggcggcaacgtggacctgaccagcagcatcacctgggtgaagcaggccgagagacccgccagctaccagagcgtgagcgtgtag

SEQ ID NO: 98458 - DNA, 1638 bp, Artificial Sequence
  Description of Artificial Sequence: Synthetic coding sequence
atggccgagcccagcggcagccccgtgcacgtgcagctgccccagcaggccgcccccgtgaccgccgccgccgccgccgcccccgccgccgccaccgccgcccccgcccccgccgcccccgccgcccccgcccccgcccccgcccccgccgcccaggccgtgggctggcccatctgcagagacgcctacgagctgcaggaggtgatcggcagcggcgccaccgccgtggtgcaggccgccctgtgcaagcccagacaggagagagtggccatcaagagaatcaacctggagaagtgccagaccagcatggacgagctgctgaaggagatccaggccatgagccagtgcagccaccccaacgtggtgacctactacaccagcttcgtggtgaaggacgagctgtggctggtgatgaagctgctgagcggcggcagcatgctggacatcatcaagtacatcgtgaacagaggcgagcacaagaacggcgtgctggaggaggccatcatcgccaccatcctgaaggaggtgctggagggcctggactacctgcacagaaacggccagatccacagagacctgaaggccggcaacatcctgctgggcgaggacggcagcgtgcagatcgccgacttcggcgtgagcgccttcctggccaccggcggcgacgtgaccagaaacaaggtgagaaagaccttcgtgggcaccccctgctggatggcccccgaggtgatggagcaggtgagaggctacgacttcaaggccgacatgtggagcttcggcatcaccgccatcgagctggccaccggcgccgccccctaccacaagtacccccccatgaaggtgctgatgctgaccctgcagaacgacccccccaccctggagaccggcgtggaggacaaggagatgatgaagaagtacggcaagagcttcagaaagctgctgagcctgtgcctgcagaaggaccccagcaagagacccaccgccgccgagctgctgaagtgcaagttcttccagaaggccaagaacagagagtacctgatcgagaagctgctgaccagaacccccgacatcgcccagagagccaagaaggtgagaagagtgcccggcagcagcggccacctgcacaagaccgaggacggcgactgggagtggagcgacgacgagatggacgagaagagcgaggagggcaaggccgccttcagccaggagaagagcagaagagtgaaggaggagaaccccgagatcgccgtgagcgccagcaccatccccgagcagatccagagcctgagcgtgcacgacagccagggcccccccaacgccaacgaggactacagagaggccagcagctgcgccgtgaacctggtgctgagactgagaaacagcagaaaggagctgaacgacatcagattcgagttcacccccggcagagacaccgccgacggcgtgagccaggagctgttcagcgccggcctggtggacggccacgacgtggtgatcgtggccgccaacctgcagaagatcgtggacgaccccaaggccctgaagaccctgaccttcaagctggccagcggctgcgacggcagcgagatccccgacgaggtgaagctgatcggcttcgcccagctgagcgtgagctag

SEQ ID NO: 98459 - DNA, 2715 bp, Artificial Sequence
  Description of Artificial Sequence: Synthetic coding sequence
atggacgccggcttcttcagaggcaccagcgccgagcaggacaacagattcagcaacaagcagaagaagctgctgaagcagctgaagttcgccgagtgcctggagaagaaggtggacatgagcaaggtgaacctggaggtgatcaagccctggatcaccaagagagtgaccgagatcctgggcttcgaggacgacgtggtgatcgagttcatcttcaaccagctggaggtgaagaaccccgacagcaagatgatgcagatcaacctgaccggcttcctgaacggcaagaacgccagagagttcatgggcgagctgtggcccctgctgctgagcgcccaggagaacatcgccggcatccccagcgccttcctggagctgaagaaggaggagatcaagcagagacagatcgagcaggagaagctggccagcatgaagaagcaggacgaggacaaggacaagagagacaaggaggagaaggagagcagcagagagaagagagagagaagcagaagccccagaagaagaaagagcagaagccccagccccagaagaagaagcagccccgtgagaagagagagaaagagaagccacagcagaagccccagacacagaaccaagagcagaagccccagccccgcccccgagaagaaggagaagacccccgagctgcccgagcccagcgtgaaggtgaaggagcccagcgtgcaggaggccaccagcaccagcgacatcctgaaggtgcccaagcccgagcccatccccgagcccaaggagcccagccccgagaagaacagcaagaaggagaaggagaaggagaagaccagacccagaagcagaagcagaagcaagagcagaagcagaaccagaagcagaagccccagccacaccagacccagaagaagacacagaagcagaagcagaagctacagccccagaagaagacccagccccagaagaagacccagccccagaagaagaaccccccccagaagaatgccccccccccccagacacagaagaagcagaagccccgtgagaagaagaagaagaagcagcgccagcctgagcggcagcagcagcagcagcagcagcagcagaagcagaagcccccccaagaagccccccaagagaaccagcagcccccccagaaagaccagaagactgagccccagcgccagcccccccagaagaagacacagacccagcccccccgccacccccccccccaagaccagacacagccccaccccccagcagagcaacagaaccagaaagagcagagtgagcgtgagccccggcagaaccagcggcaaggtgaccaagcacaagggcaccgagaagagagagagccccagccccgcccccaagcccagaaaggtggagctgagcgagagcgaggaggacaagggcggcaagatggccgccgccgacagcgtgcagcagagaagacagtacagaagacagaaccagcagagcagcagcgacagcggcagcagcagcagcagcgaggacgagagacccaagagaagccacgtgaagaacggcgaggtgggcagaagaagaagacacagccccagcagaagcgccagccccagccccagaaagagacagaaggagaccagccccagaggcagaagaagaagaagccccagccccccccccaccagaagaagaagaagccccagccccgcccccccccccagaagaagaagaacccccacccccccccccagaagaagaacccccagccccccccccagaagaagaagccccagccccagaagatacagcccccccatccagagaagatacagccccagccccccccccaagagaagaaccgccagccccccccccccccccaagagaagagccagccccagccccccccccaagagaagagtgagccacagccccccccccaagcagagaagcagccccgtgaccaagagaagaagccccagcctgagcagcaagcacagaaagggcagcagccccagcagaagcaccagagaggccagaagcccccagcccaacaagagacacagccccagccccagacccagagccccccagaccagcagcagccccccccccgtgagaagaggcgccagcagcagcccccagagaagacagagccccagccccagcaccagacccatcagaagagtgagcagaacccccgagcccaagaagatcaagaaggccgccagccccagcccccagagcgtgagaagagtgagcagcagcagaagcgtgagcggcagccccgagcccgccgccaagaagccccccgccccccccagccccgtgcagagccagagccccagcaccaactggagccccgccgtgcccgtgaagaaggccaagagccccacccccagccccagcccccccagaaacagcgaccaggagggcggcggcaagaagaagaagaagaagaaggacaagaagcacaagaaggacaagaagcacaagaagcacaagaagcacaagaaggagaaggccgtggccgccgccgccgccgccgccgtgacccccgccgccatcgccgccgccaccaccaccctggcccaggaggagcccgtggccgcccccgagcccaagaaggagaccgagagcgaggccgaggacaacctggacgacctggagaagcacctgagagagaaggccctgagaagcatgagaaaggcccaggtgagcccccagagctag

SEQ ID NO: 98460 - DNA, 2742 bp, Artificial Sequence
  Description of Artificial Sequence: Synthetic coding sequence
atggacgccggcttcttcagaggcaccagcgccgagcaggacaacagattcagcaacaagcagaagaagctgctgaagcagctgaagttcgccgagtgcctggagaagaaggtggacatgagcaaggtgaacctggaggtgatcaagccctggatcaccaagagagtgaccgagatcctgggcttcgaggacgacgtggtgatcgagttcatcttcaaccagctggaggtgaagaaccccgacagcaagatgatgcagatcaacctgaccggcttcctgaacggcaagaacgccagagagttcatgggcgagctgtggcccctgctgctgagcgcccaggagaacatcgccggcatccccagcgccttcctggagctgaagaaggaggagatcaagcagagacagatcgagcaggagaagctggccagcatgaagaagcaggacgaggacaaggacaagagagacaaggaggagaaggagagcagcagagagaagagagagagaagcagaagccccagaagaagaaagagcagaagccccagccccagaagaagaagcagccccgtgagaagagagagaaagagaagccacagcagaagccccagacacagaaccaagagcagaagccccagccccgcccccgagaagaaggagaagacccccgagctgcccgagcccagcgtgaaggtgaaggagcccagcgtgcaggaggccaccagcaccagcgacatcctgaaggtgcccaagcccgagcccatccccgagcccaaggagcccagccccgagaagaacagcaagaaggagaaggagaaggagaagaccagacccagaagcagaagcagaagcaagagcagaagcagaaccagaagcagaagccccagccacaccagacccagaagaagacacagaagcagaagcagaagaagacccagccccagaagaagacccagccccagaagaagaaccccccccagaagaatgccccccccccccagacacagaagaagcagaagccccgtgagaagaagaagaagaagcagcgccagcctgagcggcagcagcagcagcagcagcagcagcagaagcagaagcccccccaagaagccccccaagagaaccagcagcccccccagaaagaccagaagactgagccccagcgccagcccccccagaagaagacacagacccagcccccccgccacccccccccccaagaccagacacagccccaccccccagcagagcaacagaaccagaaagagcagagtgagcgtgagccccggcagaaccagcggcaaggtgaccaagcacaagggcaccgagaagagagagagccccagccccgcccccaagcccagaaaggtggagctgagcgagagcgaggaggacaagggcggcaagatggccgccgccgacagcgtgcagcagagaagacagtacagaagacagaaccagcagagcagcagcgacagcggcagcagcagcagcagcgaggacgagagacccaagagaagccacgtgaagaacggcgaggtgggcagaagaagaagacacagccccagcagaagcgccagccccagccccagaaagagacagaaggagaccagccccagaatgcagatgggcaagagatggcagagccccgtgaccaagagcggcagaagaagaagaagccccagccccccccccaccagaagaagaagaagccccagccccgcccccccccccagaagaagaagaacccccacccccccccccagaagaagaacccccagccccccccccagaagaagaagccccagccccagaagatacagcccccccatccagagaagatacagccccagccccccccccaagagaagaaccgccagccccccccccccccccaagagaagagccagccccagccccccccccaagagaagagtgagccacagccccccccccaagcagagaagcagccccgtgaccaagagaagaagccccagcctgagcagcaagcacagaaagggcagcagccccagcagaagcaccagagaggccagaagcccccagcccaacaagagacacagccccagccccagacccagagccccccagaccagcagcagccccccccccgtgagaagaggcgccagcagcagcccccagagaagacagagccccagccccagcaccagacccatcagaagagtgagcagaacccccgagcccaagaagatcaagaaggccgccagccccagcccccagagcgtgagaagagtgagcagcagcagaagcgtgagcggcagccccgagcccgccgccaagaagccccccgccccccccagccccgtgcagagccagagccccagcaccaactggagccccgccgtgcccgtgaagaaggccaagagccccacccccagccccagcccccccagaaacagcgaccaggagggcggcggcaagaagaagaagaagaagaaggacaagaagcacaagaaggacaagaagcacaagaagcacaagaagcacaagaaggagaaggccgtggccgccgccgccgccgccgccgtgacccccgccgccatcgccgccgccaccaccaccctggcccaggaggagcccgtggccgcccccgagcccaagaaggagaccgagagcgaggccgaggacaacctggacgacctggagaagcacctgagagagaaggccctgagaagcatgagaaaggcccaggtgagcccccagagctag

SEQ ID NO: 98461 - DNA, 2751 bp, Artificial Sequence
  Description of Artificial Sequence: Synthetic coding sequence
atggacgccggcttcttcagaggcaccagcgccgagcaggacaacagattcagcaacaagcagaagaagctgctgaagcagctgaagttcgccgagtgcctggagaagaaggtggacatgagcaaggtgaacctggaggtgatcaagccctggatcaccaagagagtgaccgagatcctgggcttcgaggacgacgtggtgatcgagttcatcttcaaccagctggaggtgaagaaccccgacagcaagatgatgcagatcaacctgaccggcttcctgaacggcaagaacgccagagagttcatgggcgagctgtggcccctgctgctgagcgcccaggagaacatcgccggcatccccagcgccttcctggagctgaagaaggaggagatcaagcagagacagatcgagcaggagaagctggccagcatgaagaagcaggacgaggacaaggacaagagagacaaggaggagaaggagagcagcagagagaagagagagagaagcagaagccccagaagaagaaagagcagaagccccagccccagaagaagaagcagccccgtgagaagagagagaaagagaagccacagcagaagccccagacacagaaccaagagcagaagccccagccccgcccccgagaagaaggagaagacccccgagctgcccgagcccagcgtgaaggtgaaggagcccagcgtgcaggaggccaccagcaccagcgacatcctgaaggtgcccaagcccgagcccatccccgagcccaaggagcccagccccgagaagaacagcaagaaggagaaggagaaggagaagaccagacccagaagcagaagcagaagcaagagcagaagcagaaccagaagcagaagccccagccacaccagacccagaagaagacacagaagcagaagcagaagctacagccccagaagaagacccagccccagaagaagacccagccccagaagaagaaccccccccagaagaatgccccccccccccagacacagaagaagcagaagccccgtgagaagaagaagaagaagcagcgccagcctgagcggcagcagcagcagcagcagcagcagcagaagcagaagcccccccaagaagccccccaagagaaccagcagcccccccagaaagaccagaagactgagccccagcgccagcccccccagaagaagacacagacccagcccccccgccacccccccccccaagaccagacacagccccaccccccagcagagcaacagaaccagaaagagcagagtgagcgtgagccccggcagaaccagcgtgaccaagcacaagggcaccgagaagagagagagccccagccccgcccccaagcccagaaaggtggagctgagcgagagcgaggaggacaagggcggcaagatggccgccgccgacagcgtgcagcagagaagacagtacagaagacagaaccagcagagcagcagcgacagcggcagcagcagcagcagcgaggacgagagacccaagagaagccacgtgaagaacggcgaggtgggcagaagaagaagacacagccccagcagaagcgccagccccagccccagaaagagacagaaggagaccagccccagaatgcagatgggcaagagatggcagagccccgtgaccaagagcggcagaagaagaagaagccccagccccccccccaccagaagaagaagaagccccagccccgcccccccccccagaagaagaagaacccccacccccccccccagaagaagaacccccagccccccccccagaagaagaagccccagccccagaagatacagcccccccatccagagaagatacagccccagccccccccccaagagaagaaccgccagccccccccccccccccaagagaagagccagccccagccccccccccaagagaagagtgagccacagccccccccccaagcagagaagcagccccgtgaccaagagaagaagccccagcctgagcagcaagcacagaaagggcagcagccccagcagaagcaccagagaggccagaagcccccagcccaacaagagacacagccccagccccagacccagagccccccagaccagcagcagccccccccccgtgagaagaggcgccagcagcagcccccagagaagacagagccccagccccagcaccagacccatcagaagagtgagcagaacccccgagcccaagaagatcaagaaggccgccagccccagcccccagagcgtgagaagagtgagcagcagcagaagcgtgagcggcagccccgagcccgccgccaagaagccccccgccccccccagccccgtgcagagccagagccccagcaccaactggagccccgccgtgcccgtgaagaaggccaagagccccacccccagccccagcccccccagaaacagcgaccaggagggcggcggcaagaagaagaagaagaagaaggacaagaagcacaagaaggacaagaagcacaagaagcacaagaagcacaagaaggagaaggccgtggccgccgccgccgccgccgccgtgacccccgccgccatcgccgccgccaccaccaccctggcccaggaggagcccgtggccgcccccgagcccaagaaggagaccgagagcgaggccgaggacaacctggacgacctggagaagcacctgagagagaaggccctgagaagcatgagaaaggcccaggtgagcccccagagctag

SEQ ID NO: 98462 - DNA, 957 bp, Artificial Sequence
  Description of Artificial Sequence: Synthetic coding sequence
atgggcgagctgtggcccctgctgctgagcgcccaggagaacatcgccggcatccccagcgccttcctggagctgaagaaggaggagatcaagcagagacagatcgagcaggagaagctggccagcatgaagaagcaggacgaggacaaggacaagagagacaaggaggagaaggagagcagcagagagaagagagagagaagcagaagccccagaagaaccaagagcagaagccccagccccgcccccgagaagaaggagaagacccccgagctgcccgagcccagcgtgaaggtgaaggagcccagcgtgcaggaggccaccagcaccagcgacatcctgaaggtgcccaagcccgagcccatccccgagcccaaggagcccagccccgagaagaacagcaagaaggagaaggagaaggagaagaccagacccagaagcagaagcagaagcaagagcagaagcagaaccagaagcagaagccccagccacaccagacccagaagaagacacagaagcagaagcagaagctacagccccagaagaagacccagccccagaagaagacccagccccagaagaagaaccccccccagaagaatgccccccccccccagacacagaagaagcagaagccccgtgagaagattcagcggcatcctgccccccaaggtgaacagcgccgaggaggacgtgagacagcacccctgcctgggcgtggcccaccaccccctgcacctggtgcacggccaccaccagagaagcctgcccagaggccaccccgcccccctgggcaagctggtgggctacctgctgcagcaggtgctgcagggcgagggcaccggccaccacctgctgcagctgcaccaccccaagctgggcatccccctgcaccccagcagccagaccgtgcaggagaaggtggtgttcctgtgcctgcagggcgagctgcagtag

SEQ ID NO: 98463 - DNA, 8259 bp, Artificial Sequence
  Description of Artificial Sequence: Synthetic coding sequence
atgtacaacggcatcggcctgcccacccccagaggcagcggcaccaacggctacgtgcagagaaacctgagcctggtgagaggcagaagaggcgagagacccgactacaagggcgaggaggagctgagaagactggaggccgccctggtgaagagacccaaccccgacatcctggaccacgagagaaagagaagagtggagctgagatgcctggagctggaggagatgatggaggagcagggctacgaggagcagcagatccaggagaaggtggccaccttcagactgatgctgctggagaaggacgtgaaccccggcggcaaggaggagacccccggccagagacccgccgtgaccgagacccaccagctggccgagctgaacgagaagaagaacgagagactgagagccgccttcggcatcagcgacagctacgtggacggcagcagcttcgacccccagagaagagccagagaggccaagcagcccgcccccgagccccccaagccctacagcctggtgagagagagcagcagcagcagaagccccacccccaagcagaagaagaagaagaagaagaaggacagaggcagaagaagcgagagcagcagccccagaagagagagaaagaagagcagcaagaagaagaagcacagaagcgagagcgagagcaagaagagaaagcacagaagccccacccccaagagcaagagaaagagcaaggacaagaagagaaagagaagcagaagcaccacccccgcccccaagagcagaagagcccacagaagcaccagcgccgacagcgccagcagcagcgacaccagcagaagcagaagcagaagcgccgccgccaagacccacaccaccgccctggccggcagaagccccagccccgccagcggcagaagaggcgagggcgacgcccccttcagcgagcccggcaccaccagcacccagagacccagcagccccgagaccgccaccaagcagcccagcagcccctacgaggacaaggacaaggacaagaaggagaagagcgccaccagacccagccccagccccgagagaagcagcaccggccccgagccccccgcccccacccccctgctggccgagagacacggcggcagcccccagcccctggccaccacccccctgagccaggagcccgtgaacccccccagcgaggccagccccaccagagacagaagcccccccaagagccccgagaagctgccccagagcagcagcagcgagagcagcccccccagcccccagcccaccaaggtgagcagacacgccagcagcagccccgagagccccaagcccgcccccgcccccggcagccacagagagatcagcagcagccccaccagcaagaacagaagccacggcagagccaagagagacaagagccacagccacacccccagcagaagaatgggcagaagcagaagccccgccaccgccaagagaggcagaagcagaagcagaacccccaccaagagaggccacagcagaagcagaagcccccagtggagaagaagcagaagcgcccagagatggggcagaagcagaagcccccagagaagaggcagaagcagaagcccccagagacccggctggagcagaagcagaaacacccagagaagaggcagaagcagaagcgccagaagaggcagaagccacagcagaagccccgccaccagaggcagaagcagaagcagaacccccgccagaagaggcagaagcagaagcagaacccccgccagaagaagaagcagaagcagaacccccaccagaagaagaagcagaagcagaacccccgccagaagaggcagaagcagaagcagaacccccgccagaagaagaagcagaaccagaagccccgtgagaagaagaagcagaagcagaagccccgccagaagaagcggcagaagcagaagcagaacccccgccagaagaggcagaagcagaagcagaacccccgccagaagaggcagaagcagaagcagaacccccgccagaagaagcggcagaagcagaagcagaacccccgccagaagaggcagaagcagaagcagaacccccagaagaggcagaagcagaagcagaagcctggtgagaagaggcagaagccacagcagaaccccccagagaagaggcagaagcggcagcagcagcgagagaaagaacaagagcagaaccagccagagaagaagcagaagcaacagcagccccgagatgaagaagagcagaatcagcagcagaagaagcagaagcctgagcagccccagaagcaaggccaagagcagactgagcctgagaagaagcctgagcggcagcagcccctgccccaagcagaagagccagaccccccccagaagaagcagaagcggcagcagccagcccaaggccaagagcagaaccccccccagaagaagcagaagcagcagcagccccccccccaagcagaagagcaagacccccagcagacagagccacagcagcagcagcccccaccccaaggtgaagagcggcaccccccccagacagggcagcatcaccagcccccaggccaacgagcagagcgtgaccccccagagaagaagctgcttcgagagcagccccgaccccgagctgaagagcagaacccccagcagacacagctgcagcggcagcagcccccccagagtgaagagcagcaccccccccagacagagccccagcagaagcagcagcccccagcccaaggtgaaggccatcatcagccccagacagagaagccacagcggcagcagcagccccagccccagcagagtgaccagcagaaccacccccagaagaagcagaagcgtgagcccctgcagcaacgtggagagcagactgctgcccagatacagccacagcggcagcagcagccccgacaccaaggtgaagcccgagaccccccccagacagagccacagcggcagcatcagcccctaccccaaggtgaaggcccagaccccccccggccccagcctgagcggcagcaagagcccctgcccccaggagaagagcaaggacagcctggtgcagagctgccccggcagcctgagcctgtgcgccggcgtgaagagcagcaccccccccggcgagagctacttcggcgtgagcagcctgcagctgaagggccagagccagaccagccccgaccacagaagcgacaccagcagccccgaggtgagacagagccacagcgagagccccagcctgcagagcaagagccagaccagccccaagggcggcagaagcagaagcagcagccccgtgaccgagctggccagcagaagccccatcagacaggacagaggcgagttcagcgccagccccatgctgaagagcggcatgagccccgagcagagcagattccagagcgacagcagcagctaccccaccgtggacagcaacagcctgctgggccagagcagactggagaccgccgagagcaaggagaagatggccctgcccccccaggaggacgccaccgccagcccccccagacagaaggacaagttcagccccttccccgtgcaggacagacccgagagcagcctggtgttcaaggacaccctgagaaccccccccagagagagaagcggcgccggcagcagccccgagaccaaggagcagaacagcgccctgcccaccagcagccaggacgaggagctgatggaggtggtggagaagagcgaggagcccgccggccagatcctgagccacctgagcagcgagctgaaggagatgagcaccagcaacttcgagagcagccccgaggtggaggagagacccgccgtgagcctgaccctggaccagagccagagccaggccagcctggaggccgtggaggtgcccagcatggccagcagctggggcggcccccacttcagccccgagcacaaggagctgagcaacagccccctgagagagaacagcttcggcagccccctggagttcagaaacagcggccccctgggcaccgagatgaacaccggcttcagcagcgaggtgaaggaggacctgaacggccccttcctgaaccagctggagaccgaccccagcctggacatgaaggagcagagcaccagaagcagcggccacagcagcagcgagctgagccccgacgccgtggagaaggccggcatgagcagcaaccagagcatcagcagccccgtgctggacgccgtgcccagaacccccagcagagagagaagcagcagcgccagcagccccgagatgaaggacggcctgcccagaacccccagcagaagaagcagaagcggcagcagccccggcctgagagacggcagcggcacccccagcagacacagcctgagcggcagcagccccggcatgaaggacatccccagaacccccagcagaggcagaagcgagtgcgacagcagccccgagcccaaggccctgccccagacccccagacccagaagcagaagccccagcagccccgagctgaacaacaagtgcctgaccccccagagagagagaagcggcagcgagagcagcgtggaccagaagaccgtggccagaacccccctgggccagagaagcagaagcggcagcagccaggagctggacgtgaagcccagcgccagcccccaggagagaagcgagagcgacagcagccccgacagcaaggccaagaccagaacccccctgagacagagaagcagaagcggcagcagccccgaggtggacagcaagagcagactgagccccagaagaagcagaagcggcagcagccccgaggtgaaggacaagcccagagccgcccccagagcccagagcggcagcgacagcagccccgagcccaaggcccccgcccccagagccctgcccagaagaagcagaagcggcagcagcagcaagggcagaggccccagccccgagggcagcagcagcaccgagagcagccccgagcacccccccaagagcagaaccgccagaagaggcagcagaagcagccccgagcccaagaccaagagcagaaccccccccagaagaagaagcagcagaagcagccccgagctgaccagaaaggccagactgagcagaagaagcagaagcgccagcagcagccccgagaccagaagcagaaccccccccagacacagaagaagccccagcgtgagcagccccgagcccgccgagaagagcagaagcagcagaagaagaagaagcgccagcagccccagaaccaagaccaccagcagaagaggcagaagccccagccccaagcccagaggcctgcagagaagcagaagcagaagcagaagagagaagaccagaaccaccagaagaagagacagaagcggcagcagccagagcaccagcagaagaagacagagaagcagaagcagaagcagagtgaccagaagaagaagaggcggcagcggctaccacagcagaagccccgccagacaggagagcagcagaaccagcagcagaagaagaagaggcagaagcagaaccccccccaccagcagaaagagaagcagaagcagaaccagccccgccccctggaagagaagcagaagcagagccagccccgccacccacagaagaagcagaagcagaacccccctgatcagcagaagaagaagcagaagcagaaccagccccgtgagcagaagaagaagcagaagcagaaccagcgtgaccagaagaagaagcagaagcagagccagccccgtgagcagaagaagaagcagaagcagaaccccccccgtgaccagaagaagaagcagaagcagaacccccaccaccagaagaagaagcagaagcagaaccccccccgtgaccagaagaagaagcagaagcagaaccccccccgtgaccagaagaagaagcagaagcagaaccagccccatcaccagaagaagaagcagaagcagaaccagccccgtgaccagaagaagaagcagaagcagaaccagccccgtgaccagaagaagaagcagaagcagaaccagccccgtgaccagaagaagaagcagaagcagaaccccccccgccatcagaagaagaagcagaagcagaacccccctgctgcccagaaagagaagcagaagcagaagccccctggccatcagaagaagaagcagaagcagaacccccagaaccgccagaggcaagagaagcctgaccagaagcccccccgccatcagaagaagaagcgccagcggcagcagcagcgacagaagcagaagcgccaccccccccgccaccagaaaccacagcggcagcagaaccccccccgtggccctgaacagcagcagaatgagctgcttcagcagacccagcatgagccccacccccctggacagatgcagaagccccggcatgctggagcccctgggcagcagcagaacccccatgagcgtgctgcagcaggccggcggcagcatgatggacggccccggccccagaatccccgaccaccagagaaccagcgtgcccgagaaccacgcccagagcagaatcgccctggccctgaccgccatcagcctgggcaccgccagacccccccccagcatgagcgccgccggcctggccgccagaatgagccaggtgcccgcccccgtgcccctgatgagcctgagaaccgcccccgccgccaacctggccagcagaatccccgccgccagcgccgccgccatgaacctggccagcgccagaacccccgccatccccaccgccgtgaacctggccgacagcagaacccccgccgccgccgccgccatgaacctggccagccccagaaccgccgtggcccccagcgccgtgaacctggccgaccccagaacccccaccgcccccgccgtgaacctggccggcgccagaacccccgccgccctggccgccctgagcctgaccggcagcggcaccccccccaccgccgccaactaccccagcagcagcagaaccccccaggcccccgccagcgccaacctggtgggccccagaagcgcccacgccaccgcccccgtgaacatcgccggcagcagaaccgccgccgccctggcccccgccagcctgaccagcgccagaatggcccccgccctgagcggcgccaacctgaccagccccagagtgcccctgagcgcctacgagagagtgagcggcagaaccagcccccccctgctggacagagccagaagcagaaccccccccagcgcccccagccagagcagaatgaccagcgagagagcccccagccccagcagcagaatgggccaggcccccagccagagcctgctgccccccgcccaggaccagcccagaagccccgtgcccagcgccttcagcgaccagagcagatgcctgatcgcccagaccacccccgtggccggcagccagagcctgagcagcggcgccgtggccaccaccaccagcagcgccggcgaccacaacggcatgctgagcgtgcccgcccccggcgtgccccacagcgacgtgggcgagccccccgccagcaccggcgcccagcagcccagcgccctggccgccctgcagcccgccaaggagagaagaagcagcagcagcagcagcagcagcagcagcagcagcagcagcagcagcagcagcagcagcagcagcagcagcagcggcagcagcagcagcgacagcgagggcagcagcctgcccgtgcagcccgaggtggccctgaagagagtgcccagccccacccccgcccccaaggaggccgtgagagagggcagaccccccgagcccacccccgccaagagaaagagaagaagcagcagcagcagcagcagcagcagcagcagcagcagcagcagcagcagcagcagcagcagcagcagcagcagcagcagcagcagcagcagcagcagcagcagcagcagcagcagcagcagcagccccagccccgccaagcccggcccccaggccctgcccaagcccgccagccccaagaagcccccccccggcgagagaagaagcagaagccccagaaagcccatcgacagcctgagagacagcagaagcctgagctacagccccgtggagagaagaagacccagcccccagcccagccccagagaccagcagagcagcagcagcgagagaggcagcagaagaggccagagaggcgacagcagaagccccagccacaagagaagaagagagacccccagccccagacccatgagacacagaagcagcagaagcccctag

SEQ ID NO: 98464 - DNA, 702 bp, Artificial Sequence
  Description of Artificial Sequence: Synthetic coding sequence
atgatcagcttccccagcctgcagagaaccgagctggaggagatggacctgatcctgcagcaggagggctggcagctggacctgaagagaaacagcctgggctggaaggacctgcagagaagcagccaccccagcccctgcctgcaggccggcagacccctgccccagcccacctgcacccacagaggcctgcccaagctgagactgagcgaggagggcgactaccccgccagcgccagcacccccgagcccagaggcctgatcccccccagcggcaccttcctgagattcaacctggaccccctgtgctgcggcccccagcccgtggccagcgtgagcagaggctgggtgagcagccaccactgcagccccgagaactgctggctgacctggctgggcgagctgcccgcccccttcagcggcacccccccccccaccgccgtgccccccggccagggcagcagaagcagaagccccagaaagcccatcgacagcctgagagacagcagaagcctgagctacagccccgtggagagaagaagacccagcccccagcccagccccagagaccagcagagcagcagcagcgagagaggcagcagaagaggccagagaggcgacagcagaagccccagccacaagagaagaagagagacccccagccccagacccatgagacacagaagcagcagaagcccctag

SEQ ID NO: 98465 - DNA, 7005 bp, Artificial Sequence
  Description of Artificial Sequence: Synthetic coding sequence
atgtacaacggcatcggcctgcccacccccagaggcagcggcaccaacggctacgtgcagagaaacctgagcctggtgagaggcagaagaggcgagagacccgactacaagggcgaggaggagctgagaagactggaggccgccctggtgaagagacccaaccccgacatcctggaccacgagagaaagagaagagtggagctgagatgcctggagctggaggagatgatggaggagcagggctacgaggagcagcagatccaggagaaggtggccaccttcagactgatgctgctggagaaggacgtgaaccccggcggcaaggaggagacccccggccagagacccgccgtgaccgagacccaccagctggccgagctgaacgagaagaagaacgagagactgagagccgccttcggcatcagcgacagctacgtggacggcagcagcttcgacccccagagaagagccagagaggccaagcagcccgcccccgagccccccaagccctacagcctggtgagagagagcagcagcagcagaagccccacccccaagcagaagaagaagaagaagaagaaggacagaggcagaagaagcgagagcagcagccccagaagagagagaaagaagagcagcaagaagaagaagcacagaagcgagagcgagagcaagaagagaaagcacagaagccccacccccaagagcaagagaaagagcaaggacaagaagagaaagagaagcagaagcaccacccccgcccccaagagcagaagagcccacagaagcaccagcgccgacagcgccagcagcagcgacaccagcagaagcagaagcagaagcgccgccgccaagacccacaccaccgccctggccggcagaagccccagccccgccagcggcagaagaggcgagggcgacgcccccttcagcgagcccggcaccaccagcacccagagacccagcagccccgagaccgccaccaagcagcccagcagcccctacgaggacaaggacaaggacaagaaggagaagagcgccaccagacccagccccagccccgagagaagcagcaccggccccgagccccccgcccccacccccctgctggccgagagacacggcggcagcccccagcccctggccaccacccccctgagccaggagcccgtgaacccccccagcgaggccagccccaccagagacagaagcccccccaagagccccgagaagctgccccagagcagcagcagcgagagcagcccccccagcccccagcccaccaaggtgagcagacacgccagcagcagccccgagagccccaagcccgcccccgcccccggcagccacagagagatcagcagcagccccaccagcaagaacagaagccacggcagagccaagagagacaagagccacagccacacccccagcagaagaatgggcagaagcagaagccccgccaccgccaagagaggcagaagcagaagcagaacccccaccaagagaggccacagcagaagcagaagcccccagtggagaagaagcagaagcgcccagagatggggcagaagcagaagcccccagagaagaggcagaagcagaagcccccagagacccggctggagcagaagcagaaacacccagagaagaggcagaagcagaagcgccagaagaggcagaagccacagcagaagccccgccaccagaggcagaagcagaagcagaacccccgccagaagaggcagaagcagaagcagaacccccgccagaagaagaagcagaagcagaacccccaccagaagaagaagcagaagcagaacccccgccagaagaggcagaagcagaagcagaacccccgccagaagaagaagcagaaccagaagccccgtgagaagaagaagcagaagcagaagccccgccagaagaagcggcagaagcagaagcagaacccccgccagaagaggcagaagcagaagcagaacccccgccagaagaggcagaagcagaagcagaacccccgccagaagaagcggcagaagcagaagcagaacccccgccagaagaggcagaagcagaagcagaacccccagaagaggcagaagcagaagcagaagcctggtgagaagaggcagaagccacagcagaaccccccagagaagaggcagaagcggcagcagcagcgagagaaagaacaagagcagaaccagccagagaagaagcagaagcaacagcagccccgagatgaagaagagcagaatcagcagcagaagaagcagaagcctgagcagccccagaagcaaggccaagagcagactgagcctgagaagaagcctgagcggcagcagcccctgccccaagcagaagagccagaccccccccagaagaagcagaagcggcagcagccagcccaaggccaagagcagaaccccccccagaagaagcagaagcagcagcagccccccccccaagcagaagagcaagacccccagcagacagagccacagcagcagcagcccccaccccaaggtgaagagcggcaccccccccagacagggcagcatcaccagcccccaggccaacgagcagagcgtgaccccccagagaagaagctgcttcgagagcagccccgaccccgagctgaagagcagaacccccagcagacacagctgcagcggcagcagcccccccagagtgaagagcagcaccccccccagacagagccccagcagaagcagcagcccccagcccaaggtgaaggccatcatcagccccagacagagaagccacagcggcagcagcagccccagccccagcagagtgaccagcagaaccacccccagaagaagcagaagcgtgagcccctgcagcaacgtggagagcagactgctgcccagatacagccacagcggcagcagcagccccgacaccaaggtgaagcccgagaccccccccagacagagccacagcggcagcatcagcccctaccccaaggtgaaggcccagaccccccccggccccagcctgagcggcagcaagagcccctgcccccaggagaagagcaaggacagcctggtgcagagctgccccggcagcctgagcctgtgcgccggcgtgaagagcagcaccccccccggcgagagctacttcggcgtgagcagcctgcagctgaagggccagagccagaccagccccgaccacagaagcgacaccagcagccccgaggtgagacagagccacagcgagagccccagcctgcagagcaagagccagaccagccccaagggcggcagaagcagaagcagcagccccgtgaccgagctggccagcagaagccccatcagacaggacagaggcgagttcagcgccagccccatgctgaagagcggcatgagccccgagcagagcagattccagagcgacagcagcagctaccccaccgtggacagcaacagcctgctgggccagagcagactggagaccgccgagagcaaggagaagatggccctgcccccccaggaggacgccaccgccagcccccccagacagaaggacaagttcagccccttccccgtgcaggacagacccgagagcagcctggtgttcaaggacaccctgagaaccccccccagagagagaagcggcgccggcagcagccccgagaccaaggagcagaacagcgccctgcccaccagcagccaggacgaggagctgatggaggtggtggagaagagcgaggagcccgccggccagatcctgagccacctgagcagcgagctgaaggagatgagcaccagcaacttcgagagcagccccgaggtggaggagagacccgccgtgagcctgaccctggaccagagccagagccaggccagcctggaggccgtggaggtgcccagcatggccagcagctggggcggcccccacttcagccccgagcacaaggagctgagcaacagccccctgagagagaacagcttcggcagccccctggagttcagaaacagcggccccctgggcaccgagatgaacaccggcttcagcagcgaggtgaaggaggacctgaacggccccttcctgaaccagctggagaccgaccccagcctggacatgaaggagcagagcaccagaagcagcggccacagcagcagcgagctgagccccgacgccgtggagaaggccggcatgagcagcaaccagagcatcagcagccccgtgctggacgccgtgcccagaacccccagcagagagagaagcagcagcgccagcagccccgagatgaaggacggcctgcccagaacccccagcagaagaagcagaagcggcagcagccccggcctgagagacggcagcggcacccccagcagacacagcctgagcggcagcagccccggcatgaaggacatccccagaacccccagcagaggcagaagcgagtgcgacagcagccccgagcccaaggccctgccccagacccccagacccagaagcagaagccccagcagccccgagctgaacaacaagtgcctgaccccccagagagagagaagcggcagcgagagcagcgtggaccagaagaccgtggccagaacccccctgggccagagaagcagaagcggcagcagccaggagctggacgtgaagcccagcgccagcccccaggagagaagcgagagcgacagcagccccgacagcaaggccaagaccagaacccccctgagacagagaagcagaagcggcagcagccccgaggtggacagcaagagcagactgagccccagaagaagcagaagcggcagcagccccgaggtgaaggacaagcccagagccgcccccagagcccagagcggcagcgacagcagccccgagcccaaggcccccgcccccagagccctgcccagaagaagcagaagcggcagcagcagcaagggcagaggccccagccccgagggcagcagcagcaccgagagcagccccgagcacccccccaagagcagaaccgccagaagaggcagcagaagcagccccgagcccaagaccaagagcagaaccccccccagaagaagaagcagcagaagcagccccgagctgaccagaaaggccagactgagcagaagaagcagaagcgccagcagcagccccgagaccagaagcagaaccccccccagacacagaagaagccccagcgtgagcagccccgagcccgccgagaagagcagaagcagcagaagaagaagaagcgccagcagccccagaaccaagaccaccagcagaagaggcagaagccccagccccaagcccagaggcctgcagagaagcagaagcagaagcagaagagagaagaccagaaccaccagaagaagagacagaagcggcagcagccagagcaccagcagaagaagacagagaagcagaagcagaagcagagtgaccagaagaagaagaggcggcagcggctaccacagcagaagccccgccagacaggagagcagcagaaccagcagcagaagaagaagaggcagaagcagaaccccccccaccagcagaaagagaagcagaagcagaaccagccccgccccctggaagagaagcagaagcagagccagccccgccacccacagaagaagcagaagcagaacccccctgatcagcagaagaagaagcagaagcagaaccagccccgtgagcagaagaagaagcagaagcagaaccagcgtgaccagaagaagaagcagaagcagagccagccccgtgagcagaagaagaagcagaagcagaaccccccccgtgaccagaagaagaagcagaagcagaacccccaccaccagaagaagaagcagaagcagaaccccccccgtgaccagaagaagaagcagaagcagaaccccccccgtgaccagaagaagaagcagaagcagaaccagccccatcaccagaagaagaagcagaagcagaaccagccccgtgaccagaagaagaagcagaagcagaaccagccccgtgaccagaagaagaagcagaagcagaaccagccccgtgaccagaagaagaagcagaagcagaaccccccccgcccaggaccagcccagaagccccgtgcccagcgccttcagcgaccagagcagatgcctgatcgcccagaccacccccgtggccggcagccagagcctgagcagcggcgccgtggccaccaccaccagcagcgccggcgaccacaacggcatgctgagcgtgcccgcccccggcgtgccccacagcgacgtgggcgagccccccgccagcaccggcgcccagcagcccagcgccctggccgccctgcagcccgccaaggagagaagaagcagcagcagcagcagcagcagcagcagcagcagcagcagcagcagcagcagcagcagcagcagcagcagcagcggcagcagcagcagcgacagcgagggcagcagcctgcccgtgcagcccgaggtggccctgaagagagtgcccagccccacccccgcccccaaggaggccgtgagagagggcagaccccccgagcccacccccgccaagagaaagagaagaagcagcagcagcagcagcagcagcagcagcagcagcagcagcagcagcagcagcagcagcagcagcagcagcagcagcagcagcagcagcagcagcagcagcagcagcagcagcagcagcagcagccccagccccgccaagcccggcccccaggccctgcccaagcccgccagccccaagaagcccccccccggcgagagaagaagcagaagccccagaaagcccatcgacagcctgagagacagcagaagcctgagctacagccccgtggagagaagaagacccagcccccagcccagccccagagaccagcagagcagcagcagcgagagaggcagcagaagaggccagagaggcgacagcagaagccccagccacaagagaagaagagagacccccagccccagacccatgagacacagaagcagcagaagcccctag

SEQ ID NO: 98466 - DNA, 936 bp, Artificial Sequence
  Description of Artificial Sequence: Synthetic coding sequence
atgctgctggagaaggacgtgaaccccggcggcaaggaggagacccccggccagagacccgccgtgaccgagacccaccagctggccgagctgaacgagaagaagaacgagagactgagagccgccttcggcatcagcgacagctacgtggacggcagcagcttcgacccccagagaagagccagagaggccaagcagcccgcccccgagccccccaagccctacagcctggtgagagagagcagcagcagcagaagccccacccccaagcagaagaagaagaagaagaagaaggacagaggcagaagaagcgagagcagcagccccagaagagagagaaagaagagcagcaagaagaagaagcacagaagcgagagcgagagcaagaagagaaagcacagaagccccacccccaagagcaagagaaagagcaaggacaagaagagaaagagaagcagaagcaccacccccgcccccaagagcagaagagcccacagaagcaccagcgccgacagcgccagcagcagcgacaccagcagaagcagaagcagaagcgccgccgccaagacccacaccaccgccctggccggcagaagccccagccccgccagcggcagaagaggcgagggcgacgcccccttcagcgagcccggcaccaccagcacccagagacccagcagccccgagaccgccaccaagcagcccagcagcccctacgaggacaaggacaaggacaagaaggagaagagcgccaccagacccagccccagccccgagagaagcagcaccggccccgagccccccgcccccacccccctgctggccgagagacacggcggcagcccccagcccctggccaccacccccctgagccaggagcccgtgaaccccagcccccagctgttcatgttcctgaagggcatcctggtgttctag

SEQ ID NO: 98467 - DNA, 2871 bp, Artificial Sequence
  Description of Artificial Sequence: Synthetic coding sequence
agaagaagaagactgagaagagccgacagaagaggcgaggccgccgcccccggccccagagacagcggcgccagagccgccgccgccgccagacccctgcccctgggcggcggcggcagaagaagaagagtgagaggctacgaggagcagcagatccaggagaaggtggccaccttcagactgatgctgctggagaaggacgtgaaccccggcggcaaggaggagacccccggccagagacccgccgtgaccgagacccaccagctggccgagctgaacgagaagaagaacgagagactgagagccgccttcggcatcagcgacagctacgtggacggcagcagcttcgacccccagagaagagccagagaggccaagcagcccgcccccgagccccccaagccctacagcctggtgagagagagcagcagcagcagaagccccacccccaagcagaagaagaagaagaagaagaaggacagaggcagaagaagcgagagcagcagccccagaagagagagaaagaagagcagcaagaagaagaagcacagaagcgagagcgagagcaagaagagaaagcacagaagccccacccccaagagcaagagaaagagcaaggacaagaagagaaagagaagcagaagcaccacccccgcccccaagagcagaagagcccacagaagcaccagcgccgacagcgccagcagcagcgacaccagcagaagcagaagcagaagcgccgccgccaagacccacaccaccgccctggccggcagaagccccagccccgccagcggcagaagaggcgagggcgacgcccccttcagcgagcccggcaccaccagcacccagagacccagcagccccgagaccgccaccaagcagcccagcagcccctacgaggacaaggacaaggacaagaaggagaagagcgccaccagacccagccccagccccgagagaagcagcaccggccccgagccccccgcccccacccccctgctggccgagagacacggcggcagcccccagcccctggccaccacccccctgagccaggagcccgtgaacccccccagcgaggccagccccaccagagacagaagcccccccaagagccccgagaagctgccccagagcagcagcagcgagagcagcccccccagcccccagcccaccaaggtgagcagacacgccagcagcagccccgagagccccaagcccgcccccgcccccggcagccacagagagatcagcagcagccccaccagcaagaacagaagccacggcagagccaagagagacaagagccacagccacacccccagcagaagaatgggcagaagcagaagccccgccaccgccaagagaggcagaagcagaagcagaacccccaccaagagaggccacagcagaagcagaagcccccagtggagaagaagcagaagcgcccagagatggggcagaagcagaagcccccagagaagaggcagaagcagaagcccccagagacccggctggagcagaagcagaaacacccagagaagaggcagaagcagaagcgccagaagaggcagaagccacagcagaagccccgccaccagaggcagaagcagaagcagaacccccgccagaagaggcagaagcagaagcagaacccccgccagaagaagaagcagaagcagaacccccaccagaagaagaagcagaagcagaacccccgccagaagaggcagaagcagaagcagaacccccgccagaagaagaagcagaaccagaagccccgtgagaagaagaagcagaagcagaagccccgccagaagaagcggcagaagcagaagcagaacccccgccagaagaggcagaagcagaagcagaacccccgccagaagaggcagaagcagaagcagaacccccgccagaagaagcggcagaagcagaagcagaacccccgccagaagaggcagaagcagaagcagaacccccagaagaggcagaagcagaagcagaagcctggtgagaagaggcagaagccacagcagaaccccccagagaagaggcagaagcggcagcagcagcgagagaaagaacaagagcagaaccagccagagaagaagcagaagcaacagcagccccgagatgaagaagagcagaatcagcagcagaagaagcagaagcctgagcagccccagaagcaaggccaagagcagactgagcctgagaagaagcctgagcggcagcagcccctgccccaagcagaagagccagaccccccccagaagaagcagaagcggcagcagccagcccaaggccaagagcagaaccccccccagaagaagcagaagcagcagcagccccccccccaagcagaagagcaagacccccagcagacagagccacagcagcagcagcccccaccccaaggtgaagagcggcaccccccccagacagggcagcatcaccagcccccaggccaacgagcagagcgtgaccccccagagaagaagctgcttcgagagcagccccgaccccgagctgaagagcagaacccccagcagacacagctgcagcggcagcagcccccccagagtgaagagcagcaccccccccagacagagccccagcagaagcagcagcccccagcccaaggtgaaggccatcatcagccccagacagagaagccacagcggcagcagcagccccagccccagcagagtgaccagcagaaccacccccagaagaagcagaagcgtgagcccctgcagcaacgtggagagcagactgctgcccagatacagccacagcggcagcagcagccccgacaccaaggtgaagcccgagaccccccccagacagagccacagcggctag

SEQ ID NO: 98468 - DNA, 6036 bp, Artificial Sequence
  Description of Artificial Sequence: Synthetic coding sequence
atgaagaagagcagaatcagcagcagaagaagcagaagcctgagcagccccagaagcaaggccaagagcagactgagcctgagaagaagcctgagcggcagcagcccctgccccaagcagaagagccagaccccccccagaagaagcagaagcggcagcagccagcccaaggccaagagcagaaccccccccagaagaagcagaagcagcagcagccccccccccaagcagaagagcaagacccccagcagacagagccacagcagcagcagcccccaccccaaggtgaagagcggcaccccccccagacagggcagcatcaccagcccccaggccaacgagcagagcgtgaccccccagagaagaagctgcttcgagagcagccccgaccccgagctgaagagcagaacccccagcagacacagctgcagcggcagcagcccccccagagtgaagagcagcaccccccccagacagagccccagcagaagcagcagcccccagcccaaggtgaaggccatcatcagccccagacagagaagccacagcggcagcagcagccccagccccagcagagtgaccagcagaaccacccccagaagaagcagaagcgtgagcccctgcagcaacgtggagagcagactgctgcccagatacagccacagcggcagcagcagccccgacaccaaggtgaagcccgagaccccccccagacagagccacagcggcagcatcagcccctaccccaaggtgaaggcccagaccccccccggccccagcctgagcggcagcaagagcccctgcccccaggagaagagcaaggacagcctggtgcagagctgccccggcagcctgagcctgtgcgccggcgtgaagagcagcaccccccccggcgagagctacttcggcgtgagcagcctgcagctgaagggccagagccagaccagccccgaccacagaagcgacaccagcagccccgaggtgagacagagccacagcgagagccccagcctgcagagcaagagccagaccagccccaagggcggcagaagcagaagcagcagccccgtgaccgagctggccagcagaagccccatcagacaggacagaggcgagttcagcgccagccccatgctgaagagcggcatgagccccgagcagagcagattccagagcgacagcagcagctaccccaccgtggacagcaacagcctgctgggccagagcagactggagaccgccgagagcaaggagaagatggccctgcccccccaggaggacgccaccgccagcccccccagacagaaggacaagttcagccccttccccgtgcaggacagacccgagagcagcctggtgttcaaggacaccctgagaaccccccccagagagagaagcggcgccggcagcagccccgagaccaaggagcagaacagcgccctgcccaccagcagccaggacgaggagctgatggaggtggtggagaagagcgaggagcccgccggccagatcctgagccacctgagcagcgagctgaaggagatgagcaccagcaacttcgagagcagccccgaggtggaggagagacccgccgtgagcctgaccctggaccagagccagagccaggccagcctggaggccgtggaggtgcccagcatggccagcagctggggcggcccccacttcagccccgagcacaaggagctgagcaacagccccctgagagagaacagcttcggcagccccctggagttcagaaacagcggccccctgggcaccgagatgaacaccggcttcagcagcgaggtgaaggaggacctgaacggccccttcctgaaccagctggagaccgaccccagcctggacatgaaggagcagagcaccagaagcagcggccacagcagcagcgagctgagccccgacgccgtggagaaggccggcatgagcagcaaccagagcatcagcagccccgtgctggacgccgtgcccagaacccccagcagagagagaagcagcagcgccagcagccccgagatgaaggacggcctgcccagaacccccagcagaagaagcagaagcggcagcagccccggcctgagagacggcagcggcacccccagcagacacagcctgagcggcagcagccccggcatgaaggacatccccagaacccccagcagaggcagaagcgagtgcgacagcagccccgagcccaaggccctgccccagacccccagacccagaagcagaagccccagcagccccgagctgaacaacaagtgcctgaccccccagagagagagaagcggcagcgagagcagcgtggaccagaagaccgtggccagaacccccctgggccagagaagcagaagcggcagcagccaggagctggacgtgaagcccagcgccagcccccaggagagaagcgagagcgacagcagccccgacagcaaggccaagaccagaacccccctgagacagagaagcagaagcggcagcagccccgaggtggacagcaagagcagactgagccccagaagaagcagaagcggcagcagccccgaggtgaaggacaagcccagagccgcccccagagcccagagcggcagcgacagcagccccgagcccaaggcccccgcccccagagccctgcccagaagaagcagaagcggcagcagcagcaagggcagaggccccagccccgagggcagcagcagcaccgagagcagccccgagcacccccccaagagcagaaccgccagaagaggcagcagaagcagccccgagcccaagaccaagagcagaaccccccccagaagaagaagcagcagaagcagccccgagctgaccagaaaggccagactgagcagaagaagcagaagcgccagcagcagccccgagaccagaagcagaaccccccccagacacagaagaagccccagcgtgagcagccccgagcccgccgagaagagcagaagcagcagaagaagaagaagcgccagcagccccagaaccaagaccaccagcagaagaggcagaagccccagccccaagcccagaggcctgcagagaagcagaagcagaagcagaagagagaagaccagaaccaccagaagaagagacagaagcggcagcagccagagcaccagcagaagaagacagagaagcagaagcagaagcagagtgaccagaagaagaagaggcggcagcggctaccacagcagaagccccgccagacaggagagcagcagaaccagcagcagaagaagaagaggcagaagcagaaccccccccaccagcagaaagagaagcagaagcagaaccagccccgccccctggaagagaagcagaagcagagccagccccgccacccacagaagaagcagaagcagaacccccctgatcagcagaagaagaagcagaagcagaaccagccccgtgagcagaagaagaagcagaagcagaaccagcgtgaccagaagaagaagcagaagcagagccagccccgtgagcagaagaagaagcagaagcagaaccccccccgtgaccagaagaagaagcagaagcagaacccccaccaccagaagaagaagcagaagcagaaccccccccgtgaccagaagaagaagcagaagcagaaccccccccgtgaccagaagaagaagcagaagcagaaccagccccatcaccagaagaagaagcagaagcagaaccagccccgtgaccagaagaagaagcagaagcagaaccagccccgtgaccagaagaagaagcagaagcagaaccagccccgtgaccagaagaagaagcagaagcagaaccccccccgccatcagaagaagaagcagaagcagaacccccctgctgcccagaaagagaagcagaagcagaagccccctggccatcagaagaagaagcagaagcagaacccccagaaccgccagaggcaagagaagcctgaccagaagcccccccgccatcagaagaagaagcgccagcggcagcagcagcgacagaagcagaagcgccaccccccccgccaccagaaaccacagcggcagcagaaccccccccgtggccctgaacagcagcagaatgagctgcttcagcagacccagcatgagccccacccccctggacagatgcagaagccccggcatgctggagcccctgggcagcagcagaacccccatgagcgtgctgcagcaggccggcggcagcatgatggacggccccggccccagaatccccgaccaccagagaaccagcgtgcccgagaaccacgcccagagcagaatcgccctggccctgaccgccatcagcctgggcaccgccagacccccccccagcatgagcgccgccggcctggccgccagaatgagccaggtgcccgcccccgtgcccctgatgagcctgagaaccgcccccgccgccaacctggccagcagaatccccgccgccagcgccgccgccatgaacctggccagcgccagaacccccgccatccccaccgccgtgaacctggccgacagcagaacccccgccgccgccgccgccatgaacctggccagccccagaaccgccgtggcccccagcgccgtgaacctggccgaccccagaacccccaccgcccccgccgtgaacctggccggcgccagaacccccgccgccctggccgccctgagcctgaccggcagcggcaccccccccaccgccgccaactaccccagcagcagcagaaccccccaggcccccgccagcgccaacctggtgggccccagaagcgcccacgccaccgcccccgtgaacatcgccggcagcagaaccgccgccgccctggcccccgccagcctgaccagcgccagaatggcccccgccctgagcggcgccaacctgaccagccccagagtgcccctgagcgcctacgagagagtgagcggcagaaccagcccccccctgctggacagagccagaagcagaaccccccccagcgcccccagccagagcagaatgaccagcgagagagcccccagccccagcagcagaatgggccaggcccccagccagagcctgctgccccccgcccaggaccagcccagaagccccgtgcccagcgccttcagcgaccagagcagatgcctgatcgcccagaccacccccgtggccggcagccagagcctgagcagcggcgccgtggccaccaccaccagcagcgccggcgaccacaacggcatgctgagcgtgcccgcccccggcgtgccccacagcgacgtgggcgagccccccgccagcaccggcgcccagcagcccagcgccctggccgccctgcagcccgccaaggagagaagaagcagcagcagcagcagcagcagcagcagcagcagcagcagcagcagcagcagcagcagcagcagcagcagcagcggcagcagcagcagcgacagcgagggcagcagcctgcccgtgcagcccgaggtggccctgaagagagtgcccagccccacccccgcccccaaggaggccgtgagagagggcagaccccccgagcccacccccgccaagagaaagagaagaagcagcagcagcagcagcagcagcagcagcagcagcagcagcagcagcagcagcagcagcagcagcagcagcagcagcagcagcagcagcagcagcagcagcagcagcagcagcagcagcagcagccccagccccgccaagcccggcccccaggccctgcccaagcccgccagccccaagaagcccccccccggcgagagaagcctgctgcccgtgagccccagccccagacacagcctgccccacgtggccagaggcaccttcctgaagagaaccagcggctacttcccccccctgcacaagagcttcggcaccccctgcggcctgcaggacaaggccccccccctgagagagtggagagtgagactgttcaccaacggcccctgccccccctgcgtgctgctgctgcccgcccccacccacgccctgtgcagcagccacacccagagactggccgtgtag

SEQ ID NO: 98469 - DNA, 1836 bp, Artificial Sequence
  Description of Artificial Sequence: Synthetic coding sequence
atggccagcgtgcagcagggcgagaagcagctgttcgagaagttctggagaggcaccttcaaggccgtggccacccccagacccgagagcatcatcgtggccagcatcaccgccagaaagcccctgcccagaaccgagccccagaacaaccccgtggtgcccgcccaggacggccccagcgagaagctgggccagcacctggccaccgagcccctgggcaccaacagctgggagagagacaagacctgcagagagctgggcgccaccagaggccacagcgccagccacgacaaggacctgacccccccccccagcagcagaggcaagaagaagaagaagaagagcaccagaaagaagagaagaagaagcagcagctacagccccagccccgtgaagaagaagaagaagaagagcagcaagaagcacaagagaagaagaagcttcagcaagaagagaagacacagcagcagcagccccaagagcaagagaagagacgagaagagacacaagaagcagagcagaagcagacccagaaagagccacagacacagacaccacagatgccccagcagaagccagagcagcgagagcagacccagcagctgcgagagcagacacagaggcagaagccccgaggagggccagaagagcagaagaagacacagcagaagatgcagcaagaccctgtgcaaggacagccccgaggcccagagcagcagaccccccagccagcccctgcagatgctgggctacctgagcgccagaggcgtgatcaccggcagcggcagcgccgccgacctgttcaccaagaccgccagccccctgaccaccagcagaggcagaagccaggagtacgacagcggcaacgacaccagcagcccccccagcacccagaccagcagcgccagaagcagaggccaggagaagggcagccccagcggcggcctgagcaagagcagagagctgaacagcggcaacaccagcgacagcggcaacagcttcaccaccagcagcccccagaacaagggcgccatgctggagaacctgagccccaccagcagaggcagagagagcagaggcttccagagcccctgcctggagtgcgccgaggtgaagaagagcagcctggtgcccagcaccgccagaagcagccccatgaagggctgcagcagaagcagcagctacgccagcaccagaagcagcagccacagcagcagaagccccaaccccagagccagccccagatacacccagagcagaagcaccagcagcgagaagagaagctacagcagaagccccagctacagcagcaagagcggcaagagaagcccccccagcagaagcagcagaagcagaagaagccccagctacagcagatacagccccagcagagagagagaccccaagtacagcgagaaggacagccagcagagagagagagagagagccagaagaagaagaagaagctacagccccatgagaaagagaagaagagacagccccagccacctggaggccagaagaatcaccagcgccagaaagagacccatcccctactacagacccagccccagcagcagcggcagcctgagcagcaccagcagctggtacagcagcagcagcagcagaagcgccagcagaagctacagcagaagcagaagcagaagcagaagcagaagaagaagcagaaccagaaccagcagcagcagcagcagcagaagccccagccccggcagcagaagcagaagcagaagcagaagcagaagcagaagcagaagcagaagccagagcagaagctacagcagcgccgacagctacagcagcaccagaagatag

SEQ ID NO: 98470 - DNA, 747 bp, Artificial Sequence
  Description of Artificial Sequence: Synthetic coding sequence
atgagcggcggcggcgtgatcagaggccccgccggcaacaacgactgcagaatctacgtgggcaacctgccccccgacatcagaaccaaggacatcgaggacgtgttctacaagtacggcgccatcagagacatcgacctgaagaacagaagaggcggcccccccttcgccttcgtggagttcgaggaccccagagacgccgaggacgccgtgtacggcagagacggctacgactacgacggctacagactgagagtggagttccccagaagcggcagaggcaccggcagaggcggcggcggcggcggcggcggcggcgcccccagaggcagatacggcccccccagcagaagaagcgagaacagagtggtggtgagcggcctgccccccagcggcagctggcaggacctgaaggaccacatgagagaggccggcgacgtgtgctacgccgacgtgtacagagacggcaccggcgtggtggagttcgtgagaaaggaggacatgacctacgccgtgagaaagctggacaacaccaagttcagaagccacgagggcgagaccgcctacatcagagtgaaggtggacggccccagaagccccagctacggcagaagcagaagcagaagcagaagcagaagcagaagcagaagcagaagcaacagcagaagcagaagctacagccccagaagaagcagaggcagccccagatacagccccagacacagcagaagcagaagcagaacctag

SEQ ID NO: 98471 - DNA, 606 bp, Artificial Sequence
  Description of Artificial Sequence: Synthetic coding sequence
atgagcggcggcggcgtgatcagaggccccgccggcaacaacgactgcagaatctacgtgggcaacctgccccccgacatcagaaccaaggacatcgaggacgtgttctacaagtacggcgccatcagagacatcgacctgaagaacagaagaggcggcccccccttcgccttcgtggagttcgaggaccccagagacgccgaggacgccgtgtacggcagagacggctacgactacgacggctacagactgagagtggagttccccagaagcggcagaggcaccggcagaggcggcggcggcggcggcggcggcggcgcccccagaggcagatacggcccccccagcagaagaagcgagaacagagtggtggtgagcggcctgccccccagcggcagctggcaggacctgaaggaccacatgagagaggccggcgacgtgtgctacgccgacgtgtacagagacggcaccggcgtggtggagttcgtgagaaaggaggacatgacctacgccgtgagaaagctggacaacaccaagttcagaagccacgaggtgggctacaccagaatcctgttcttcgaccagaactggatccagtggagctag

SEQ ID NO: 98472 - DNA, 786 bp, Artificial Sequence
  Description of Artificial Sequence: Synthetic coding sequence
atgagcagatacctgagaccccccaacaccagcctgttcgtgagaaacgtggccgacgacaccagaagcgaggacctgagaagagagttcggcagatacggccccatcgtggacgtgtacgtgcccctggacttctacaccagaagacccagaggcttcgcctacgtgcagttcgaggacgtgagagacgccgaggacgccctgcacaacctggacagaaagtggatctgcggcagacagatcgagatccagttcgcccagggcgacagaaagacccccaaccagatgaaggccaaggagggcagaaacgtgtacagcagcagcagatacgacgactacgacagatacagaagaagcagaagcagaagctacgagagaagaagaagcagaagcagaagcttcgactacaactacagaagaagctacagccccagaaacagacccaccggcagacccagaagaagcagaagccacagcgacaacgacagattcaagcacagaaacagaagcttcagcagaagcaagagcaacagcagaagcagaagcaagagccagcccaagaaggagatgaaggccaagagcagaagcagaagcgccagccacaccaagaccagaggcaccagcaagaccgacagcaagacccactacaagagcggcagcagatacgagaaggagagcagaaagaaggagccccccagaagcaagagccagagcagaagccagagcagaagcagaagcaagagcagaagcagaagctggaccagccccaagagcagcggccactag

SEQ ID NO: 98473 - DNA, 552 bp, Artificial Sequence
  Description of Artificial Sequence: Synthetic coding sequence
atgagcagatacctgagaccccccaacaccagcctgttcgtgagaaacgtggccgacgacaccagaagcgaggacctgagaagagagttcggcagatacggccccatcgtggacgtgtacgtgcccctggacttctacaccagaagacccagaggcttcgcctacgtgcagttcgaggacgtgagagacgccgaggacgccctgcacaacctggacagaaagtggatctgcggcagacagatcgagatccagttcgcccagggcgacagaaagacccccaaccagatgaaggccaaggagggcagaaacgtgtacagcagcagcagatacgacgactacgacagatacagaagaagcagaagcagaagctacgagagaagaagaagcagaagcagaagcttcgactacaactacagaagaagctacagccccagaaacagcagacccaccggcagacccagaagaagcagaagccacagcgacaacgacagacccaactgcagctggaacacccagtacagcagcgcctactacaccagcagaaagatctag

SEQ ID NO: 98474 - DNA, 522 bp, Artificial Sequence
  Description of Artificial Sequence: Synthetic coding sequence
atgagcagatacctgagaccccccaacaccagcctgttcgtgagaaacgtggccgacgacaccagaagcgaggacctgagaagagagttcggcagatacggccccatcgtggacgtgtacgtgcccctggacttctacaccagaagacccagaggcttcgcctacgtgcagttcgaggacgtgagagacgccgaggacgccctgcacaacctggacagaaagtggatctgcggcagacagatcgagatccagttcgcccagggcgacagaaagacccccaaccagatgaaggccaaggagggcagaaacgtgtacagcagcagcagatacgacgactacgacagatacagaagaagcagaagcagaagctacgagagaagaagaagcagaagcagaagcttcgactacaactacagaagaagctacagccccagaaacagcagacccaccggcagacccagaagaagcagaagccacagcgacaacgacagccaggtgagcaagaagaagaacgagagatag

SEQ ID NO: 98475 - DNA, 519 bp, Artificial Sequence
  Description of Artificial Sequence: Synthetic coding sequence
atgagcagatacctgagaccccccaacaccagcctgttcgtgagaaacgtggccgacgacaccagaagcgaggacctgagaagagagttcggcagatacggccccatcgtggacgtgtacgtgcccctggacttctacaccagaagacccagaggcttcgcctacgtgcagttcgaggacgtgagagacgccgaggacgccctgcacaacctggacagaaagtggatctgcggcagacagatcgagatccagttcgcccagggcgacagaaagacccccaaccagatgaaggccaaggagggcagaaacgtgtacagcagcagcagatacgacgactacgacagatacagaagaagcagaagcagaagctacgagagaagaagaagcagaagcagaagcttcgactacaactacagaagaagctacagccccagaaacagacccaccggcagacccagaagaagcagaagccacagcgacaacgacagccaggtgagcaagaagaagaacgagagatag

SEQ ID NO: 98476 - DNA, 498 bp, Artificial Sequence
  Description of Artificial Sequence: Synthetic coding sequence
atgagcagatacctgagaccccccaacaccagcctgttcgtgagaaacgtggccgacgacaccagaagcgaggacctgagaagagagttcggcagatacggccccatcgtggacgtgtacgtgcccctggacttctacaccagaagacccagaggcttcgcctacgtgcagttcgaggacgtgagagacgccgaggacgccctgcacaacctggacagaaagtggatctgcggcagacagatcgagatccagttcgcccagggcgacagaaagacccccaaccagatgaaggccaaggagggcagaaacgtgtacagcagcagcagatacgacgactacgacagatacagaagaagcagaagcagaagctacgagagaagaagaagcagaagcagaagcttcgactacaactacagaagaagctacagccccagaaagcccaactgcagctggaacacccagtacagcagcgcctactacaccagcagaaagatctag

SEQ ID NO: 98477 - DNA, 549 bp, Artificial Sequence
  Description of Artificial Sequence: Synthetic coding sequence
atgagcagatacctgagaccccccaacaccagcctgttcgtgagaaacgtggccgacgacaccagaagcgaggacctgagaagagagttcggcagatacggccccatcgtggacgtgtacgtgcccctggacttctacaccagaagacccagaggcttcgcctacgtgcagttcgaggacgtgagagacgccgaggacgccctgcacaacctggacagaaagtggatctgcggcagacagatcgagatccagttcgcccagggcgacagaaagacccccaaccagatgaaggccaaggagggcagaaacgtgtacagcagcagcagatacgacgactacgacagatacagaagaagcagaagcagaagctacgagagaagaagaagcagaagcagaagcttcgactacaactacagaagaagctacagccccagaaacagacccaccggcagacccagaagaagcagaagccacagcgacaacgacagacccaactgcagctggaacacccagtacagcagcgcctactacaccagcagaaagatctag

SEQ ID NO: 98478 - DNA, 789 bp, Artificial Sequence
  Description of Artificial Sequence: Synthetic coding sequence
atgagcagatacctgagaccccccaacaccagcctgttcgtgagaaacgtggccgacgacaccagaagcgaggacctgagaagagagttcggcagatacggccccatcgtggacgtgtacgtgcccctggacttctacaccagaagacccagaggcttcgcctacgtgcagttcgaggacgtgagagacgccgaggacgccctgcacaacctggacagaaagtggatctgcggcagacagatcgagatccagttcgcccagggcgacagaaagacccccaaccagatgaaggccaaggagggcagaaacgtgtacagcagcagcagatacgacgactacgacagatacagaagaagcagaagcagaagctacgagagaagaagaagcagaagcagaagcttcgactacaactacagaagaagctacagccccagaaacagcagacccaccggcagacccagaagaagcagaagccacagcgacaacgacagattcaagcacagaaacagaagcttcagcagaagcaagagcaacagcagaagcagaagcaagagccagcccaagaaggagatgaaggccaagagcagaagcagaagcgccagccacaccaagaccagaggcaccagcaagaccgacagcaagacccactacaagagcggcagcagatacgagaaggagagcagaaagaaggagccccccagaagcaagagccagagcagaagccagagcagaagcagaagcaagagcagaagcagaagctggaccagccccaagagcagcggccactag

SEQ ID NO: 98479 - DNA, 1275 bp, Artificial Sequence
  Description of Artificial Sequence: Synthetic coding sequence
atgatcaacaaccacagaaaccaggccctgtacttcagcgagcacaagtacttccagcagacccaggtggtgtaccagggcgacatcttctgggtgttcctgtgcgtgttctgcctgagaaaggagtgcgtgctgatgcagggctgcttcagcgccggcgtgatccccgacgaggccaaggccctgagcctgctggcccccgccaacgccgtggccggcctgctgcccggcggcggcctgctgcccacccccaaccccctgacccagatcggcgccgtgcccctggccgccctgggcgcccccaccctggaccccgccctggccgccctgggcctgcccggcgccaacctgaacagccagagcctggccgccgaccagctgctgaagctgatgagcaccgtggaccccaagctgaaccacgtggccgccggcctggtgagccccagcctgaagagcgacaccagcagcaaggagatcgaggaggccatgaagagagtgagagaggcccagagcctgatcagcgccgccatcgagcccgacaagaaggaggagaagagaagacacagcagaagcagaagcagaagcagaagaagaagaacccccagcagcagcagacacagaagaagcagaagcagaagcagaagaagaagccacagcaagagcagaagcagaagaagaagcaagagccccagaagaagaagaagccacagcagagagagaggcagaagaagcagaagcaccagcaagaccagagacaagaagaaggaggacaaggagaagaagagaagcaagaccccccccaagagctacagcaccgccagaagaagcagaagcgccagcagagagagaagaagaagaagaagcagaagcggcaccagaagccccaagaagcccagaagccccaagagaaagctgagcagaagccccagccccagaagacacaagaaggagaagaagaaggacaaggacaaggagagaagcagagacgagagagagagaagcaccagcaagaagaagaagagcaaggacaaggagaaggacagagagagaaagagcgagagcgacaaggacgtgaagcaggtgaccagagactacgacgaggaggagcagggctacgacagcgagaaggagaagaaggaggagaagaagcccatcgagaccggcagccccaagaccaaggagtgcagcgtggagaagggcaccggcgacagcctgagagagagcaaggtgaacggcgacgaccaccacgaggaggacatggacatgagcgactag

SEQ ID NO: 98480 - DNA, 1455 bp, Artificial Sequence
  Description of Artificial Sequence: Synthetic coding sequence
atgagcaacaccaccgtggtgcccagcaccgccggccccggccccagcggcggccccggcggcggcggcggcggcggcggcggcggcggcggcaccgaggtgatccaggtgaccaacgtgagccccagcgccagcagcgagcagatgagaaccctgttcggcttcctgggcaagatcgacgagctgagactgttcccccccgacgacagccccctgcccgtgagcagcagagtgtgcttcgtgaagttccacgaccccgacagcgccgtggtggcccagcacctgaccaacaccgtgttcgtggacagagccctgatcgtggtgccctacgccgagggcgtgatccccgacgaggccaaggccctgagcctgctggcccccgccaacgccgtggccggcctgctgcccggcggcggcctgctgcccacccccaaccccctgacccagatcggcgccgtgcccctggccgccctgggcgcccccaccctggaccccgccctggccgccctgggcctgcccggcgccaacctgaacagccagagcctggccgccgaccagctgctgaagctgatgagcaccgtggaccccaagctgaaccacgtggccgccggcctggtgagccccagcctgaagagcgacaccagcagcaaggagatcgaggaggccatgaagagagtgagagaggcccagagcctgatcagcgccgccatcgagcccgacaagaaggaggagaagagaagacacagcagaagcagaagcagaagcagaagaagaagaacccccagcagcagcagacacagaagaagcagaagcagaagcagaagaagaagccacagcaagagcagaagcagaagaagaagcaagagccccagaagaagaagaagccacagcagagagagaggcagaagaagcagaagcaccagcaagaccagagacaagaagaaggaggacaaggagaagaagagaagcaagaccccccccaagagctacagcaccgccagaagaagcagaagcgccagcagagagagaagaagaagaagaagcagaagcggcaccagaagccccaagaagcccagaagccccaagagaaagctgagcagaagccccagccccagaagacacaagaaggagaagaagaaggacaaggacaaggagagaagcagagacgagagagagagaagcaccagcaagaagaagaagagcaaggacaaggagaaggacagagagagaaagagcgagagcgacaaggacgtgaagcaggtgaccagagactacgacgaggaggagcagggctacgacagcgagaaggagaagaaggaggagaagaagcccatcgagaccggcagccccaagaccaaggagtgcagcgtggagaagggcaccggcgacagcctgagagagagcaaggtgaacggcgacgaccaccacgaggaggacatggacatgagcgactag

SEQ ID NO: 98481 - DNA, 1452 bp, Artificial Sequence
  Description of Artificial Sequence: Synthetic coding sequence
atgagcaacaccaccgtggtgcccagcaccgccggccccggccccagcggcggccccggcggcggcggcggcggcggcggcggcggcggcggcaccgaggtgatccaggtgaccaacgtgagccccagcgccagcagcgagcagatgagaaccctgttcggcttcctgggcaagatcgacgagctgagactgttcccccccgacgacagccccctgcccgtgagcagcagagtgtgcttcgtgaagttccacgaccccgacagcgccgtggtggcccagcacctgaccaacaccgtgttcgtggacagagccctgatcgtggtgccctacgccgagggcgtgatccccgacgaggccaaggccctgagcctgctggcccccgccaacgccgtggccggcctgctgcccggcggcggcctgctgcccacccccaaccccctgacccagatcggcgccgtgcccctggccgccctgggcgcccccaccctggaccccgccctggccgccctgggcctgcccggcgccaacctgaacagccagagcctggccgccgaccagctgctgaagctgatgagcaccgtggaccccaagctgaaccacgtggccgccggcctggtgagccccagcctgaagagcgacaccagcagcaaggagatcgaggaggccatgaagagagtgagagaggcccagagcctgatcagcgccgccatcgagcccgacaagaaggaggagaagagaagacacagcagaagcagaagcagaagcagaagaagaagaacccccagcagcagcagacacagaagaagcagaagcagaagcagaagaagaagccacagcaagagcagaagcagaagaagaagcaagagccccagaagaagaagaagccacagcagagagagaggcagaagaagcagaagcaccagcaagaccagagacaagaagaaggaggacaaggagaagaagagaagcaagaccccccccaagagctacagcaccgccagaagaagcagaagcgccagcagagagagaagaagaagaagaagcagaagcggcaccagaagccccaagaagcccagaagccccaagagaaagctgagcagaagccccagccccagaagacacaagaaggagaagaagaaggacaaggacaaggagagaagcagagacgagagagagagaagcaccagcaagaagaagaagagcaaggacaaggagaaggacagagagagaaagagcgagagcgacaaggacgtgaaggtgaccagagactacgacgaggaggagcagggctacgacagcgagaaggagaagaaggaggagaagaagcccatcgagaccggcagccccaagaccaaggagtgcagcgtggagaagggcaccggcgacagcctgagagagagcaaggtgaacggcgacgaccaccacgaggaggacatggacatgagcgactag

SEQ ID NO: 98482 - DNA, 1170 bp, Artificial Sequence
  Description of Artificial Sequence: Synthetic coding sequence
atgagcaacaccaccgtggtgcccagcaccgccggccccggccccagcggcggccccggcggcggcggcggcggcggcggcggcggcggcggcaccgaggtgatccaggtgaccaacgtgagccccagcgccagcagcgagcagatgagaaccctgttcggcttcctgggcaagatcgacgagctgagactgttcccccccgacgacagccccctgcccgtgagcagcagagtgtgcttcgtgaagttccacgaccccgacagcgccgtggtggcccagcacctgaccaacaccgtgttcgtggacagagccctgatcgtggtgccctacgccgagggcgtgatccccgacgaggccaaggccctgagcctgctggcccccgccaacgccgtggccggcctgctgcccggcggcggcctgctgcccacccccaaccccctgacccagatcggcgccgtgcccctggccgccctgggcgcccccaccctggaccccgccctggccgccctgggcctgcccggcgccaacctgaacagccagagcctggccgccgaccagctgctgaagctgatgagcaccgtggaccccaagctgaaccacgtggccgccggcctggtgagccccagcctgaagagcgacaccagcagcaaggagatcgaggaggccatgaagagagtgagagaggcccagagcctgatcagcgccgccatcgagcccgacaagaaggaggagaagagaagacacagcagaagcagaagcagaagcagaagaagaagaacccccagcagcagcagacacagaagaagcagaagcagaagcagaagaagaagccacagcaagagcagaagcagaagaagaagcaagagccccagaagaagaagaagccacagcagagagagaggcagaagaagcagaagcaccagcaagaccagagacaagaagaaggaggacaaggagaagaagagaagcaagaccccccccaagagctacagcaccgccagaagaagcagaagcgccagcagcctgcacatctgcgacagcagagagagaagaagaagaagaagcagaagcggcaccagaagccccaagaagcccagaagccccaagagaaagctgagcagaagccccagccccagaagacacaagaaggagaagaagaaggacaagtag

SEQ ID NO: 98483 - DNA, 1455 bp, Artificial Sequence; identical to SEQ ID NO: 98480
  Description of Artificial Sequence: Synthetic coding sequence

SEQ ID NO: 98484 - DNA, 387 bp, Artificial Sequence
  Description of Artificial Sequence: Synthetic coding sequence
atgagcaacaccaccgtggtgcccagcaccgccggccccggccccagcggcggccccggcggcggcggcggcggcggcggcggcggcggcggcaccgaggtgatccaggtgaccaacgtgagccccagcgccagcagcgagcagatgagaaccctgttcggcttcctgggcaagatcgacgagctgagactgttcccccccgacgacagccccctgcccgtgagcagcagagtgtgcttcgtgaagttccacgaccccgacagcgccgtggtggcccagcacctgaccaacaccgtgttcgtggacagagccctgatcgtggtgccctacgccgaggtgaagcagcccaccagagtggtggtgcacaagaccgccttcgagagctag

SEQ ID NO: 98485 - DNA, 396 bp, Artificial Sequence
  Description of Artificial Sequence: Synthetic coding sequence
atgagcaacaccaccgtggtgcccagcaccgccggccccggccccagcggcggccccggcggcggcggcggcggcggcggcggcggcggcggcaccgaggtgatccaggtgaccaacgtgagccccagcgccagcagcgagcagatgagaaccctgttcggcttcctgggcaagatcgacgagctgagactgttcccccccgacgacagccccctgcccgtgagcagcagagtgtgcttcgtgaagttccacgaccccgacagcgccgtggtggcccagcacctgaccaacaccgtgttcgtggacagagccctgatcgtggtgccctacgccgaggtgttccacggcagcatcaaggccgccgtgaagaagatcctgctgacccacgagaactag

SEQ ID NO: 98486 - DNA, 630 bp, Artificial Sequence
  Description of Artificial Sequence: Synthetic coding sequence
atgaccagcctgaaggtggacaacctgacctacagaaccagccccgacaccctgagaagagtgttcgagaagtacggcagagtgggcgacgtgtacatccccagagacagatacaccaaggagagcagaggcttcgccttcgtgagattccacgacaagagagacgccgaggacgccatggacgccatggacggcgccgtgctggacggcagagagctgagagtgcagatggccagatacggcagaccccccgacagccaccacagcagaagaggccccccccccagaagatacggcggcggcggctacggcagaagaagcagaagccccagaagaagaagaagaagcagaagcagaagcagaagcagaagcagaagcagaagcagaagcagatacagcagaagcaagagcagaagcagaaccagaagcagaagcagaagcaccagcaagagcagaagcgccagaagaagcaagagcaagagcagcagcgtgagcagaagcagaagcagaagcagaagcagaagcagaagcagaagccccccccccgtgagcaagagagagagcaagagcagaagcagaagcaagagcccccccaagagccccgaggaggagggcgccgtgagcagctag

SEQ ID NO: 98487 - DNA, 606 bp, Artificial Sequence
  Description of Artificial Sequence: Synthetic coding sequence
atgagctacggcagacccccccccgacgtggagggcatgaccagcctgaaggtggacaacctgacctacagaaccagccccgacaccctgagaagagtgttcgagaagtacggcagagtgggcgacgtgtacatccccagagacagatacaccaaggagagcagaggcttcgccttcgtgagattccacgacaagagagacgccgaggacgccatggacgccatggacggcgccgtgctggacggcagagagctgagagtgcagatggccagatgcggcggctacggcagaagaagcagaagccccagaagaagaagaagaagcagaagcagaagcagaagcagaagcagaagcagaagcagaagcagatacagcagaagcaagagcagaagcagaaccagaagcagaagcagaagcaccagcaagagcagaagcgccagaagaagcaagagcaagagcagcagcgtgagcagaagcagaagcagaagcagaagcagaagcagaagcagaagccccccccccgtgagcaagagagagagcaagagcagaagcagaagcaagagcccccccaagagccccgaggaggagggcgccgtgagcagctag

SEQ ID NO: 98488 - DNA, 666 bp, Artificial Sequence
  Description of Artificial Sequence: Synthetic coding sequence
atgagctacggcagacccccccccgacgtggagggcatgaccagcctgaaggtggacaacctgacctacagaaccagccccgacaccctgagaagagtgttcgagaagtacggcagagtgggcgacgtgtacatccccagagacagatacaccaaggagagcagaggcttcgccttcgtgagattccacgacaagagagacgccgaggacgccatggacgccatggacggcgccgtgctggacggcagagagctgagagtgcagatggccagatacggcagaccccccgacagccaccacagcagaagaggccccccccccagaagatacggcggcggcggctacggcagaagaagcagaagccccagaagaagaagaagaagcagaagcagaagcagaagcagaagcagaagcagaagcagaagcagatacagcagaagcaagagcagaagcagaaccagaagcagaagcagaagcaccagcaagagcagaagcgccagaagaagcaagagcaagagcagcagcgtgagcagaagcagaagcagaagcagaagcagaagcagaagcagaagccccccccccgtgagcaagagagagagcaagagcagaagcagaagcaagagcccccccaagagccccgaggaggagggcgccgtgagcagctag

SEQ ID NO: 98489 - DNA, 540 bp, Artificial Sequence
  Description of Artificial Sequence: Synthetic coding sequence
atgagctacggcagacccccccccgacgtggagggcatgaccagcctgaaggtggacaacctgacctacagaaccagccccgacaccctgagaagagtgttcgagaagtacggcagagtgggcgacgtgtacatccccagagacagatacaccaaggagagcagaggcttcgccttcgtgagattccacgacaagagagacgccgaggacgccatggacgccatggacggcgccgaccccggcgtgggcgtggtgcccggcctggccgccgacctggccaccgccgccagaagcctgggccccgccctggtgctggacctgggcagaccccccagccccgacccccacgagggccccagccccagccccagaagaagccccgacctggtgagaggccccggccccggcctgggccccggcgtgctgccccagtgccccagaggcaaccccaaccccggcagagacagaagagtgccccccagcctgctgaagagaaaggagagatgccccctgaagaagatgctgagaagccccgtgtag

SEQ ID NO: 98490 - DNA, 669 bp, Artificial Sequence
  Description of Artificial Sequence: Synthetic coding sequence
cccgagagaagaggcgtggccccccccagagccgaggaggccggcgccagcagcagaggcagcggcccccccctgagagccatgagctacggcagacccccccccgacgtggagggcatgaccagcctgaaggtggacaacctgacctacagaaccagccccgacaccctgagaagagtgttcgagaagtacggcagagtgggcgacgtgtacatccccagagacagatacaccaaggagagcagaggcttcgccttcgtgagattccacgacaagagagacgccgaggacgccatggacgccatggacggcgccgtgctggacggcagagagctgagagtgcagatggccagatacggcagaccccccgacagccaccacagcagaagaggccccccccccagaagatacggcggcggcggctacggcagaagaagcagaagccccagaagaagaagaagaagcagaagcagaagcagaagcagaagcagaagcagaagcagaagcagatacagcagaagcaagagcagaagcagaaccagaagcagaagcagaagcaccagcaagagcagaagcgccagaagaagcaagagcaagagcagcagcgtgagcagaagcagaagcagaagcagaagcagaagcagaagcagaagccccccccccgtgtag

SEQ ID NO: 98491 - DNA, 375 bp, Artificial Sequence
  Description of Artificial Sequence: Synthetic coding sequence
atgcacagagacagctgccccctggactgcaaggtgtacgtgggcaacctgggcaacaacggcaacaagaccgagctggagagagccttcggctactacggccccctgagaagcgtgtgggtggccagaaacccccccggcttcgccttcgtggagttcgaggaccccagagacgccgccgacgccgtgagagagctggacggcagaaccctgtgcggctgcagagtgagagtggagctgagcaacggcgagaagagaagcagaaacagaggccccccccccagctggggcagaagacccagagacgactacagaagaagaagccccccccccagaagaagagtgaccatcatgagcctgctgaccaccctgtag

SEQ ID NO: 98492 - DNA, 495 bp, Artificial Sequence
  Description of Artificial Sequence: Synthetic coding sequence
atgcacagagacagctgccccctggactgcaaggtgtacgtgggcaacctgggcaacaacggcaacaagaccgagctggagagagccttcggctactacggccccctgagaagcgtgtgggtggccagaaacccccccggcttcgccttcgtggagttcgaggaccccagagacgccgccgacgccgtgagagagctggacggcagaaccctgtgcggctgcagagtgagagtggagctgagcaacggcgagaagagaagcagaaacagaggccccccccccagctggggcagaagacccagagacgactacagaagaagaagccccccccccagaagaagaagccccagaagaagaagcttcagcagaagcagaagcagaagcctgagcagagacagaagaagagagagaagcctgagcagagagagaaaccacaagcccagcagaagcttcagcagaagcagaagcagaagcagaagcaacgagagaaagtag

SEQ ID NO: 98493 - DNA, 1485 bp, Artificial Sequence
  Description of Artificial Sequence: Synthetic coding sequence
atgcccagagtgtacatcggcagactgagctaccaggccagagagagagacgtggagagattcttcaagggctacggcaagatcctggaggtggacctgaagaacggctacggcttcgtggagttcgacgacctgagagacgccgacgacgccgtgtacgagctgaacggcaaggacctgtgcggcgagagagtgatcgtggagcacgccagaggccccagaagagacggcagctacggcagcggcagaagcggctacggctacagaagaagcggcagagacaagtacggcccccccaccagaaccgagtacagactgatcgtggagaacctgagcagcagatgcagctggcaggacctgaaggactacatgagacaggccggcgaggtgacctacgccgacgcccacaagggcagaaagaacgagggcgtgatcgagttcgtgagctacagcgacatgaagagagccctggagaagctggacggcaccgaggtgaacggcagaaagatcagactggtggaggacaagcccggcagcagaagaagaagaagctacagcagaagcagaagccacagcagaagcagaagcagaagcagacacagcagaaagagcagaagcagaagcggcagcagcaagagcagccacagcaagagcagaagcagaagcagaagcggcagcagaagcagaagcaagagcagaagcagaagccagagcagaagcagaagcaagaaggagaagagcagaagccccagcaaggagaagagcagaagcagaagccacagcgccggcaagagcagaagcaagagcaaggaccaggccgaggagaagatccagaacaacgacaacgtgggcaagcccaagagcagaagccccagcagacacaagagcaagagcaagagcagaagcagaagccaggagagaagagtggaggaggagaagagaggcagcgtgagcagaggcagaagccaggagaagagcctgagacagagcagaagcagaagcagaagcaagggcggcagcagaagcagaagcagaagcagaagcaagagcaaggacaagagaaagggcagaaagagaagcagagaggagagcagaagcagaagcagaagcagaagcaagagcgagagaagcagaaagagaggcagcaagagagacagcaaggccggcagcagcaagaagaagaagaaggaggacaccgacagaagccagagcagaagccccagcagaagcgtgagcaaggagagagagcacgccaagagcgagagcagccagagagagggcagaggcgagagcgagaacgccggcaccaaccaggagaccagaagcagaagcagaagcaacagcaagagcaagcccaacctgcccagcgagagcagaagcagaagcaagagcgccagcaagaccagaagcagaagcaagagcagaagcagaagcgccagcagaagccccagcagaagcagaagcagaagccacagcagaagctag

SEQ ID NO: 98494 - DNA, 1221 bp, Artificial Sequence
  Description of Artificial Sequence: Synthetic coding sequence
atgcccagagtgtacatcggcagactgagctaccaggccagagagagagacgtggagagattcttcaagggctacggcaagatcctggaggtggacctgaagaacggctacggcttcgtggagttcgacgacctgagagacgccgacgacgccgtgtacgagctgaacggcaaggacctgtgcggcgagagagtgatcgtggagcacgccagaggccccagaagagacggcagctacggcagcggcagaagcggctacggctacagaagaagcggcagagacaagtacggcccccccaccagaaccgagtacagactgatcgtggagaacctgagcagcagatgcagctggcaggacctgaaggactacatgagacaggccggcgaggtgacctacgccgacgcccacaagggcagaaagaacgagggcgtgatcgagttcgtgagctacagcgacatgaagagagccctggagaagctggacggcaccgaggtgaacggcagaaagatcagactggtggaggacaagcccggcagcagaagaagaagaagctacagcagaagcagaagccacagcagaagcagaagcagaagcagacacagcagaaagagcagaagcagaagcggcagcagcaagagcagccacagcaagagcagaagcagaagcagaagcggcagcagaagcagaagcaagagcagaagcagaagccagagcagaagcagaagcaagaaggagaagagcagaagccccagcaaggagaagagcagaagcagaagccacagcgccggcaagagcagaagcaagagcaaggaccaggccgaggagaagatccagaacaacgacaacgtgggcaagcccaagagcagaagccccagcagacacaagagcaagagcaagagcagaagcagaagccaggagagaagagtggaggaggagaagagaggcagcgtgagcagaggcagaagccaggagaagagcctgagacagagcagaagcagaagcagaagcaagggcggcagcagaagcagaagcagaagcagaagcaagagcaaggacaagagaaagggcagaaagagaagcagagaggagagcagaagcagaagcagaagcagaagcaagagcgagagaagcagaaagagaggcagcctggccttcagacccggcctgagctacagagagctgagcaacctggacggcagcaaggccggcatgaccacctag

SEQ ID NO: 98495 - DNA, 477 bp, Artificial Sequence
  Description of Artificial Sequence: Synthetic coding sequence
atgcccagagtgtacatcggcagactgagctaccaggccagagagagagacgtggagagattcttcaagggctacggcaagatcctggaggtggacctgaagaacggctacggcttcgtggagttcgacgacctgagagacgccgacgacgccgtgtacgagctgaacggcaaggacctgtgcggcgagagagtgatcgtggagcacgccagaggccccagaagagacggcagctacggcagcggcagaagcggctacggctacagaagaagcggcagagacaagtacggcccccccaccagaaccgagtacagactgatcgtggagaacctgagcagcagatgcagctggcaggacctgaaggtgggcctgcccctgcccgagcaggagcccgagcccgagcccgagagcgagcccgagcaggagagagagaagcaggagccccagcagggcaaggagccccagccccagccctag

SEQ ID NO: 98496 - DNA, 819 bp, Artificial Sequence
  Description of Artificial Sequence: Synthetic coding sequence
atgagcggctgcagagtgttcatcggcagactgaaccccgccgccagagagaaggacgtggagagattcttcaagggctacggcagaatcagagacatcgacctgaagagaggcttcggcttcgtggagttcgaggaccccagagacgccgacgacgccgtgtacgagctggacggcaaggagctgtgcagcgagagagtgaccatcgagcacgccagagccagaagcagaggcggcagaggcagaggcagatacagcgacagattcagcagcagaagacccagaaacgacagaagaaacgccccccccgtgagaaccgagaacagactgatcgtggagaacctgagcagcagagtgagctggcaggacctgaaggacttcatgagacaggccggcgaggtgaccttcgccgacgcccacagacccaagctgaacgagggcgtggtggagttcgccagctacggcgacctgaagaacgccatcgagaagctgagcggcaaggagatcaacggcagaaagatcaagctgatcgagggcagcaagagacacagcagaagcagaagcagaagcagaagcagaaccagaagcagcagcagaagcagaagcagaagcagaagcagaagcagaaagagctacagcagaagcagaagcagaagcagaagcagaagcagaagcaagagcagaagcgtgagcagaagccccgtgcccgagaagagccagaagagaggcagcagcagcagaagcaagagccccgccagcgtggacagacagagaagcagaagcagaagcagaagcagaagcgtggacagcggcaactag

SEQ ID NO: 98497 - DNA, 417 bp, Artificial Sequence
  Description of Artificial Sequence: Synthetic coding sequence
atgagcggctgcagagtgttcatcggcagactgaaccccgccgccagagagaaggacgtggagagattcttcaagggctacggcagaatcagagacatcgacctgaagagaggcttcggcttcgtggagttcgaggaccccagagacgccgacgacgccgtgtacgagctggacggcaaggagctgtgcagcgagagagtgaccatcgagcacgccagagccagaagcagaggcggcagaggcagaggcagatacagcgacagattcagcagcagaagacccagaaacgacagaagaaacgccccccccgtgagaaccgagaacagactgatcgtggagaacctgagcagcagagtgagctggcagcccgtgtgcgtggtgggcctgatgaccagaagcgcctgcggcctgagctag

SEQ ID NO: 98498 - DNA, 819 bp, Artificial Sequence; identical to SEQ ID NO: 98496
  Description of Artificial Sequence: Synthetic coding sequence

SEQ ID NO: 98499 - DNA, 819 bp, Artificial Sequence; identical to SEQ ID NO: 98496
  Description of Artificial Sequence: Synthetic coding sequence

SEQ ID NO: 98500 - DNA, 1035 bp, Artificial Sequence
  Description of Artificial Sequence: Synthetic coding sequence
atgcccagagtgtacatcggcagactgagctacaacgtgagagagaaggacatccagagattcttcagcggctacggcagactgctggaggtggacctgaagaacggctacggcttcgtggagttcgaggacagcagagacgccgacgacgccgtgtacgagctgaacggcaaggagctgtgcggcgagagagtgatcgtggagcacgccagaggccccagaagagacagagacggctacagctacggcagcagaagcggcggcggcggctacagcagcagaagaaccagcggcagagacaagtacggcccccccgtgagaaccgagtacagactgatcgtggagaacctgagcagcagatgcagctggcaggacctgaaggacttcatgagacaggccggcgaggtgacctacgccgacgcccacaaggagagaaccaacgagggcgtgatcgagttcagaagctacagcgacatgaagagagccctggacaagctggacggcaccgagatcaacggcagaaacatcagactgatcgaggacaagcccagaaccagccacagaagaagctacagcggcagcagaagcagaagcagaagcagaagaagaagcagaagcagaagcagaagaagcagcagaagcagaagcagaagcatcagcaagagcagaagcagaagcagaagcagaagcaagggcagaagcagaagcagaagcaagggcagaaagagcagaagcaagagcaagagcaagcccaagagcgacagaggcagccacagccacagcagaagcagaagcaaggacgagtacgagaagagcagaagcagaagcagaagcagaagccccaaggagaacggcaagggcgacatcaagagcaagagcagaagcagaagccagagcagaagcaacagccccctgcccgtgccccccagcaaggccagaagcgtgagccccccccccaagagagccaccagcagaagcagaagcagaagcagaagcaagagcagaagcagaagcagaagcagcagcagagactag

SEQ ID NO: 98501 - DNA, 717 bp, Artificial Sequence
  Description of Artificial Sequence: Synthetic coding sequence
atgagcagatacggcagatacggcggcgagaccaaggtgtacgtgggcaacctgggcaccggcgccggcaagggcgagctggagagagccttcagctactacggccccctgagaaccgtgtggatcgccagaaacccccccggcttcgccttcgtggagttcgaggaccccagagacgccgaggacgccgtgagaggcctggacggcaaggtgatctgcggcagcagagtgagagtggagctgagcaccggcatgcccagaagaagcagattcgacagaccccccgccagaagacccttcgaccccaacgacagatgctacgagtgcggcgagaagggccactacgcctacgactgccacagatacagcagaagaagaagaagcagaagcagaagcagaagccacagcagaagcagaggcagaagatacagcagaagcagaagcagaagcagaggcagaagaagcagaagcgccagccccagaagaagcagaagcatcagcctgagaagaagcagaagcgccagcctgagaagaagcagaagcggcagcatcaagggcagcagatacttccagagccccagcagaagcagaagcagaagcagaagcatcagcagacccagaagcagcagaagcaagagcagaagccccagccccaagagaagcagaagccccagcggcagccccagaagaagcgccagccccgagagaatggactag

SEQ ID NO: 98502 - DNA, 681 bp, Artificial Sequence
  Description of Artificial Sequence: Synthetic coding sequence
atgagcagatacggcagatacggcggcgagaccaaggtgtacgtgggcaacctgggcaccggcgccggcaagggcgagctggagagagccttcagctactacggccccctgagaaccgtgtggatcgccagaaacccccccggcttcgccttcgtggagttcgaggaccccagagacgccgaggacgccgtgagaggcctggacggcaaggtgatctgcggcagcagagtgagagtggagctgagcaccggcatgcccagaagaagcagattcgacagaccccccgccagaagacccttcgaccccaacgacagatgctacgagtgcggcgagaagggccactacgcctacgactgccacagatacagcagaagaagaagaagcagaagcagaagcagaagccacagcagaagcagaggcagaagatacagcagaagcagaagcagaagcagaggcagaagaagcagaagcgccagccccagaagaagcagaagcatcagcctgagaagaagcagaagcgccagcctgagaagaagcagaagcggcagcatcaagggcagcagatacttccagagccccagcagaagcagaagcagaagcagaagcatcagcagacccagaagcagcagaagccccagcggcagccccagaagaagcgccagccccgagagaatggactag

SEQ ID NO: 98503 - DNA, 1926 bp, Artificial Sequence
  Description of Artificial Sequence: Synthetic coding sequence
atgaactgggccgccttcggcggcagcgagttcttcatccccgagggcatccagatcgacagcagatgccccctgagcagaaacatcaccgagtggtaccactactacggcatcgccgtgaaggagagcagccagtactacgacgtgatgtacagcaagaagggcgccgcctgggtgagcgagaccggcaagaaggaggtgagcaagcagaccgtggcctacagccccagaagcaagctgggcaccctgctgcccgagttccccaacgtgaaggacctgaacctgcccgccagcctgcccgaggagaaggtgagcaccttcatcatgatgtacagaacccactgccagagaatcctggacaccgtgatcagagccaacttcgacgaggtgcagagcttcctgctgcacttctggcagggcatgcccccccacatgctgcccgtgctgggcagcagcaccgtggtgaacatcgtgggcgtgtgcgacagcatcctgtacaaggccatcagcggcgtgctgatgcccaccgtgctgcaggccctgcccgacagcctgacccaggtgatcagaaagttcgccaagcagctggacgagtggctgaaggtggccctgcacgacctgcccgagaacctgagaaacatcaagttcgagctgagcagaagattcagccagatcctgagaagacagaccagcctgaaccacctgtgccaggccagcagaaccgtgatccacagcgccgacatcaccttccagatgctggaggactggagaaacgtggacctgaacagcatcaccaagcagaccctgtacaccatggaggacagcagagacgagcacagaaagctgatcacccagctgtaccaggagttcgaccacctgctggaggagcagagccccatcgagagctacatcgagtggctggacaccatggtggacagatgcgtggtgaaggtggccgccaagagacagggcagcctgaagaaggtggcccagcagttcctgctgatgtggagctgcttcggcaccagagtgatcagagacatgaccctgcacagcgcccccagcttcggcagcttccacctgatccacctgatgttcgacgactacgtgctgtacctgctggagagcctgcactgccaggagagagccaacgagctgatgagagccatgaagggcgagggcagcaccgccgaggtgagagaggagatcatcctgaccgaggccgccgcccccacccccagccccgtgcccagcttcagccccgccaagagcgccaccagcgtggaggtgcccccccccagcagccccgtgagcaaccccagccccgagtacaccggcctgagcaccaccggcgccatgcagagctacacctggagcctgacctacaccgtgaccaccgccgccggcagccccgccgagaacagccagcagctgccctgcatgagaaacacccacgtgcccagcagcagcgtgacccacagaatccccgtgtacccccacagagaggagcacggctacaccggcagctacaactacggcagctacggcaaccagcacccccaccccatgcagagccagtaccccgccctgccccacgacaccgccatcagcggccccctgcactacgccccctaccacagaagcagcgcccagtaccccttcaacagccccaccagcagaatggagccctgcctgatgagcagcacccccagactgcaccccacccccgtgacccccagatggcccgaggtgcccagcgccaacacctgctacaccagccccagcgtgcacagcgccagatacggcaacagcagcgacatgtacacccccctgaccaccagaagaaacagcgagtacgagcacatgcagcacttccccggcttcgcctacatcaacggcgaggccagcaccggctgggccaagtag

SEQ ID NO: 98504 - DNA, 2907 bp, Artificial Sequence
  Description of Artificial Sequence: Synthetic coding sequence
atggccttcgccaacttcagaagaatcctgagactgagcaccttcgagaagagaaagagcagagagtacgagcacgtgagaagagacctggaccccaacgaggtgtgggagatcgtgggcgagctgggcgacggcgccttcggcaaggtgtacaaggccaagaacaaggagaccggcgccctggccgccgccaaggtgatcgagaccaagagcgaggaggagctggaggactacatcgtggagatcgagatcctggccacctgcgaccacccctacatcgtgaagctgctgggcgcctactaccacgacggcaagctgtggatcatgatcgagttctgccccggcggcgccgtggacgccatcatgctggagctggacagaggcctgaccgagccccagatccaggtggtgtgcagacagatgctggaggccctgaacttcctgcacagcaagagaatcatccacagagacctgaaggccggcaacgtgctgatgaccctggagggcgacatcagactggccgacttcggcgtgagcgccaagaacctgaagaccctgcagaagagagacagcttcatcggcaccccctactggatggcccccgaggtggtgatgtgcgagaccatgaaggacaccccctacgactacaaggccgacatctggagcctgggcatcaccctgatcgagatggcccagatcgagcccccccaccacgagctgaaccccatgagagtgctgctgaagatcgccaagagcgacccccccaccctgctgacccccagcaagtggagcgtggagttcagagacttcctgaagatcgccctggacaagaaccccgagaccagacccagcgccgcccagctgctggagcaccccttcgtgagcagcatcaccagcaacaaggccctgagagagctggtggccgaggccaaggccgaggtgatggaggagatcgaggacggcagagacgagggcgaggaggaggacgccgtggacgccgccagcaccctggagaaccacacccagaacagcagcgaggtgagcccccccagcctgaacgccgacaagcccctggaggagagccccagcacccccctggcccccagccagagccaggacagcgtgaacgagccctgcagccagcccagcggcgacagaagcctgcagaccaccagcccccccgtggtggcccccggcaacgagaacggcctggccgtgcccgtgcccctgagaaagagcagacccgtgagcatggacgccagaatccaggtggcccaggagaagcaggtggccgagcagggcggcgacctgagccccgccgccaacagaagccagaaggccagccagagcagacccaacagcagcgccctggagaccctgggcggcgagaagctggccaacggcagcctggagccccccgcccaggccgcccccggccccagcaagagagacagcgactgcagcagcctgtgcaccagcgagagcatggactacggcaccaacctgagcaccgacctgagcctgaacaaggagatgggcagcctgagcatcaaggaccccaagctgtacaagaagaccctgaagagaaccagaaagttcgtggtggacggcgtggaggtgagcatcaccaccagcaagatcatcagcgaggacgagaagaaggacgaggagatgagattcctgagaagacaggagctgagagagctgagactgctgcagaaggaggagcacagaaaccagacccagctgagcaacaagcacgagctgcagctggagcagatgcacaagagattcgagcaggagatcaacgccaagaagaagttcttcgacaccgagctggagaacctggagagacagcagaagcagcaggtggagaagatggagcaggaccacgccgtgagaagaagagaggaggccagaagaatcagactggagcaggacagagactacaccagattccaggagcagctgaagctgatgaagaaggaggtgaagaacgaggtggagaagctgcccagacagcagagaaaggagagcatgaagcagaagatggaggagcacacccagaagaagcagctgctggacagagacttcgtggccaagcagaaggaggacctggagctggccatgaagagactgaccaccgacaacagaagagagatctgcgacaaggagagagagtgcctgatgaagaagcaggagctgctgagagacagagaggccgccctgtgggagatggaggagcaccagctgcaggagagacaccagctggtgaagcagcagctgaaggaccagtacttcctgcagagacacgagctgctgagaaagcacgagaaggagagagagcagatgcagagatacaaccagagaatgatcgagcagctgaaggtgagacagcagcaggagaaggccagactgcccaagatccagagaagcgagggcaagaccagaatggccatgtacaagaagagcctgcacatcaacggcggcggcagcgccgccgagcagagagagaagatcaagcagttcagccagcaggaggagaagagacagaagagcgagagactgcagcagcagcagaagcacgagaaccagatgagagacatgctggcccagtgcgagagcaacatgagcgagctgcagcagctgcagaacgagaagtgccacctgctggtggagcacgagacccagaagctgaaggccctggacgagagccacaaccagaacctgaaggagtggagagacaagctgagacccagaaagaaggccctggaggaggacctgaaccagaagaagagagagcaggagatgttcttcaagctgagcgaggaggccgagtgccccaaccccagcacccccagcaaggccgccaagttcttcccctacagcagcgccgacgccagctag

SEQ ID NO: 98505 - DNA, 2907 bp, Artificial Sequence; identical to SEQ ID NO: 98504
  Description of Artificial Sequence: Synthetic coding sequence

SEQ ID NO: 98506 - DNA, 3300 bp, Artificial Sequence
  Description of Artificial Sequence: Synthetic coding sequence
agattcggcagcgccccccagagacccgtggccatgaccaccgcccagagagacagcctgctgtggaagctggccggcctgctgagagagagcggcgacgtggtgctgagcggctgcagcaccctgagcctgctgacccccaccctgcagcagctgaaccacgtgttcgagctgcacctgggcccctggggccccggccagaccggcttcgtggccctgcccagccaccccgccgacagccccgtgatcctgcagctgcagttcctgttcgacgtgctgcagaagaccctgagcctgaagctggtgcacgtggccggccccggccccaccggccccatcaagatcttccccttcaagagcctgagacacctggagctgagaggcgtgcccctgcactgcctgcacggcctgagaggcatctacagccagctggagaccctgatctgcagcagaagcctgcaggccctggaggagctgctgagcgcctgcggcggcgacttctgcagcgccctgccctggctggccctgctgagcgccaacttcagctacaacgccctgaccgccctggacagcagcctgagactgctgagcgccctgagattcctgaacctgagccacaaccaggtgcaggactgccagggcttcctgatggacctgtgcgagctgcaccacctggacatcagctacaacagactgcacctggtgcccagaatgggccccagcggcgccgccctgggcgtgctgatcctgagaggcaacgagctgagaagcctgcacggcctggagcagctgagaaacctgagacacctggacctggcctacaacctgctggagggccacagagagctgagccccctgtggctgctggccgagctgagaaagctgtacctggagggcaaccccctgtggttccaccccgagcacagagccgccaccgcccagtacctgagccccagagccagagacgccgccaccggcttcctgctggacggcaaggtgctgagcctgaccgacttccagacccacaccagcctgggcctgagccccatgggcccccccctgccctggcccgtgggcagcacccccgagaccagcggcggccccgacctgagcgacagcctgagcagcggcggcgtggtgacccagcccctgctgcacaaggtgaagagcagagtgagagtgagaagagccagcatcagcgagcccagcgacaccgaccccgagcccagaaccctgaaccccagccccgccggctggttcgtgcagcagcaccccgagctggagctgatgagcagcttcagagagagattcggcagaaactggctgcagtacagaagccacctggagcccagcggcaaccccctgcccgccacccccaccaccagcgcccccagcgccccccccgccagcagccagggccccgacaccgcccccagacccagccccccccaggaggaggccagaggcccccaggagagcccccagaagatgagcgaggaggtgagagccgagccccaggaggaggaggaggagaaggagggcaaggaggagaaggaggagggcgagatggtggagcagggcgaggaggaggccggcgaggaggaggaggaggagcaggaccagaaggaggtggaggccgagctgtgcagacccctgctggtgtgccccctggagggccccgagggcgtgagaggcagagagtgcttcctgagagtgaccagcgcccacctgttcgaggtggagctgcaggccgccagaaccctggagagactggagctgcagagcctggaggccgccgagatcgagcccgaggcccaggcccagagaagccccagacccaccggcagcgacctgctgcccggcgcccccatcctgagcctgagattcagctacatctgccccgacagacagctgagaagatacctggtgctggagcccgacgcccacgccgccgtgcaggagctgctggccgtgctgacccccgtgaccaacgtggccagagagcagctgggcgaggccagagacctgctgctgggcagattccagtgcctgagatgcggccacgagttcaagcccgaggagcccagaatgggcctggacagcgaggagggctggagacccctgttccagaagaccgagagccccgccgtgtgccccaactgcggcagcgaccacgtggtgctgctggccgtgagcagaggcacccccaacagagagagaaagcagggcgagcagagcctggcccccagccccagcgccagccccgtgtgccacccccccggccacggcgaccacctggacagagccaagaacagccccccccaggcccccagcaccagagaccacggcagctggagcctgagccccccccccgagagatgcggcctgagaagcgtggaccacagactgagactgttcctggacgtggaggtgttcagcgacgcccaggaggagttccagtgctgcctgaaggtgcccgtggccctggccggccacaccggcgagttcatgtgcctggtggtggtgagcgacagaagactgtacctgctgaaggtgaccggcgagatgagagagccccccgccagctggctgcagctgaccctggccgtgcccctgcaggacctgagcggcatcgagctgggcctggccggccagagcctgagactggagtgggccgccggcgccggcagatgcgtgctgctgcccagagacgccagacactgcagagccttcctggaggagctgctggacgtgctgcagagcctgccccccgcctggagaaactgcgtgagcgccaccgaggaggaggtgaccccccagcacagactgtggcccctgctggagaaggacagcagcctggaggccagacagttcttctacctgagagccttcctggtggagggccccagcacctgcctggtgagcctgctgctgacccccagcaccctgttcctgctggacgaggacgccgccggcagccccgccgagcccagcccccccgccgccagcggcgaggccagcgagaaggtgccccccagcggccccggccccgccgtgagagtgagagagcagcagcccctgagcagcctgagcagcgtgctgctgtacagaagcgcccccgaggacctgagactgctgttctacgacgaggtgagcagactggagagcttctgggccctgagagtggtgtgccaggagcagctgaccgccctgctggcctggatcagagagccctgggaggagctgttcagcatcggcctgagaaccgtgatccaggaggccctggccctggacagatag

SEQ ID NO: 98507 - DNA, 1938 bp, Artificial Sequence
  Description of Artificial Sequence: Synthetic coding sequence
agattcggcagcgccccccagagacccgtggccatgaccaccgcccagagagacagcctgctgtggaagctggccggcctgctgagagagagcggcgacgtggtgctgagcggctgcagcaccctgagcctgctgacccccaccctgcagcagctgaaccacgtgttcgagctgcacctgggcccctggggccccggccagaccggcttcgtggccctgcccagccaccccgccgacagccccgtgatcctgcagctgcagttcctgttcgacgtgctgcagaagaccctgagcctgaagctggtgcacgtggccggccccggccccaccggccccatcaagatcttccccttcaagagcctgagacacctggagctgagaggcgtgcccctgcactgcctgcacggcctgagaggcatctacagccagctggagaccctgatctgcagcagaagcctgcaggccctggaggagctgctgagcgcctgcggcggcgacttctgcagcgccctgccctggctggccctgctgagcgccaacttcagctacaacgccctgaccgccctggacagcagcctgagactgctgagcgccctgagattcctgaacctgagccacaaccaggtgcaggactgccagggcttcctgatggacctgtgcgagctgcaccacctggacatcagctacaacagactgcacctggtgcccagaatgggccccagcggcgccgccctgggcgtgctgatcctgagaggcaacgagctgagaagcctgcacggcctggagcagctgagaaacctgagacacctggacctggcctacaacctgctggagggccacagagagctgagccccctgtggctgctggccgagctgagaaagttcctgctggacggcaaggtgctgagcctgaccgacttccagacccacaccagcctgggcctgagccccatgggcccccccctgccctggcccgtgggcagcacccccgagaccagcggcggccccgacctgagcgacagcctgagcagcggcggcgtggtgacccagcccctgctgcacaaggtgaagagcagagtgagagtgagaagagccagcatcagcgagcccagcgacaccgaccccgagcccagaaccctgaaccccagccccgccggctggttcgtgcagcagcaccccgagctggagctgatgagcagcttcagagagagattcggcagaaactggctgcagtacagaagccacctggagcccagcggcaaccccctgcccgccacccccaccaccagcgcccccagcgccccccccgccagcagccagggccccgacaccgcccccagacccagccccccccaggaggaggccagaggcccccaggagagcccccagaagatgagcgaggaggtgagagccgagccccaggaggaggaggaggagaaggagggcaaggaggagaaggaggagggcgagatggtggagcagggcgaggaggaggccggcgaggaggaggaggaggagcaggaccagaaggaggtggaggccgagctgtgcagacccctgctggtgtgccccctggagggccccgagggcgtgagaggcagagagtgcttcctgagagtgaccagcgcccacctgttcgaggtggagctgcaggccgccagaaccctggagagactggagctgcagagcctggaggccgccgagatcgagcccgaggcccaggcccagagaagccccagacccaccggcagcgacctgctgcccggcgcccccatcctgagcctgagattcagctacatctgccccgacagacagctgagaagatacctggtgctggagcccgacgcccacgccgccgtgcaggtgatggcccccagagtgggcgcccaggaggccgtgggcatcaagagagccagaggcaagtggcagcaggcctag

SEQ ID NO: 98508 - DNA, 1095 bp, Artificial Sequence
  Description of Artificial Sequence: Synthetic coding sequence
atgcagaagtggttcagcgccttcgacgacgccatcatccagagacagtggagagccaaccccagcagaggcggcggcggcgtgagcttcaccaaggaggtggacaccaacgtggccaccggcgccccccccagaagacagagagtgcccggcagagcctgcccctggagagagcccatcagaggcagaagaggcgccagacccggcggcggcgacgccggcggcacccccggcgagaccgtgagacactgcagcgcccccgaggaccccatcttcagattcagcagcctgcacagctaccccttccccggcaccatcaagagcagagacatgagctggaagagacaccacctgatccccgagaccttcggcgtgaagagaagaagaaagagaggccccgtggagagcgaccccctgagaggcgagcccggcagcgccagagccgccgtgagcgagctgatgcagctgttccccagaggcctgttcgaggacgccctgccccccatcgtgctgagaagccaggtgtacagcctggtgcccgacagaaccgtggccgacagacagctgaaggagctgcaggagcagggcgagatcagaatcgtgcagctgggcttcgacctggacgcccacggcatcatcttcaccgaggactacagaaccagagtgctgaaggcctgcgacggcagaccctacgccggcgccgtgcagaagttcctggccagcgtgctgcccgcctgcggcgacctgagcttccagcaggaccagatgacccagaccttcggcttcagagacagcgagatcacccacctggtgaacgccggcgtgctgaccgtgagagacgccggcagctggtggctggccgtgcccggcgccggcagattcatcaagtacttcgtgaagggcagacaggccgtgctgagcatggtgagaaaggccaagtacagagagctgctgctgagcgagctgctgggcagaagagcccccgtggtggtgagactgggcctgacctaccacgtgcacgacctgatcggcgcccagctggtggactgcatcagcaccaccagcggcaccctgctgagactgcccgagacctag

SEQ ID NO: 98509 - DNA, 1107 bp, Artificial Sequence
  Description of Artificial Sequence: Synthetic coding sequence
atgcagaagtggttcagcgccttcgacgacgccatcatccagagacagtggagagccaaccccagcagaggcggcggcggcgtgagcttcaccaaggaggtggacaccaacgtggccaccggcgccccccccagaagacagagagtgcccggcagagcctgcccctggagagagcccatcagaggcagaagaggcgccagacccggcggcggcgacgccggcggcacccccggcgagaccgtgagacactgcagcgcccccgaggaccccatcttcagattcagcagcctgcacagctaccccttccccggcaccatcaagagcagagacatgagctggaagagacaccacctgatccccgagaccttcggcgtgaagagaagaagaaagagaggccccgtggagagcgaccccctgagaggcgagcccggcagcgccagagccgccgtgagcgagctgatgcagctgttccccagaggcctgttcgaggacgccctgccccccatcgtgctgagaagccaggtgtacagcctggtgcccgacagaaccgtggccgacagacagctgaaggagctgcaggagcagggcgagatcagaatcgtgcagctgggcttcgacctggacgcccacggcatcatcttcaccgaggactacagaaccagagtgtgcgactgcgtgctgaaggcctgcgacggcagaccctacgccggcgccgtgcagaagttcctggccagcgtgctgcccgcctgcggcgacctgagcttccagcaggaccagatgacccagaccttcggcttcagagacagcgagatcacccacctggtgaacgccggcgtgctgaccgtgagagacgccggcagctggtggctggccgtgcccggcgccggcagattcatcaagtacttcgtgaagggcagacaggccgtgctgagcatggtgagaaaggccaagtacagagagctgctgctgagcgagctgctgggcagaagagcccccgtggtggtgagactgggcctgacctaccacgtgcacgacctgatcggcgcccagctggtggactgcatcagcaccaccagcggcaccctgctgagactgcccgagacctag

SEQ ID NO: 98510 - DNA, 1107 bp, Artificial Sequence
  Description of Artificial Sequence: Synthetic coding sequence
atgcagaagtggttcagcgccttcgacgacgccatcatccagagacagtggagagccaaccccagcagaggcggcggcggcgtgagcttcaccaaggaggtggacaccaacgtggccaccggcgccccccccagaagacagagagtgcccggcagagcctgcccctggagagagcccatcagaggcagaagaggcgccagacccggcggcggcgacgccggcggcacccccggcgagaccgtgagacactgcagcgcccccgaggaccccatcttcagattcagcagcctgcacagctaccccttccccggcaccatcaagagcagagacatgagctggaagagacaccacctgatccccgagaccttcggcgtgaagagaagaagaaagagaggccccgtggagagcgaccccctgagaggcgagcccggcagcgccagagccgccgtgagcgagctgatgcagctgttccccagaggcctgttcgaggacgccctgccccccatcgtgctgagaagccaggtgtacagcctggtgcccgacagaaccgtggccgacagacagctgaaggagctgcaggagcagggcgagatcagaatcgtgcagctgggcttcgacctggacgcccacggcatcatcttcaccgaggactacagaaccagagtgtgcgactgcgtgctgaaggcctgcgacggcagaccctacgccggcgccgtgcagaagttcctggccagcgtgctgcccgcctgcggcgacctgagcttccagcaggaccagatgacccagaccttcggcttcagagacagcgagatcacccacctggtgaacgccggcgtgctgaccgtgagagacgccggcagctggtggctggccgtgcccggcgccggcagattcatcaagtacttcgtgaagggcagacaggccgtgctgggcatggtgagaaaggccaagtacagagagctgctgctgagcgagctgctgggcagaagagcccccgtggtggtgagactgggcctgacctaccacgtgcacgacctgatcggcgcccagctggtggactgcatcagcaccaccagcggcaccctgctgagactgcccgagacctag

SEQ ID NO: 98511 - DNA, 1095 bp, Artificial Sequence
  Description of Artificial Sequence: Synthetic coding sequence
atgcagaagtggttcagcgccttcgacgacgccatcatccagagacagtggagagccaaccccagcagaggcggcggcggcgtgagcttcaccaaggaggtggacaccaacgtggccaccggcgccccccccagaagacagagagtgcccggcagagcctgcccctggagagagcccatcagaggcagaagaggcgccagacccggcggcggcgacgccggcggcacccccggcgagaccgtgagacactgcagcgcccccgaggaccccatcttcagattcagcagcctgcacagctaccccttccccggcaccatcaagagcagagacatgagctggaagagacaccacctgatccccgagaccttcggcgtgaagagaagaagaaagagaggccccgtggagagcgaccccctgagaggcgagcccggcagcgccagagccgccgtgagcgagctgatgcagctgttccccagaggcctgttcgaggacgccctgccccccatcgtgctgagaagccaggtgtacagcctggtgcccgacagaaccgtggccgacagacagctgaaggagctgcaggagcagggcgagatcagaatcgtgcagctgggcttcgacctggacgcccacggcatcatcttcaccgaggactacagaaccagagtgctgaaggcctgcgacggcagaccctacgccggcgccgtgcagaagttcctggccagcgtgctgcccgcctgcggcgacctgagcttccagcaggaccagatgacccagaccttcggcttcagagacagcgagatcacccacctggtgaacgccggcgtgctgaccgtgagagacgccggcagctggtggctggccgtgcccggcgccggcagattcatcaagtacttcgtgaagggcagacaggccgtgctgggcatggtgagaaaggccaagtacagagagctgctgctgagcgagctgctgggcagaagagcccccgtggtggtgagactgggcctgacctaccacgtgcacgacctgatcggcgcccagctggtggactgcatcagcaccaccagcggcaccctgctgagactgcccgagacctag

SEQ ID NO: 98512 - DNA, 1095 bp, Artificial Sequence; identical to SEQ ID NO: 98508
  Description of Artificial Sequence: Synthetic coding sequence

SEQ ID NO: 98513 - DNA, 1095 bp, Artificial Sequence; identical to SEQ ID NO: 98508
  Description of Artificial Sequence: Synthetic coding sequence

SEQ ID NO: 98514 - DNA, 1095 bp, Artificial Sequence; identical to SEQ ID NO: 98508
  Description of Artificial Sequence: Synthetic coding sequence

SEQ ID NO: 98515 - DNA, 1107 bp, Artificial Sequence; identical to SEQ ID NO: 98509
  Description of Artificial Sequence: Synthetic coding sequence

SEQ ID NO: 98516 - DNA, 1107 bp, Artificial Sequence; identical to SEQ ID NO: 98509
  Description of Artificial Sequence: Synthetic coding sequence

SEQ ID NO: 98517 - DNA, 1107 bp, Artificial Sequence; identical to SEQ ID NO: 98509
  Description of Artificial Sequence: Synthetic coding sequence

SEQ ID NO: 98518 - DNA, 1095 bp, Artificial Sequence; identical to SEQ ID NO: 98508
  Description of Artificial Sequence: Synthetic coding sequence

SEQ ID NO: 98519 - DNA, 1107 bp, Artificial Sequence; identical to SEQ ID NO: 98509
  Description of Artificial Sequence: Synthetic coding sequence

SEQ ID NO: 98520 - DNA, 339 bp, Artificial Sequence
  Description of Artificial Sequence: Synthetic coding sequence
atgcagaagtggttcagcgccttcgacgacgccatcatccagagacagtggagagccaaccccagcagaggcggcggcggcgtgagcttcaccaaggaggtggacaccaacgtggccaccggcgccccccccagaagacagagagtgcccggcagagcctgcccctggagagagcccatcagaggcagaagaggcgccagacccggcggcggcgacgccggcggcacccccggcgagaccgtgagacactgcagcgcccccgaggaccccatcttcagattcagcagcctgcacagctaccccttccccggcaccatcaagagcagagacatgagctag

SEQ ID NO: 98521 - DNA, 966 bp, Artificial Sequence
  Description of Artificial Sequence: Synthetic coding sequence
atgctggtgtgcgccagccccccccccctgcccgccctgaccggcctgagagacgacaagctgaccctgctgagcagcagccccggcctgggcggcacccccggcgagaccgtgagacactgcagcgcccccgaggaccccatcttcagattcagcagcctgcacagctaccccttccccggcaccatcaagagcagagacatgagctggaagagacaccacctgatccccgagaccttcggcgtgaagagaagaagaaagagaggccccgtggagagcgaccccctgagaggcgagcccggcagcgccagagccgccgtgagcgagctgatgcagctgttccccagaggcctgttcgaggacgccctgccccccatcgtgctgagaagccaggtgtacagcctggtgcccgacagaaccgtggccgacagacagctgaaggagctgcaggagcagggcgagatcagaatcgtgcagctgggcttcgacctggacgcccacggcatcatcttcaccgaggactacagaaccagagtgctgaaggcctgcgacggcagaccctacgccggcgccgtgcagaagttcctggccagcgtgctgcccgcctgcggcgacctgagcttccagcaggaccagatgacccagaccttcggcttcagagacagcgagatcacccacctggtgaacgccggcgtgctgaccgtgagagacgccggcagctggtggctggccgtgcccggcgccggcagattcatcaagtacttcgtgaagggcagacaggccgtgctgggcatggtgagaaaggccaagtacagagagctgctgctgagcgagctgctgggcagaagagcccccgtggtggtgagactgggcctgacctaccacgtgcacgacctgatcggcgcccagctggtggactgcatcagcaccaccagcggcaccctgctgagactgcccgagacctag

SEQ ID NO: 98522 - DNA, 966 bp, Artificial Sequence
  Description of Artificial Sequence: Synthetic coding sequence
atgctggtgtgcgccagccccccccccctgcccgccctgaccggcctgagagacgacaagctgaccctgctgagcagcagccccggcctgggcggcacccccggcgagaccgtgagacactgcagcgcccccgaggaccccatcttcagattcagcagcctgcacagctaccccttccccggcaccatcaagagcagagacatgagctggaagagacaccacctgatccccgagaccttcggcgtgaagagaagaagaaagagaggccccgtggagagcgaccccctgagaggcgagcccggcagcgccagagccgccgtgagcgagctgatgcagctgttccccagaggcctgttcgaggacgccctgccccccatcgtgctgagaagccaggtgtacagcctggtgcccgacagaaccgtggccgacagacagctgaaggagctgcaggagcagggcgagatcagaatcgtgcagctgggcttcgacctggacgcccacggcatcatcttcaccgaggactacagaaccagagtgctgaaggcctgcgacggcagaccctacgccggcgccgtgcagaagttcctggccagcgtgctgcccgcctgcggcgacctgagcttccagcaggaccagatgacccagaccttcggcttcagagacagcgagatcacccacctggtgaacgccggcgtgctgaccgtgagagacgccggcagctggtggctggccgtgcccggcgccggcagattcatcaagtacttcgtgaagggcagacaggccgtgctgagcatggtgagaaaggccaagtacagagagctgctgctgagcgagctgctgggcagaagagcccccgtggtggtgagactgggcctgacctaccacgtgcacgacctgatcggcgcccagctggtggactgcatcagcaccaccagcggcaccctgctgagactgcccgagacctag

SEQ ID NO: 98523 - DNA, 966 bp, Artificial Sequence; identical to SEQ ID NO: 98522
  Description of Artificial Sequence: Synthetic coding sequence

SEQ ID NO: 98524 - DNA, 966 bp, Artificial Sequence; identical to SEQ ID NO: 98522
  Description of Artificial Sequence: Synthetic coding sequence

SEQ ID NO: 98525 - DNA, 966 bp, Artificial Sequence; identical to SEQ ID NO: 98522
  Description of Artificial Sequence: Synthetic coding sequence

SEQ ID NO: 98526 - DNA, 1320 bp, Artificial Sequence
  Description of Artificial Sequence: Synthetic coding sequence
atgcagaacctgaaggccgaccccgaggagctgttcaccaagctggagaagatcggcaagggcagcttcggcgaggtgttcaagggcatcgacaacagaacccagaaggtggtggccatcaagatcatcgacctggaggaggccgaggacgagatcgaggacatccagcaggagatcaccgtgctgagccagtgcgacagcccctacgtgaccaagtactacggcagctacctgaaggacaccaagctgtggatcatcatggagtacctgggcggcggcagcgccctggacctgctggagcccggccccctggacgagacccagatcgccaccatcctgagagagatcctgaagggcctggactacctgcacagcgagaagaagatccacagagacatcaaggccgccaacgtgctgctgagcgagcacggcgaggtgaagctggccgacttcggcgtggccggccagctgaccgacacccagatcaagagaaacaccttcgtgggcacccccttctggatggcccccgaggtgatcaagcagagcgcctacgacagcaaggccgacatctggagcctgggcatcaccgccatcgagctggccagaggcgagcccccccacagcgagctgcaccccatgaaggtgctgttcctgatccccaagaacaacccccccaccctggagggcaactacagcaagcccctgaaggagttcgtggaggcctgcctgaacaaggagcccagcttcagacccaccgccaaggagctgctgaagcacaagttcatcctgagaaacgccaagaagaccagctacctgaccgagctgatcgacagatacaagagatggaaggccgagcagagccacgacgacagcagcagcgaggacagcgacgccgagaccgacggccaggccagcggcggcagcgacagcggcgactggatcttcaccatcagagagaaggaccccaagaacctggagaacggcgccctgcagcccagcgacctggacagaaacaagatgaaggacatccccaagagacccttcagccagtgcctgagcaccatcatcagccccctgttcgccgagctgaaggagaagagccaggcctgcggcggcaacctgggcagcatcgaggagctgagaggcgccatctacctggccgaggaggcctgccccggcatcagcgacaccatggtggcccagctggtgcagagactgcagagaagcatccacggcaaccaggccccccccgactgccacctggcccaggtgcaggccttcggcggcagcggctgcgtgctgggcagcagaagcgtgtag

SEQ ID NO: 98527 - DNA, 672 bp, Artificial Sequence
  Description of Artificial Sequence: Synthetic coding sequence
atggcccccgaggtgatcaagcagagcgcctacgacagcaaggccgacatctggagcctgggcatcaccgccatcgagctggccagaggcgagcccccccacagcgagctgcaccccatgaaggtgctgttcctgatccccaagaacaacccccccaccctggagggcaactacagcaagcccctgaaggagttcgtggaggcctgcctgaacaaggagcccagcttcagacccaccgccaaggagctgctgaagcacaagttcatcctgagaaacgccaagaagaccagctacctgaccgagctgatcgacagatacaagagatggaaggccgagcagagccacgacgacagcagcagcgaggacagcgacgccgagaccgacggccaggccagcggcggcagcgacagcggcgactggatcttcaccatcagagagaaggaccccaagaacctggagaacggcgccctgcagcccagcgacctggacagaaacaagctgaaggagaagagccaggcctgcggcggcaacctgggcagcatcgaggagctgagaggcgccatctacctggccgaggaggcctgccccggcatcagcgacaccatggtggcccagctggtgcagagactgcagagatacagcctgagcggcggcggcaccagcagccactag

SEQ ID NO: 98528 - DNA, 1332 bp, Artificial Sequence
  Description of Artificial Sequence: Synthetic coding sequence
atggacagcagagcccagctgtggggcctggccctgaacaagagaagagccaccctgccccaccccggcggcagcaccaacctgaaggccgaccccgaggagctgttcaccaagctggagaagatcggcaagggcagcttcggcgaggtgttcaagggcatcgacaacagaacccagaaggtggtggccatcaagatcatcgacctggaggaggccgaggacgagatcgaggacatccagcaggagatcaccgtgctgagccagtgcgacagcccctacgtgaccaagtactacggcagctacctgaaggacaccaagctgtggatcatcatggagtacctgggcggcggcagcgccctggacctgctggagcccggccccctggacgagacccagatcgccaccatcctgagagagatcctgaagggcctggactacctgcacagcgagaagaagatccacagagacatcaaggccgccaacgtgctgctgagcgagcacggcgaggtgaagctggccgacttcggcgtggccggccagctgaccgacacccagatcaagagaaacaccttcgtgggcacccccttctggatggcccccgaggtgatcaagcagagcgcctacgacagcaaggccgacatctggagcctgggcatcaccgccatcgagctggccagaggcgagcccccccacagcgagctgcaccccatgaaggtgctgttcctgatccccaagaacaacccccccaccctggagggcaactacagcaagcccctgaaggagttcgtggaggcctgcctgaacaaggagcccagcttcagacccaccgccaaggagctgctgaagcacaagttcatcctgagaaacgccaagaagaccagctacctgaccgagctgatcgacagatacaagagatggaaggccgagcagagccacgacgacagcagcagcgaggacagcgacgccgagaccgacggccaggccagcggcggcagcgacagcggcgactggatcttcaccatcagagagaaggaccccaagaacctggagaacggcgccctgcagcccagcgacctggacagaaacaagatgaaggacatccccaagagacccttcagccagtgcctgagcaccatcatcagccccctgttcgccgagctgaaggagaagagccaggcctgcggcggcaacctgggcagcatcgaggagctgagaggcgccatctacctggccgaggaggcctgccccggcatcagcgacaccatggtggcccagctggtgcagagactgcagagatacagcctgagcggcggcggcaccagcagccactag

SEQ ID NO: 98529 - DNA, 1296 bp, Artificial Sequence
  Description of Artificial Sequence: Synthetic coding sequence
atggcccacagccccgtgcagagcggcctgcccggcatgcagaacctgaaggccgaccccgaggagctgttcaccaagctggagaagatcggcaagggcagcttcggcgaggtgttcaagggcatcgacaacagaacccagaaggtggtggccatcaagatcatcgacctggaggaggccgaggacgagatcgaggacatccagcaggagatcaccgtgctgagccagtgcgacagcccctacgtgaccaagtactacggcagctacctgaaggacaccaagctgtggatcatcatggagtacctgggcggcggcagcgccctggacctgctggagcccggccccctggacgagacccagatcgccaccatcctgagagagatcctgaagggcctggactacctgcacagcgagaagaagatccacagagacatcaaggccgccaacgtgctgctgagcgagcacggcgaggtgaagctggccgacttcggcgtggccggccagctgaccgacacccagatcaagagaaacaccttcgtgggcacccccttctggatggcccccgaggtgatcaagcagagcgcctacgacagcaaggccgacatctggagcctgggcatcaccgccatcgagctggccagaggcgagcccccccacagcgagctgcaccccatgaaggtgctgttcctgatccccaagaacaacccccccaccctggagggcaactacagcaagcccctgaaggagttcgtggaggcctgcctgaacaaggagcccagcttcagacccaccgccaaggagctgctgaagcacaagttcatcctgagaaacgccaagaagaccagctacctgaccgagctgatcgacagatacaagagatggaaggccgagcagagccacgacgacagcagcagcgaggacagcgacgccgagaccgacggccaggccagcggcggcagcgacagcggcgactggatcttcaccatcagagagaaggaccccaagaacctggagaacggcgccctgcagcccagcgacctggacagaaacaagatgaaggacatccccaagagacccttcagccagtgcctgagcaccatcatcagccccctgttcgccgagctgaaggagaagagccaggcctgcggcggcaacctgggcagcatcgaggagctgagaggcgccatctacctggccgaggaggcctgccccggcatcagcgacaccatggtggcccagctggtgcagagactgcagagatacagcctgagcggcggcggcaccagcagccactag

SEQ ID NO: 98530 - DNA, 1239 bp, Artificial Sequence
  Description of Artificial Sequence: Synthetic coding sequence
atggcccacagccccgtgcagagcggcctgcccggcatgcagaacctgaaggccgaccccgaggagctgttcaccaagctggagaagatcggcaagggcagcttcggcgaggtgttcaagggcatcgacaacagaacccagaaggtggtggccatcaagatcatcgacctggaggaggccgaggacgagatcgaggacatccagcaggagatcaccgtgctgagccagtgcgacagcccctacgtgaccaagtactacggcagctacctgaagctggagcccggccccctggacgagacccagatcgccaccatcctgagagagatcctgaagggcctggactacctgcacagcgagaagaagatccacagagacatcaaggccgccaacgtgctgctgagcgagcacggcgaggtgaagctggccgacttcggcgtggccggccagctgaccgacacccagatcaagagaaacaccttcgtgggcacccccttctggatggcccccgaggtgatcaagcagagcgcctacgacagcaaggccgacatctggagcctgggcatcaccgccatcgagctggccagaggcgagcccccccacagcgagctgcaccccatgaaggtgctgttcctgatccccaagaacaacccccccaccctggagggcaactacagcaagcccctgaaggagttcgtggaggcctgcctgaacaaggagcccagcttcagacccaccgccaaggagctgctgaagcacaagttcatcctgagaaacgccaagaagaccagctacctgaccgagctgatcgacagatacaagagatggaaggccgagcagagccacgacgacagcagcagcgaggacagcgacgccgagaccgacggccaggccagcggcggcagcgacagcggcgactggatcttcaccatcagagagaaggaccccaagaacctggagaacggcgccctgcagcccagcgacctggacagaaacaagatgaaggacatccccaagagacccttcagccagtgcctgagcaccatcatcagccccctgttcgccgagctgaaggagaagagccaggcctgcggcggcaacctgggcagcatcgaggagctgagaggcgccatctacctggccgaggaggcctgccccggcatcagcgacaccatggtggcccagctggtgcagagactgcagagatacagcctgagcggcggcggcaccagcagccactag

SEQ ID NO: 98531 - DNA, 1029 bp, Artificial Sequence
  Description of Artificial Sequence: Synthetic coding sequence
atggcccacagccccgtgcagagcggcctgcccggcatgcagaacctgaaggccgaccccgaggagctgttcaccaagctggagaagatcggcaagggcagcttcggcgaggtgttcaagggcatcgacaacagaacccagaaggtggtggccatcaagatcatcgacctggaggaggccgaggacgagatcgaggacatccagcaggagatcaccgtgctgagccagtgcgacagcccctacgtgaccaagtactacggcagctacctgaaggacaccaagctgtggatcatcatggagtacctgggcggcggcagcgccctggacctgctggagcccggccccctggacgagacccagatcgccaccatcctgagagagatcctgaagggcctggactacctgcacagcgagaagaagatccacagagacatcaaggccgccaacgtgctgctgagcgagcacggcgaggtgaagctggccgacttcggcgtggccggccagctgaccgacacccagatcaagagaaacaccttcgtgggcacccccttctggatggcccccgaggtgatcaagcagagcgcctacgacagcaaggccgacatctggagcctgggcatcaccgccatcgagctggccagaggcgagcccccccacagcgagctgcaccccatgaaggtgctgttcctgatccccaagaacaacccccccaccctggagggcaactacagcaagcccctgaaggagttcgtggaggcctgcctgaacaaggagcccagcttcagacccaccgccaaggagctgctgaagcacaagttcatcctgagaaacgccaagaagaccagctacctgaccgagctgatcgacagatacaagagatggaaggccgagcagagccacgacgacagcagcagcgaggacagcgacgccgagaccgacggccaggccagcggcggcagcgacagcggcgactggatcttcaccatcagagagtggagcagcagcgccatcggcctgggccagaagtag

SEQ ID NO: 98532 - DNA, 2991 bp, Artificial Sequence
  Description of Artificial Sequence: Synthetic coding sequence
atggacgaggacacccactacgacaaggtggaggacgtggtgggcagccacatcgaggacgccgtgaccttctgggcccagagcatcaacagaaacaaggacatcatgaagatcggctgcagcctgagcgaggtgtgcccccaggccagcagcgtgctgggcaacctggaccccaacaagatctacggcggcctgttcagcgaggaccagtgctggtacagatgcaaggtgctgaagatcatcagcgtggagaagtgcctggtgagatacatcgactacggcaacaccgagatcctgaacagaagcgacatcgtggagatccccctggagctgcagttcagcagcgtggccaagaagtacaagctgtggggcctgcacatccccagcgaccaggaggtgacccagttcgaccagggcaccaccttcctgggcagcctgatcttcgagaaggagatcaagatgagaatcaaggccaccagcgaggacggcaccgtgatcgcccaggccgagtacggcagcgtggacatcggcgaggaggtgctgaagaagggcttcgccgagaagtgcagactggccagcagaaccgacatctgcgaggagaagaagctggaccccggccagctggtgctgagaaacctgaagagccccatccccctgtggggccacagaagcaaccagagcaccttcagcagacccaagggccacctgagcgagaagatgaccctggacctgaaggacgagaacgacgccggcaacctgatcaccttccccaaggagagcctggccgtgggcgacttcaacctgggcagcaacgtgagcctggagaagatcaagcaggaccagaagctgatcgaggagaacgagaagctgaagaccgagaaggacgccctgctggagagctacaaggccctggagctgaaggtggagcagatcgcccaggagctgcagcaggagaaggccgccgccgtggacctgaccaaccacctggagtacaccctgaagacctacatcgacaccagaatgaagaacctggccgccaagatggagatcctgaaggagatgagacacgtggacatcagcgtgagattcggcaaggacctgagcgacgccatccaggtgctggacgagggctgcttcaccacccccgccagcctgaacggcctggagatcatctgggccgagtacagcctggcccaggagaacatcaagacctgcgagtacgtgagcgagggcaacatcctgatcgcccagagaaacgagatgcagcagaagctgtacatgagcgtggaggacttcatcctggaggtggacgagagcagcctgaacaagagactgaagaccctgcaggacctgagcgtgagcctggaggccgtgtacggccaggccaaggagggcgccaacagcgacgagatcctgaagaagttctacgactggaagtgcgacaagagagaggagttcaccagcgtgagaagcgagaccgacgccagcctgcacagactggtggcctggttccagagaaccctgaaggtgttcgacctgagcgtggagggcagcctgatcagcgaggacgccatggacaacatcgacgagatcctggagaagaccgagagcagcgtgtgcaaggagctggagatcgccctggtggaccagggcgacgccgacaaggagatcatcagcaacacctacagccaggtgctgcagaagatccacagcgaggagagactgatcgccaccgtgcaggccaagtacaaggacagcatcgagttcaagaagcagctgatcgagtacctgaacaagagccccagcgtggaccacctgctgagcatcaagaagaccctgaagagcctgaaggccctgctgagatggaagctggtggagaagagcaacctggaggagagcgacgaccccgacggcagccagatcgagaagatcaaggaggagatcacccagctgagaaacaacgtgttccaggagatctaccacgagagagaggagtacgagatgctgaccagcctggcccagaagtggttccccgagctgcccctgctgcaccccgagatcggcctgctgaagtacatgaacagcggcggcctgctgaccatgagcctggagagagacctgctggacgccgagcccatgaaggagctgagcagcaagagacccctggtgagaagcgaggtgaacggccagatcatcctgctgaagggctacagcgtggacgtggacaccgaggccaaggtgatcgagagagccgccacctaccacagagcctggagagaggccgagggcgacagcggcctgctgcccctgatcttcctgttcctgtgcaagagcgaccccatggcctacctgatggtgccctactaccccagagccaacctgaacgccgtgcaggccaacatgcccctgaacagcgaggagaccctgaaggtgatgaagggcgtggcccagggcctgcacaccctgcacaaggccgacatcatccacggcagcctgcaccagaacaacgtgttcgccctgaacagagagcagggcatcgtgggcgacttcgacttcaccaagagcgtgagccagagagccagcgtgaacatgatggtgggcgacctgagcctgatgagccccgagctgaagatgggcaagcccgccagccccggcagcgacctgtacgcctacggctgcctgctgctgtggctgagcgtgcagaaccaggagttcgagatcaacaaggacggcatccccaaggtggaccagttccacctggacgacaaggtgaagagcctgctgtgcagcctgatctgctacagaagcagcatgaccgccgagcaggtgctgaacgccgagtgcttcctgatgcccaaggagcagagcgtgcccaaccccgagaaggacaccgagtacaccctgtacaagaaggaggaggagatcaagaccgagaacctggacaagtgcatggagaagaccagaaacggcgaggccaacttcgactgctag

SEQ ID NO: 98533 - DNA, 3060 bp, Artificial Sequence
  Description of Artificial Sequence: Synthetic coding sequence
atgtgggtgcagggccacagcagcagagccagcgccaccgagagcgtgagcttcagcggcatcgtgcagatggacgaggacacccactacgacaaggtggaggacgtggtgggcagccacatcgaggacgccgtgaccttctgggcccagagcatcaacagaaacaaggacatcatgaagatcggctgcagcctgagcgaggtgtgcccccaggccagcagcgtgctgggcaacctggaccccaacaagatctacggcggcctgttcagcgaggaccagtgctggtacagatgcaaggtgctgaagatcatcagcgtggagaagtgcctggtgagatacatcgactacggcaacaccgagatcctgaacagaagcgacatcgtggagatccccctggagctgcagttcagcagcgtggccaagaagtacaagctgtggggcctgcacatccccagcgaccaggaggtgacccagttcgaccagggcaccaccttcctgggcagcctgatcttcgagaaggagatcaagatgagaatcaaggccaccagcgaggacggcaccgtgatcgcccaggccgagtacggcagcgtggacatcggcgaggaggtgctgaagaagggcttcgccgagaagtgcagactggccagcagaaccgacatctgcgaggagaagaagctggaccccggccagctggtgctgagaaacctgaagagccccatccccctgtggggccacagaagcaaccagagcaccttcagcagacccaagggccacctgagcgagaagatgaccctggacctgaaggacgagaacgacgccggcaacctgatcaccttccccaaggagagcctggccgtgggcgacttcaacctgggcagcaacgtgagcctggagaagatcaagcaggaccagaagctgatcgaggagaacgagaagctgaagaccgagaaggacgccctgctggagagctacaaggccctggagctgaaggtggagcagatcgcccaggagctgcagcaggagaaggccgccgccgtggacctgaccaaccacctggagtacaccctgaagacctacatcgacaccagaatgaagaacctggccgccaagatggagatcctgaaggagatgagacacgtggacatcagcgtgagattcggcaaggacctgagcgacgccatccaggtgctggacgagggctgcttcaccacccccgccagcctgaacggcctggagatcatctgggccgagtacagcctggcccaggagaacatcaagacctgcgagtacgtgagcgagggcaacatcctgatcgcccagagaaacgagatgcagcagaagctgtacatgagcgtggaggacttcatcctggaggtggacgagagcagcctgaacaagagactgaagaccctgcaggacctgagcgtgagcctggaggccgtgtacggccaggccaaggagggcgccaacagcgacgagatcctgaagaagttctacgactggaagtgcgacaagagagaggagttcaccagcgtgagaagcgagaccgacgccagcctgcacagactggtggcctggttccagagaaccctgaaggtgttcgacctgagcgtggagggcagcctgatcagcgaggacgccatggacaacatcgacgagatcctggagaagaccgagagcagcgtgtgcaaggagctggagatcgccctggtggaccagggcgacgccgacaaggagatcatcagcaacacctacagccaggtgctgcagaagatccacagcgaggagagactgatcgccaccgtgcaggccaagtacaaggacagcatcgagttcaagaagcagctgatcgagtacctgaacaagagccccagcgtggaccacctgctgagcatcaagaagaccctgaagagcctgaaggccctgctgagatggaagctggtggagaagagcaacctggaggagagcgacgaccccgacggcagccagatcgagaagatcaaggaggagatcacccagctgagaaacaacgtgttccaggagatctaccacgagagagaggagtacgagatgctgaccagcctggcccagaagtggttccccgagctgcccctgctgcaccccgagatcggcctgctgaagtacatgaacagcggcggcctgctgaccatgagcctggagagagacctgctggacgccgagcccatgaaggagctgagcagcaagagacccctggtgagaagcgaggtgaacggccagatcatcctgctgaagggctacagcgtggacgtggacaccgaggccaaggtgatcgagagagccgccacctaccacagagcctggagagaggccgagggcgacagcggcctgctgcccctgatcttcctgttcctgtgcaagagcgaccccatggcctacctgatggtgccctactaccccagagccaacctgaacgccgtgcaggccaacatgcccctgaacagcgaggagaccctgaaggtgatgaagggcgtggcccagggcctgcacaccctgcacaaggccgacatcatccacggcagcctgcaccagaacaacgtgttcgccctgaacagagagcagggcatcgtgggcgacttcgacttcaccaagagcgtgagccagagagccagcgtgaacatgatggtgggcgacctgagcctgatgagccccgagctgaagatgggcaagcccgccagccccggcagcgacctgtacgcctacggctgcctgctgctgtggctgagcgtgcagaaccaggagttcgagatcaacaaggacggcatccccaaggtggaccagttccacctggacgacaaggtgaagagcctgctgtgcagcctgatctgctacagaagcagcatgaccgccgagcaggtgctgaacgccgagtgcttcctgatgcccaaggagcagagcgtgcccaaccccgagaaggacaccgagtacaccctgtacaagaaggaggaggagatcaagaccgagaacctggacaagtgcatggagaagaccagaaacggcgaggccaacttcgactgctag

SEQ ID NO: 98534 - DNA, 2991 bp, Artificial Sequence; identical to SEQ ID NO: 98532
  Description of Artificial Sequence: Synthetic coding sequence

SEQ ID NO: 98535 - DNA, 285 bp, Artificial Sequence
  Description of Artificial Sequence: Synthetic coding sequence
atggacgaggacacccactacgacaaggtggaggacgtggtgggcagccacatcgaggacgccgtgaccttctgggcccagagcatcaacagaaacaaggacatcatgaagatcggctgcagcctgagcgaggtgtgcccccaggccagcagcgtgctgggcaacctggaccccaacaagatctacggcggcctgttcagcgaggaccagtgctggtacagatgcaaggtgctgaagatcatcagcgtggagaagtgcctggtgagatacatcgactacggctag

SEQ ID NO: 98536 - DNA, 132 bp, Artificial Sequence
  Description of Artificial Sequence: Synthetic coding sequence
atggacgaggacacccactacgacaaggtggaggacgtggtgggcagccacatcgaggacgccgtgaccttctgggcccagagcatcaacagaaacaaggacatcatgaagatcggctgcagcctgagctag

SEQ ID NO: 98537 - DNA, 2991 bp, Artificial Sequence
  Description of Artificial Sequence: Synthetic coding sequence
atgtgggtgcagggccacagcagcagagccagcgccaccgagagcgtgagcttcagcggcatcgtgcagatggacgaggacacccactacgacaaggtggaggacgtggtgggcagccacatcgaggacgccgtgaccttctgggcccagagcatcaacagaaacaaggacatcatgaagatcggctgcagcctgagcgaggtgtgcccccaggccagcagcgtgctgggcaacctggaccccaacaagatctacggcggcctgttcagcgaggaccagtgctggtacagatgcaaggtgctgaagatcatcagcgtggagaagtgcctggtgagatacatcgactacggcaacaccgagatcctgaacagaagcgacatcgtggagatccccctggagctgcagttcagcagcgtggccaagaagtacaagctgtggggcctgcacatccccagcgaccaggaggtgacccagttcgaccagggcaccaccttcctgggcagcctgatcttcgagaaggagatcaagatgagaatcaaggccaccagcgaggacggcaccgtgatcgcccaggccgagtacggcagcgtggacatcggcgaggaggtgctgaagaagggcttcgccgagaagtgcagactggccagcagaaccgacatctgcgaggagaagaagctggaccccggccagctggtgctgagaaacctgaagagccccatccccctgtggggccacagaagcaaccagagcaccttcagcagacccaagggccacctgagcgagaagatgaccctggacctgaaggacgagaacgacgccggcaacctgatcaccttccccaaggagagcctggccgtgggcgacttcaacctgggcagcaacgtgagcctggagaagatcaagcaggaccagaagctgatcgaggagaacgagaagctgaagaccgagaaggacgccctgctggagagctacaaggccctggagctgaaggtggagcagatcgcccaggagctgcagcaggagaaggccgccgccgtggacctgaccaaccacctggagtacaccctgaagacctacatcgacaccagaatgaagaacctggccgccaagatggagatcctgaaggagatgagacacgtggacatcagcgtgagattcggcaaggacctgagcgacgccatccaggtgctggacgagggctgcttcaccacccccgccagcctgaacggcctggagatcatctgggccgagtacagcctggcccaggagaacatcaagacctgcgagtacgtgagcgagggcaacatcctgatcgcccagagaaacgagatgcagcagaagctgtacatgagcgtggaggacttcatcctggaggtggacgagagcagcctgaacaagagactgaagaccctgcaggacctgagcgtgagcctggaggccgtgtacggccaggccaaggagggcgccaacagcgacgagatcctgaagaagttctacgactggaagtgcgacaagagagaggagttcaccagcgtgagaagcgagaccgacgccagcctgcacagactggtggcctggttccagagaaccctgaaggtgttcgacctgagcgtggagggcagcctgatcagcgaggacgccatggacaacatcgacgagatcctggagaagaccgagagcagcgtgtgcaaggagctggagatcgccctggtggaccagggcgacgccgacaaggagatcatcagcaacacctacagccaggtgctgcagaagatccacagcgaggagagactgatcgccaccgtgcaggccaagtacaaggacagcatcgagttcaagaagcagctgatcgagtacctgaacaagagccccagcgtggaccacctgctgagcatcaagaagaccctgaagagcctgaaggccctgctgagatggaagctggtggagaagagcaacctggaggagagcgacgaccccgacggcagccagatcgagaagatcaaggaggagatcacccagctgagaaacaacgtgttccaggagatctaccacgagagagaggagtacgagatgctgaccagcctggcccagaagtggttccccgagctgcccctgctgcaccccgagatcggcctgctgaagtacatgaacagcggcggcctgctgaccatgagcctggagagagacctgctggacgccgagcccatgaaggagctgagcagcaagagacccctggtgagaagcgaggtgaacggccagatcatcctgctgaagggctacagcgtggacgtggacaccgaggccaaggtgatcgagagagccgccacctaccacagagcctggagagaggccgagggcgacagcggcctgctgcccctgatcttcctgttcctgtgcaagagcgaccccatggcctacctgatggtgccctactaccccagagccaacctgaacgccgtgcaggccaacatgcccctgaacagcgaggagaccctgaaggtgatgaagggcgtggcccagggcctgcacaccctgcacaaggccgacatcatccacggcagcctgcaccagaacaacgtgttcgccctgaacagagagcagggcatcgtgggcgacttcgacttcaccaagagcgtgagccagagagccagcgtgaacatgatggtgggcgacctgagcctgatgagccccgagctgaagatgggcaagcccgccagccccggcagcgacctgtacgcctacggctgcctgctgctgtgggacgacaaggtgaagagcctgctgtgcagcctgatctgctacagaagcagcatgaccgccgagcaggtgctgaacgccgagtgcttcctgatgcccaaggagcagagcgtgcccaaccccgagaaggacaccgagtacaccctgtacaagaaggaggaggagatcaagaccgagaacctggacaagtgcatggagaagaccagaaacggcgaggccaacttcgactgctag

SEQ ID NO: 98538 - DNA, 1545 bp, Artificial Sequence
  Description of Artificial Sequence: Synthetic coding sequence
atggccgacagcggcctggacaagaagagcaccaagtgccccgactgcagcagcgccagccagaaggacgtgctgtgcgtgtgcagcagcaagaccagagtgccccccgtgctggtggtggagatgagccagaccagcagcatcggcagcgccgagagcctgatcagcctggagagaaagaaggagaagaacatcaacagagacatcaccagcagaaaggacctgcccagcagaaccagcaacgtggagagaaaggccagccagcagcagtggggcagaggcaacttcaccgagggcaaggtgccccacatcagaatcgagaacggcgccgccatcgaggagatctacaccttcggcagaatcctgggcaagggcagcttcggcatcgtgatcgaggccaccgacaaggagaccgagaccaagtgggccatcaagaaggtgaacaaggagaaggccggcagcagcgccgtgaagctgctggagagagaggtgaacatcctgaagagcgtgaagcacgagcacatcatccacctggagcaggtgttcgagacccccaagaagatgtacctggtgatggagctgtgcgaggacggcgagctgaaggagatcctggacagaaagggccacttcagcgagaacgagaccagatggatcatccagagcctggccagcgccatcgcctacctgcacaacaacgacatcgtgcacagagacctgaagctggagaacatcatggtgaagagcagcctgatcgacgacaacaacgagatcaacctgaacatcaaggtgaccgacttcggcctggccgtgaagaagcagagcagaagcgaggccatgctgcaggccacctgcggcacccccatctacatggcccccgaggtgatcagcgcccacgactacagccagcagtgcgacatctggagcatcggcgtggtgatgtacatgctgctgagaggcgagccccccttcctggccagcagcgaggagaagctgttcgagctgatcagaaagggcgagctgcacttcgagaacgccgtgtggaacagcatcagcgactgcgccaagagcgtgctgaagcagctgatgaaggtggaccccgcccacagaatcaccgccaaggagctgctggacaaccagtggctgaccggcaacaagctgagcagcgtgagacccaccaacgtgctggagatgatgaaggagtggaagaacaaccccgagagcgtggaggagaacaccaccgaggagaagaacaagcccagcaccgaggagaagctgaagagctaccagccctggggcaacgtgcccgacgccaactacaccagcgacgaggaggaggagaagcagagcaccgcctacgagaagcagttccccgccaccagcaaggacaacttcgacatgtgcagcagcagcttcaccagcagcaagctgctgcccgccgagatcaagggcgagatggagaagacccccgtgacccccagccagggcaccgccaccaagtaccccgccaagagcggcgccctgagcagaaccaagaagaagctgtag

SEQ ID NO: 98539 - DNA, 1545 bp, Artificial Sequence; identical to SEQ ID NO: 98538
  Description of Artificial Sequence: Synthetic coding sequence

SEQ ID NO: 98540 - DNA, 1347 bp, Artificial Sequence
  Description of Artificial Sequence: Synthetic coding sequence
atggccgacagcggcctggacaagaagagcaccaagtgccccgactgcagcagcgccagccagaaggacgtgctgtgcgtgtgcagcagcaagaccagagtgccccccgtgctggtggtggagatgagccagaccagcagcatcggcagcgccgagagcctgatcagcctggagagaaagaaggagaagaacatcaacagagacatcaccagcagaaaggacctgcccagcagaaccagcaacgtggagagaaaggccagccagcagcagtggggcagaggcaacttcaccgagggcaaggtgccccacatcagaatcgagaacggcgccgccatcgaggagatctacaccttcggcagaatcctgggcaagggcagcttcggcatcgtgatcgaggccaccgacaaggagaccgagaccaagtgggccatcaagaaggtgaacaaggagaaggccggcagcagcgccgtgaagctgctggagagagaggtgaacatcctgaagagcgtgaagcacgagcacatcatccacctggagcaggtgttcgagacccccaagaagatgtacctggtgatggagctgtgcgaggacggcgagctgaaggagatcctggacagaaagggccacttcagcgagaacgagaccagatggatcatccagagcctggccagcgccatcgcctacctgcacaacaacgacatcgtgcacagagacctgaagctggagaacatcatggtgaagagcagcctgatcgacgacaacaacgagatcaacctgaacatcaaggtgaccgacttcggcctggccgtgaagaagcagagcagaagcgaggccatgctgcaggccacctgcggcacccccatctacatggcccccgaggtgatcagcgcccacgactacagccagcagtgcgacatctggagcatcggcgtggtgatgtacatgctgctgagaggcgagccccccttcctggccagcagcgaggagaagctgttcgagctgatcagaaagggcgagctgcacttcgagaacgccgtgtggaacagcatcagcgactgcgccaagagcgtgctgaagcagctgatgaaggtggaccccgcccacagaatcaccgccaaggagctgctggacaaccagtggctgaccagcaccgcctacgagaagcagttccccgccaccagcaaggacaacttcgacatgtgcagcagcagcttcaccagcagcaagctgctgcccgccgagatcaagggcgagatggagaagacccccgtgacccccagccagggcaccgccaccaagtaccccgccaagagcggcgccctgagcagaaccaagaagaagctgtag

SEQ ID NO: 98541 - DNA, 192 bp, Artificial Sequence
  Description of Artificial Sequence: Synthetic coding sequence
atggccgacagcggcctggacaagaagagcaccaagtgccccgactgcagcagcgccagccagaaggacgtgctgtgcgtgtgcagcagcaagaccagagtgccccccgtgctggtggtggagatgagccagaccagcagcatcggcagcgccgagagcctgatcagcctggagagaaagaaggagaagtag

SEQ ID NO: 98542 - DNA, 1545 bp, Artificial Sequence; identical to SEQ ID NO: 98538
  Description of Artificial Sequence: Synthetic coding sequence

SEQ ID NO: 98543 - DNA, 114 bp, Artificial Sequence
  Description of Artificial Sequence: Synthetic coding sequence
atggccgacagcggcctggacaagaagagcaccaagtgccccgactgcagcagcgccagccagaaggacgtgctgtgcgtgtgcagcagcaagaccagagtgccccccgtgtag

SEQ ID NO: 98544 - DNA, 516 bp, Artificial Sequence
  Description of Artificial Sequence: Synthetic coding sequence
atggccgacagcggcctggacaagaagagcaccaagtgccccgactgcagcagcgccagccagaaggacgtgctgtgcgtgtgcagcagcaagaccagagtgccccccgtgctggtggtggagatgagccagaccagcagcatcggcagcgccgagagcctgatcagcctggagagaaagaaggagaagaacatcaacagagacatcaccagcagaaaggacctgcccagcagaaccagcaacgtggagagaaaggccagccagcagcagtggggcagaggcaacttcaccgagggcaaggtgccccacatcagaatcgagaacggcgccgccatcgaggagatctacaccttcggcagaatcctgggcaagggcagcttcggcatcgtgatcgaggccaccgacaaggagaccgagaccaagtgggccatcaagaaggtgaacaaggagaaggccggcagcagcgccgtgaagctgctggagagagaggtgaacatcctgaagagcgtgaagtag

SEQ ID NO: 98545 - DNA, 90 bp, Artificial Sequence
  Description of Artificial Sequence: Synthetic coding sequence
atggccgacagcggcctggacaagaagagcaccaagtgccccgactgcagcagcgccagccagaaggacgtgctgtgcgtgtgcagctag

SEQ ID NO: 98546 - DNA, 1206 bp, Artificial Sequence
  Description of Artificial Sequence: Synthetic coding sequence
atggagaccggcaaggacggcgccagaagaggcacccagagccccgagagaaagagaagaagccccgtgcccagagcccccagcaccaagctgagacccgccgccgccgccagagccatggaccccgtggccgccgaggcccccggcgaggccttcctggccagaagaagacccgagggcggcggcggcagcgccagacccagatacagcctgctggccgagatcggcagaggcagctacggcgtggtgtacgaggccgtggccggcagaagcggcgccagagtggccgtgaagaagatcagatgcgacgcccccgagaacgtggagctggccctggccgagttctgggccctgaccagcctgaagagaagacaccagaacgtggtgcagttcgaggagtgcgtgctgcagagaaacggcctggcccagagaatgagccacggcaacaagagcagccagctgtacctgagactggtggagaccagcctgaagggcgagagaatcctgggctacgccgaggagccctgctacctgtggttcgtgatggagttctgcgagggcggcgacctgaaccagtacgtgctgagcagaagacccgaccccgccaccaacaagagcttcatgctgcagctgaccagcgccatcgccttcctgcacaagaaccacatcgtgcacagagacctgaagcccgacaacatcctgatcaccgagagaagcggcacccccatcctgaaggtggccgacttcggcctgagcaaggtgtgcgccggcctggcccccagaggcaaggagggcaaccaggacaacaagaacgtgaacgtgaacaagtactggctgagcagcgcctgcggcagcgacttctacatggcccccgaggtgtgggagggccactacaccgccaaggccgacatcttcgccctgggcatcatcatctgggccatgatcgagagaatcaccttcatcgacagcgagaccaagaaggagctgctgggcacctacatcaagcagggcaccgagatcgtgcccgtgggcgaggccctgctggagaaccccaagatggagctgcacatcccccagaagagaagaaccagcatgagcgagggcatcaagcagctgctgaaggacatgctggccgccaacccccaggacagacccgacgccttcgagctggagaccagaatggaccaggtgacctgcgccgcctag

SEQ ID NO: 98547 - DNA, 1605 bp, Artificial Sequence
  Description of Artificial Sequence: Synthetic coding sequence
atgggccaccaggagagccccctggccagagcccccgccggcggcgccgcctacgtgaagagactgtgcaagggcctgagctggagagagcacgtggagagccacggcagcctgggcgcccaggccagccccgccagcgccgccgccgccgagggcagcgccaccagaagagccagagccgccaccagcagagccgccagaagcagaagacagcccggccccggcgccgaccacccccaggccggcgcccccggcggcaagagagccgccagaaagtggagatgcgccggccaggtgaccatccagggccccgccccccccagacccagagccggcagaagagacgaggccggcggcgccagagccgcccccctgctgctgccccccccccccgccgccatggagaccggcaaggacggcgccagaagaggcacccagagccccgagagaaagagaagaagccccgtgcccagagcccccagcaccaagctgagacccgccgccgccgccagagccatggaccccgtggccgccgaggcccccggcgaggccttcctggccagaagaagacccgagggcggcggcggcagcgccagacccagatacagcctgctggccgagatcggcagaggcagctacggcgtggtgtacgaggccgtggccggcagaagcggcgccagagtggccgtgaagaagatcagatgcgacgcccccgagaacgtggagctggccctggccgagttctgggccctgaccagcctgaagagaagacaccagaacgtggtgcagttcgaggagtgcgtgctgcagagaaacggcctggcccagagaatgagccacggcaacaagagcagccagctgtacctgagactggtggagaccagcctgaagggcgagagaatcctgggctacgccgaggagccctgctacctgtggttcgtgatggagttctgcgagggcggcgacctgaaccagtacgtgctgagcagaagacccgaccccgccaccaacaagagcttcatgctgcagctgaccagcgccatcgccttcctgcacaagaaccacatcgtgcacagagacctgaagcccgacaacatcctgatcaccgagagaagcggcacccccatcctgaaggtggccgacttcggcctgagcaaggtgtgcgccggcctggcccccagaggcaaggagggcaaccaggacaacaagaacgtgaacgtgaacaagtactggctgagcagcgcctgcggcagcgacttctacatggcccccgaggtgtgggagggccactacaccgccaaggccgacatcttcgccctgggcatcatcatctgggccatgatcgagagaatcaccttcatcgacagcgagaccaagaaggagctgctgggcacctacatcaagcagggcaccgagatcgtgcccgtgggcgaggccctgctggagaaccccaagatggagctgcacatcccccagaagagaagaaccagcatgagcgagggcatcaagcagctgctgaaggacatgctggccgccaacccccaggacagacccgacgccttcgagctggagaccagaatggaccaggtgacctgcgccgcctag

SEQ ID NO: 98548 - DNA, 489 bp, Artificial Sequence
  Description of Artificial Sequence: Synthetic coding sequence
atggaccccgtggccgccgaggcccccggcgaggccttcctggccagaagaagacccgagggcggcggcggcagcgccagacccagatacagcctgctggccgagatcggcagaggcagctacggcgtggtgtacgaggccgtggccggcagaagcggcgccagagtggccgtgaagaagatcagatgcgacgcccccgagaacgtggagctggccctggccgagttctgggccctgaccagcctgaagagaagacaccagaacgtggtgcagttcgaggagtgcgtgctgcagagaaacggcctggcccagagaatgagccacggcaacaagagcagccagctgtacctgagactggtggagaccagcctgaagggcagattcctgggcacccacagcctgaccaccagcccccccgaggacggcagaggctacagatggtggcccggcagactggccatcagcagacagctggaccccgccatgtag

SEQ ID NO: 98549 - DNA, 3948 bp, Artificial Sequence
  Description of Artificial Sequence: Synthetic coding sequence
atggagaagtaccacgtgctggagatgatcggcgagggcagcttcggcagagtgtacaagggcagaagaaagtacagcgcccaggtggtggccctgaagttcatccccaagctgggcagaagcgagaaggagctgagaaacctgcagagagagatcgagatcatgagaggcctgagacaccccaacatcgtgcacatgctggacagcttcgagaccgacaaggaggtggtggtggtgaccgactacgccgagggcgagctgttccagatcctggaggacgacggcaagctgcccgaggaccaggtgcaggccatcgccgcccagctggtgagcgccctgtactacctgcacagccacagaatcctgcacagagacatgaagccccagaacatcctgctggccaagggcggcggcatcaagctgtgcgacttcggcttcgccagagccatgagcaccaacaccatggtgctgaccagcatcaagggcacccccctgtacatgagccccgagctggtggaggagagaccctacgaccacaccgccgacctgtggagcgtgggctgcatcctgtacgagctggccgtgggcaccccccccttctacgccaccagcatcttccagctggtgagcctgatcctgaaggaccccgtgagatggcccagcaccatcagcccctgcttcaagaacttcctgcagggcctgctgaccaaggaccccagacagagactgagctggcccgacctgctgtaccaccccttcatcgccggccacgtgaccatcatcaccgagcccgccggccccgacctgggcacccccttcaccagcagactgccccccgagctgcaggtgctgaaggacgagcaggcccacagactggcccccaagggcaaccagagcagaatcctgacccaggcctacaagagaatggccgaggaggccatgcagaagaagcaccagaacaccggccccgccctggagcaggaggacaagaccagcaaggtggcccccggcaccgcccccctgcccagactgggcgccaccccccaggagagcagcctgctggccggcatcctggccagcgagctgaagagcagctgggccaagagcggcaccggcgaggtgcccagcgcccccagagagaacagaaccacccccgactgcgagagagccttccccgaggagagacccgaggtgctgggccagagaagcaccgacgtggtggacctggagaacgaggagcccgacagcgacaacgagtggcagcacctgctggagaccaccgagcccgtgcccatccagctgaaggcccccctgaccctgctgtgcaaccccgacttctgccagagaatccagagccagctgcacgaggccggcggccagatcctgaagggcatcctggagggcgccagccacatcctgcccgccttcagagtgctgagcagcctgctgagcagctgcagcgacagcgtggccctgtacagcttctgcagagaggccggcctgcccggcctgctgctgagcctgctgagacacagccaggagagcaacagcctgcagcagcagagctggtacggcaccttcctgcaggacctgatggccgtgatccaggcctacttcgcctgcaccttcaacctggagagaagccagaccagcgacagcctgcaggtgttccaggaggccgccaacctgttcctggacctgctgggcaagctgctggcccagcccgacgacagcgagcagaccctgagaagagacagcctgatgtgcttcaccgtgctgtgcgaggccatggacggcaacagcagagccatcagcaaggccttctacagcagcctgctgaccacccagcaggtggtgctggacggcctgctgcacggcctgaccgtgccccagctgcccgtgcacaccccccagggcgccccccaggtgagccagcccctgagagagcagagcgaggacatccccggcgccatcagcagcgccctggccgccatctgcaccgcccccgtgggcctgcccgactgctgggacgccaaggagcaggtgtgctggcacctggccaaccagctgaccgaggacagcagccagctgagacccagcctgatcagcggcctgcagcaccccatcctgtgcctgcacctgctgaaggtgctgtacagctgctgcctggtgagcgagggcctgtgcagactgctgggccaggagcccctggccctggagagcctgttcatgctgatccagggcaaggtgaaggtggtggactgggaggagagcaccgaggtgaccctgtacttcctgagcctgctggtgttcagactgcagaacctgccctgcggcatggagaagctgggcagcgacgtggccaccctgttcacccacagccacgtggtgagcctggtgagcgccgccgcctgcctgctgggccagctgggccagcagggcgtgaccttcgacctgcagcccatggagtggatggccgccgccacccacgccctgagcgcccccgccgaggtgagactgaccccccccggcagctgcggcttctacgacggcctgctgatcctgctgctgcagctgctgaccgagcagggcaaggccagcctgatcagagacatgagcagcagcgagatgtggaccgtgctgtggcacagattcagcatggtgctgagactgcccgaggaggccagcgcccaggagggcgagctgagcctgagcagcccccccagccccgagcccgactggaccctgatcagcccccagggcatggccgccctgctgagcctggccatggccaccttcacccaggagccccagctgtgcctgagctgcctgagccagcacggcagcatcctgatgagcatcctgaagcacctgctgtgccccagcttcctgaaccagctgagacaggccccccacggcagcgagttcctgcccgtggtggtgctgagcgtgtgccagctgctgtgcttccccttcgccctggacatggacgccgacctgctgatcggcgtgctggccgacctgagagacagcgaggtggccgcccacctgctgcaggtgtgctgctaccacctgcccctgatgcaggtggagctgcccatcagcctgctgaccagactggccctgatggaccccaccagcctgaaccagttcgtgaacaccgtgagcgccagccccagaaccatcgtgagcttcctgagcgtggccctgctgagcgaccagcccctgctgaccagcgacctgctgagcctgctggcccacaccgccagagtgctgagccccagccacctgagcttcatccaggagctgctggccggcagcgacgagagctacagacccctgagaagcctgctgggccaccccgagaacagcgtgagagcccacacctacagactgctgggccacctgctgcagcacagcatggccctgagaggcgccctgcagagccagagcggcctgctgagcctgctgctgctgggcctgggcgacaaggaccccgtggtgagatgcagcgccagcttcgccgtgggcaacgccgcctaccaggccggccccctgggccccgccctggccgccgccgtgcccagcatgacccagctgctgggcgacccccaggccggcatcagaagaaacgtggccagcgccctgggcaacctgggccccgagggcctgggcgaggagctgctgcagtgcgaggtgccccagagactgctggagatggcctgcggcgacccccagcccaacgtgaaggaggccgccctgatcgccctgagaagcctgcagcaggagcccggcatccaccaggtgctggtgagcctgggcgccagcgagaagctgagcctgctgagcctgggcaaccagagcctgccccacagcagccccagacccgccagcgccaagcactgcagaaagctgatccacctgctgagacccgcccacagcatgtag

SEQ ID NO: 98550 - DNA, 3885 bp, Artificial Sequence
  Description of Artificial Sequence: Synthetic coding sequence
atggagaagtaccacgtgctggagatgatcggcgagggcagcttcggcagagtgtacaagggcagaagaaagtacagcgcccaggtggtggccctgaagttcatccccaagctgggcagaagcgagaaggagctgagaaacctgcagagagagatcgagatcatgagaggcctgagacaccccaacatcgtgcacatgctggacagcttcgagaccgacaaggaggtggtggtggtgaccgactacgccgagggcgagctgttccagatcctggaggacgacggcaagctgcccgaggaccaggtgcaggccatcgccgcccagctggtgagcgccctgtactacctgcacagccacagaatcctgcacagagacatgaagccccagaacatcctgctggccaagggcggcggcatcaagctgtgcgacttcggcttcgccagagccatgagcaccaacaccatggtgctgaccagcatcaagggcacccccctgtacatgagccccgagctggtggaggagagaccctacgaccacaccgccgacctgtggagcgtgggctgcatcctgtacgagctggccgtgggcaccccccccttctacgccaccagcatcttccagctggtgagcctgatcctgaaggaccccgtgagatggcccagcaccatcagcccctgcttcaagaacttcctgcagggcctgctgaccaaggaccccagacagagactgagctggcccgacctgctgtaccaccccttcatcgccggccacgtgaccatcatcaccgagcccgccggccccgacctgggcacccccttcaccagcagactgccccccgagctgcaggtgctgaaggacgagcaggcccacagactggcccccaagggcaaccagagcagaatcctgacccaggcctacaagagaatggccgaggaggccatgcagaagaagcaccagaacaccggccccgccctggagcaggaggacaagaccagcaaggtggcccccggcaccgcccccctgcccagactgggcgccaccccccaggagagcagcctgctggccggcatcctggccagcgagctgaagagcagctgggccaagagcggcaccggcgaggtgcccagcgcccccagagagaacagaaccacccccgactgcgagagagccttccccgaggagagacccgaggtgctgggccagagaagcaccgacgtggtggacctggagaacgaggagcccgacagcgacaacgagtggcagcacctgctggagaccaccgagcccgtgcccatccagctgaaggcccccctgaccctgctgtgcaaccccgacttctgccagagaatccagagccagctgcacgaggccggcggccagatcctgaagggcatcctggagggcgccagccacatcctgcccgccttcagagtgctgagcagcctgctgagcagctgcagcgacagcgtggccctgtacagcttctgcagagaggccggcctgcccggcctgctgctgagcctgctgagacacagccaggagagcaacagcctgcagcagcagagctggtacggcaccttcctgcaggacctgatggccgtgatccaggcctacttcgcctgcaccttcaacctggagagaagccagaccagcgacagcctgcaggtgttccaggaggccgccaacctgttcctggacctgctgggcaagctgctggcccagcccgacgacagcgagcagaccctgagaagagacagcctgatgtgcttcaccgtgctgtgcgaggccatggacggcaacagcagagccatcagcaaggccttctacagcagcctgctgaccacccagcaggtggtgctggacggcctgctgcacggcctgaccgtgccccagctgcccgtgcacaccccccagggcgccccccaggtgagccagcccctgagagagcagagcgaggacatccccggcgccatcagcagcgccctggccgccatctgcaccgcccccgtgggcctgcccgactgctgggacgccaaggagcaggtgtgctggcacctggccaaccagctgaccgaggacagcagccagctgagacccagcctgatcagcggcctgcagcaccccatcctgtgcctgcacctgctgaaggtgctgtacagctgctgcctggtgagcgagggcctgtgcagactgctgggccaggagcccctggccctggagagcctgttcatgctgatccagggcaaggtgaaggtggtggactgggaggagagcaccgaggtgaccctgtacttcctgagcctgctggtgttcagactgcagaacctgccctgcggcatggagaagctgggcagcgacgtggccaccctgttcacccacagccacgtggtgagcctggtgagcgccgccgcctgcctgctgggccagctgggccagcagggcgtgaccttcgacctgcagcccatggagtggatggccgccgccacccacgccctgagcgcccccgccgagctgctgaccgagcagggcaaggccagcctgatcagagacatgagcagcagcgagatgtggaccgtgctgtggcacagattcagcatggtgctgagactgcccgaggaggccagcgcccaggagggcgagctgagcctgagcagcccccccagccccgagcccgactggaccctgatcagcccccagggcatggccgccctgctgagcctggccatggccaccttcacccaggagccccagctgtgcctgagctgcctgagccagcacggcagcatcctgatgagcatcctgaagcacctgctgtgccccagcttcctgaaccagctgagacaggccccccacggcagcgagttcctgcccgtggtggtgctgagcgtgtgccagctgctgtgcttccccttcgccctggacatggacgccgacctgctgatcggcgtgctggccgacctgagagacagcgaggtggccgcccacctgctgcaggtgtgctgctaccacctgcccctgatgcaggtggagctgcccatcagcctgctgaccagactggccctgatggaccccaccagcctgaaccagttcgtgaacaccgtgagcgccagccccagaaccatcgtgagcttcctgagcgtggccctgctgagcgaccagcccctgctgaccagcgacctgctgagcctgctggcccacaccgccagagtgctgagccccagccacctgagcttcatccaggagctgctggccggcagcgacgagagctacagacccctgagaagcctgctgggccaccccgagaacagcgtgagagcccacacctacagactgctgggccacctgctgcagcacagcatggccctgagaggcgccctgcagagccagagcggcctgctgagcctgctgctgctgggcctgggcgacaaggaccccgtggtgagatgcagcgccagcttcgccgtgggcaacgccgcctaccaggccggccccctgggccccgccctggccgccgccgtgcccagcatgacccagctgctgggcgacccccaggccggcatcagaagaaacgtggccagcgccctgggcaacctgggccccgagggcctgggcgaggagctgctgcagtgcgaggtgccccagagactgctggagatggcctgcggcgacccccagcccaacgtgaaggaggccgccctgatcgccctgagaagcctgcagcaggagcccggcatccaccaggtgctggtgagcctgggcgccagcgagaagctgagcctgctgagcctgggcaaccagagcctgccccacagcagccccagacccgccagcgccaagcactgcagaaagctgatccacctgctgagacccgcccacagcatgtag

SEQ ID NO: 98551 - DNA, 3885 bp, Artificial Sequence
  Description of Artificial Sequence: Synthetic coding sequence
atggagaagtaccacgtgctggagatgatcggcgagggcagcttcggcagagtgtacaagggcagaagaaagtacagcgcccaggtggtggccctgaagttcatccccaagctgggcagaagcgagaaggagctgagaaacctgcagagagagatcgagatcatgagaggcctgagacaccccaacatcgtgcacatgctggacagcttcgagaccgacaaggaggtggtggtggtgaccgactacgccgagggcgagctgttccagatcctggaggacgacggcaagctgcccgaggaccaggtgcaggccatcgccgcccagctggtgagcgccctgtactacctgcacagccacagaatcctgcacagagacatgaagccccagaacatcctgctggccaagggcggcggcatcaagctgtgcgacttcggcttcgccagagccatgagcaccaacaccatggtgctgaccagcatcaagggcacccccctgtacatgagccccgagctggtggaggagagaccctacgaccacaccgccgacctgtggagcgtgggctgcatcctgtacgagctggccgtgggcaccccccccttctacgccaccagcatcttccagctggtgagcctgatcctgaaggaccccgtgagatggcccagcaccatcagcccctgcttcaagaacttcctgcagggcctgctgaccaaggaccccagacagagactgagctggcccgacctgctgtaccaccccttcatcgccggccacgtgaccatcatcaccgagcccgccggccccgacctgggcacccccttcaccagcagactgccccccgagctgcaggtgctgaaggacgagcaggcccacagactggcccccaagggcaaccagagcagaatcctgacccaggcctacaagagaatggccgaggaggccatgcagaagaagcaccagaacaccggccccgccctggagcaggaggacaagaccagcaaggtggcccccggcaccgcccccctgcccagactgggcgccaccccccaggagagcagcctgctggccggcatcctggccagcgagctgaagagcagctgggccaagagcggcaccggcgaggtgcccagcgcccccagagagaacagaaccacccccgactgcgagagagccttccccgaggagagacccgaggtgctgggccagagaagcaccgacgtggtggacctggagaacgaggagcccgacagcgacaacgagtggcagcacctgctggagaccaccgagcccgtgcccatccagctgaaggcccccctgaccctgctgtgcaaccccgacttctgccagagaatccagagccagctgcacgaggccggcggccagatcctgaagggcatcctggagggcgccagccacatcctgcccgccttcagagtgctgagcagcctgctgagcagctgcagcgacagcgtggccctgtacagcttctgcagagaggccggcctgcccggcctgctgctgagcctgctgagacacagccaggagagcaacagcctgcagcagcagagctggtacggcaccttcctgcaggacctgatggccgtgatccaggcctacttcgcctgcaccttcaacctggagagaagccagaccagcgacagcctgcaggtgttccaggaggccgccaacctgttcctggacctgctgggcaagctgctggcccagcccgacgacagcgagcagaccctgagaagagacagcctgatgtgcttcaccgtgctgtgcgaggccatggacggcaacagcagagccatcagcaaggccttctacagcagcctgctgaccacccagcaggtggtgctggacggcctgctgcacggcctgaccgtgccccagctgcccgtgcacaccccccagggcgccccccaggtgagccagcccctgagagagcagagcgaggacatccccggcgccatcagcagcgccctggccgccatctgcaccgcccccgtgggcctgcccgactgctgggacgccaaggagcaggtgtgctggcacctggccaaccagctgaccgaggacagcagccagctgagacccagcctgatcagcggcctgcagcaccccatcctgtgcctgcacctgctgaaggtgctgtacagctgctgcctggtgagcgagggcctgtgcagactgctgggccaggagcccctggccctggagagcctgttcatgctgatccagggcaaggtgaaggtggtggactgggaggagagcaccgaggtgaccctgtacttcctgagcctgctggtgttcagactgcagaacctgccctgcggcatggagaagctgggcagcgacgtggccaccctgttcacccacagccacgtggtgagcctggtgagcgccgccgcctgcctgctgggccagctgggccagcagggcgtgaccttcgacctgcagcccatggagtggatggccgccgccacccacgccctgagcgcccccgccgagatgagctgcgagcagggcaaggccagcctgatcagagacatgagcagcagcgagatgtggaccgtgctgtggcacagattcagcatggtgctgagactgcccgaggaggccagcgcccaggagggcgagctgagcctgagcagcccccccagccccgagcccgactggaccctgatcagcccccagggcatggccgccctgctgagcctggccatggccaccttcacccaggagccccagctgtgcctgagctgcctgagccagcacggcagcatcctgatgagcatcctgaagcacctgctgtgccccagcttcctgaaccagctgagacaggccccccacggcagcgagttcctgcccgtggtggtgctgagcgtgtgccagctgctgtgcttccccttcgccctggacatggacgccgacctgctgatcggcgtgctggccgacctgagagacagcgaggtggccgcccacctgctgcaggtgtgctgctaccacctgcccctgatgcaggtggagctgcccatcagcctgctgaccagactggccctgatggaccccaccagcctgaaccagttcgtgaacaccgtgagcgccagccccagaaccatcgtgagcttcctgagcgtggccctgctgagcgaccagcccctgctgaccagcgacctgctgagcctgctggcccacaccgccagagtgctgagccccagccacctgagcttcatccaggagctgctggccggcagcgacgagagctacagacccctgagaagcctgctgggccaccccgagaacagcgtgagagcccacacctacagactgctgggccacctgctgcagcacagcatggccctgagaggcgccctgcagagccagagcggcctgctgagcctgctgctgctgggcctgggcgacaaggaccccgtggtgagatgcagcgccagcttcgccgtgggcaacgccgcctaccaggccggccccctgggccccgccctggccgccgccgtgcccagcatgacccagctgctgggcgacccccaggccggcatcagaagaaacgtggccagcgccctgggcaacctgggccccgagggcctgggcgaggagctgctgcagtgcgaggtgccccagagactgctggagatggcctgcggcgacccccagcccaacgtgaaggaggccgccctgatcgccctgagaagcctgcagcaggagcccggcatccaccaggtgctggtgagcctgggcgccagcgagaagctgagcctgctgagcctgggcaaccagagcctgccccacagcagccccagacccgccagcgccaagcactgcagaaagctgatccacctgctgagacccgcccacagcatgtag

SEQ ID NO: 98552 - DNA, 840 bp, Artificial Sequence
  Description of Artificial Sequence: Synthetic coding sequence
atggagaagtaccacgtgctggagatgatcggcgagggcagcttcggcagagtgtacaagggcagaagaaagtacagcgcccaggtggtggccctgaagttcatccccaagctgggcagaagcgagaaggagctgagaaacctgcagagagagatcgagatcatgagaggcctgagacaccccaacatcgtgcacatgctggacagcttcgagaccgacaaggaggtggtggtggtgaccgactacgccgagggcgagctgttccagatcctggaggacgacggcaagctgcccgaggaccaggtgcaggccatcgccgcccagctggtgagcgccctgtactacctgcacagccacagaatcctgcacagagacatgaagccccagaacatcctgctggccaagggcggcggcatcaagctgtgcgacttcggcttcgccagagccatgagcaccaacaccatggtgctgaccagcatcaagggcacccccctgtacatgagccccgagctggtggaggagagaccctacgaccacaccgccgacctgtggagcgtgggctgcatcctgtacgagctggccgtgggcaccccccccttctacgccaccagcatcttccagctggtgagcctgatcctgaaggaccccgtgagatggcccagcaccatcagcccctgcttcaagaacttcctgcagggcctgctgaccaaggaccccagacagagactgagctggcccgacctgctgtaccaccccttcatcgccggccacgtgaccatcatcaccgagcccgccggccccgacctgggcacccccttcaccagcagactgcccccctag

SEQ ID NO: 98553 - DNA, 3948 bp, Artificial Sequence; identical to SEQ ID NO: 98549
  Description of Artificial Sequence: Synthetic coding sequence

SEQ ID NO: 98554 - DNA, 1056 bp, Artificial Sequence
  Description of Artificial Sequence: Synthetic coding sequence
atgagattcaccttccccctgatggccatcgtgctggagatcgccatgatcgtgctgttcggcctgttcgtggagtacgagaccgaccagaccgtgctggagcagctgaacatcaccaagcccaccgacatgggcatcttcttcgagctgtaccccctgttccaggacgtgcacgtgatgatcttcgtgggcttcggcttcctgatgaccttcctgaagaagtacggcttcagcagcgtgggcatcaacctgctggtggccgccctgggcctgcagtggggcaccatcgtgcagggcatcctgcagagccagggccagaagttcaacatcggcatcaagaacatgatcaacgccgacttcagcgccgccaccgtgctgatcagcttcggcgccgtgctgggcaagaccagccccacccagatgctgatcatgaccatcctggagatcgtgttcttcgcccacaacgagtacctggtgagcgagatcttcaaggccagcgacatcggcgccagcatgaccatccacgccttcggcgcctacttcggcctggccgtggccggcatcctgtacagaagcggcctgagaaagggccacgagaacgaggagagcgcctactacagcgacctgttcgccatgatcggcaccctgttcctgtggatgttctggcccagcttcaacagcgccatcgccgagcccggcgacaagcagtgcagagccatcgtgaacacctacttcagcctggccgcctgcgtgctgaccgccttcgccttcagcagcctggtggagcacagaggcaagctgaacatggtgcacatccagaacgccaccctggccggcggcgtggccgtgggcacctgcgccgacatggccatccaccccttcggcagcatgatcatcggcagcatcgccggcatggtgagcgtgctgggctacaagttcctgaccgtgtacggccacgccggcagctgcaccggcttcctgtacagaaacagcagctgctggagaagcgacgacagattcaacagcaaggtggccagcctgggcaccgccatctag

SEQ ID NO: 98555 - DNA, 1389 bp, Artificial Sequence
  Description of Artificial Sequence: Synthetic coding sequence
atggagaccgtgcagctgagaaacccccccagaagacagctgaagaagctggacgaggacagcctgaccaagcagcccgaggaggtgttcgacgtgctggagaagctgggcgagggcagctacggcagcgtgtacaaggccatccacaaggagaccggccagatcgtggccatcaagcaggtgcccgtggagagcgacctgcaggagatcatcaaggagatcagcatcatgcagcagtgcgacagcccccacgtggtgaagtactacggcagctacttcaagaacaccgacctgtggatcgtgatggagtactgcggcgccggcagcgtgagcgacatcatcagactgagaaacaagaccctgaccgaggacgagatcgccaccatcctgcagagcaccctgaagggcctggagtacctgcacttcatgagaaagatccacagagacatcaaggccggcaacatcctgctgaacaccgagggccacgccaagctggccgacttcggcgtggccggccagctgaccgacaccatggccaagagaaacaccgtgatcggcacccccttctggatggcccccgaggtgatccaggagatcggctacaactgcgtggccgacatctggagcctgggcatcaccgccatcgagatggccgagggcaagcccccctacgccgacatccaccccatgagagccatcttcatgatccccaccaaccccccccccaccttcagaaagcccgagctgtggagcgacaacttcaccgacttcgtgaagcagtgcctggtgaagagccccgagcagagagccaccgccacccagctgctgcagcaccccttcgtgagaagcgccaagggcgtgagcatcctgagagacctgatcaacgaggccatggacgtgaagctgaagagacaggagagccagcagagagaggtggaccaggacgacgaggagaacagcgaggaggacgagatggacagcggcaccatggtgagagccgtgggcgacgagatgggcaccgtgagagtggccagcaccatgaccgacggcgccaacaccatgatcgagcacgacgacaccctgcccagccagctgggcaccatggtgatcaacgccgaggacgaggaggaggagggcaccatgaagagaagagacgagaccatgcagcccgccaagcccagcttcctggagtacttcgagcagaaggagaaggagaaccagatcaacagcttcggcaagagcgtgcccggccccctgaagaacagcagcgactggaagatcccccaggacggcgactacgagttcaagaccagccaggagcagcagagcggcaaggacatctgcatccagaactgccagggcaacctgctgtgcagatacgccttctag

SEQ ID NO: 98556 - DNA, 1464 bp, Artificial Sequence
  Description of Artificial Sequence: Synthetic coding sequence
atggagaccgtgcagctgagaaacccccccagaagacagctgaagaagctggacgaggacagcctgaccaagcagcccgaggaggtgttcgacgtgctggagaagctgggcgagggcagctacggcagcgtgtacaaggccatccacaaggagaccggccagatcgtggccatcaagcaggtgcccgtggagagcgacctgcaggagatcatcaaggagatcagcatcatgcagcagtgcgacagcccccacgtggtgaagtactacggcagctacttcaagaacaccgacctgtggatcgtgatggagtactgcggcgccggcagcgtgagcgacatcatcagactgagaaacaagaccctgaccgaggacgagatcgccaccatcctgcagagcaccctgaagggcctggagtacctgcacttcatgagaaagatccacagagacatcaaggccggcaacatcctgctgaacaccgagggccacgccaagctggccgacttcggcgtggccggccagctgaccgacaccatggccaagagaaacaccgtgatcggcacccccttctggatggcccccgaggtgatccaggagatcggctacaactgcgtggccgacatctggagcctgggcatcaccgccatcgagatggccgagggcaagcccccctacgccgacatccaccccatgagagccatcttcatgatccccaccaaccccccccccaccttcagaaagcccgagctgtggagcgacaacttcaccgacttcgtgaagcagtgcctggtgaagagccccgagcagagagccaccgccacccagctgctgcagcaccccttcgtgagaagcgccaagggcgtgagcatcctgagagacctgatcaacgaggccatggacgtgaagctgaagagacaggagagccagcagagagaggtggaccaggacgacgaggagaacagcgaggaggacgagatggacagcggcaccatggtgagagccgtgggcgacgagatgggcaccgtgagagtggccagcaccatgaccgacggcgccaacaccatgatcgagcacgacgacaccctgcccagccagctgggcaccatggtgatcaacgccgaggacgaggaggaggagggcaccatgaagagaagagacgagaccatgcagcccgccaagcccagcttcctggagtacttcgagcagaaggagaaggagaaccagatcaacagcttcggcaagagcgtgcccggccccctgaagaacagcagcgactggaagatcccccaggacggcgactacgagttcctgaagagctggaccgtggaggacctgcagaagagactgctggccctggaccccatgatggagcaggagatcgaggagatcagacagaagtaccagagcaagagacagcccatcctggacgccatcgaggccaagaagagaagacagcagaacttctag

SEQ ID NO: 98557 - DNA, 1389 bp, Artificial Sequence; identical to SEQ ID NO: 98555
  Description of Artificial Sequence: Synthetic coding sequence

SEQ ID NO: 98558 - DNA, 1299 bp, Artificial Sequence
  Description of Artificial Sequence: Synthetic coding sequence
atggagaccgtgcagctgagaaacccccccagaagacagctgaagaagctggacgaggacagcctgaccaagcagcccgaggaggtgttcgacgtgctggagaagctgggcgagggcagctacggcagcgtgtacaaggccatccacaaggagaccggccagatcgtggccatcaagcaggtgcccgtggagagcgacctgcaggagatcatcaaggagatcagcatcatgcagcagtgcgacagcccccacgtggtgaagtactacggcagctacttcaagaacaccgacctgtggatcgtgatggagtactgcggcgccggcagcgtgagcgacatcatcagactgagaaacaagaccgacaccatggccaagagaaacaccgtgatcggcacccccttctggatggcccccgaggtgatccaggagatcggctacaactgcgtggccgacatctggagcctgggcatcaccgccatcgagatggccgagggcaagcccccctacgccgacatccaccccatgagagccatcttcatgatccccaccaaccccccccccaccttcagaaagcccgagctgtggagcgacaacttcaccgacttcgtgaagcagtgcctggtgaagagccccgagcagagagccaccgccacccagctgctgcagcaccccttcgtgagaagcgccaagggcgtgagcatcctgagagacctgatcaacgaggccatggacgtgaagctgaagagacaggagagccagcagagagaggtggaccaggacgacgaggagaacagcgaggaggacgagatggacagcggcaccatggtgagagccgtgggcgacgagatgggcaccgtgagagtggccagcaccatgaccgacggcgccaacaccatgatcgagcacgacgacaccctgcccagccagctgggcaccatggtgatcaacgccgaggacgaggaggaggagggcaccatgaagagaagagacgagaccatgcagcccgccaagcccagcttcctggagtacttcgagcagaaggagaaggagaaccagatcaacagcttcggcaagagcgtgcccggccccctgaagaacagcagcgactggaagatcccccaggacggcgactacgagttcctgaagagctggaccgtggaggacctgcagaagagactgctggccctggaccccatgatggagcaggagatcgaggagatcagacagaagtaccagagcaagagacagcccatcctggacgccatcgaggccaagaagagaagacagcagaacttctag

SEQ ID NO: 98559 - DNA, 1254 bp, Artificial Sequence
  Description of Artificial Sequence: Synthetic coding sequence
atgaagagaagagccagcgacagaggcgccggcgagaccagcgccagagccaaggccctgggcagcggcatcagcggcaacaacgccaagagagccggccccttcatcctgggccccagactgggcaacagccccgtgcccagcatcgtgcagtgcctggccagaaaggacggcaccgacgacttctaccagctgaagatcctgaccctggaggagagaggcgaccagggcatcgagagccaggaggagagacagggcaagatgctgctgcacaccgagtacagcctgctgagcctgctgcacacccaggacggcgtggtgcaccaccacggcctgttccaggacagaacctgcgagatcgtggaggacaccgagagcagcagaatggtgaagaagatgaagaagagaatctgcctggtgctggactgcctgtgcgcccacgacttcagcgacaagaccgccgacctgatcaacctgcagcactacgtgatcaaggagaagagactgagcgagagagagaccgtggtgatcttctacgacgtggtgagagtggtggaggccctgcaccagaagaacatcgtgcacagagacctgaagctgggcaacatggtgctgaacaagagaacccacagaatcaccatcaccaacttctgcctgggcaagcacctggtgagcgagggcgacctgctgaaggaccagagaggcagccccgcctacatcagccccgacgtgctgagcggcagaccctacagaggcaagcccagcgacatgtgggccctgggcgtggtgctgttcaccatgctgtacggccagttccccttctacgacagcatcccccaggagctgttcagaaagatcaaggccgccgagtacaccatccccgaggacggcagagtgagcgagaacaccgtgtgcctgatcagaaagctgctggtgctggacccccagcagagactggccgccgccgacgtgctggaggccctgagcgccatcatcgccagctggcagagcctgagcagcctgagcggccccctgcaggtggtgcccgacatcgacgaccagatgagcaacgccgacagcagccaggaggtgagctggggcggccagatgggccactaccccgcccccagagacagactgctgggcgccggcagagccagagccgaggtggccgccaccagaagaccccagagcttcctgggcctgctgccccagccctggggcggcaagggcagactgcagagcagcgcctag

SEQ ID NO: 98560 - DNA, 1308 bp, Artificial Sequence
  Description of Artificial Sequence: Synthetic coding sequence
atgaagagaagagccagcgacagaggcgccggcgagaccagcgccagagccaaggccctgggcagcggcatcagcggcaacaacgccaagagagccggccccttcatcctgggccccagactgggcaacagccccgtgcccagcatcgtgcagtgcctggccagaaaggacggcaccgacgacttctaccagctgaagatcctgaccctggaggagagaggcgaccagggcatcgagagccaggaggagagacagggcaagatgctgctgcacaccgagtacagcctgctgagcctgctgcacacccaggacggcgtggtgcaccaccacggcctgttccaggacagaacctgcgagatcgtggaggacaccgagagcagcagaatggtgaagaagatgaagaagagaatctgcctggtgctggactgcctgtgcgcccacgacttcagcgacaagaccgccgacctgatcaacctgcagcactacgtgatcaaggagaagagactgagcgagagagagaccgtggtgatcttctacgacgtggtgagagtggtggaggccctgcaccagaagaacatcgtgcacagagacctgaagctgggcaacatggtgctgaacaagagaacccacagaatcaccatcaccaacttctgcctgggcaagcacctggtgagcgagggcgacctgctgaaggaccagagaggcagccccgcctacatcagccccgacgtgctgagcggcagaccctacagaggcaagcccagcgacatgtgggccctgggcgtggtgctgttcaccatgctgtacggccagttccccttctacgacagcatcccccaggagctgttcagaaagatcaaggccgccgagtacaccatccccgaggacggcagagtgagcgagaacaccgtgtgcctgatcagaaagctgctggtgctggacccccagcagagactggccgccgccgacgtgctggaggccctgagcgccatcatcgccagctggcagagcctgagcagcctgagcggccccctgcaggtggtgcccgacatcgacgaccagatgagcaacgccgacagcagccaggaggccaaggtgaccgaggagtgcagccagtacgagttcgagaactacatgagacagcagctgctgctggccgaggagaagagcagcatccacgacgccagaagctgggtgcccaagagacagttcggcagcgccccccccgtgagaagactgggccacgacgcccagcccatgaccagcctggacaccgccatcctggcccagagatacctgagaaagtag

SEQ ID NO: 98561 - DNA, 1323 bp, Artificial Sequence
  Description of Artificial Sequence: Synthetic coding sequence
atgaagagaagagccagcgacagaggcgccggcgagaccagcgccagagccaaggccctgggcagcggcatcagcggcaacaacgccaagagagccggccccttcatcctggccctgtgcgccgtgggccccagactgggcaacagccccgtgcccagcatcgtgcagtgcctggccagaaaggacggcaccgacgacttctaccagctgaagatcctgaccctggaggagagaggcgaccagggcatcgagagccaggaggagagacagggcaagatgctgctgcacaccgagtacagcctgctgagcctgctgcacacccaggacggcgtggtgcaccaccacggcctgttccaggacagaacctgcgagatcgtggaggacaccgagagcagcagaatggtgaagaagatgaagaagagaatctgcctggtgctggactgcctgtgcgcccacgacttcagcgacaagaccgccgacctgatcaacctgcagcactacgtgatcaaggagaagagactgagcgagagagagaccgtggtgatcttctacgacgtggtgagagtggtggaggccctgcaccagaagaacatcgtgcacagagacctgaagctgggcaacatggtgctgaacaagagaacccacagaatcaccatcaccaacttctgcctgggcaagcacctggtgagcgagggcgacctgctgaaggaccagagaggcagccccgcctacatcagccccgacgtgctgagcggcagaccctacagaggcaagcccagcgacatgtgggccctgggcgtggtgctgttcaccatgctgtacggccagttccccttctacgacagcatcccccaggagctgttcagaaagatcaaggccgccgagtacaccatccccgaggacggcagagtgagcgagaacaccgtgtgcctgatcagaaagctgctggtgctggacccccagcagagactggccgccgccgacgtgctggaggccctgagcgccatcatcgccagctggcagagcctgagcagcctgagcggccccctgcaggtggtgcccgacatcgacgaccagatgagcaacgccgacagcagccaggaggccaaggtgaccgaggagtgcagccagtacgagttcgagaactacatgagacagcagctgctgctggccgaggagaagagcagcatccacgacgccagaagctgggtgcccaagagacagttcggcagcgccccccccgtgagaagactgggccacgacgcccagcccatgaccagcctggacaccgccatcctggcccagagatacctgagaaagtag

SEQ ID NO: 98562 - DNA, 1308 bp, Artificial Sequence; identical to SEQ ID NO: 98560
  Description of Artificial Sequence: Synthetic coding sequence

SEQ ID NO: 98563 - DNA, 1092 bp, Artificial Sequence
  Description of Artificial Sequence: Synthetic coding sequence
atggccatgagacagacccccctgacctgcagcggccacaccagacccgtggtggacctggccttcagcggcatcaccccctacggctacttcctgatcagcgcctgcaagggcgccggccagcacctgcccagactgagcggccagcacgacggcaagcccatgctgagacagggcgacaccggcgactggatcggcaccttcctgggccacaagggcgccgtgtggggcgccaccctgaacaaggacgccaccaaggccgccaccgccgccgccgacttcaccgccaaggtgtgggacgccgtgagcggcgacgagctgatgaccctggcccacaagcacatcgtgaagaccgtggacttcacccaggacagcaactacctgctgaccggcggccaggacaagctgctgagaatctacgacctgaacaagcccgaggccgagcccaaggagatcagcggccacaccagcggcatcaagaaggccctgtggtgcagcgaggacaagcagatcctgagcgccgacgacaagaccgtgagactgtgggaccacgccaccatgaccgaggtgaagagcctgaacttcaacatgagcgtgagcagcatggagtacatccccgagggcgagatcctggtgatcacctacggcagaagcatcgccttccacagcgccgtgagcctggaccccatcaagagcttcgaggcccccgccaccatcaacagcgccagcctgcaccccgagaaggagttcctggtggccggcggcgaggacttcaagctgtacaagtacgactacaacagcggcgaggagctggagagctacaagggccacttcggccccatccactgcgtgagattcagccccgacggcgagctgtacgccagcggcagcgaggacggcaccctgagactgtggcagaccgtggtgggcaagacctacggcctgtggaagtgcgtgctgcccgaggaggacagcggcgagctggccaagcccaagatcggcttccccgagaccaccgaggaggagctggaggagatcgccagcgagaacagcgactgcatcttccccagcgcccccgacgtgaaggcctag

SEQ ID NO: 98564 - DNA, 1053 bp, Artificial Sequence
  Description of Artificial Sequence: Synthetic coding sequence
atggccatgagacagacccccctgacctgcagcggccacaccagacccgtggtggacctggccttcagcggcatcaccccctacggctacttcctgatcagcgcctgcaaggacggcaagcccatgctgagacagggcgacaccggcgactggatcggcaccttcctgggccacaagggcgccgtgtggggcgccaccctgaacaaggacgccaccaaggccgccaccgccgccgccgacttcaccgccaaggtgtgggacgccgtgagcggcgacgagctgatgaccctggcccacaagcacatcgtgaagaccgtggacttcacccaggacagcaactacctgctgaccggcggccaggacaagctgctgagaatctacgacctgaacaagcccgaggccgagcccaaggagatcagcggccacaccagcggcatcaagaaggccctgtggtgcagcgaggacaagcagatcctgagcgccgacgacaagaccgtgagactgtgggaccacgccaccatgaccgaggtgaagagcctgaacttcaacatgagcgtgagcagcatggagtacatccccgagggcgagatcctggtgatcacctacggcagaagcatcgccttccacagcgccgtgagcctggaccccatcaagagcttcgaggcccccgccaccatcaacagcgccagcctgcaccccgagaaggagttcctggtggccggcggcgaggacttcaagctgtacaagtacgactacaacagcggcgaggagctggagagctacaagggccacttcggccccatccactgcgtgagattcagccccgacggcgagctgtacgccagcggcagcgaggacggcaccctgagactgtggcagaccgtggtgggcaagacctacggcctgtggaagtgcgtgctgcccgaggaggacagcggcgagctggccaagcccaagatcggcttccccgagaccaccgaggaggagctggaggagatcgccagcgagaacagcgactgcatcttccccagcgcccccgacgtgaaggcctag

SEQ ID NO: 98565 - DNA, 771 bp, Artificial Sequence
  Description of Artificial Sequence: Synthetic coding sequence
atgaccctggcccacaagcacatcgtgaagaccgtggacttcacccaggacagcaactacctgctgaccggcggccaggacaagctgctgagaatctacgacctgaacaagcccgaggccgagcccaaggagatcagcggccacaccagcggcatcaagaaggccctgtggtgcagcgaggacaagcagatcctgagcgccgacgacaagaccgtgagactgtgggaccacgccaccatgaccgaggtgaagagcctgaacttcaacatgagcgtgagcagcatggagtacatccccgagggcgagatcctggtgatcacctacggcagaagcatcgccttccacagcgccgtgagcctggaccccatcaagagcttcgaggcccccgccaccatcaacagcgccagcctgcaccccgagaaggagttcctggtggccggcggcgaggacttcaagctgtacaagtacgactacaacagcggcgaggagctggagagctacaagggccacttcggccccatccactgcgtgagattcagccccgacggcgagctgtacgccagcggcagcgaggacggcaccctgagactgtggcagaccgtggtgggcaagacctacggcctgtggaagtgcgtgctgcccgaggaggacagcggcgagctggccaagcccaagatcggcttccccgagaccaccgaggaggagctggaggagatcgccagcgagaacagcgactgcatcttccccagcgcccccgacgtgaaggcctag

SEQ ID NO: 98566 - DNA, 1707 bp, Artificial Sequence
  Description of Artificial Sequence: Synthetic coding sequence
atgaagaacaagatccaggtggtggtgctggagaacgagggcctgcagcagcagctgaagagccagagacaggaggagaccctgagagagcagaccctgctggacgccagcggcaacatgcacaacagctggatcaccaccggcgaggacagcggcgtgggcgagaccagcaagagacccttcagccacgacaacgccgacttcggcaaggccgccagcgccggcgagcagctggagctggagaagctgaagctgacctacgaggagaagtgcgagatcgaggagagccagctgaagttcctgagaaacgacctggccgagtaccagagaacctgcgaggacctgaaggagcagctgaagcacaaggagttcctgctggccgccaacacctgcaacagagtgggcggcctgtgcctgaagtgcgcccagcacgaggccgtgctgagccagacccacaccaacgtgcacatgcagaccatcgagagactggtgaaggagagagacgacctgatgagcgccctggtgagcgtgagaagcagcctggccgacacccagcagagagaggccagcgcctacgagcaggtgaagcaggtgctgcagatcagcgaggaggccaacttcgagaagaccaaggccctgatccagtgcgaccagctgagaaaggagctggagagacaggccgagagactggagaaggagctggccagccagcaggagaagagagccatcgagaaggacatgatgaagaaggagatcaccaaggagagagagtacatgggcagcaagatgctgatcctgagccagaacatcgcccagctggaggcccaggtggagaaggtgaccaaggagaagatcagcgccatcaaccagctggaggagatccagagccagctggccagcagagagatggacgtgaccaaggtgtgcggcgagatgagataccagctgaacaagaccaacatggagaaggacgaggccgagaaggagcacagagagttcagagccaagaccaacagagacctggagatcaaggaccaggagatcgagaagctgagaatcgagctggacgagagcaagcagcacctggagcaggagcagcagaaggccgccctggccagagaggagtgcctgagactgaccgagctgctgggcgagagcgagcaccagctgcacctgaccagacaggagaaggacagcatccagcagagcttcagcaaggaggccaaggcccaggccctgcaggcccagcagagagagcaggagctgacccagaagatccagcagatggaggcccagcacgacaagaccgagaacgagcagtacctgctgctgaccagccagaacaccttcctgaccaagctgaaggaggagtgctgcaccctggccaagaagctggagcagatcagccagaagaccagaagcgagatcgcccagctgagccaggagaagagatacacctacgacaagctgggcaagctgcagagaagaaacgaggagctggaggagcagtgcgtgcagcacggcagagtgcacgagaccatgaagcagagactgagacagctggacaagcacagccaggccaccgcccagcagctggtgcagctgctgagcaagcagaaccagctgctgctggagagacagagcctgagcgaggaggtggacagactgagaacccagctgcccagcatgccccagagcgactgctag

SEQ ID NO: 98567 - DNA, 2013 bp, Artificial Sequence
  Description of Artificial Sequence: Synthetic coding sequence
atggccaagagccccgagaacagcaccctggaggagatcctgggccagtaccagagaagcctgagagagcacgccagcagaagcatccaccagctgacctgcgccctgaaggagggcgacgtgaccatcggcgaggacgcccccaacctgagcttcagcaccagcgtgggcaacgaggacgccagaaccgcctggcccgagctgcagcagagccacgccgtgaaccagctgaaggacctgctgagacagcaggccgacaaggagagcgaggtgagccccagcagaagaagaaagatgagccccctgagaagcctggagcacgaggagaccaacatgcccaccatgcacgacctggtgcacaccatcaacgaccagagccagtacatccaccacctggaggccgaggtgaagttctgcaaggaggagctgagcggcatgaagaacaagatccaggtggtggtgctggagaacgagggcctgcagcagcagctgaagagccagagacaggaggagaccctgagagagcagaccctgctggacgccagcgagaagctgaagctgacctacgaggagaagtgcgagatcgaggagagccagctgaagttcctgagaaacgacctggccgagtaccagagaacctgcgaggacctgaaggagcagctgaagcacaaggagttcctgctggccgccaacacctgcaacagagtgggcggcctgtgcctgaagtgcgcccagcacgaggccgtgctgagccagacccacaccaacgtgcacatgcagaccatcgagagactggtgaaggagagagacgacctgatgagcgccctggtgagcgtgagaagcagcctggccgacacccagcagagagaggccagcgcctacgagcaggtgaagcaggtgctgcagatcagcgaggaggccaacttcgagaagaccaaggccctgatccagtgcgaccagctgagaaaggagctggagagacaggccgagagactggagaaggagctggccagccagcaggagaagagagccatcgagaaggacatgatgaagaaggagatcaccaaggagagagagtacatgggcagcaagatgctgatcctgagccagaacatcgcccagctggaggcccaggtggagaaggtgaccaaggagaagatcagcgccatcaaccagctggaggagatccagagccagctggccagcagagagatggacgtgaccaaggtgtgcggcgagatgagataccagctgaacaagaccaacatggagaaggacgaggccgagaaggagcacagagagttcagagccaagaccaacagagacctggagatcaaggaccaggagatcgagaagctgagaatcgagctggacgagagcaagcagcacctggagcaggagcagcagaaggccgccctggccagagaggagtgcctgagactgaccgagctgctgggcgagagcgagcaccagctgcacctgaccagacaggagaaggacagcatccagcagagcttcagcaaggaggccaaggcccaggccctgcaggcccagcagagagagcaggagctgacccagaagatccagcagatggaggcccagcacgacaagaccgagaacgagcagtacctgctgctgaccagccagaacaccttcctgaccaagctgaaggaggagtgctgcaccctggccaagaagctggagcagatcagccagaagaccagaagcgagatcgcccagctgagccaggagaagagatacacctacgacaagctgggcaagctgcagagaagaaacgaggagctggaggagcagtgcgtgcagcacggcagagtgcacgagaccatgaagcagagactgagacagctggacaagcacagccaggccaccgcccagcagctggtgcagctgctgagcaagcagaaccagctgctgctggagagacagagcctgagcgaggaggtggacagactgagaacccagctgcccagcatgccccagagcgactgctag

SEQ ID NO: 98568 - DNA, 2142 bp, Artificial Sequence
  Description of Artificial Sequence: Synthetic coding sequence
atggccaagagccccgagaacagcaccctggaggagatcctgggccagtaccagagaagcctgagagagcacgccagcagaagcatccaccagctgacctgcgccctgaaggagggcgacgtgaccatcggcgaggacgcccccaacctgagcttcagcaccagcgtgggcaacgaggacgccagaaccgcctggcccgagctgcagcagagccacgccgtgaaccagctgaaggacctgctgagacagcaggccgacaaggagagcgaggtgagccccagcagaagaagaaagatgagccccctgagaagcctggagcacgaggagaccaacatgcccaccatgcacgacctggtgcacaccatcaacgaccagagccagtacatccaccacctggaggccgaggtgaagttctgcaaggaggagctgagcggcatgaagaacaagatccaggtggtggtgctggagaacgagggcctgcagcagcagctgaagagccagagacaggaggagaccctgagagagcagaccctgctggacgccagcggcaacatgcacaacagctggatcaccaccggcgaggacagcggcgtgggcgagaccagcaagagacccttcagccacgacaacgccgacttcggcaaggccgccagcgccggcgagcagctggagctggagaagctgaagctgacctacgaggagaagtgcgagatcgaggagagccagctgaagttcctgagaaacgacctggccgagtaccagagaacctgcgaggacctgaaggagcagctgaagcacaaggagttcctgctggccgccaacacctgcaacagagtgggcggcctgtgcctgaagtgcgcccagcacgaggccgtgctgagccagacccacaccaacgtgcacatgcagaccatcgagagactggtgaaggagagagacgacctgatgagcgccctggtgagcgtgagaagcagcctggccgacacccagcagagagaggccagcgcctacgagcaggtgaagcaggtgctgcagatcagcgaggaggccaacttcgagaagaccaaggccctgatccagtgcgaccagctgagaaaggagctggagagacaggccgagagactggagaaggagctggccagccagcaggagaagagagccatcgagaaggacatgatgaagaaggagatcaccaaggagagagagtacatgggcagcaagatgctgatcctgagccagaacatcgcccagctggaggcccaggtggagaaggtgaccaaggagaagatcagcgccatcaaccagctggaggagatccagagccagctggccagcagagagatggacgtgaccaaggtgtgcggcgagatgagataccagctgaacaagaccaacatggagaaggacgaggccgagaaggagcacagagagttcagagccaagaccaacagagacctggagatcaaggaccaggagatcgagaagctgagaatcgagctggacgagagcaagcagcacctggagcaggagcagcagaaggccgccctggccagagaggagtgcctgagactgaccgagctgctgggcgagagcgagcaccagctgcacctgaccagacaggagaaggacagcatccagcagagcttcagcaaggaggccaaggcccaggccctgcaggcccagcagagagagcaggagctgacccagaagatccagcagatggaggcccagcacgacaagaccgagaacgagcagtacctgctgctgaccagccagaacaccttcctgaccaagctgaaggaggagtgctgcaccctggccaagaagctggagcagatcagccagaagaccagaagcgagatcgcccagctgagccaggagaagagatacacctacgacaagctgggcaagctgcagagaagaaacgaggagctggaggagcagtgcgtgcagcacggcagagtgcacgagaccatgaagcagagactgagacagctggacaagcacagccaggccaccgcccagcagctggtgcagctgctgagcaagcagaaccagctgctgctggagagacagagcctgagcgaggaggtggacagactgagaacccagctgcccagcatgccccagagcgactgctag

SEQ ID NO: 98569 - DNA, 1083 bp, Artificial Sequence
  Description of Artificial Sequence: Synthetic coding sequence
atggccaagagccccgagaacagcaccctggaggagatcctgggccagtaccagagaagcctgagagagcacgccagcagaagcatccaccagctgacctgcgccctgaaggagggcgacgtgaccatcggcgaggacgcccccaacctgagcttcagcaccagcgtgggcaacgaggacgccagaaccgcctggcccgagctgcagcagagccacgccgtgaaccagctgaaggacctgctgagacagcaggccgacaaggagagcgaggtgagccccagcagaagaagaaagatgagccccctgagaagcctggagcacgaggagaccaacatgcccaccatgcacgacctggtgcacaccatcaacgaccagagccagtacatccaccacctggaggccgaggtgaagttctgcaaggaggagctgagcggcatgaagaacaagatccaggtggtggtgctggagaacgagggcctgcagcagcagctgaagagccagagacaggaggagaccctgagagagcagaccctgctggacgccagcggcaacatgcacaacagctggatcaccaccggcgaggacagcggcgtgggcgagaccagcaagagacccttcagccacgacaacgccgacttcggcaaggccgccagcgccggcgagcagctggagctggagaagctgaagctgacctacgaggagaagtgcgagatcgaggagagccagctgaagttcctgagaaacgacctggccgagtaccagagaacctgcgaggacctgaaggagcagctgaagcacaaggagttcctgctggccgccaacacctgcaacagagtgggcggcctgtgcctgaagtgcgcccagcacgaggccgtgctgagccagacccacaccaacgtgcacatgcagaccatcgagagactggtgaaggagagagacgacctgatgagcgccctggtgagcgtgagaagcagcctggccgacacccagcagagagaggccagcgcctacgagcaggtgaagcaggtgctgcagatcagcgaggaggccaacttcgagaagaccaagcaccccagccagtag

SEQ ID NO: 98570 - DNA, 1245 bp, Artificial Sequence
  Description of Artificial Sequence: Synthetic coding sequence
ctgctggacgccagcgagaagctgaagctgacctacgaggagaagtgcgagatcgaggagagccagctgaagttcctgagaaacgacctggccgagtaccagagaacctgcgaggacctgaaggagcagctgaagcacaaggagttcctgctggccgccaacacctgcaacagagtgggcggcctgtgcctgaagtgcgcccagcacgaggccgtgctgagccagacccacaccaacgtgcacatgcagaccatcgagagactggtgaaggagagagacgacctgatgagcgccctggtgagcgtgagaagcagcctggccgacacccagcagagagaggccagcgcctacgagcaggtgaagcaggtgctgcagatcagcgaggaggccaacttcgagaagaccaaggccctgatccagtgcgaccagctgagaaaggagctggagagacaggccgagagactggagaaggagctggccagccagcaggagaagagagccatcgagaaggacatgatgaagaaggagatcaccaaggagagagagtacatgggcagcaagatgctgatcctgagccagaacatcgcccagctggaggcccaggtggagaaggtgaccaaggagaagatcagcgccatcaaccagctggaggagatccagagccagctggccagcagagagatggacgtgaccaaggtgtgcggcgagatgagataccagctgaacaagaccaacatggagaaggacgaggccgagaaggagcacagagagttcagagccaagaccaacagagacctggagatcaaggaccaggagatcgagaagctgagaatcgagctggacgagagcaagcagcacctggagcaggagcagcagaaggccgccctggccagagaggagtgcctgagactgaccgagctgctgggcgagagcgagcaccagctgcacctgaccagaagcgagatcgcccagctgagccaggagaagagatacacctacgacaagctgggcaagctgcagagaagaaacgaggagctggaggagcagtgcgtgcagcacggcagagtgcacgagaccatgaagcagagactgagacagctggacaagcacagccaggccaccgcccagcagctggtgcagctgctgagcaagcagaaccagctgctgctggagagacagagcctgagcgaggaggtggacagactgagaacccagctgcccagcatgccccagagcgactgctag

SEQ ID NO: 98571 - DNA, 729 bp, Artificial Sequence
  Description of Artificial Sequence: Synthetic coding sequence
atggacgacctgtgcgaggccaacggcaccttcgccatcagcctgttcaagatcctgggcgaggaggacaacagcagaaacgtgttcttcagccccatgagcatcagcagcgccctggccatggtgttcatgggcgccaagggcagcaccgccgcccagatgagccaggccctgtgcctgtacaaggacggcgacatccacagaggcttccagagcctgctgagcgaggtgaacagaaccggcacccagtacctgctgagaaccgccaacagactgttcggcgagaagacctgcgacttcctgcccgacttcaaggagtactgccagaagttctaccaggccgagctggaggagctgagcttcgccgaggacaccgaggagtgcagaaagcacatcaacgactgggtggccgagaagaccgagggcaagatcagcgaggtgctggacgccggcaccgtggaccccctgaccaagctggtgctggtgaacgccatctacttcaagggcaagtggaacgagcagttcgacagaaagtacaccagaggcatgctgttcaagaccaacgaggagaagaagaccgtgcagatgatgttcaaggaggccaagttcaagatgggctacgccgacgaggtgcacacccaggtgctggagctgccctacgtggaggaggagctgagcatggtgatcctgctgcccgacgacaacaccgacctggccgtgaaggagtag

SEQ ID NO: 98572 - DNA, 1335 bp, Artificial Sequence
  Description of Artificial Sequence: Synthetic coding sequence
atgaaggtggtgcccagcctgctgctgagcgtgctgctggcccaggtgtggctggtgcccggcctggcccccagcccccagagccccgagacccccgccccccagaaccagaccagcagagtggtgcaggcccccaaggaggaggaggaggacgagcaggaggccagcgaggagaaggccagcgaggaggagaaggcctggctgatggccagcagacagcagctggccaaggagaccagcaacttcggcttcagcctgctgagaaagatcagcatgagacacgacggcaacatggtgttcagccccttcggcatgagcctggccatgaccggcctgatgctgggcgccaccggccccaccgagacccagatcaagagaggcctgcacctgcaggccctgaagcccaccaagcccggcctgctgcccagcctgttcaagggcctgagagagaccctgagcagaaacctggagctgggcctgacccagggcagcttcgccttcatccacaaggacttcgacgtgaaggagaccttcttcaacctgagcaagagatacttcgacaccgagtgcgtgcccatgaacttcagaaacgccagccaggccaagagactgatgaaccactacatcaacaaggagaccagaggcaagatccccaagctgttcgacgagatcaaccccgagaccaagctgatcctggtggactacatcctgttcaagggcaagtggctgacccccttcgaccccgtgttcaccgaggtggacaccttccacctggacaagtacaagaccatcaaggtgcccatgatgtacggcgccggcaagttcgccagcaccttcgacaagaacttcagatgccacgtgctgaagctgccctaccagggcaacgccaccatgctggtggtgctgatggagaagatgggcgaccacctggccctggaggactacctgaccaccgacctggtggagacctggctgagaaacatgaagaccagaaacatggaggtgttcttccccaagttcaagctggaccagaagtacgagatgcacgagctgctgagacagatgggcatcagaagaatcttcagccccttcgccgacctgagcgagctgagcgccaccggcagaaacctgcaggtgagcagagtgctgcagagaaccgtgatcgaggtggacgagagaggcaccgaggccgtggccggcatcctgagcgagatcaccgcctacagcatgccccccgtgatcaaggtggacagacccttccacttcatgatctacgaggagaccagcggcatgctgctgttcctgggcagagtggtgaaccccaccctgctgtag

SEQ ID NO: 98573 - DNA, 1335 bp, Artificial Sequence; identical to SEQ ID NO: 98572
  Description of Artificial Sequence: Synthetic coding sequence

SEQ ID NO: 98574 - DNA, 1335 bp, Artificial Sequence; identical to SEQ ID NO: 98572
  Description of Artificial Sequence: Synthetic coding sequence

SEQ ID NO: 98575 - DNA, 1455 bp, Artificial Sequence
  Description of Artificial Sequence: Synthetic coding sequence
atgagcagaagcacccaggagctgctgggctaccactgcagactgcaggacaagctgcaggagcaggagggcagcctggccgccgagggcagacacagcctggccagcgccgccgaccacatgaaggtggtgcccagcctgctgctgagcgtgctgctggcccaggtgtggctggtgcccggcctggcccccagcccccagagccccgagacccccgccccccagaaccagaccagcagagtggtgcaggcccccaaggaggaggaggaggacgagcaggaggccagcgaggagaaggccagcgaggaggagaaggcctggctgatggccagcagacagcagctggccaaggagaccagcaacttcggcttcagcctgctgagaaagatcagcatgagacacgacggcaacatggtgttcagccccttcggcatgagcctggccatgaccggcctgatgctgggcgccaccggccccaccgagacccagatcaagagaggcctgcacctgcaggccctgaagcccaccaagcccggcctgctgcccagcctgttcaagggcctgagagagaccctgagcagaaacctggagctgggcctgacccagggcagcttcgccttcatccacaaggacttcgacgtgaaggagaccttcttcaacctgagcaagagatacttcgacaccgagtgcgtgcccatgaacttcagaaacgccagccaggccaagagactgatgaaccactacatcaacaaggagaccagaggcaagatccccaagctgttcgacgagatcaaccccgagaccaagctgatcctggtggactacatcctgttcaagggcaagtggctgacccccttcgaccccgtgttcaccgaggtggacaccttccacctggacaagtacaagaccatcaaggtgcccatgatgtacggcgccggcaagttcgccagcaccttcgacaagaacttcagatgccacgtgctgaagctgccctaccagggcaacgccaccatgctggtggtgctgatggagaagatgggcgaccacctggccctggaggactacctgaccaccgacctggtggagacctggctgagaaacatgaagaccagaaacatggaggtgttcttccccaagttcaagctggaccagaagtacgagatgcacgagctgctgagacagatgggcatcagaagaatcttcagccccttcgccgacctgagcgagctgagcgccaccggcagaaacctgcaggtgagcagagtgctgcagagaaccgtgatcgaggtggacgagagaggcaccgaggccgtggccggcatcctgagcgagatcaccgcctacagcatgccccccgtgatcaaggtggacagacccttccacttcatgatctacgaggagaccagcggcatgctgctgttcctgggcagagtggtgaaccccaccctgctgtag

SEQ ID NO: 98576 - DNA, 288 bp, Artificial Sequence
  Description of Artificial Sequence: Synthetic coding sequence
atggagagaatgctgcccctgctggccctgggcctgctggccgccggcttctgccccgccgtgctgtgccaccccaacagccccctggacgaggagaacctgacccaggagaaccaggacagaggcacccacgtggacctgggcctggccagcgccaacgtggacttcgccttcagcctgtacaagcacccccacagatggagcatcagactgtgcctgatgtacctgagaagagcccagaagcacctgctgccccagcagagcaagagccccagcttcctgcactag

SEQ ID NO: 98577 - DNA, 1272 bp, Artificial Sequence
  Description of Artificial Sequence: Synthetic coding sequence
atggagagaatgctgcccctgctggccctgggcctgctggccgccggcttctgccccgccgtgctgtgccaccccaacagccccctggacgaggagaacctgacccaggagaaccaggacagaggcacccacgtggacctgggcctggccagcgccaacgtggacttcgccttcagcctgtacaagcagctggtgctgaaggcccccgacaagaacgtgatcttcagccccctgagcatcagcaccgccctggccttcctgagcctgggcgcccacaacaccaccctgaccgagatcctgaagggcctgaagttcaacctgaccgagaccagcgaggccgagatccaccagagcttccagcacctgctgagaaccctgaaccagagcagcgacgagctgcagctgagcatgggcaacgccatgttcgtgaaggagcagctgagcctgctggacagattcaccgaggacgccaagagactgtacggcagcgaggccttcgccaccgacttccaggacagcgccgccgccaagaagctgatcaacgactacgtgaagaacggcaccagaggcaagatcaccgacctgatcaaggacctggacagccagaccatgatggtgctggtgaactacatcttcttcaaggccaagtgggagatgcccttcgacccccaggacacccaccagagcagattctacctgagcaagaagaagtgggtgatggtgcccatgatgagcctgcaccacctgaccatcccctacttcagagacgaggagctgagctgcaccgtggtggagctgaagtacaccggcaacgccagcgccctgttcatcctgcccgaccaggacaagatggaggaggtggaggccatgctgctgcccgagaccctgaagagatggagagacagcctggagttcagagagatcggcgagctgtacctgcccaagttcagcatcagcagagactacaacctgaacgacatcctgctgcagctgggcatcgaggaggccttcaccagcaaggccgacctgagcggcatcaccggcgccagaaacctggccgtgagccaggtggtgcacaaggccgtgctggacgtgttcgaggagggcaccgaggccagcgccgccaccgccgtgaagatcaccctgctgagcgccctggtggagaccagaaccatcgtgagattcaacagacccttcctgatgatcatcgtgcccaccgacacccagaacatcttcttcatgagcaaggtgaccaaccccaagcaggcctag

SEQ ID NO: 98578 - DNA, 1272 bp, Artificial Sequence; identical to SEQ ID NO: 98577
  Description of Artificial Sequence: Synthetic coding sequence

SEQ ID NO: 98579 - DNA, 1272 bp, Artificial Sequence; identical to SEQ ID NO: 98577
  Description of Artificial Sequence: Synthetic coding sequence

SEQ ID NO: 98580 - DNA, 1347 bp, Artificial Sequence
  Description of Artificial Sequence: Synthetic coding sequence
atgaagatccactacagcagacagaccgccctggagagcaccagctacatccagctgcccgaggccgagctgagaatggagagaatgctgcccctgctggccctgggcctgctggccgccggcttctgccccgccgtgctgtgccaccccaacagccccctggacgaggagaacctgacccaggagaaccaggacagaggcacccacgtggacctgggcctggccagcgccaacgtggacttcgccttcagcctgtacaagcagctggtgctgaaggcccccgacaagaacgtgatcttcagccccctgagcatcagcaccgccctggccttcctgagcctgggcgcccacaacaccaccctgaccgagatcctgaagggcctgaagttcaacctgaccgagaccagcgaggccgagatccaccagagcttccagcacctgctgagaaccctgaaccagagcagcgacgagctgcagctgagcatgggcaacgccatgttcgtgaaggagcagctgagcctgctggacagattcaccgaggacgccaagagactgtacggcagcgaggccttcgccaccgacttccaggacagcgccgccgccaagaagctgatcaacgactacgtgaagaacggcaccagaggcaagatcaccgacctgatcaaggacctggacagccagaccatgatggtgctggtgaactacatcttcttcaaggccaagtgggagatgcccttcgacccccaggacacccaccagagcagattctacctgagcaagaagaagtgggtgatggtgcccatgatgagcctgcaccacctgaccatcccctacttcagagacgaggagctgagctgcaccgtggtggagctgaagtacaccggcaacgccagcgccctgttcatcctgcccgaccaggacaagatggaggaggtggaggccatgctgctgcccgagaccctgaagagatggagagacagcctggagttcagagagatcggcgagctgtacctgcccaagttcagcatcagcagagactacaacctgaacgacatcctgctgcagctgggcatcgaggaggccttcaccagcaaggccgacctgagcggcatcaccggcgccagaaacctggccgtgagccaggtggtgcacaaggccgtgctggacgtgttcgaggagggcaccgaggccagcgccgccaccgccgtgaagatcaccctgctgagcgccctggtggagaccagaaccatcgtgagattcaacagacccttcctgatgatcatcgtgcccaccgacacccagaacatcttcttcatgagcaaggtgaccaaccccaagcaggcctag

SEQ ID NO: 98581 - DNA, 918 bp, Artificial Sequence
  Description of Artificial Sequence: Synthetic coding sequence
atggagagaatgctgcccctgctggccctgggcctgctggccgccggcttctgccccgccgtgctgtgccaccccaacagccccctggacgaggagaacctgacccaggagaaccaggacagaggcacccacgtggacctgggcctggccagcgccaacgtggacttcgccttcagcctgtacaagcagctggtgctgaaggcccccgacaagaacgtgatcttcagccccctgagcatcagcaccgccctggccttcctgagcctgggcgcccacaacaccaccctgaccgagatcctgaagggcctgaagttcaacctgaccgagaccagcgaggccgagatccaccagagcttccagcacctgctgagaaccctgaaccagagcagcgacgagctgcagctgagcatgggcaacgccatgttcgtgaaggagcagctgagcctgctggacagattcaccgaggacgccaagagactgtacggcagcgaggccttcgccaccgacttccaggacagcgccgccgccaagaagctgatcaacgactacgtgaagaacggcaccagaggcaagatcaccgacctgatcaaggacctggacagccagaccatgatggtgctggtgaactacatcttcttcaaggccaagtgggagatgcccttcgacccccaggacacccaccagagcagattctacctgagcaagaagaagtgggtgatggtgcccatgatgagcctgcaccacctgaccatcccctacttcagagacgaggagctgagctgcaccgtggtggagctgaagtacaccggcaacgccagcgccctgttcatcctgcccgaccaggacaagatggaggaggtggaggccatgctgctgcccgagaccctgaagagatggagagacagcctggagttctag

SEQ ID NO: 98582 - DNA, 1284 bp, Artificial Sequence
  Description of Artificial Sequence: Synthetic coding sequence
atgcacctgatcgactacctgctgctgctgctggtgggcctgctggccctgagccacggccagctgcacgtggagcacgacggcgagagctgcagcaacagcagccaccagcagatcctggagaccggcgagggcagccccagcctgaagatcgcccccgccaacgccgacttcgccttcagattctactacctgatcgccagcgagacccccggcaagaacatcttcttcagccccctgagcatcagcgccgcctacgccatgctgagcctgggcgcctgcagccacagcagaagccagatcctggagggcctgggcttcaacctgaccgagctgagcgagagcgacgtgcacagaggcttccagcacctgctgcacaccctgaacctgcccggccacggcctggagaccagagtgggcagcgccctgttcctgagccacaacctgaagttcctggccaagttcctgaacgacaccatggccgtgtacgaggccaagctgttccacaccaacttctacgacaccgtgggcaccatccagctgatcaacgaccacgtgaagaaggagaccagaggcaagatcgtggacctggtgagcgagctgaagaaggacgtgctgatggtgctggtgaactacatctacttcaaggccctgtgggagaagcccttcatcagcagcagaaccacccccaaggacttctacgtggacgagaacaccaccgtgagagtgcccatgatgctgcaggaccaggagcaccactggtacctgcacgacagatacctgccctgcagcgtgctgagaatggactacaagggcgacgccaccgtgttcttcatcctgcccaaccagggcaagatgagagagatcgaggaggtgctgacccccgagatgctgatgagatggaacaacctgctgagaaagagaaacttctacaagaagctggagctgcacctgcccaagttcagcatcagcggcagctacgtgctggaccagatcctgcccagactgggcttcaccgacctgttcagcaagtgggccgacctgagcggcatcaccaagcagcagaagctggaggccagcaagagcttccacaaggccaccctggacgtggacgaggccggcaccgaggccgccgccgccaccagcttcgccatcaagttcttcagcgcccagaccaacagacacatcctgagattcaacagacccttcctggtggtgatcttcagcaccagcacccagagcgtgctgttcctgggcaaggtggtggaccccaccaagccctag

SEQ ID NO: 98583 - DNA, 1284 bp, Artificial Sequence; identical to SEQ ID NO: 98582
  Description of Artificial Sequence: Synthetic coding sequence

SEQ ID NO: 98584 - DNA, 1284 bp, Artificial Sequence; identical to SEQ ID NO: 98582
  Description of Artificial Sequence: Synthetic coding sequence

SEQ ID NO: 98585 - DNA, 1218 bp, Artificial Sequence
  Description of Artificial Sequence: Synthetic coding sequence
atgcccctgctgctgtacacctgcctgctgtggctgcccaccagcggcctgtggaccgtgcaggccatggaccccaacgccgcctacgtgaacatgagcaaccaccacagaggcctggccagcgccaacgtggacttcgccttcagcctgtacaagcacctggtggccctgagccccaagaagaacatcttcatcagccccgtgagcatcagcatggccctggccatgctgagcctgggcacctgcggccacaccagagcccagctgctgcagggcctgggcttcaacctgaccgagagaagcgagaccgagatccaccagggcttccagcacctgcaccagctgttcgccaagagcgacaccagcctggagatgaccatgggcaacgccctgttcctggacggcagcctggagctgctggagagcttcagcgccgacatcaagcactactacgagagcgaggtgctggccatgaacttccaggactgggccaccgccagcagacagatcaacagctacgtgaagaacaagacccagggcaagatcgtggacctgttcagcggcctggacagccccgccatcctggtgctggtgaactacatcttcttcaagggcacctggacccagcccttcgacctggccagcaccagagaggagaacttctacgtggacgagaccaccgtggtgaaggtgcccatgatgctgcagagcagcaccatcagctacctgcacgacagcgagctgccctgccagctggtgcagatgaactacgtgggcaacggcaccgtgttcttcatcctgcccgacaagggcaagatgaacaccgtgatcgccgccctgagcagagacaccatcaacagatggagcgccggcctgaccagcagccaggtggacctgtacatccccaaggtgaccatcagcggcgtgtacgacctgggcgacgtgctggaggagatgggcatcgccgacctgttcaccaaccaggccaacttcagcagaatcacccaggacgcccagctgaagagcagcaaggtggtgcacaaggccgtgctgcagctgaacgaggagggcgtggacaccgccggcagcaccggcgtgaccctgaacctgaccagcaagcccatcatcctgagattcaaccagcccttcatcatcatgatcttcgaccacttcacctggagcagcctgttcctggccagagtgatgaaccccgtgtag

SEQ ID NO: 98586 - DNA, 411 bp, Artificial Sequence
  Description of Artificial Sequence: Synthetic coding sequence
atgcccctgctgctgtacacctgcctgctgtggctgcccaccagcggcctgtggaccgtgcaggccatggaccccaacgccgcctacgtgaacatgagcaaccaccacagaggcctggccagcgccaacgtggacttcgccttcagcctgtacaagcacctggtggccctgagccccaagaagaacatcttcatcagccccgtgagcatcagcatggccctggccatgctgagcctgggcacctgcggccacaccagagcccagctgctgcagggcctgggcttcaacctgaccgagagaagcgagaccgagatccaccagggcttccagcacctgcaccagctgttcgccaagagcgacaccagcctggagatgaccatgggcaacgccctgttcctggacggcagctag

SEQ ID NO: 98587 - DNA, 1194 bp, Artificial Sequence
  Description of Artificial Sequence: Synthetic coding sequence
atggacagcctggccaccagcatcaaccagttcgccctggagctgagcaagaagctggccgagagcgcccagggcaagaacatcttcttcagcagctggagcatcagcaccagcctgaccatcgtgtacctgggcgccaagggcaccaccgccgcccagatggcccaggtgctgcagttcaacagagaccagggcgtgaagtgcgaccccgagagcgagaagaagagaaagatggagttcaacctgagcaacagcgaggagatccacagcgacttccagaccctgatcagcgagatcctgaagcccaacgacgactacctgctgaagaccgccaacgccatctacggcgagaagacctacgccttccacaacaagtacctggaggacatgaagacctacttcggcgccgagccccagcccgtgaacttcgtggaggccagcgaccagatcagaaaggacatcaacagctgggtggagagacagaccgagggcaagatccagaacctgctgcccgacgacagcgtggacagcaccaccagaatgatcctggtgaacgccctgtacttcaagggcatctgggagcaccagttcctggtgcagaacaccaccgagaagcccttcagaatcaacgagaccaccagcaagcccgtgcagatgatgttcatgaagaagaagctgcacatcttccacatcgagaagcccaaggccgtgggcctgcagctgtactacaagagcagagacctgagcctgctgatcctgctgcccgaggacatcaacggcctggagcagctggagaaggccatcacctacgagaagctgaacgagtggaccagcgccgacatgatggagctgtacgaggtgcagctgcacctgcccaagttcaagctggaggacagctacgacctgaagagcaccctgagcagcatgggcatgagcgacgccttcagccagagcaaggccgacttcagcggcatgagcagcgccagaaacctgttcctgagcaacgtgttccacaaggccttcgtggagatcaacgagcagggcaccgaggccgccgccggcagcggcagcgagatcgacatcagaatcagagtgcccagcatcgagttcaacgccaaccaccccttcctgttcttcatcagacacaacaagaccaacaccatcctgttctacggcagactgtgcagcccctag

SEQ ID NO: 98588 - DNA, 1020 bp, Artificial Sequence
  Description of Artificial Sequence: Synthetic coding sequence
atggacagcctgggcgccgtgagcaccagactgggcttcgacctgttcaaggagctgaagaagaccaacgacggcaacatcttcttcagccccgtgggcatcctgaccgccatcggcatggtgctgctgggcaccagaggcgccaccgccagccagctggaggaggtgttccacagcgagaaggagaccaagagcagcagaatcaaggccgaggagaaggaggtgatcgagaacaccgaggccgtgcaccagcagttccagaagttcctgaccgagatcagcaagctgaccaacgactacgagctgaacatcaccaacagactgttcggcgagaagacctacctgttcctgcagaagtacctggactacgtggagaagtactaccacgccagcctggagcccgtggacttcgtgaacgccgccgacgagagcagaaagaagatcaacagctgggtggagagcaagaccaacgagaagatcaaggacctgttccccgacggcagcatcagcagcagcaccaagctggtgctggtgaacatggtgtacttcaagggccagtgggacagagagttcaagaaggagaacaccaaggaggagaagttctggatgaacaagatcatcgacaagatcagccccgagaagctggtggagtggaccagccccggccacatggaggagagaaaggtgaacctgcacctgcccagattcgaggtggaggacggctacgacctggaggccgtgctggccgccatgggcatgggcgacgccttcagcgagcacaaggccgactacagcggcatgagcagcggcagcggcctgtacgcccagaagttcctgcacagcagcttcgtggccgtgaccgaggagggcaccgaggccgccgccgccaccggcatcggcttcaccgtgaccagcgcccccggccacgagaacgtgcactgcaaccaccccttcctgttcttcatcagacacaacgagagcaacagcatcctgttcttcggcagattcagcagcccctag

SEQ ID NO: 98589 - DNA, 1176 bp, Artificial Sequence
  Description of Artificial Sequence: Synthetic coding sequence
atggacagcctgggcgccgtgagcaccagactgggcttcgacctgttcaaggagctgaagaagaccaacgacggcaacatcttcttcagccccgtgggcatcctgaccgccatcggcatggtgctgctgggcaccagaggcgccaccgccagccagctggaggaggtgttccacagcgagaaggagaccaagagcagcagaatcaaggccgaggagaaggaggtgatcgagaacaccgaggccgtgcaccagcagttccagaagttcctgaccgagatcagcaagctgaccaacgactacgagctgaacatcaccaacagactgttcggcgagaagacctacctgttcctgcagaagtacctggactacgtggagaagtactaccacgccagcctggagcccgtggacttcgtgaacgccgccgacgagagcagaaagaagatcaacagctgggtggagagcaagaccaacgagaagatcaaggacctgttccccgacggcagcatcagcagcagcaccaagctggtgctggtgaacatggtgtacttcaagggccagtgggacagagagttcaagaaggagaacaccaaggaggagaagttctggatgaacaagagcaccagcaagagcgtgcagatgatgacccagagccacagcttcagcttcaccttcctggaggacctgcaggccaagatcctgggcatcccctacaagaacaacgacctgagcatgttcgtgctgctgcccaacgacatcgacggcctggagaagatcatcgacaagatcagccccgagaagctggtggagtggaccagccccggccacatggaggagagaaaggtgaacctgcacctgcccagattcgaggtggaggacggctacgacctggaggccgtgctggccgccatgggcatgggcgacgccttcagcgagcacaaggccgactacagcggcatgagcagcggcagcggcctgtacgcccagaagttcctgcacagcagcttcgtggccgtgaccgaggagggcaccgaggccgccgccgccaccggcatcggcttcaccgtgaccagcgcccccggccacgagaacgtgcactgcaaccaccccttcctgttcttcatcagacacaacgagagcaacagcatcctgttcttcggcagattcagcagcccctag

SEQ ID NO: 98590 - DNA, 930 bp, Artificial Sequence
  Description of Artificial Sequence: Synthetic coding sequence
atggacagcctgggcgccgtgagcaccagactgggcttcgacctgttcaaggagctgaagaagaccaacgacggcaacatcttcttcagccccgtgggcatcctgaccgccatcggcatggtgctgctgggcaccagaggcgccaccgccagccagctggaggaggtgttccacagcgagaaggagaccaagagcagcagaatcaaggccgaggagaaggaggtggagaagatcaaggacctgttccccgacggcagcatcagcagcagcaccaagctggtgctggtgaacatggtgtacttcaagggccagtgggacagagagttcaagaaggagaacaccaaggaggagaagttctggatgaacaagagcaccagcaagagcgtgcagatgatgacccagagccacagcttcagcttcaccttcctggaggacctgcaggccaagatcctgggcatcccctacaagaacaacgacctgagcatgttcgtgctgctgcccaacgacatcgacggcctggagaagatcatcgacaagatcagccccgagaagctggtggagtggaccagccccggccacatggaggagagaaaggtgaacctgcacctgcccagattcgaggtggaggacggctacgacctggaggccgtgctggccgccatgggcatgggcgacgccttcagcgagcacaaggccgactacagcggcatgagcagcggcagcggcctgtacgcccagaagttcctgcacagcagcttcgtggccgtgaccgaggagggcaccgaggccgccgccgccaccggcatcggcttcaccgtgaccagcgcccccggccacgagaacgtgcactgcaaccaccccttcctgttcttcatcagacacaacgagagcaacagcatcctgttcttcggcagattcagcagcccctag

SEQ ID NO: 98591 - DNA, 1173 bp, Artificial Sequence
  Description of Artificial Sequence: Synthetic coding sequence
atgaacagcctgagcgaggccaacaccaagttcatgttcgacctgttccagcagttcagaaagagcaaggagaacaacatcttctacagccccatcagcatcaccagcgccctgggcatggtgctgctgggcgccaaggacaacaccgcccagcagatcaagaaggtgctgcacttcgaccaggtgaccgagaacaccaccggcaaggccgccacctaccacgtggacagaagcggcaacgtgcaccaccagttccagaagctgctgaccgagttcaacaagagcaccgacgcctacgagctgaagatcgccaacaagctgttcggcgagaagacctacctgttcctgcaggagtacctggacgccatcaagaagttctaccagaccagcgtggagagcgtggacttcgccaacgcccccgaggagagcagaaagaagatcaacagctgggtggagagccagaccaacgagaagatcaagaacctgatccccgagggcaacatcggcagcaacaccaccctggtgctggtgaacgccatctacttcaagggccagtgggagaagaagttcaacaaggaggacaccaaggaggagaagttctggcccaacaagaacacctacaagagcatccagatgatgagacagtacaccagcttccacttcgccagcctggaggacgtgcaggccaaggtgctggagatcccctacaagggcaaggacctgagcatgatcgtgctgctgcccaacgagatcgacggcctgcagaagctggaggagaagctgaccgccgagaagctgatggagtggaccagcctgcagaacatgagagagaccagagtggacctgcacctgcccagattcaaggtggaggagagctacgacctgaaggacaccctgagaaccatgggcatggtggacatcttcaacggcgacgccgacctgagcggcatgaccggcagcagaggcctggtgctgagcggcgtgctgcacaaggccttcgtggaggtgaccgaggagggcgccgaggccgccgccgccaccgccgtggtgggcttcggcagcagccccaccagcaccaacgaggagttccactgcaaccaccccttcctgttcttcatcagacagaacaagaccaacagcatcctgttctacggcagattcagcagcccctag

SEQ ID NO: 98592 - DNA, 1173 bp, Artificial Sequence
  Description of Artificial Sequence: Synthetic coding sequence
atgaacagcctgagcgaggccaacaccaagttcatgttcgacctgttccagcagttcagaaagagcaaggagaacaacatcttctacagccccatcagcatcaccagcgccctgggcatggtgctgctgggcgccaaggacaacaccgcccagcagatcagcaaggtgctgcacttcgaccaggtgaccgagaacaccaccgagaaggccgccacctaccacgtggacagaagcggcaacgtgcaccaccagttccagaagctgctgaccgagttcaacaagagcaccgacgcctacgagctgaagatcgccaacaagctgttcggcgagaagacctaccagttcctgcaggagtacctggacgccatcaagaagttctaccagaccagcgtggagagcaccgacttcgccaacgcccccgaggagagcagaaagaagatcaacagctgggtggagagccagaccaacgagaagatcaagaacctgttccccgacggcaccatcggcaacgacaccaccctggtgctggtgaacgccatctacttcaagggccagtgggagaacaagttcaagaaggagaacaccaaggaggagaagttctggcccaacaagaacacctacaagagcgtgcagatgatgagacagtacaacagcttcaacttcgccctgctggaggacgtgcaggccaaggtgctggagatcccctacaagggcaaggacctgagcatgatcgtgctgctgcccaacgagatcgacggcctgcagaagctggaggagaagctgaccgccgagaagctgatggagtggaccagcctgcagaacatgagagagacctgcgtggacctgcacctgcccagattcaagatggaggagagctacgacctgaaggacaccctgagaaccatgggcatggtgaacatcttcaacggcgacgccgacctgagcggcatgacctggagccacggcctgagcgtgagcaaggtgctgcacaaggccttcgtggaggtgaccgaggagggcgtggaggccgccgccgccaccgccgtggtggtggtggagctgagcagccccagcaccaacgaggagttctgctgcaaccaccccttcctgttcttcatcagacagaacaagaccaacagcatcctgttctacggcagattcagcagcccctag

SEQ ID NO: 98593 - DNA, 1017 bp, Artificial Sequence
  Description of Artificial Sequence: Synthetic coding sequence
atgaacagcctgagcgaggccaacaccaagttcatgttcgacctgttccagcagttcagaaagagcaaggagaacaacatcttctacagccccatcagcatcaccagcgccctgggcatggtgctgctgggcgccaaggacaacaccgcccagcagatcagcaaggtgctgcacttcgaccaggtgaccgagaacaccaccgagaaggccgccacctaccacgtggacagaagcggcaacgtgcaccaccagttccagaagctgctgaccgagttcaacaagagcaccgacgcctacgagctgaagatcgccaacaagctgttcggcgagaagacctaccagttcctgcaggagtacctggacgccatcaagaagttctaccagaccagcgtggagagcaccgacttcgccaacgcccccgaggagagcagaaagaagatcaacagctgggtggagagccagaccaacgagaagatcaagaacctgttccccgacggcaccatcggcaacgacaccaccctggtgctggtgaacgccatctacttcaagggccagtgggagaacaagttcaagaaggagaacaccaaggaggagaagttctggcccaacaagctggaggagaagctgaccgccgagaagctgatggagtggaccagcctgcagaacatgagagagacctgcgtggacctgcacctgcccagattcaagatggaggagagctacgacctgaaggacaccctgagaaccatgggcatggtgaacatcttcaacggcgacgccgacctgagcggcatgacctggagccacggcctgagcgtgagcaaggtgctgcacaaggccttcgtggaggtgaccgaggagggcgtggaggccgccgccgccaccgccgtggtggtggtggagctgagcagccccagcaccaacgaggagttctgctgcaaccaccccttcctgttcttcatcagacagaacaagaccaacagcatcctgttctacggcagattcagcagcccctag

SEQ ID NO: 98594 - DNA, 1128 bp, Artificial Sequence
  Description of Artificial Sequence: Synthetic coding sequence
atggacgccctgcagctggccaacagcgccttcgccgtggacctgttcaagcagctgtgcgagaaggagcccctgggcaacgtgctgttcagccccatctgcctgagcaccagcctgagcctggcccaggtgggcgccaagggcgacaccgccaacgagatcggccaggtgctgcacttcgagaacgtgaaggacgtgcccttcggcttccagaccgtgaccagcgacgtgaacaagctgagcagcttctacagcctgaagctgatcaagagactgtacgtggacaagagcctgaacctgagcaccgagttcatcagcagcaccaagagaccctacgccaaggagctggagaccgtggacttcaaggacaagctggaggagaccaagggccagatcaacaacagcatcaaggacctgaccgacggccacttcgagaacatcctggccgacaacagcgtgaacgaccagaccaagatcctggtggtgaacgccgcctacttcgtgggcaagtggatgaagaagttcagcgagagcgagaccaaggagtgccccttcagagtgaacaagaccgacaccaagcccgtgcagatgatgaacatggaggccaccttctgcatgggcaacatcgacagcatcaactgcaagatcatcgagctgcccttccagaacaagcacctgagcatgttcatcctgctgcccaaggacgtggaggacgagagcaccggcctggagaagatcgagaagcagctgaacagcgagagcctgagccagtggaccaaccccagcaccatggccaacgccaaggtgaagctgagcatccccaagttcaaggtggagaagatgatcgaccccaaggcctgcctggagaacctgggcctgaagcacatcttcagcgaggacaccagcgacttcagcggcatgagcgagaccaagggcgtggccctgagcaacgtgatccacaaggtgtgcctggagatcaccgaggacggcggcgacagcatcgaggtgcccggcgccagaatcctgcagcacaaggacgagctgaacgccgaccaccccttcatctacatcatcagacacaacaagaccagaaacatcatcttcttcggcaagttctgcagcccctag

SEQ ID NO: 98595 - DNA, 390 bp, Artificial Sequence
  Description of Artificial Sequence: Synthetic coding sequence
atggacgccctgcagctggccaacagcgccttcgccgtggacctgttcaagcagctgtgcgagaaggagcccctgggcaacgtgctgttcagccccatctgcctgagcaccagcctgagcctggcccaggtgggcgccaagggcgacaccgccaacgagatcggccaggtgctgcacttcgagaacgtgaaggacgtgcccttcggcttccagaccgtgaccagcgacgtgaacaagctgagcagcttctacagcctgaagctgatcaagagactgtacgtggacaagagcctgaacctgagcaccgagttcatcagcagcaccaagagaccctacgccaaggagctggagaccgtggacttcaaggacaagctggaggagaccaagtag

SEQ ID NO: 98596 - DNA, 1131 bp, Artificial Sequence
  Description of Artificial Sequence: Synthetic coding sequence
atggacgtgctggccgaggccaacggcaccttcgccctgaacctgctgaagaccctgggcaaggacaacagcaagaacgtgttcttcagccccatgagcatgagctgcgccctggccatggtgtacatgggcgccaagggcaacaccgccgcccagatggcccagatcctgagcttcaacaagagcggcggcggcggcgacatccaccagggcttccagagcctgctgaccgaggtgaacaagaccggcacccagtacctgctgagaatggccaacagactgttcggcgagaagagctgcgacttcctgagcagcttcagagacagctgccagaagttctaccaggccgagatggaggagctggacttcatcagcgccgtggagaagagcagaaagcacatcaacacctgggtggccgagaagaccgagggcaagatcgccgagctgctgagccccggcagcgtggaccccctgaccagactggtgctggtgaacgccgtgtacttcagaggcaactgggacgagcagttcgacaaggagaacaccgaggagagactgttcaaggtgagcaagaacgaggagaagcccgtgcagatgatgttcaagcagagcaccttcaagaagacctacatcggcgagatcttcacccagatcctggtgctgccctacgtgggcaaggagctgaacatgatcatcatgctgcccgacgagaccaccgacctgagaaccgtggagaaggagctgacctacgagaagttcgtggagtggaccagactggacatgatggacgaggaggaggtggaggtgagcctgcccagattcaagctggaggagagctacgacatggagagcgtgctgagaaacctgggcatgaccgacgccttcgagctgggcaaggccgacttcagcggcatgagccagaccgacctgagcctgagcaaggtggtgcacaagagcttcgtggaggtgaacgaggagggcaccgaggccgccgccgccaccgccgccatcatgatgatgagatgcgccagattcgtgcccagattctgcgccgaccaccccttcctgttcttcatccagcacagcaagaccaacggcatcctgttctgcggcagattcagcagcccctag

SEQ ID NO: 98597 - DNA, 546 bp, Artificial Sequence
  Description of Artificial Sequence: Synthetic coding sequence
tgactgaacctgctgaagaccctgggcaaggacaacagcaagaacgtgttcttcagccccatgagcatgagctgcgccctggccatggtgtacatgggcgccaagggcaacaccgccgcccagatggcccagatcctgagcttcaacaagagcggcggcggcggcgacatccaccagggcttccagagcctgctgaccgaggtgaacaagaccggcacccagtacctgctgagaatggccaacagagagagctacgacatggagagcgtgctgagaaacctgggcatgaccgacgccttcgagctgggcaaggccgacttcagcggcatgagccagaccgacctgagcctgagcaaggtggtgcacaagagcttcgtggaggtgaacgaggagggcaccgaggccgccgccgccaccgccgccatcatgatgatgagatgcgccagattcgtgcccagattctgcgccgaccaccccttcctgttcttcatccagcacagcaagaccaacggcatcctgttctgcggcagattcagcagcccctag

SEQ ID NO: 98598 - DNA, 1131 bp, Artificial Sequence; identical to SEQ ID NO: 98596
  Description of Artificial Sequence: Synthetic coding sequence

SEQ ID NO: 98599 - DNA, 1131 bp, Artificial Sequence; identical to SEQ ID NO: 98596
  Description of Artificial Sequence: Synthetic coding sequence

SEQ ID NO: 98600 - DNA, 1131 bp, Artificial Sequence; identical to SEQ ID NO: 98596
  Description of Artificial Sequence: Synthetic coding sequence

SEQ ID NO: 98601 - DNA, 1131 bp, Artificial Sequence; identical to SEQ ID NO: 98596
  Description of Artificial Sequence: Synthetic coding sequence

SEQ ID NO: 98602 - DNA, 1131 bp, Artificial Sequence; identical to SEQ ID NO: 98596
  Description of Artificial Sequence: Synthetic coding sequence

SEQ ID NO: 98603 - DNA, 579 bp, Artificial Sequence
  Description of Artificial Sequence: Synthetic coding sequence
atggacgtgctggccgaggccaacggcaccttcgccctgaacctgctgaagaccctgggcaaggacaacagcaagaacgtgttcttcagccccatgagcatgagctgcgccctggccatggtgtacatgggcgccaagggcaacaccgccgcccagatggcccagatcctgagcttcaacaagagcggcggcggcggcgacatccaccagggcttccagagcctgctgaccgaggtgaacaagaccggcacccagtacctgctgagaatggccaacagagagagctacgacatggagagcgtgctgagaaacctgggcatgaccgacgccttcgagctgggcaaggccgacttcagcggcatgagccagaccgacctgagcctgagcaaggtggtgcacaagagcttcgtggaggtgaacgaggagggcaccgaggccgccgccgccaccgccgccatcatgatgatgagatgcgccagattcgtgcccagattctgcgccgaccaccccttcctgttcttcatccagcacagcaagaccaacggcatcctgttctgcggcagattcagcagcccctag

SEQ ID NO: 98604 - DNA, 1143 bp, Artificial Sequence
  Description of Artificial Sequence: Synthetic coding sequence
atggccagcctggccgccgccaacgccgagttctgcttcaacctgttcagagagatggacgacaaccagggcaacggcaacgtgttcttcagcagcctgagcctgttcgccgccctggccctggtgagactgggcgcccaggacgacagcctgagccagatcgacaagctgctgcacgtgaacaccgccagcggctacggcaacagcagcaacagccagagcggcctgcagagccagctgaagagagtgttcagcgacatcaacgccagccacaaggactacgacctgagcatcgtgaacggcctgttcgccgagaaggtgtacggcttccacaaggactacatcgagtgcgccgagaagctgtacgacgccaaggtggagagagtggacttcaccaaccacctggaggacaccagaagaaacatcaacaagtgggtggagaacgagacccacggcaagatcaagaacgtgatcggcgagggcggcatcagcagcagcgccgtgatggtgctggtgaacgccgtgtacttcaagggcaagtggcagagcgccttcaccaagagcgagaccatcaactgccacttcaagagccccaagtgcagcggcaaggccgtggccatgatgcaccaggagagaaagttcaacctgagcgtgatcgaggaccccagcatgaagatcctggagctgagatacaacggcggcatcaacatgtacgtgctgctgcccgagaacgacctgagcgagatcgagaacaagctgaccttccagaacctgatggagtggaccaaccccagaagaatgaccagcaagtacgtggaggtgttcttcccccagttcaagatcgagaagaactacgagatgaagcagtacctgagagccctgggcctgaaggacatcttcgacgagagcaaggccgacctgagcggcatcgccagcggcggcagactgtacatcagcagaatgatgcacaagagctacatcgaggtgaccgaggagggcaccgaggccaccgccgccaccggcagcaacatcgtggagaagcagctgccccagagcaccctgttcagagccgaccaccccttcctgttcgtgatcagaaaggacgacatcatcctgttcagcggcaaggtgagctgcccctag

SEQ ID NO: 98605 - DNA, 1143 bp, Artificial Sequence; identical to SEQ ID NO: 98604
  Description of Artificial Sequence: Synthetic coding sequence

SEQ ID NO: 98606 - DNA, 387 bp, Artificial Sequence
  Description of Artificial Sequence: Synthetic coding sequence
atggccagcctggccgccgccaacgccgagttctgcttcaacctgttcagagagatggacgacaaccagggcaacggcaacgtgttcttcagcagcctgagcctgttcgccgccctggccctggtgagactgggcgcccaggacgacagcctgagccagatcgacaagctgctgcacgtgaacaccgccagcggctacggcaacagcagcaacagccagagcggcctgcagagccagctgaagagagtgttcagcgacatcaacgccagccacaaggactacgacctgagcatcgtgaacggcctgttcgccgagaaggtgtacggcttccacaaggactacatcgagtgcgccgagaagctgtacgacgccaaggtggagagatag

SEQ ID NO: 98607 - DNA, 387 bp, Artificial Sequence; identical to SEQ ID NO: 98606
  Description of Artificial Sequence: Synthetic coding sequence

SEQ ID NO: 98608 - DNA, 498 bp, Artificial Sequence
  Description of Artificial Sequence: Synthetic coding sequence
atggccagcctggccgccgccaacgccgagttctgcttcaacctgttcagagagatggacgacaaccagggcaacggcaacgtgttcttcagcagcctgagcctgttcgccgccctggccctggtgagactgggcgcccaggacgacagcctgagccagatcgacaagctgctgcacgtgaacaccgccagcggctacggcaacagcagcaacagccagagcggcctgcagagccagctgaagagagtgttcagcgacatcaacgccagccacaaggactacgacctgagcatcgtgaacggcctgttcgccgagaaggtgtacggcttccacaaggactacatcgagtgcgccgagaagctgtacgacgccaaggtggagagagtggacttcaccaaccacctggaggacaccagaagaaacatcaacaagtgggtggagaacgagacccacggcaagatcaagaacgtgatcggcgagggcggcatcagcagctag

SEQ ID NO: 98609 - DNA, 1092 bp, Artificial Sequence
  Description of Artificial Sequence: Synthetic coding sequence
atggccagcctggccgccgccaacgccgagttctgcttcaacctgttcagagagatggacgacaaccagggcaacggcaacgtgttcttcagcagcctgagcctgttcgccgccctggccctggtgagactgggcgcccaggacgacagcctgagccagatcgacaagagcggcctgcagagccagctgaagagagtgttcagcgacatcaacgccagccacaaggactacgacctgagcatcgtgaacggcctgttcgccgagaaggtgtacggcttccacaaggactacatcgagtgcgccgagaagctgtacgacgccaaggtggagagagtggacttcaccaaccacctggaggacaccagaagaaacatcaacaagtgggtggagaacgagacccacggcaagatcaagaacgtgatcggcgagggcggcatcagcagcagcgccgtgatggtgctggtgaacgccgtgtacttcaagggcaagtggcagagcgccttcaccaagagcgagaccatcaactgccacttcaagagccccaagtgcagcggcaaggccgtggccatgatgcaccaggagagaaagttcaacctgagcgtgatcgaggaccccagcatgaagatcctggagctgagatacaacggcggcatcaacatgtacgtgctgctgcccgagaacgacctgagcgagatcgagaacaagctgaccttccagaacctgatggagtggaccaaccccagaagaatgaccagcaagtacgtggaggtgttcttcccccagttcaagatcgagaagaactacgagatgaagcagtacctgagagccctgggcctgaaggacatcttcgacgagagcaaggccgacctgagcggcatcgccagcggcggcagactgtacatcagcagaatgatgcacaagagctacatcgaggtgaccgaggagggcaccgaggccaccgccgccaccggcagcaacatcgtggagaagcagctgccccagagcaccctgttcagagccgaccaccccttcctgttcgtgatcagaaaggacgacatcatcctgttcagcggcaaggtgagctgcccctag

SEQ ID NO: 98610 - DNA, 1143 bp, Artificial Sequence; identical to SEQ ID NO: 98604
  Description of Artificial Sequence: Synthetic coding sequence

SEQ ID NO: 98611 - DNA, 1125 bp, Artificial Sequence
  Description of Artificial Sequence: Synthetic coding sequence
atggacgacctgtgcgaggccaacggcaccttcgccatcagcctgttcaagatcctgggcgaggaggacaacagcagaaacgtgttcttcagccccatgagcatcagcagcgccctggccatggtgttcatgggcgccaagggcagcaccgccgcccagatgagccaggccctgtgcctgtacaaggacggcgacatccacagaggcttccagagcctgctgagcgaggtgaacagaaccggcacccagtacctgctgagaaccgccaacagactgttcggcgagaagacctgcgacttcctgcccgacttcaaggagtactgccagaagttctaccaggccgagctggaggagctgagcttcgccgaggacaccgaggagtgcagaaagcacatcaacgactgggtggccgagaagaccgagggcaagatcagcgaggtgctggacgccggcaccgtggaccccctgaccaagctggtgctggtgaacgccatctacttcaagggcaagtggaacgagcagttcgacagaaagtacaccagaggcatgctgttcaagaccaacgaggagaagaagaccgtgcagatgatgttcaaggaggccaagttcaagatgggctacgccgacgaggtgcacacccaggtgctggagctgccctacgtggaggaggagctgagcatggtgatcctgctgcccgacgacaacaccgacctggccgtggtggagaaggccctgacctacgagaagttcaaggcctggaccaacagcgagaagctgaccaagagcaaggtgcaggtgttcctgcccagactgaagctggaggagagctacgacctggagcccttcctgagaagactgggcatgatcgacgccttcgacgaggccaaggccgacttcagcggcatgagcaccgagaagaacgtgcccctgagcaaggtggcccacaagtgcttcgtggaggtgaacgaggagggcaccgaggccgccgccgccaccgccgtggtgagaaacagcagatgcagcagaatggagcccagattctgcgccgaccaccccttcctgttcttcatcagacaccacaagaccaactgcatcctgttctgcggcagattcagcagcccctag

SEQ ID NO: 98612 - DNA, 1125 bp, Artificial Sequence; identical to SEQ ID NO: 98611
  Description of Artificial Sequence: Synthetic coding sequence

SEQ ID NO: 98613 - DNA, 495 bp, Artificial Sequence
  Description of Artificial Sequence: Synthetic coding sequence
atggacgacctgtgcgaggccaacggcaccttcgccatcagcctgttcaagatcctgggcgaggaggacaacagcagaaacgtgttcttcagccccatgagcatcagcagcgccctggccatggtgttcatgggcgccaagggcagcaccgccgcccagatgagccaggccctgtgcctgtacaaggacggcgacatccacagaggcttccagagcctgctgagcgaggtgaacagaaccggcacccagtacctgctgagaaccgccaacagactgttcggcgagaagacctgcgacttcctgcccgacttcaaggagtactgccagaagttctaccaggccgagctggaggagctgagcttcgccgaggacaccgaggagtgcagaaagcacatcaacgactgggtggccgagaagaccgagggcaagatcagcgaggtgctggacgccggcaccgtggaccccctgaccaagctggtgctggtgaacgcctag

SEQ ID NO: 98614 - DNA, 375 bp, Artificial Sequence
  Description of Artificial Sequence: Synthetic coding sequence
atggacgacctgtgcgaggccaacggcaccttcgccatcagcctgttcaagatcctgggcgaggaggacaacagcagaaacgtgttcttcagccccatgagcatcagcagcgccctggccatggtgttcatgggcgccaagggcagcaccgccgcccagatgagccaggccctgtgcctgtacaaggacggcgacatccacagaggcttccagagcctgctgagcgaggtgaacagaaccggcacccagtacctgctgagaaccgccaacagactgttcggcgagaagacctgcgacttcctgcccgacttcaaggagtactgccagaagttctaccaggccgagctggaggagctgagcttcgccgaggactag

SEQ ID NO: 98615 - DNA, 579 bp, Artificial Sequence
  Description of Artificial Sequence: Synthetic coding sequence
atgctgttcaagaccaacgaggagaagaagaccgtgcagatgatgttcaaggaggccaagttcaagatgggctacgccgacgaggtgcacacccaggtgctggagctgccctacgtggaggaggagctgagcatggtgatcctgctgcccgacgacaacaccgacctggccgtggtggagaaggccctgacctacgagaagttcaaggcctggaccaacagcgagaagctgaccaagagcaaggtgcaggtgttcctgcccagactgaagctggaggagagctacgacctggagcccttcctgagaagactgggcatgatcgacgccttcgacgaggccaaggccgacttcagcggcatgagcaccgagaagaacgtgcccctgagcaaggtggcccacaagtgcttcgtggaggtgaacgaggagggcaccgaggccgccgccgccaccgccgtggtgagaaacagcagatgcagcagaatggagcccagattctgcgccgaccaccccttcctgttcttcatcagacaccacaagaccaactgcatcctgttctgcggcagattcagcagcccctag

SEQ ID NO: 98616 - DNA, 1131 bp, Artificial Sequence
  Description of Artificial Sequence: Synthetic coding sequence
atggagaccctgagcaacgccagcggcaccttcgccatcagactgctgaagatcctgtgccaggacaaccccagccacaacgtgttctgcagccccgtgagcatcagcagcgccctggccatggtgctgctgggcgccaagggcaacaccgccacccagatggcccaggccctgagcctgaacaccgaggaggacatccacagagccttccagagcctgctgaccgaggtgaacaaggccggcacccagtacctgctgagaaccgccaacagactgttcggcgagaagacctgccagttcctgagcaccttcaaggagagctgcctgcagttctaccacgccgagctgaaggagctgagcttcatcagagccgccgaggagagcagaaagcacatcaacacctgggtgagcaagaagaccgagggcaagatcgaggagctgctgcccggcagcagcatcgacgccgagaccagactggtgctggtgaacgccatctacttcaagggcaagtggaacgagcccttcgacgagacctacaccagagagatgcccttcaagatcaaccaggaggagcagagacccgtgcagatgatgtaccaggaggccaccttcaagctggcccacgtgggcgaggtgagagcccagctgctggagctgccctacgccagaaaggagctgagcctgctggtgctgctgcccgacgacggcgtggagctgagcaccgtggagaagagcctgaccttcgagaagctgaccgcctggaccaagcccgactgcatgaagagcaccgaggtggaggtgctgctgcccaagttcaagctgcaggaggactacgacatggagagcgtgctgagacacctgggcatcgtggacgccttccagcagggcaaggccgacctgagcgccatgagcgccgagagagacctgtgcctgagcaagttcgtgcacaagagcttcgtggaggtgaacgaggagggcaccgaggccgccgccgccagcagctgcttcgtggtggccgagtgctgcatggagagcggccccagattctgcgccgaccaccccttcctgttcttcatcagacacaacagagccaacagcatcctgttctgcggcagattcagcagcccctag

SEQ ID NO: 98617 - DNA, 1104 bp, Artificial Sequence
  Description of Artificial Sequence: Synthetic coding sequence
atgagcagccccccccccgccagaagcggcttctacagacaggaggtgaccaagaccgcctgggaggtgagagccgtgtacagagacctgcagcccgtgggcagcggcgcctacggcgccgtgtgcagcgccgtggacggcagaaccggcgccaaggtggccatcaagaagctgtacagacccttccagagcgagctgttcgccaagagagcctacagagagctgagactgctgaagcacatgagacacgagaacgtgatcggcctgctggacgtgttcacccccgacgagaccctggacgacttcaccgacttctacctggtgatgcccttcatgggcaccgacctgggcaagctgatgaagcacgagaagctgggcgaggacagaatccagttcctggtgtaccagatgctgaagggcctgagatacatccacgccgccggcatcatccacagagacctgaagcccggcaacctggccgtgaacgaggactgcgagctgaagatcctggacttcggcctggccagacaggccgacagcgagatgaccggctacgtggtgaccagatggtacagagcccccgaggtgatcctgaactggatgagatacacccagaccgtggacatctggagcgtgggctgcatcatggccgagatgatcaccggcaagaccctgttcaagggcagcgaccacctggaccagctgaaggagatcatgaaggtgaccggcaccccccccgccgagttcgtgcagagactgcagagcgacgaggccaagaactacatgaagggcctgcccgagctggagaagaaggacttcgccagcatcctgaccaacgccagccccctggccgtgaacctgctggagaagatgctggtgctggacgccgagcagagagtgaccgccggcgaggccctggcccacccctacttcgagagcctgcacgacaccgaggacgagccccaggtgcagaagtacgacgacagcttcgacgacgtggacagaaccctggacgagtggaagagagtgacctacaaggaggtgctgagcttcaagccccccagacagctgggcgccagagtgagcaaggagacccccctgtag

SEQ ID NO: 98618 - DNA, 1500 bp, Artificial Sequence
  Description of Artificial Sequence: Synthetic coding sequence
atgaagcacagcctgaacgccctgctgatcttcctgatcatcaccagcgcctggggcggcagcaagggccccctggaccagctggagaagggcggcgagaccgcccagagcgccgacccccagtgggagcagctgaacaacaagaacctgagcatgcccctgctgcccgccgacttccacaaggagaacaccgtgaccaacgactggatccccgagggcgaggaggacgacgactacctggacctggagaagatcttcagcgaggacgacgactacatcgacatcgtggacagcctgagcgtgagccccaccgacagcgacgtgagcgccggcaacatcctgcagctgttccacggcaagagcagaatccagagactgaacatcctgaacgccaagttcgccttcaacctgtacagagtgctgaaggaccaggtgaacaccttcgacaacatcttcatcgcccccgtgggcatcagcaccgccatgggcatgatcagcctgggcctgaagggcgagacccacgagcaggtgcacagcatcctgcacttcaaggacttcgtgaacgccagcagcaagtacgagatcaccaccatccacaacctgttcagaaagctgacccacagactgttcagaagaaacttcggctacaccctgagaagcgtgaacgacctgtacatccagaagcagttccccatcctgctggacttcaagaccaaggtgagagagtactacttcgccgaggcccagatcgccgacttcagcgaccccgccttcatcagcaagaccaacaaccacatcatgaagctgaccaagggcctgatcaaggacgccctggagaacatcgaccccgccacccagatgatgatcctgaactgcatctacttcaagggcagctgggtgaacaagttccccgtggagatgacccacaaccacaacttcagactgaacgagagagaggtggtgaaggtgagcatgatgcagaccaagggcaacttcctggccgccaacgaccaggagctggactgcgacatcctgcagctggagtacgtgggcggcatcagcatgctgatcgtggtgccccacaagatgagcggcatgaagaccctggaggcccagctgacccccagagtggtggagagatggcagaagagcatgaccaacagaaccagagaggtgctgctgcccaagttcaagctggagaagaactacaacctggtggagagcctgaagctgatgggcatcagaatgctgttcgacaagaacggcaacatggccggcatcagcgaccagagaatcgccatcgacctgttcaagcaccagggcaccatcaccgtgaacgaggagggcacccaggccaccaccgtgaccaccgtgggcttcatgcccctgagcacccaggtgagattcaccgtggacagacccttcctgttcctgatctacgagcacagaaccagctgcctgctgttcatgggcagagtggccaaccccagcagaagctag

SEQ ID NO: 98619 - DNA, 1197 bp, Artificial Sequence
  Description of Artificial Sequence: Synthetic coding sequence
atgaactggcacctgcccctgttcctgctggccagcgtgaccctgcccagcatctgcagccacttcaaccccctgagcctggaggagctgggcagcaacaccggcatccaggtgttcaaccagatcgtgaagagcagaccccacgacaacatcgtgatcagcccccacggcatcgccagcgtgctgggcatgctgcagctgggcgccgacggcagaaccaagaagcagctggccatggtgatgagatacggcgtgaacggcgtgggcaagatcctgaagaagatcaacaaggccatcgtgagcaagaagaacaaggacatcgtgaccgtggccaacgccgtgttcgtgaagaacgccagcgagatcgaggtgcccttcgtgaccagaaacaaggacgtgttccagtgcgaggtgagaaacgtgaacttcgaggaccccgccagcgcctgcgacagcatcaacgcctgggtgaagaacgagaccagagacatgatcgacaacctgctgagccccgacctgatcgacggcgtgctgaccagactggtgctggtgaacgccgtgtacttcaagggcctgtggaagagcagattccagcccgagaacaccaagaagagaaccttcgtggccgccgacggcaagagctaccaggtgcccatgctggcccagctgagcgtgttcagatgcggcagcaccagcgcccccaacgacctgtggtacaacttcatcgagctgccctaccacggcgagagcatcagcatgctgatcgccctgcccaccgagagcagcacccccctgagcgccatcatcccccacatcagcaccaagaccatcgacagctggatgagcatcatggtgcccaagagagtgcaggtgatcctgcccaagttcaccgccgtggcccagaccgacctgaaggagcccctgaaggtgctgggcatcaccgacatgttcgacagcagcaaggccaacttcgccaagatcaccaccggcagcgagaacctgcacgtgagccacatcctgcagaaggccaagatcgaggtgagcgaggacggcaccaaggccagcgccgccaccaccgccatcctgatcgccagaagcagccccccctggttcatcgtggacagacccttcctgttcttcatcagacacaaccccaccggcgccgtgctgttcatgggccagatcaacaagccctag

SEQ ID NO: 98620 - DNA, 1194 bp, Artificial Sequence
  Description of Artificial Sequence: Synthetic coding sequence
atgaactggcacctgcccctgttcctgctggccagcgtgaccctgcccagcatctgcagccacttcaaccccctgagcctggaggagctgggcagcaacaccggcatccaggtgttcaaccagatcgtgaagagcagaccccacgacaacatcgtgatcagcccccacggcatcgccagcgtgctgggcatgctgcagctgggcgccgacggcagaaccaagaagcagctggccatggtgatgagatacggcgtgaacggcgtgggcaagatcctgaagaagatcaacaaggccatcgtgagcaagaagaacaaggacatcgtgaccgtggccaacgccgtgttcgtgaagaacgccagcgagatcgaggtgcccttcgtgaccagaaacaaggacgtgttccagtgcgaggtgagaaacgtgaacttcgaggaccccgccagcgcctgcgacagcatcaacgcctgggtgaagaacgagaccagagacatgatcgacaacctgctgagccccgacctgatcgacggcgtgctgaccagactggtgctggtgaacgccgtgtacttcaagggcctgtggaagagcagattccagcccgagaacaccaagaagagaaccttcgtggccgccgacggcaagagctaccaggtgcccatgctggcccagctgagcgtgttcagatgcggcagcaccagcgcccccaacgacctgtggtacaacttcatcgagctgccctaccacggcgagagcatcagcatgctgatcgccctgcccaccgagagcagcacccccctgagcgccatcatcccccacatcagcaccaagaccatcgacagctggatgagcatcatggtgcccaagagagtgcaggtgatcctgcccaagttcaccgccgtggcccagaccgacctgaaggagcccctgaaggtgctgggcatcaccgacatgttcgacagcagcaaggccaacttcgccaagatcaccagaagcgagaacctgcacgtgagccacatcctgcagaaggccaagatcgaggtgagcgaggacggcaccaaggccagcgccgccaccaccgccatcctgatcgccagaagcagccccccctggttcatcgtggacagacccttcctgttcttcatcagacacaaccccaccggcgccgtgctgttcatgggccagatcaacaagccctag

SEQ ID NO: 98621 - DNA, 1194 bp, Artificial Sequence; identical to SEQ ID NO: 98620
  Description of Artificial Sequence: Synthetic coding sequence

SEQ ID NO: 98622 - DNA, 129 bp, Artificial Sequence
  Description of Artificial Sequence: Synthetic coding sequence
atgaactggcacctgcccctgttcctgctggccagcgtgaccctgcccagcatctgcagccacttcaaccccctgagcctggaggagctgggcagcaacaccggcatccaggtgttcaaccagatctag

SEQ ID NO: 98623 - DNA, 831 bp, Artificial Sequence
  Description of Artificial Sequence: Synthetic coding sequence
atgaactggcacctgcccctgttcctgctggccagcgtgaccctgcccagcatctgcagccacttcaaccccctgagcctggaggagctgggcagcaacaccggcatccaggtgttcaaccagatcgtgaagagcagaccccacgacaacatcgtgatcagcccccacggcatcgccagcgtgctgggcatgctgcagctgggcgccgacggcagaaccaagaagcagctggccatggtgatgagatacggcgtgaacggcgtgggcaagatcctgaagaagatcaacaaggccatcgtgagcaagaagaacaaggacatcgtgaccgtggccaacgccgtgttcgtgaagaacgccagcgagatcgaggtgcccttcgtgaccagaaacaaggacgtgttccagtgcgaggtgagaaacgtgaacttcgaggaccccgccagcgcctgcgacagcatcaacgcctgggtgaagaacgagaccagagacatgatcgacaacctgctgagccccgacctgatcgacggcgtgctgaccagactggtgctggtgaacgccgtgtacttcaagggcctgtggaagagcagattccagcccgagaacaccaagaagagaaccttcgtggccgccgacggcaagagctaccaggtgcccatgctggcccagctgagcgtgttcagatgcggcagcaccagcgcccccaacgacctgtggtacaacttcatcgagctgccctaccacggcgagagcatcagcatgctgatcgccctgcccaccgagagcagcacccccctgagcgccatcatcccccacatcagcaccaagacctag

SEQ ID NO: 98624 - DNA, 1230 bp, Artificial Sequence
  Description of Artificial Sequence: Synthetic coding sequence
atgagcgactgcagaagcagcctggtggagggcaccatgaactggcacctgcccctgttcctgctggccagcgtgaccctgcccagcatctgcagccacttcaaccccctgagcctggaggagctgggcagcaacaccggcatccaggtgttcaaccagatcgtgaagagcagaccccacgacaacatcgtgatcagcccccacggcatcgccagcgtgctgggcatgctgcagctgggcgccgacggcagaaccaagaagcagctggccatggtgatgagatacggcgtgaacggcgtgggcaagatcctgaagaagatcaacaaggccatcgtgagcaagaagaacaaggacatcgtgaccgtggccaacgccgtgttcgtgaagaacgccagcgagatcgaggtgcccttcgtgaccagaaacaaggacgtgttccagtgcgaggtgagaaacgtgaacttcgaggaccccgccagcgcctgcgacagcatcaacgcctgggtgaagaacgagaccagagacatgatcgacaacctgctgagccccgacctgatcgacggcgtgctgaccagactggtgctggtgaacgccgtgtacttcaagggcctgtggaagagcagattccagcccgagaacaccaagaagagaaccttcgtggccgccgacggcaagagctaccaggtgcccatgctggcccagctgagcgtgttcagatgcggcagcaccagcgcccccaacgacctgtggtacaacttcatcgagctgccctaccacggcgagagcatcagcatgctgatcgccctgcccaccgagagcagcacccccctgagcgccatcatcccccacatcagcaccaagaccatcgacagctggatgagcatcatggtgcccaagagagtgcaggtgatcctgcccaagttcaccgccgtggcccagaccgacctgaaggagcccctgaaggtgctgggcatcaccgacatgttcgacagcagcaaggccaacttcgccaagatcaccagaagcgagaacctgcacgtgagccacatcctgcagaaggccaagatcgaggtgagcgaggacggcaccaaggccagcgccgccaccaccgccatcctgatcgccagaagcagccccccctggttcatcgtggacagacccttcctgttcttcatcagacacaaccccaccggcgccgtgctgttcatgggccagatcaacaagccctag

SEQ ID NO: 98625 - DNA, 264 bp, Artificial Sequence
  Description of Artificial Sequence: Synthetic coding sequence
atgaactggcacctgcccctgttcctgctggccagcgtgaccctgcccagcatctgcagccacttcaaccccctgagcctggaggagctgggcagcaacaccggcatccaggtgttcaaccagatcgtgaagagcagaccccacgacaacatcgtgatcagcccccacggcatcgccagcgtgctgggcatgctgcagctgggcgccgacggcagaaccaagaagcagctggccatggtgatgagatacggcgtgaacggctag

SEQ ID NO: 98626 - DNA, 1257 bp, Artificial Sequence
  Description of Artificial Sequence: Synthetic coding sequence
atgcaggccctggtgctgctgctgtgcatcggcgccctgctgggccacagcagctgccagaaccccgccagcccccccgaggagggcagccccgaccccgacagcaccggcgccctggtggaggaggaggaccccttcttcaaggtgcccgtgaacaagctggccgccgccgtgagcaacttcggctacgacctgtacagagtgagaagcagcaccagccccaccaccaacgtgctgctgagccccctgagcgtggccaccgccctgagcgccctgagcctgggcgccgagcagagaaccgagagcatcatccacagagccctgtactacgacctgatcagcagccccgacatccacggcacctacaaggagctgctggacaccgtgaccgccccccagaagaacctgaagagcgccagcagaatcgtgttcgagaagaagctgagaatcaagagcagcttcgtggcccccctggagaagagctacggcaccagacccagagtgctgaccggcaaccccagactggacctgcaggagatcaacaactgggtgcaggcccagatgaagggcaagctggccagaagcaccaaggagatccccgacgagatcagcatcctgctgctgggcgtggcccacttcaagggccagtgggtgaccaagttcgacagcagaaagaccagcctggaggacttctacctggacgaggagagaaccgtgagagtgcccatgatgagcgaccccaaggccgtgctgagatacggcctggacagcgacctgagctgcaagatcgcccagctgcccctgaccggcagcatgagcatcatcttcttcctgcccctgaaggtgacccagaacctgaccctgatcgaggagagcctgaccagcgagttcatccacgacatcgacagagagctgaagaccgtgcaggccgtgctgaccgtgcccaagctgaagctgagctacgagggcgaggtgaccaagagcctgcaggagatgaagctgcagagcctgttcgacagccccgacttcagcaagatcaccggcaagcccatcaagctgacccaggtggagcacagagccggcttcgagtggaacgaggacggcgccggcaccacccccagccccggcctgcagcccgcccacctgaccttccccctggactaccacctgaaccagcccttcatcttcgtgctgagagacaccgacaccggcgccctgctgttcatcggcaagatcctggaccccagaggcccctag

SEQ ID NO: 98627 - DNA, 1233 bp, Artificial Sequence
  Description of Artificial Sequence: Synthetic coding sequence
atggccttcctgggcctgttcagcctgctggtgctgcagagcatggccaccggcgccaccttccccgaggaggccatcgccgacctgagcgtgaacatgtacaacagactgagagccaccggcgaggacgagaacatcctgttcagccccctgagcatcgccctggccatgggcatgatggagctgggcgcccagggcagcacccagaaggagatcagacacagcatgggctacgacagcctgaagaacggcgaggagttcagcttcctgaaggagttcagcaacatggtgaccgccaaggagagccagtacgtgatgaagatcgccaacagcctgttcgtgcagaacggcttccacgtgaacgaggagttcctgcagatgatgaagaagtacttcaacgccgccgtgaaccacgtggacttcagccagaacgtggccgtggccaactacatcaacaagtgggtggagaacaacaccaacaacctggtgaaggacctggtgagccccagagacttcgacgccgccacctacctggccctgatcaacgccgtgtacttcaagggcaactggaagagccagttcagacccgagaacaccagaaccttcagcttcaccaaggacgacgagagcgaggtgcagatccccatgatgtaccagcagggcgagttctactacggcgagttcagcgacggcagcaacgaggccggcggcatctaccaggtgctggagatcccctacgagggcgacgagatcagcatgatgctggtgctgagcagacaggaggtgcccctggccaccctggagcccctggtgaaggcccagctggtggaggagtgggccaacagcgtgaagaagcagaaggtggaggtgtacctgcccagattcaccgtggagcaggagatcgacctgaaggacgtgctgaaggccctgggcatcaccgagatcttcatcaaggacgccaacctgaccggcctgagcgacaacaaggagatcttcctgagcaaggccatccacaagagcttcctggaggtgaacgaggagggcagcgaggccgccgccgtgagcggcatgatcgccatcagcagaatggccgtgctgtacccccaggtgatcgtggaccaccccttcttcttcctgatcagaaacagaagaaccggcaccatcctgttcatgggcagagtgatgcaccccgagaccatgaacaccagcggccacgacttcgaggagctgtag

SEQ ID NO: 98628 - DNA, 1233 bp, Artificial Sequence; identical to SEQ ID NO: 98627
  Description of Artificial Sequence: Synthetic coding sequence

SEQ ID NO: 98629 - DNA, 738 bp, Artificial Sequence
  Description of Artificial Sequence: Synthetic coding sequence
atggccttcctgggcctgttcagcctgctggtgctgcagagcatggccaccggcgccaccttccccgaggaggccatcgccgacctgagcgtgaacatgtacaacagactgagagccaccggcgaggacgagaacatcctgttcagccccctgagcatcgccctggccatgggcatgatggagctgggcgcccagggcagcacccagaaggagatcagacacagcatgggctacgacagcctgaagaacggcgaggagttcagcttcctgaaggagttcagcaacatggtgaccgccaaggagagccagtacgtgatgaagatcgccaacagcctgttcgtgcagaacggcttccacgtgaacgaggagttcctgcagatgatgaagaagtacttcaacgccgccgtgaaccacgtggacttcagccagaacgtggccgtggccaactacatcaacaagtgggtggagaacaacaccaacaacctggtgaaggacctggtgagccccagagacttcgacgccgccacctacctggccctgatcaacgccgtgtacttcaagggcaactggaagagccagttcagacccgagaacaccagaaccttcagcttcaccaaggacgacgagagcgaggtgcagatccccatgatgtaccagcagggcgagttctactacggcgagttcagcgacggcagcaacgaggccggcggcatctaccaggtgctggagatcccctag

SEQ ID NO: 98630 - DNA, 483 bp, Artificial Sequence
  Description of Artificial Sequence: Synthetic coding sequence
atggccttcctgggcctgttcagcctgctggtgctgcagagcatggccaccggcgccaccttccccgaggaggccatcgccgacctgagcgtgaacatgtacaacagactgagagccaccggcgaggacgagaacatcctgttcagccccctgagcatcgccctggccatgggcatgatggagctgggcgcccagggcagcacccagaaggagatcagacacagcatgggctacgacagcctgaagaacggcgaggagttcagcttcctgaaggagttcagcaacatggtgaccgccaaggagagccagtacgtgatgaagatcgccaacagcctgttcgtgcagaacggcttccacgtgaacgaggagttcctgcagatgatgaagaagtacttcaacgccgccgtgaaccacgtggacttcagccagaacgtggccgtggccaactacatcaacaagtgggtggagaacaacaccaactag

SEQ ID NO: 98631 - DNA, 591 bp, Artificial Sequence
  Description of Artificial Sequence: Synthetic coding sequence
atggtgggcggcctgaagagaaagcacagcgacctggaggaggaggaggagagatgggagtggagccccgccggcctgcagagctaccagcaggccctgctgagaatcagcctggacaaggtgcagagaagcctgggccccagagcccccagcctgagaagacacgtgctgatccacaacaccctgcagcagctgcaggccgccctgagactggcccccgcccccgccctgccccccgagcccctgttcctgggcgaggaggacttcagcctgagcgccaccatcggcagcatcctgagagagctggacaccagcatggacggcaccgagcccccccagaaccccgtgacccccctgggcctgcagaacgaggtgcccccccagcccgaccccgtgttcctggaggccctgagcagcagatacctgggcgacagcggcctggacgacttcttcctggacatcgacaccagcgccgtggagaaggagcccgccagagccccccccgagcccccccacaacctgttctgcgcccccggcagctgggagtggaacgagctggaccacatcatggagatcatcctgggcagctag

SEQ ID NO: 98632 - DNA, 591 bp, Artificial Sequence; identical to SEQ ID NO: 98631
  Description of Artificial Sequence: Synthetic coding sequence

SEQ ID NO: 98633 - DNA, 369 bp, Artificial Sequence
  Description of Artificial Sequence: Synthetic coding sequence
atgaagctgctgaccggcctggtgttctgcagcctggtgctgggcgtgagcagcagaagcttcttcagcttcctgggcgaggccttcgacggcgccagagacatgtggagagcctacagcgacatgagagaggccaactacatcggcagcgacaagtacttccacgccagaggcaactacgacgccgccaagagaggccccggcggcgcctgggccgccgaggtgatcaccgacgccagagagaacatccagagattcttcggccacggcgccgaggacagcctggccgaccaggccgccaacgagtggggcagaagcggcaaggaccccaaccacttcagacccgccggcctgcccgagaagtactag

SEQ ID NO: 98634 - DNA, 369 bp, Artificial Sequence; identical to SEQ ID NO: 98633
  Description of Artificial Sequence: Synthetic coding sequence

SEQ ID NO: 98635 - DNA, 369 bp, Artificial Sequence; identical to SEQ ID NO: 98633
  Description of Artificial Sequence: Synthetic coding sequence

SEQ ID NO: 98636 - DNA, 369 bp, Artificial Sequence
  Description of Artificial Sequence: Synthetic coding sequence
atgaagctgctgaccggcctggtgttctgcagcctggtgctgagcgtgagcagcagaagcttcttcagcttcctgggcgaggccttcgacggcgccagagacatgtggagagcctacagcgacatgagagaggccaactacatcggcagcgacaagtacttccacgccagaggcaactacgacgccgccaagagaggccccggcggcgcctgggccgccgaggtgatcagcaacgccagagagaacatccagagactgaccggcagaggcgccgaggacagcctggccgaccaggccgccaacaagtggggcagaagcggcagagaccccaaccacttcagacccgccggcctgcccgagaagtactag

SEQ ID NO: 98637 - DNA, 252 bp, Artificial Sequence
  Description of Artificial Sequence: Synthetic coding sequence
atgaagctgctgaccggcctggtgttctgcagcctggtgctgagcgtgagcagcagaagcttcttcagcttcctgggcgaggccttcgacggcgccagagacatgtggagagcctacagcgacatgagagaggccaactacatcggcagcgacaagtacttccacgccagaggcaactacgacgccgccaagagaggccccggcggcgcctgggccgccgaggtgatcagcctgttcagcgccgagctgtag

SEQ ID NO: 98638 - DNA, 369 bp, Artificial Sequence; identical to SEQ ID NO: 98636
  Description of Artificial Sequence: Synthetic coding sequence

SEQ ID NO: 98639 - DNA, 369 bp, Artificial Sequence; identical to SEQ ID NO: 98636
  Description of Artificial Sequence: Synthetic coding sequence

SEQ ID NO: 98640 - DNA, 393 bp, Artificial Sequence
  Description of Artificial Sequence: Synthetic coding sequence
atgagactgttcaccggcatcgtgttctgcagcctggtgatgggcgtgaccagcgagagctggagaagcttcttcaaggaggccctgcagggcgtgggcgacatgggcagagcctactgggacatcatgatcagcaaccaccagaacagcaacagatacctgtacgccagaggcaactacgacgccgcccagagaggccccggcggcgtgtgggccgccaagctgatcagcagaagcagagtgtacctgcagggcctgatcgactgctacctgttcggcaacagcagcaccgtgctggaggacagcaagagcaacgagaaggccgaggagtggggcagaagcggcaaggaccccgacagattcagacccgacggcctgcccaagaagtactag

SEQ ID NO: 98641 - DNA, 1278 bp, Artificial Sequence
  Description of Artificial Sequence: Synthetic coding sequence
atgggcgaggacgccgcccaggccgagaagttccagcaccccggcagcgacatgagacaggagaagcccagcagccccagccccatgcccagcagcacccccagccccagcctgaacctgggcaacaccgaggaggccatcagagacaacagccaggtgaacgccgtgaccgtgctgaccctgctggacaagctggtgaacatgctggacgccgtgcaggagaaccagcacaagatggagcagagacagatcagcctggagggcagcgtgaagggcatccagaacgacctgaccaagctgagcaagtaccaggccagcaccagcaacaccgtgagcaagctgctggagaagagcagaaaggtgagcgcccacaccagagccgtgaaggagagaatggacagacagtgcgcccaggtgaagagactggagaacaaccacgcccagctgctgagaagaaaccacttcaaggtgctgatcttccaggaggagaacgagatccccgccagcgtgttcgtgaagcagcccgtgagcggcgccgtggagggcaaggaggagctgcccgacgagaacaagagcctggaggagaccctgcacaccgtggacctgagcagcgacgacgacctgccccacgacgaggaggccctggaggacagcgccgaggagaaggtggaggagagcagagccgagaagatcaagagaagcagcctgaagaaggtggacagcctgaagaaggccttcagcagacagaacatcgagaagaagatgaacaagctgggcaccaagatcgtgagcgtggagagaagagagaagatcaagaagagcctgaccagcaaccaccagaagatcagcagcggcaagagcagccccttcaaggtgagccccctgaccttcggcagaaagaaggtgagagagggcgagagccacgccgagaacgagaccaagagcgaggacctgcccagcagcgagcagatgcccaacgaccaggaggaggagagcttcgccgagggccacagcgaggccagcctggccagcgccctggtggagggcgagatcgccgaggaggccgccgagaaggccaccagcagaggcagcaacagcggcatggacagcaacatcgacctgaccatcgtggaggacgaggaggaggagagcgtggccctggagcaggcccagaaggtgagatacgagggcagctacgccctgaccagcgaggaggccgagagaagcgacggcgaccccgtgcagcccgccgtgctgcaggtgcaccagaccagctag

SEQ ID NO: 98642 - DNA, 1290 bp, Artificial Sequence
  Description of Artificial Sequence: Synthetic coding sequence
atggcccagcccggcaccctgaacctgaacaacgaggtggtgaagatgagaaaggaggtgaagagaatcagagtgctggtgatcagaaagctggtgagaagcgtgggcagactgaagagcaagaagggcaccgaggacgccctgctgaagaaccagagaagagcccagagactgctggaggagatccacgccatgaaggagctgaagcccgacatcgtgaccaagagcgccctgggcgacgacatcaacttcgagaagatcttcaagaagcccgacagcaccgccaccgagagagccatcgccagactggccgtgcaccccctgctgaagaagaagatcgacgtgctgaaggccgccgtgcaggccttcaaggaggccagacagaacgtggccgaggtggagagcagcaagaacgccagcgaggacaaccacagcgagaacaccctgtacagcaacgacaacggcagcaacctgcagagagaggccaccgtgatcagcgagcagaaggtgaaggagaccaagatcctggccaagaagcccatccacaacagcaaggagaagatcgccaagatggagcacggccccaaggccgtgaccatcgccaacagccccagcaagcccagcgagaaggacagcgtggtgagcctggagagccagaagacccccgccgaccccaagctgaagaccctgagccagaccaagaagaacaagggcagcgacagcagcctgagcggcaacagcgacggcggcgaggagttctgcgaggaggagaaggagtacttcgacgacagcaccgaggagagattctacaagcagagcagcatgagcgaggacagcgacagcggcgacgacttcttcatcggcaaggtgagaagaaccagaaagaaggagagcagctgccacagcagcgtgaaggagcagaagcccctggagaaggtgttcctgaaggaggacaccggcgagacccacggcgacaccagaaacgacaagatcaagcccagcaccgagaccagaaagctggagagcgtgttcttccacagcctgagcggcagcaagagcagcagaagaaacttcaaggagcaggcccccaagaccagaagcctggacttcccccagaacgagccccagatcaagaaccagttcaacaagaagctgagcggcagactggagaacaccaagcagcagctgcagctgcccctgcaccccagctgggaggccagcagaagaagaaaggagcagcagagcaacatcgccgtgttccagggcaagaagatcaccttcgacgactag

SEQ ID NO: 98643 - DNA, 1296 bp, Artificial Sequence
  Description of Artificial Sequence: Synthetic coding sequence
atgaccgtgaagaccgaggccgccaagggcaccctgacctacagcagaatgagaggcatggtggccatcctgatcgccttcatgaagcagagaagaatgggcctgaacgacttcatccagaagatcgccaacaacagctacgcctgcaagcaccccgaggtgcagagcatcctgaagatcagccagccccaggagcccgagctgatgaacgccaaccccagccccccccccagccccagccagcagatcaacctgggccccagcagcaacccccacgccaagcccagcgacttccacttcctgaaggtgatcggcaagggcagcttcggcaaggtgctgctggccagacacaaggccgaggaggtgttctacgccgtgaaggtgctgcagaagaaggccatcctgaagaagaaggaggagaagcacatcatgagcgagagaaacgtgctgctgaagaacgtgaagcaccccttcctggtgggcctgcacttcagcttccagaccgccgacaagctgtacttcgtgctggactacatcaacggcggcgagctgttctaccacctgcagagagagagatgcttcctggagcccagagccagattctacgccgccgagatcgccagcgccctgggctacctgcacagcctgaacatcgtgtacagagacctgaagcccgagaacatcctgctggacagccagggccacatcgtgctgaccgacttcggcctgtgcaaggagaacatcgagcacaacagcaccaccagcaccttctgcggcacccccgagtacctggcccccgaggtgctgcacaagcagccctacgacagaaccgtggactggtggtgcctgggcgccgtgctgtacgagatgctgtacggcctgccccccttctacagcagaaacaccgccgagatgtacgacaacatcctgaacaagcccctgcagctgaagcccaacatcaccaacagcgccagacacctgctggagggcctgctgcagaaggacagaaccaagagactgggcgccaaggacgacttcatggagatcaagagccacgtgttcttcagcctgatcaactgggacgacctgatcaacaagaagatcaccccccccttcaaccccaacgtgagcggccccaacgacctgagacacttcgaccccgagttcaccgaggagcccgtgcccaacagcatcggcaagagccccgacagcgtgctggtgaccgccagcgtgaaggaggccgccgaggccttcctgggcttcagctacgccccccccaccgacagcttcctgtag

SEQ ID NO: 98644 - DNA, 1266 bp, Artificial Sequence
  Description of Artificial Sequence: Synthetic coding sequence
atgaagcccagcaagagattcttcatcagcccccccagcagcaccgccttcatgaagcagagaagaatgggcctgaacgacttcatccagaagatcgccaacaacagctacgcctgcaagcaccccgaggtgcagagcatcctgaagatcagccagccccaggagcccgagctgatgaacgccaaccccagccccccccccagccccagccagcagatcaacctgggccccagcagcaacccccacgccaagcccagcgacttccacttcctgaaggtgatcggcaagggcagcttcggcaaggtgctgctggccagacacaaggccgaggaggtgttctacgccgtgaaggtgctgcagaagaaggccatcctgaagaagaaggaggagaagcacatcatgagcgagagaaacgtgctgctgaagaacgtgaagcaccccttcctggtgggcctgcacttcagcttccagaccgccgacaagctgtacttcgtgctggactacatcaacggcggcgagctgttctaccacctgcagagagagagatgcttcctggagcccagagccagattctacgccgccgagatcgccagcgccctgggctacctgcacagcctgaacatcgtgtacagagacctgaagcccgagaacatcctgctggacagccagggccacatcgtgctgaccgacttcggcctgtgcaaggagaacatcgagcacaacagcaccaccagcaccttctgcggcacccccgagtacctggcccccgaggtgctgcacaagcagccctacgacagaaccgtggactggtggtgcctgggcgccgtgctgtacgagatgctgtacggcctgccccccttctacagcagaaacaccgccgagatgtacgacaacatcctgaacaagcccctgcagctgaagcccaacatcaccaacagcgccagacacctgctggagggcctgctgcagaaggacagaaccaagagactgggcgccaaggacgacttcatggagatcaagagccacgtgttcttcagcctgatcaactgggacgacctgatcaacaagaagatcaccccccccttcaaccccaacgtgagcggccccaacgacctgagacacttcgaccccgagttcaccgaggagcccgtgcccaacagcatcggcaagagccccgacagcgtgctggtgaccgccagcgtgaaggaggccgccgaggccttcctgggcttcagctacgccccccccaccgacagcttcctgtag

SEQ ID NO: 98645 - DNA, 1581 bp, Artificial Sequence
  Description of Artificial Sequence: Synthetic coding sequence
atggtgaacaaggacatgaacggcttccccgtgaagaagtgcagcgccttccagttcttcaagaagagagtgagaagatggatcaagagccccatggtgagcgtggacaagcaccagagccccagcctgaagtacaccggcagcagcatggtgcacatcccccccggcgagcccgacttcgagagcagcctgtgccagacctgcctgggcgagcacgccttccagagaggcgtgctgccccaggagaacgagagctgcagctgggagacccagagcggctgcgaggtgagagagccctgcaaccacgccaacatcctgaccaagcccgaccccagaaccttctggaccaacgacgaccccgccttcatgaagcagagaagaatgggcctgaacgacttcatccagaagatcgccaacaacagctacgcctgcaagcaccccgaggtgcagagcatcctgaagatcagccagccccaggagcccgagctgatgaacgccaaccccagccccccccccagccccagccagcagatcaacctgggccccagcagcaacccccacgccaagcccagcgacttccacttcctgaaggtgatcggcaagggcagcttcggcaaggtgctgctggccagacacaaggccgaggaggtgttctacgccgtgaaggtgctgcagaagaaggccatcctgaagaagaaggaggagaagcacatcatgagcgagagaaacgtgctgctgaagaacgtgaagcaccccttcctggtgggcctgcacttcagcttccagaccgccgacaagctgtacttcgtgctggactacatcaacggcggcgagctgttctaccacctgcagagagagagatgcttcctggagcccagagccagattctacgccgccgagatcgccagcgccctgggctacctgcacagcctgaacatcgtgtacagagacctgaagcccgagaacatcctgctggacagccagggccacatcgtgctgaccgacttcggcctgtgcaaggagaacatcgagcacaacagcaccaccagcaccttctgcggcacccccgagtacctggcccccgaggtgctgcacaagcagccctacgacagaaccgtggactggtggtgcctgggcgccgtgctgtacgagatgctgtacggcctgccccccttctacagcagaaacaccgccgagatgtacgacaacatcctgaacaagcccctgcagctgaagcccaacatcaccaacagcgccagacacctgctggagggcctgctgcagaaggacagaaccaagagactgggcgccaaggacgacttcatggagatcaagagccacgtgttcttcagcctgatcaactgggacgacctgatcaacaagaagatcaccccccccttcaaccccaacgtgagcggccccaacgacctgagacacttcgaccccgagttcaccgaggagcccgtgcccaacagcatcggcaagagccccgacagcgtgctggtgaccgccagcgtgaaggaggccgccgaggccttcctgggcttcagctacgccccccccaccgacagcttcctgtag

SEQ ID NO: 98646 - DNA, 1338 bp, Artificial Sequence
  Description of Artificial Sequence: Synthetic coding sequence
atgggcgagatgcagggcgccctggccagagccagactggagagcctgctgagacccagacacaagaagagagccgaggcccagaagagaagcgagagcttcctgctgagcggcctggccttcatgaagcagagaagaatgggcctgaacgacttcatccagaagatcgccaacaacagctacgcctgcaagcaccccgaggtgcagagcatcctgaagatcagccagccccaggagcccgagctgatgaacgccaaccccagccccccccccagccccagccagcagatcaacctgggccccagcagcaacccccacgccaagcccagcgacttccacttcctgaaggtgatcggcaagggcagcttcggcaaggtgctgctggccagacacaaggccgaggaggtgttctacgccgtgaaggtgctgcagaagaaggccatcctgaagaagaaggaggagaagcacatcatgagcgagagaaacgtgctgctgaagaacgtgaagcaccccttcctggtgggcctgcacttcagcttccagaccgccgacaagctgtacttcgtgctggactacatcaacggcggcgagctgttctaccacctgcagagagagagatgcttcctggagcccagagccagattctacgccgccgagatcgccagcgccctgggctacctgcacagcctgaacatcgtgtacagagacctgaagcccgagaacatcctgctggacagccagggccacatcgtgctgaccgacttcggcctgtgcaaggagaacatcgagcacaacagcaccaccagcaccttctgcggcacccccgagtacctggcccccgaggtgctgcacaagcagccctacgacagaaccgtggactggtggtgcctgggcgccgtgctgtacgagatgctgtacggcctgccccccttctacagcagaaacaccgccgagatgtacgacaacatcctgaacaagcccctgcagctgaagcccaacatcaccaacagcgccagacacctgctggagggcctgctgcagaaggacagaaccaagagactgggcgccaaggacgacttcatggagatcaagagccacgtgttcttcagcctgatcaactgggacgacctgatcaacaagaagatcaccccccccttcaaccccaacgtgagcggccccaacgacctgagacacttcgaccccgagttcaccgaggagcccgtgcccaacagcatcggcaagagccccgacagcgtgctggtgaccgccagcgtgaaggaggccgccgaggccttcctgggcttcagctacgccccccccaccgacagcttcctgtag

SEQ ID NO: 98647 - DNA, 435 bp, Artificial Sequence
  Description of Artificial Sequence: Synthetic coding sequence
atggtgagcgtggacaagcaccagagccccagcctgaagtacaccggcagcagcatggtgcacatcccccccggcgagcccgacttcgagagcagcctgtgccagacctgcctgggcgagcacgccttccagagaggcgtgctgccccaggagaacgagagctgcagctgggagacccagagcggctgcgaggtgagagagccctgcaaccacgccaacatcctgaccaagcccgaccccagaaccttctggaccaacgacgaccccgccttcatgaagcagagaagaatgggcctgaacgacttcatccagaagatcgccaacaacagctacgcctgcaagcaccccgaggtgcagagcatcctgaagatcagccagccccaggagcccgagctgatgaacgccaaccccagccccccccccagccccagctag

SEQ ID NO: 98648 - DNA, 1380 bp, Artificial Sequence
  Description of Artificial Sequence: Synthetic coding sequence
atgagcagccagagcagcagcctgagcgaggcctgcagcagagaggcctacagcagccacaactgggccctgccccccgccagcagaagcaacccccagcccgcctacccctgggccaccagaagaatgaaggaggaggccatcaagccccccctgaaggccttcatgaagcagagaagaatgggcctgaacgacttcatccagaagatcgccaacaacagctacgcctgcaagcaccccgaggtgcagagcatcctgaagatcagccagccccaggagcccgagctgatgaacgccaaccccagccccccccccagccccagccagcagatcaacctgggccccagcagcaacccccacgccaagcccagcgacttccacttcctgaaggtgatcggcaagggcagcttcggcaaggtgctgctggccagacacaaggccgaggaggtgttctacgccgtgaaggtgctgcagaagaaggccatcctgaagaagaaggaggagaagcacatcatgagcgagagaaacgtgctgctgaagaacgtgaagcaccccttcctggtgggcctgcacttcagcttccagaccgccgacaagctgtacttcgtgctggactacatcaacggcggcgagctgttctaccacctgcagagagagagatgcttcctggagcccagagccagattctacgccgccgagatcgccagcgccctgggctacctgcacagcctgaacatcgtgtacagagacctgaagcccgagaacatcctgctggacagccagggccacatcgtgctgaccgacttcggcctgtgcaaggagaacatcgagcacaacagcaccaccagcaccttctgcggcacccccgagtacctggcccccgaggtgctgcacaagcagccctacgacagaaccgtggactggtggtgcctgggcgccgtgctgtacgagatgctgtacggcctgccccccttctacagcagaaacaccgccgagatgtacgacaacatcctgaacaagcccctgcagctgaagcccaacatcaccaacagcgccagacacctgctggagggcctgctgcagaaggacagaaccaagagactgggcgccaaggacgacttcatggagatcaagagccacgtgttcttcagcctgatcaactgggacgacctgatcaacaagaagatcaccccccccttcaaccccaacgtgagcggccccaacgacctgagacacttcgaccccgagttcaccgaggagcccgtgcccaacagcatcggcaagagccccgacagcgtgctggtgaccgccagcgtgaaggaggccgccgaggccttcctgggcttcagctacgccccccccaccgacagcttcctgtag

SEQ ID NO: 98649 - DNA, 183 bp, Artificial Sequence
  Description of Artificial Sequence: Synthetic coding sequence
atggtgaacaaggacatgaacggcttccccgtgaagaagtgcagcgccttccagttcttcaagaagagagtgagaagatggatcaagagccccatggtgagcgtggacaagcaccagagccccagcctgaagtacaccggcagcagcatggtgcacatcccccccggcgagcccgacttctag

SEQ ID NO: 98650 - DNA, 1284 bp, Artificial Sequence
  Description of Artificial Sequence: Synthetic coding sequence
atgcagggcctgctgaccagcggcagaaagcccagcggcggcggcagatgcaccggcagaggcggctggagaggccagtggtgcctgaagccctggatgggcggcgccgacccccccacccccaccctgagctgcctgctgctgcccgtgccccccgagctgcccgaccactgctacagaatgaacagcagccccgccggcacccccagcccccagcccagcagagccaacggcaacatcaacctgggccccagcgccaaccccaacgcccagcccaccgacttcgacttcctgaaggtgatcggcaagggcaactacggcaaggtgctgctggccaagagaaagagcgacggcgccttctacgccgtgaaggtgctgcagaagaagagcatcctgaagaagaaggagcagagccacatcatggccgagagaagcgtgctgctgaagaacgtgagacaccccttcctggtgggcctgagatacagcttccagacccccgagaagctgtacttcgtgctggactacgtgaacggcggcgagctgttcttccacctgcagagagagagaagattcctggagcccagagccagattctacgccgccgaggtggccagcgccatcggctacctgcacagcctgaacatcatctacagagacctgaagcccgagaacatcctgctggactgccagggccacgtggtgctgaccgacttcggcctgtgcaaggagggcgtggagcccgaggacaccaccagcaccttctgcggcacccccgagtacctggcccccgaggtgctgagaaaggagccctacgacagagccgtggactggtggtgcctgggcgccgtgctgtacgagatgctgcacggcctgccccccttctacagccaggacgtgagccagatgtacgagaacatcctgcaccagcccctgcagatccccggcggcagaaccgtggccgcctgcgacctgctgcagagcctgctgcacaaggaccagagacagagactgggcagcaaggccgacttcctggagatcaagaaccacgtgttcttcagccccatcaactgggacgacctgtaccacaagagactgaccccccccttcaaccccaacgtgaccggccccgccgacctgaagcacttcgaccccgagttcacccaggaggccgtgagcaagagcatcggctgcacccccgacaccgtggccagcagcagcggcgccagcagcgccttcctgggcttcagctacgcccccgaggacgacgacatcctggactgctag

SEQ ID NO: 98651 - DNA, 1101 bp, Artificial Sequence
  Description of Artificial Sequence: Synthetic coding sequence
atgaacagcagccccgccggcacccccagcccccagcccagcagagccaacggcaacatcaacctgggccccagcgccaaccccaacgcccagcccaccgacttcgacttcctgaaggtgatcggcaagggcaactacggcaaggtgctgctggccaagagaaagagcgacggcgccttctacgccgtgaaggtgctgcagaagaagagcatcctgaagaagaaggagagccacatcatggccgagagaagcgtgctgctgaagaacgtgagacaccccttcctggtgggcctgagatacagcttccagacccccgagaagctgtacttcgtgctggactacgtgaacggcggcgagctgttcttccacctgcagagagagagaagattcctggagcccagagccagattctacgccgccgaggtggccagcgccatcggctacctgcacagcctgaacatcatctacagagacctgaagcccgagaacatcctgctggactgccagggccacgtggtgctgaccgacttcggcctgtgcaaggagggcgtggagcccgaggacaccaccagcaccttctgcggcacccccgagtacctggcccccgaggtgctgagaaaggagccctacgacagagccgtggactggtggtgcctgggcgccgtgctgtacgagatgctgcacggcctgccccccttctacagccaggacgtgagccagatgtacgagaacatcctgcaccagcccctgcagatccccggcggcagaaccgtggccgcctgcgacctgctgcagagcctgctgcacaaggaccagagacagagactgggcagcaaggccgacttcctggagatcaagaaccacgtgttcttcagccccatcaactgggacgacctgtaccacaagagactgaccccccccttcaaccccaacgtgaccggccccgccgacctgaagcacttcgaccccgagttcacccaggaggccgtgagcaagagcatcggctgcacccccgacaccgtggccagcagcagcggcgccagcagcgccttcctgggcttcagctacgcccccgaggacgacgacatcctggactgctag

SEQ ID NO: 98652 - DNA, 1104 bp, Artificial Sequence
  Description of Artificial Sequence: Synthetic coding sequence
atgaacagcagccccgccggcacccccagcccccagcccagcagagccaacggcaacatcaacctgggccccagcgccaaccccaacgcccagcccaccgacttcgacttcctgaaggtgatcggcaagggcaactacggcaaggtgctgctggccaagagaaagagcgacggcgccttctacgccgtgaaggtgctgcagaagaagagcatcctgaagaagaaggagcagagccacatcatggccgagagaagcgtgctgctgaagaacgtgagacaccccttcctggtgggcctgagatacagcttccagacccccgagaagctgtacttcgtgctggactacgtgaacggcggcgagctgttcttccacctgcagagagagagaagattcctggagcccagagccagattctacgccgccgaggtggccagcgccatcggctacctgcacagcctgaacatcatctacagagacctgaagcccgagaacatcctgctggactgccagggccacgtggtgctgaccgacttcggcctgtgcaaggagggcgtggagcccgaggacaccaccagcaccttctgcggcacccccgagtacctggcccccgaggtgctgagaaaggagccctacgacagagccgtggactggtggtgcctgggcgccgtgctgtacgagatgctgcacggcctgccccccttctacagccaggacgtgagccagatgtacgagaacatcctgcaccagcccctgcagatccccggcggcagaaccgtggccgcctgcgacctgctgcagagcctgctgcacaaggaccagagacagagactgggcagcaaggccgacttcctggagatcaagaaccacgtgttcttcagccccatcaactgggacgacctgtaccacaagagactgaccccccccttcaaccccaacgtgaccggccccgccgacctgaagcacttcgaccccgagttcacccaggaggccgtgagcaagagcatcggctgcacccccgacaccgtggccagcagcagcggcgccagcagcgccttcctgggcttcagctacgcccccgaggacgacgacatcctggactgctag

SEQ ID NO: 98653 - DNA, 1104 bp, Artificial Sequence; identical to SEQ ID NO: 98652
  Description of Artificial Sequence: Synthetic coding sequence

SEQ ID NO: 98654 - DNA, 597 bp, Artificial Sequence
  Description of Artificial Sequence: Synthetic coding sequence
atgaacagcagccccgccggcacccccagcccccagcccagcagagccaacggcaacatcaacctgggccccagcgccaaccccaacgcccagcccaccgacttcgacttcctgaaggtgatcggcaagggcaactacggcaaggtgctgctggccaagagaaagagcgacggcgccttctacgccgtgaaggtgctgcagaagaagagcatcctgaagaagaaggagagccacatcatggccgagagaagcgtgctgctgaagaacgtgagacaccccttcctggtgggcctgagatacagcttccagacccccgagaagctgtacttcgtgctggactacgtgaacggcggcgagctgttcttccacctgcagagagagagaagattcctggagcccagagccagattctacgccgccgaggtggccagcgccatcggctacctgcacagcctgaacatcatctacagagacctgaagcccgagaacatcctgctggactgccagggccacgtggtgctgaccgacttcggcctgtgcaaggagggcgtggagcccgaggacaccaccagcaccttctgcggcacccccgagtag

SEQ ID NO: 98655 - DNA, 1104 bp, Artificial Sequence; identical to SEQ ID NO: 98652
  Description of Artificial Sequence: Synthetic coding sequence

SEQ ID NO: 98656 - DNA, 1182 bp, Artificial Sequence
  Description of Artificial Sequence: Synthetic coding sequence
atgcagggcctgctgaccagcggcagaaagcccagcggcggcggcagatgcaccgagctgcccgaccactgctacagaatgaacagcagccccgccggcacccccagcccccagcccagcagagccaacggcaacatcaacctgggccccagcgccaaccccaacgcccagcccaccgacttcgacttcctgaaggtgatcggcaagggcaactacggcaaggtgctgctggccaagagaaagagcgacggcgccttctacgccgtgaaggtgctgcagaagaagagcatcctgaagaagaaggagcagagccacatcatggccgagagaagcgtgctgctgaagaacgtgagacaccccttcctggtgggcctgagatacagcttccagacccccgagaagctgtacttcgtgctggactacgtgaacggcggcgagctgttcttccacctgcagagagagagaagattcctggagcccagagccagattctacgccgccgaggtggccagcgccatcggctacctgcacagcctgaacatcatctacagagacctgaagcccgagaacatcctgctggactgccagggccacgtggtgctgaccgacttcggcctgtgcaaggagggcgtggagcccgaggacaccaccagcaccttctgcggcacccccgagtacctggcccccgaggtgctgagaaaggagccctacgacagagccgtggactggtggtgcctgggcgccgtgctgtacgagatgctgcacggcctgccccccttctacagccaggacgtgagccagatgtacgagaacatcctgcaccagcccctgcagatccccggcggcagaaccgtggccgcctgcgacctgctgcagagcctgctgcacaaggaccagagacagagactgggcagcaaggccgacttcctggagatcaagaaccacgtgttcttcagccccatcaactgggacgacctgtaccacaagagactgaccccccccttcaaccccaacgtgaccggccccgccgacctgaagcacttcgaccccgagttcacccaggaggccgtgagcaagagcatcggctgcacccccgacaccgtggccagcagcagcggcgccagcagcgccttcctgggcttcagctacgcccccgaggacgacgacatcctggactgctag

SEQ ID NO: 98657 - DNA, 1491 bp, Artificial Sequence
  Description of Artificial Sequence: Synthetic coding sequence
atgcagagagaccacaccatggactacaaggagagctgccccagcgtgagcatccccagcagcgacgagcacagagagaagaagaagagattcaccgtgtacaaggtgctggtgagcgtgggcagaagcgagtggttcgtgttcagaagatacgccgagttcgacaagctgtacaacaccctgaagaagcagttccccgccatggccctgaagatccccgccaagagaatcttcggcgacaacttcgaccccgacttcatcaagcagagaagagccggcctgaacgagttcatccagaacctggtgagataccccgagctgtacaaccaccccgacgtgagagccttcctgcagatggacagccccaagcaccagagcgaccccagcgaggacgaggacgagagaagcagccagaagctgcacagcaccagccagaacatcaacctgggccccagcggcaacccccacgccaagcccaccgacttcgacttcctgaaggtgatcggcaagggcagcttcggcaaggtgctgctggccaagagaaagctggacggcaagttctacgccgtgaaggtgctgcagaagaagatcgtgctgaacagaaaggagcagaagcacatcatggccgagagaaacgtgctgctgaagaacgtgaagcaccccttcctggtgggcctgcactacagcttccagaccaccgagaagctgtacttcgtgctggacttcgtgaacggcggcgagctgttcttccacctgcagagagagagaagcttccccgagcacagagccagattctacgccgccgagatcgccagcgccctgggctacctgcacagcatcaagatcgtgtacagagacctgaagcccgagaacatcctgctggacagcgtgggccacgtggtgctgaccgacttcggcctgtgcaaggagggcatcgccatcagcgacaccaccaccaccttctgcggcacccccgagtacctggcccccgaggtgatcagaaagcagccctacgacaacaccgtggactggtggtgcctgggcgccgtgctgtacgagatgctgtacggcctgccccccttctactgcagagacgtggccgagatgtacgacaacatcctgcacaagcccctgagcctgagacccggcgtgagcctgaccgcctggagcatcctggaggagctgctggagaaggacagacagaacagactgggcgccaaggaggacttcctggagatccagaaccaccccttcttcgagagcctgagctgggccgacctggtgcagaagaagatccccccccccttcaaccccaacgtggccggccccgacgacatcagaaacttcgacaccgccttcaccgaggagaccgtgccctacagcgtgtgcgtgagcagcgactacagcatcgtgaacgccagcgtgctggaggccgacgacgccttcgtgggcttcagctacgccccccccagcgaggacctgttcctgtag

SEQ ID NO: 98658 - DNA, 1491 bp, Artificial Sequence; identical to SEQ ID NO: 98657
  Description of Artificial Sequence: Synthetic coding sequence

SEQ ID NO: 98659 - DNA, 1491 bp, Artificial Sequence; identical to SEQ ID NO: 98657
  Description of Artificial Sequence: Synthetic coding sequence

SEQ ID NO: 98660 - DNA, 1491 bp, Artificial Sequence; identical to SEQ ID NO: 98657
  Description of Artificial Sequence: Synthetic coding sequence

SEQ ID NO: 98661 - DNA, 1395 bp, Artificial Sequence
  Description of Artificial Sequence: Synthetic coding sequence
atgcagagagaccacaccatggactacaaggagagctgccccagcgtgagcatccccagcagcgacgagcacagagagaagaagaagagattcaccgtgtacaaggtgctggtgagcgtgggcagaagcgagtggttcgtgttcagaagatacgccgagttcgacaagctgtacaacaccctgaagaagcagttccccgccatggccctgaagatccccgccaagagaatcttcggcgacaacttcgaccccgacttcatcaagcagagaagagccggcctgaacgagttcatccagaacctggtgagataccccgagctgtacaaccaccccgacgtgagagccttcctgcagatggacagccccaagcaccagagcgaccccagcgaggacgaggacgagagaagcagccagaagctgcacagcaccagccagaacatcaacctgggccccagcggcaacccccacgccaagcccaccgacttcgacttcctgaaggtgatcggcaagggcagcttcggcaaggtgctgctggccaagagaaagctggacggcaagttctacgccgtgaaggtgctgcagaagaagatcgtgctgaacagaaaggagcagaagcacatcatggccgagagaaacgtgctgctgaagaacgtgaagcaccccttcctggtgggcctgcactacagcttccagaccaccgagaagctgtacttcgtgctggacttcgtgaacggcggcgagctgttcttccacctgcagagagagagaagcttccccgagcacagagccagattctacgccgccgagatcgccagcgccctgggctacctgcacagcatcaagatcgtgtacagagacctgaagcccgagaacatcctgctggacagcgtgggccacgtggtgctgaccgacttcggcctgtgcaaggagggcatcgccatcagcgacaccaccaccaccttctgcggcacccccgagccccccttctactgcagagacgtggccgagatgtacgacaacatcctgcacaagcccctgagcctgagacccggcgtgagcctgaccgcctggagcatcctggaggagctgctggagaaggacagacagaacagactgggcgccaaggaggacttcctggagatccagaaccaccccttcttcgagagcctgagctgggccgacctggtgcagaagaagatccccccccccttcaaccccaacgtggccggccccgacgacatcagaaacttcgacaccgccttcaccgaggagaccgtgccctacagcgtgtgcgtgagcagcgactacagcatcgtgaacgccagcgtgctggaggccgacgacgccttcgtgggcttcagctacgccccccccagcgaggacctgttcctgtag

SEQ ID NO: 98662 - DNA, 1491 bp, Artificial Sequence; identical to SEQ ID NO: 98657
  Description of Artificial Sequence: Synthetic coding sequence

SEQ ID NO: 98663 - DNA, 1491 bp, Artificial Sequence; identical to SEQ ID NO: 98657
  Description of Artificial Sequence: Synthetic coding sequence

SEQ ID NO: 98664 - DNA, 1725 bp, Artificial Sequence; identical to SEQ ID NO: 76188
  Description of Artificial Sequence: Synthetic coding sequence

SEQ ID NO: 98665 - DNA, 1611 bp, Artificial Sequence
  Description of Artificial Sequence: Synthetic coding sequence
atggtgctggacctggacctgttcagagtggacaagggcggcgaccccgccctgatcagagagacccaggagaagagattcaaggaccccggcctggtggaccagctggtgaaggccgacagcgagtggagaagatgcagattcagagccgacaacctgaacaagctgaagaacctgtgcagcaagaccatcggcgagaagatgaagaagaaggagcccgtgggcgacgacgagagcgtgcccgagaacgtgctgagcttcgacgacctgaccgccgacgccctggccaacctgaaggtgagccagatcaagaaggtgagactgctgatcgacgaggccatcctgaagtgcgacgccgagagaatcaagctggaggccgagagattcgagaacctgagagagatcggcaacctgctgcaccccagcgtgcccatcagcaacgacgaggacgtggacaacaaggtggagagaatctggggcgactgcaccgtgagaaagaagtacagccacgtggacctggtggtgatggtggacggcttcgagggcgagaagggcgccgtggtggccggcagcagaggctacttcctgaagggcgtgctggtgttcctggagcaggccctgatccagtacgccctgagaaccctgggcagcagaggctacatccccatctacacccccttcttcatgagaaaggaggtgatgcaggaggtggcccagctgagccagttcgacgaggagctgtacaaggtgatcggcaagggcagcgagaagagcgacgacaacagctacgacgagaagtacctgatcgccaccagcgagcagcccatcgccgccctgcacagagacgagtggctgagacccgaggacctgcccatcaagtacgccggcctgagcacctgcttcagacaggaggtgggcagccacggcagagacaccagaggcatcttcagagtgcaccagttcgagaagatcgagcagttcgtgtacagcagcccccacgacaacaagagctgggagatgttcgaggagatgatcaccaccgccgaggagttctaccagagcctgggcatcccctaccacatcgtgaacatcgtgagcggcagcctgaaccacgccgccagcaagaagctggacctggaggcctggttccccggcagcggcgccttcagagagctggtgagctgcagcaactgcaccgactaccaggccagaagactgagaatcagatacggccagaccaagaagatgatggacaagagaaagaacaacctgcacctgagcacccagaacaagctggaggccagcctgttcagccccaagaaggtggagttcgtgcacatgctgaacgccaccatgtgcgccaccaccagaaccatctgcgccatcctggagaactaccagaccgagaagggcatcaccgtgcccgagaagctgaaggagttcatgccccccggcctgcaggagctgatccccttcgtgaagcccgcccccatcgagcaggagcccagcaagaagcagaagaagcagcacgagggcagcaagaagaaggccgccgccagagacgtgaccctggagaacagactgcagaacatggaggtgaccgacgcctag

SEQ ID NO: 98666 - DNA, 1563 bp, Artificial Sequence
  Description of Artificial Sequence: Synthetic coding sequence
atggccgccagcatggccagaagactgtggcccctgctgaccagaagaggcttcagacccagaggcggctgcatcagcaacgacagccccagaagaagcttcaccaccgagaagagaaacagaaacctgctgtacgagtacgccagagagggctacagcgccctgccccagctggacatcgagagattctgcgcctgccccgaggaggccgcccacgccctggagctgagaaagggcgagctgagaagcgccgacctgcccgccatcatcagcacctggcaggagctgagacagctgcaggagcagatcagaagcctggaggaggagaaggccgccgtgaccgaggccgtgagagccctgctggccaaccaggacagcggcgaggtgcagcaggtgagactggaccccggcgccggcagcatcttcggccccaccttcctgcccttccccggccagctgagcctgctggtggaggcccagctggaggagcagttctacctgcaggccctgaagctgcccaaccagacccaccccgacgtgcccgtgggcgacgagagccaggccagagtgctgcacatggtgggcgacaagcccgtgttcagcttccagcccagaggccacctggagatcggcgagaagctggacatcatcagacagaagagactgagccacgtgagcggccacagaagctactacctgagaggcgccggcgccctgctgcagcacggcctggtgaacttcaccttcaacaagctgctgagaagaggcttcacccccatgaccgtgcccgacctgctgagaggcgccgtgttcgagggctgcggcatgacccccaacgccaaccccagccagatctacaacatcgaccccgccagattcaaggacctgaacctggccggcaccgccgaggtgggcctggccggctacttcatggaccacaccgtggccttcagagacctgcccgtgagaatggtgtgcagcagcacctgctacagagccgagaccaacaccggccaggagcccagaggcctgtacagagtgcaccacttcaccaaggtggagatgttcggcgtgaccggccccggcctggagcagagcagccagctgctggaggagttcctgagcctgcagatggagatcctgaccgagctgggcctgcacttcagagtgctggacatgcccacccaggagctgggcctgcccgcctacagaaagttcgacatcgaggcctggatgcccggcagaggcagattcggcgaggtgaccagcgccagcaactgcaccgacttccagagcagaagactgcacatcatgttccagaccgaggccggcgagctgcagttcgcccacaccgtgaacgccaccgcctgcgccgtgcccagactgctgatcgccctgctggagagcaaccagcagaaggacggcagcgtgctggtgccccccgccctgcagagctacctgggcaccgacagaatcaccgcccccacccacgtgcccctgcagtacatcggccccaaccagcccagaaagcccggcctgcccggccagcccgccgtgagctag

SEQ ID NO: 98667 - DNA, 426 bp, Artificial Sequence
  Description of Artificial Sequence: Synthetic coding sequence
atggagatgctgcagggcctgctgctgctgctgctgctgagcatgggcggcgcctgggccagcagagagcccctgagaccctggtgccaccccatcaacgccatcctggccgtggagaaggagggctgccccgtgtgcatcaccgtgaacaccaccatctgcgccggctactgccccaccatgatgagagtgctgcaggccgtgctgccccccctgccccaggtggtgtgcacctacagagacgtgagattcgagagcatcagactgcccggctgccccagaggcgtggaccccgtggtgagcttccccgtggccctgagctgcagatgcggcccctgcagaagaagcaccagcgactgcggcggccccaaggaccaccccctgacctgcgaccacccccagctgagcggcctgctgttcctgtag

SEQ ID NO: 98668 - DNA, 837 bp, Artificial Sequence
  Description of Artificial Sequence: Synthetic coding sequence
atgggcgccagactgagcagaagaagactgcccgccgaccccagcctggccctggacgccctgccccccgagctgctggtgcaggtgctgagccacgtgccccccagaagcctggtgaccagatgcagacccgtgtgcagagcctggagagacatcgtggacggccccaccgtgtggctgctgcagctggccagagacagaagcgccgagggcagagccctgtacgccgtggcccagagatgcctgcccagcaacgaggacaaggaggagttccccctgtgcgccctggccagatactgcctgagagcccccttcggcagaaacctgatcttcaacagctgcggcgagcagggcttcagaggctgggaggtggagcacggcggcaacggctgggccatcgagaagaacctgacccccgtgcccggcgcccccagccagacctgcttcgtgaccagcttcgagtggtgcagcaagagacagctggtggacctggtgatggagggcgtgtggcaggagctgctggacagcgcccagatcgagatctgcgtggccgactggtggggcgccagagagaactgcggctgcgtgtaccagctgagagtgagactgctggacgtgtacgagaaggaggtggtgaagttcagcgccagccccgaccccgtgctgcagtggaccgagagaggctgcagacaggtgagccacgtgttcaccaacttcggcaagggcatcagatacgtgagcttcgagcagtacggcagagacgtgagcagctgggtgggccactacggcgccctggtgacccacagcagcgtgagagtgagaatcagactgagctag

SEQ ID NO: 98669 - DNA, 864 bp, Artificial Sequence
  Description of Artificial Sequence: Synthetic coding sequence
ttcaagcagggcctgtggctgctggagatgggcgccagactgagcagaagaagactgcccgccgaccccagcctggccctggacgccctgccccccgagctgctggtgcaggtgctgagccacgtgccccccagaagcctggtgaccagatgcagacccgtgtgcagagcctggagagacatcgtggacggccccaccgtgtggctgctgcagctggccagagacagaagcgccgagggcagagccctgtacgccgtggcccagagatgcctgcccagcaacgaggacaaggaggagttccccctgtgcgccctggccagatactgcctgagagcccccttcggcagaaacctgatcttcaacagctgcggcgagcagggcttcagaggctgggaggtggagcacggcggcaacggctgggccatcgagaagaacctgacccccgtgcccggcgcccccagccagacctgcttcgtgaccagcttcgagtggtgcagcaagagacagctggtggacctggtgatggagggcgtgtggcaggagctgctggacagcgcccagatcgagatctgcgtggccgactggtggggcgccagagagaactgcggctgcgtgtaccagctgagagtgagactgctggacgtgtacgagaaggaggtggtgaagttcagcgccagccccgaccccgtgctgcagtggaccgagagaggctgcagacaggtgagccacgtgttcaccaacttcggcaagggcatcagatacgtgagcttcgagcagtacggcagagacgtgagcagctgggtgggccactacggcgccctggtgacccacagcagcgtgagagtgagaatcagactgagctag

SEQ ID NO: 98670 - DNA, 1563 bp, Artificial Sequence; identical to SEQ ID NO: 98666
  Description of Artificial Sequence: Synthetic coding sequence

SEQ ID NO: 98671 - DNA, 1557 bp, Artificial Sequence
  Description of Artificial Sequence: Synthetic coding sequence
atggagggcgtgtggcaggagctgctggacagcgcccagatcgagatctgcgtggccgactggtggggcgccagagagaactgcggctgcgtgtaccagctgagagtgagactgctggacgtgtacgagaaggaggtggtgaagttcagcgccagccccgaccccgtgctgcagtggaccgagagaggctgcagacaggtgagccacgtgttcaccaacttcggcaagggcatcagatacgtgagcttcgagcagtacggcagagacatcagcacctggcaggagctgagacagctgcaggagcagatcagaagcctggaggaggagaaggccgccgtgaccgaggccgtgagagccctgctggccaaccaggacagcggcgaggtgcagcaggaccccaagtaccagggcctgagagccagaggcagagagatcagaaaggagctggtgcacctgtaccccagagaggcccagctggaggagcagttctacctgcaggccctgaagctgcccaaccagacccaccccgacgtgcccgtgggcgacgagagccaggccagagtgctgcacatggtgggcgacaagcccgtgttcagcttccagcccagaggccacctggagatcggcgagaagctggacatcatcagacagaagagactgagccacgtgagcggccacagaagctactacctgagaggcgccggcgccctgctgcagcacggcctggtgaacttcaccttcaacaagctgctgagaagaggcttcacccccatgaccgtgcccgacctgctgagaggcgccgtgttcgagggctgcggcatgacccccaacgccaaccccagccagatctacaacatcgaccccgccagattcaaggacctgaacctggccggcaccgccgaggtgggcctggccggctacttcatggaccacaccgtggccttcagagacctgcccgtgagaatggtgtgcagcagcacctgctacagagccgagaccaacaccggccaggagcccagaggcctgtacagagtgcaccacttcaccaaggtggagatgttcggcgtgaccggccccggcctggagcagagcagccagctgctggaggagttcctgagcctgcagatggagatcctgaccgagctgggcctgcacttcagagtgctggacatgcccacccaggagctgggcctgcccgcctacagaaagttcgacatcgaggcctggatgcccggcagaggcagattcggcgaggtgaccagcgccagcaactgcaccgacttccagagcagaagactgcacatcatgttccagaccgaggccggcgagctgcagttcgcccacaccgtgaacgccaccgcctgcgccgtgcccagactgctgatcgccctgctggagagcaaccagcagaaggacggcagcgtgctggtgccccccgccctgcagagctacctgggcaccgacagaatcaccgcccccacccacgtgcccctgcagtacatcggccccaaccagcccagaaagcccggcctgcccggccagcccgccgtgagctag

SEQ ID NO: 98672 - DNA, 711 bp, Artificial Sequence
  Description of Artificial Sequence: Synthetic coding sequence
atggccgccagcatggccagaagactgtggcccctgctgaccagaagaggcttcagacccagaggcggctgcatcagcaacgacagccccagaagaagcttcaccaccgagaagagaaacagaaacctgctgtacgagtacgccagagagggctacagcgccctgccccagctggacatcgagagattctgcgcctgccccgaggaggccgcccacgccctggagctgagaaagggcgagctgagaagcgccgacctgcccgccatcatcagcacctggcaggagctgagacagctgcaggagcagatcagaagcctggaggaggagaaggccgccgtgaccgaggccgtgagagccctgctggccaaccaggacagcggcgaggtgcagcaggaccccaagtaccagggcctgagagccagaggcagagagatcagaaaggagctggtgcacctgtaccccagagaggcccagctggaggagcagttctacctgcaggccctgaagctgcccaaccagacccaccccgacgtgcccgtgggcgacgagagccaggccagagtgctgcacatggtgggcgacaagcccggcgcctgccccacctgcctggccaccggccccatcacctgcgccggcctggagcccagctgcagcaccgcctggagcaccagccacagcaccagcttcagcgccggcgccagccccccctag

SEQ ID NO: 98673 - DNA, 1281 bp, Artificial Sequence
  Description of Artificial Sequence: Synthetic coding sequence
atgcacgccctgttcgccgacagcttcgccgccctgggcagactggacaacatcaccctggtgatggtgttccacccccagtacctggagagcttcctgaagacccagcactacctgctgcagatggacggccccctgcccctgcactacagacactacatcggcatcatggccgccgccagacaccagtgcagctacctggtgaacctgcacgtgaacgacttcctgcacgtgggcggcgaccccaagtggctgaacggcctggagaacgccccccagaagctgcagaacctgggcgagctgaacaaggtgctggcccacagaccctggctgatcaccaaggagcacatcgagggcctgctgaaggccgaggagcacagctggagcctggccgagctggtgcacgccgtggtgctgctgacccactaccacagcctggccagcttcaccttcggctgcggcatcagccccgagatccactgcgacggcggccacaccttcagaccccccagcgtgagcaactactgcatctgcgacatcaccaacggcaaccacagcgtggacgagatgcccgtgaacagcgccgagaacgtgagcgtgagcgacagcttcttcgaggtggaggccctgatggagaagatgagacagctgcaggagtgcagagacgaggaggaggccagccaggaggagatggccagcagattcgagatcgagaagagagagagcatgttcgtgttcagcagcgacgacgaggaggtgacccccgccagagccgtgagcagacacttcgaggacaccagctacggctacaaggacttcagcagacacggcatgcacgtgcccaccttcagagtgcaggactactgctgggaggaccacggctacagcctggtgaacagactgtaccccgacgtgggccagctgatcgacgagaagttccacatcgcctacaacctgacctacaacaccatggccatgcacaaggacgtggacaccagcatgctgagaagagccatctggaactacatccactgcatgttcggcatcagatacgacgactacgactacggcgagatcaaccagctgctggacagaagcttcaaggtgtacatcaagaccgtggtgtgcacccccgagaaggtgaccaagagaatgtacgacagcttctggagacagttcaagcacagcgagaaggtgcacgtgaacctgctgctgatcgaggccagaatgcaggccgagctgctgtacgccctgagagccatcaccagatacatgacctag

SEQ ID NO: 98674 - DNA, 1479 bp, Artificial Sequence
  Description of Artificial Sequence: Synthetic coding sequence
atgagactggccgccgccgccaacgaggcctacaccgcccccctggccgtgagcggcctgctgggctgcaagcagtgcggcggcggcagagaccaggacgaggagctgggcatcagaatccccagacccctgggccagggccccagcagattcatccccgagaaggagatcctgcaggtgggcagcgaggacgcccagatgcacgccctgttcgccgacagcttcgccgccctgggcagactggacaacatcaccctggtgatggtgttccacccccagtacctggagagcttcctgaagacccagcactacctgctgcagatggacggccccctgcccctgcactacagacactacatcggcatcatggccgccgccagacaccagtgcagctacctggtgaacctgcacgtgaacgacttcctgcacgtgggcggcgaccccaagtggctgaacggcctggagaacgccccccagaagctgcagaacctgggcgagctgaacaaggtgctggcccacagaccctggctgatcaccaaggagcacatcgagggcctgctgaaggccgaggagcacagctggagcctggccgagctggtgcacgccgtggtgctgctgacccactaccacagcctggccagcttcaccttcggctgcggcatcagccccgagatccactgcgacggcggccacaccttcagaccccccagcgtgagcaactactgcatctgcgacatcaccaacggcaaccacagcgtggacgagatgcccgtgaacagcgccgagaacgtgagcgtgagcgacagcttcttcgaggtggaggccctgatggagaagatgagacagctgcaggagtgcagagacgaggaggaggccagccaggaggagatggccagcagattcgagatcgagaagagagagagcatgttcgtgttcagcagcgacgacgaggaggtgacccccgccagagccgtgagcagacacttcgaggacaccagctacggctacaaggacttcagcagacacggcatgcacgtgcccaccttcagagtgcaggactactgctgggaggaccacggctacagcctggtgaacagactgtaccccgacgtgggccagctgatcgacgagaagttccacatcgcctacaacctgacctacaacaccatggccatgcacaaggacgtggacaccagcatgctgagaagagccatctggaactacatccactgcatgttcggcatcagatacgacgactacgactacggcgagatcaaccagctgctggacagaagcttcaaggtgtacatcaagaccgtggtgtgcacccccgagaaggtgaccaagagaatgtacgacagcttctggagacagttcaagcacagcgagaaggtgcacgtgaacctgctgctgatcgaggccagaatgcaggccgagctgctgtacgccctgagagccatcaccagatacatgacctag

SEQ ID NO: 98675 - DNA, 1656 bp, Artificial Sequence
  Description of Artificial Sequence: Synthetic coding sequence
atggccgagggcgagaacgaggtgagatgggacggcctgtgcagcagagacagcaccaccagagagaccgccctggagaacatcagacagaccatcctgagaaagaccgagtacctgagaagcgtgaaggagaccccccacagacccagcgacggcctgagcaacaccgagagcagcgacggcctgaacaagctgctggcccacctgctgatgctgagcaagagatgccccttcaaggacgtgagagagaagagcgagttcatcctgaagagcatccaggagctgggcatcagaatccccagacccctgggccagggccccagcagattcatccccgagaaggagatcctgcaggtgggcagcgaggacgcccagatgcacgccctgttcgccgacagcttcgccgccctgggcagactggacaacatcaccctggtgatggtgttccacccccagtacctggagagcttcctgaagacccagcactacctgctgcagatggacggccccctgcccctgcactacagacactacatcggcatcatggccgccgccagacaccagtgcagctacctggtgaacctgcacgtgaacgacttcctgcacgtgggcggcgaccccaagtggctgaacggcctggagaacgccccccagaagctgcagaacctgggcgagctgaacaaggtgctggcccacagaccctggctgatcaccaaggagcacatcgagggcctgctgaaggccgaggagcacagctggagcctggccgagctggtgcacgccgtggtgctgctgacccactaccacagcctggccagcttcaccttcggctgcggcatcagccccgagatccactgcgacggcggccacaccttcagaccccccagcgtgagcaactactgcatctgcgacatcaccaacggcaaccacagcgtggacgagatgcccgtgaacagcgccgagaacgtgagcgtgagcgacagcttcttcgaggtggaggccctgatggagaagatgagacagctgcaggagtgcagagacgaggaggaggccagccaggaggagatggccagcagattcgagatcgagaagagagagagcatgttcgtgttcagcagcgacgacgaggaggtgacccccgccagagccgtgagcagacacttcgaggacaccagctacggctacaaggacttcagcagacacggcatgcacgtgcccaccttcagagtgcaggactactgctgggaggaccacggctacagcctggtgaacagactgtaccccgacgtgggccagctgatcgacgagaagttccacatcgcctacaacctgacctacaacaccatggccatgcacaaggacgtggacaccagcatgctgagaagagccatctggaactacatccactgcatgttcggcatcagatacgacgactacgactacggcgagatcaaccagctgctggacagaagcttcaaggtgtacatcaagaccgtggtgtgcacccccgagaaggtgaccaagagaatgtacgacagcttctggagacagttcaagcacagcgagaaggtgcacgtgaacctgctgctgatcgaggccagaatgcaggccgagctgctgtacgccctgagagccatcaccagatacatgacctag

SEQ ID NO: 98676 - DNA, 1302 bp, Artificial Sequence
  Description of Artificial Sequence: Synthetic coding sequence
atgagagccgagggcctgggcggcctggagagattctgcagccccggcaagggcagaggcctgagagccctgcagcccttccaggtgggcgacctgctgttcagctgccccgcctacgcctacgtgctgaccgtgaacgagagaggcaaccactgcgagtactgcttcaccagaaaggagggcctgagcaagtgcggcagatgcaagcaggccttctactgcaacgtggagtgccagaaggaggactggcccatgcacaagctggagtgcagccccatggtggtgttcggcgagaactggaaccccagcgagaccgtgagactgaccgccagaatcctggccaagcagaagatccaccccgagagaacccccagcgagaagctgctggccgtgaaggagttcgagagccacctggacaagctggacaacgagaagaaggacctgatccagagcgacatcgccgccctgcaccacttctacagcaagcacctgggcttccccgacaacgacagcctggtggtgctgttcgcccaggtgaactgcaacggcttcaccatcgaggacgaggagctgagccacctgggcagcgccatcttccccgacgtggccctgatgaaccacagctgctgccccaacgtgatcgtgacctacaagggcaccctggccgaggtgagagccgtgcaggagatcaagcccggcgaggaggtgttcaccagctacatcgacctgctgtaccccaccgaggacagaaacgacagactgagagacagctacttcttcacctgcgagtgccaggagtgcaccaccaaggacaaggacaaggccaaggtggagatcagaaagctgagcgacccccccaaggccgaggccatcagagacatggtgagatacgccagaaacgtgatcgaggagttcagaagagccaagcactacaagagccccagcgagctgctggagatctgcgagctgagccaggagaagatgagcagcgtgttcgaggacagcaacgtgtacatgctgcacatgatgtaccaggccatgggcgtgtgcctgtacatgcaggactgggagggcgccctgcagtacggccagaagatcatcaagccctacagcaagcactaccccctgtacagcctgaacgtggccagcatgtggctgaagctgggcagactgtacatgggcctggagcacaaggccgccggcgagaaggccctgaagaaggccatcgccatcatggaggtggcccacggcaaggaccacccctacatcagcgagatcaagcaggagatcgagagccactag

SEQ ID NO: 98677 - DNA, 819 bp, Artificial Sequence
  Description of Artificial Sequence: Synthetic coding sequence
atgagagccgagggcctgggcggcctggagagattctgcagccccggcaagggcagaggcctgagagccctgcagcccttccaggtgggcgacctgctgttcagctgccccgcctacgcctacgtgctgaccgtgaacgagagaggcaaccactgcgagtactgcttcaccagaaaggagggcctgagcaagtgcggcagatgcaagcaggccttctactgcaacgtggagtgccagaaggaggactggcccatgcacaagctggagtgcagccccatggtggtgttcggcgagaactggaaccccagcgagaccgtgagactgaccgccagaatcctggccaagcagaagatccaccccgagagaacccccagcgagaagctgctggccgtgaaggagttcgagagccacctggacaagctggacaacgagaagaaggacctgatccagagcgacatcgccgccctgcaccacttctacagcaagcacctgggcttccccgacaacgacagcctggtggtgctgttcgcccaggtgaactgcaacggcttcaccatcgaggacgaggagctgagccacctgggcagcgccatcttccccgacgtggccctgatgaaccacagctgctgccccaacgtgatcgtgacctacaagggcaccctggccgaggtgagagccgtgcaggagatcaagcccggcgaggaggtgttcaccagctacatcgacctgctgtaccccaccgaggacagaaacgacagactgagagacagctacttcttcacctgcgagtgccaggagtgcaccaccaaggacaagtag

SEQ ID NO: 98678 - DNA, 5712 bp, Artificial Sequence
  Description of Artificial Sequence: Synthetic coding sequence
atggccgccggcacctgggccgccgccgccgccgccgccgccgccgactacttcgtgctggtggccttcggcccccaccccagaggcagcggcgagggccagggccagatcctgcagagattccccgagaaggactgggaggacaaccccttcccccagggcatcgagctgttctgccagcccagcggctggcagctgtgccccgagagaaacccccccaccttcttcgtggccgtgctgaccgacatcaacagcgagagacactactgcgcctgcctgaccttctgggagcccgccgagcccagccaggagaccaccagagtggaggacgccaccgagagagaggaggagggcgacgagggcggccagacccacctgagccccaccgcccccgcccccagcgcccagctgttcgcccccaagaccctggtgctggtgagcagactggaccacaccgaggtgttcagaaacagcctgggcctgatctacgccatccacgtggagggcctgaacgtgtgcctggagaacgtgatcggcaacctgctgacctgcaccgtgcccctggccggcggcagccagagaaccatcagcctgggcgccggcgacagacaggtgatccagacccccctggccgacagcctgcccgtgagcagatgcagcgtggccctgctgttcagacagctgggcatcaccaacgtgctgagcctgttctgcgccgccctgaccgagcacaaggtgctgttcctgagcagaagctaccagagactggccgacgcctgcagaggcctgctggccctgctgttccccctgagatacagcttcacctacgtgcccatcctgcccgcccagctgctggaggtgctgagcacccccacccccttcatcatcggcgtgaacgccgccttccaggccgagacccaggagctgctggacgtgatcgtggccgacctggacggcggcaccgtgaccatccccgagtgcgtgcacatcccccccctgcccgagcccctgcagagccagacccacagcgtgctgagcatggtgctggaccccgagctggagctggccgacctggccttccccccccccaccaccagcaccagcagcctgaagatgcaggacaaggagctgagagccgtgttcctgagactgttcgcccagctgctgcagggctacagatggtgcctgcacgtggtgagaatccaccccgagcccgtgatcagattccacaaggccgccttcctgggccagagaggcctggtggaggacgacttcctgatgaaggtgctggagggcatggccttcgccggcttcgtgagcgagagaggcgtgccctacagacccaccgacctgttcgacgagctggtggcccacgaggtggccagaatgagagccgacgagaaccacccccagagagtgctgagacacgtgcaggagctggccgagcagctgtacaagaacgagaacccctaccccgccgtggccatgcacaaggtgcagagacccggcgagagcagccacctgagaagagtgcccagacccttccccagactggacgagggcaccgtgcagtggatcgtggaccaggccgccgccaagatgcagggcgccccccccgccgtgaaggccgagagaagaaccaccgtgcccagcggcccccccatgaccgccatcctggagagatgcagcggcctgcacgtgaacagcgccagaagactggaggtggtgagaaactgcatcagctacgtgttcgagggcaagatgctggaggccaagaagctgctgcccgccgtgctgagagccctgaagggcagagccgccagaagatgcctggcccaggagctgcacctgcacgtgcagcagaacagagccgtgctggaccaccagcagttcgacttcgtggtgagaatgatgaactgctgcctgcaggactgcaccagcctggacgagcacggcatcgccgccgccctgctgcccctggtgaccgccttctgcagaaagctgagccccggcgtgacccagttcgcctacagctgcgtgcaggagcacgtggtgtggagcaccccccagttctgggaggccatgttctacggcgacgtgcagacccacatcagagccctgtacctggagcccaccgaggacctggcccccgcccaggaggtgggcgaggcccccagccaggaggacgagagaagcgccctggacgtggccagcgagcagagaagactgtggcccaccctgagcagagagaagcagcaggagctggtgcagaaggaggagagcaccgtgttcagccaggccatccactacgccaacagaatgagctacctgctgctgcccctggacagcagcaagagcagactgctgagagagagagccggcctgggcgacctggagagcgccagcaacagcctggtgaccaacagcatggccggcagcgtggccgagagctacgacaccgagagcggcttcgaggacgccgagacctgcgacgtggccggcgccgtggtgagattcatcaacagattcgtggacaaggtgtgcaccgagagcggcgtgaccagcgaccacctgaagggcctgcacgtgatggtgcccgacatcgtgcagatgcacatcgagaccctggaggccgtgcagagagagagcagaagactgccccccatccagaagcccaagctgctgagacccagactgctgcccggcgaggagtgcgtgctggacggcctgagagtgtacctgctgcccgacggcagagaggagggcgccggcggcagcgccggcggccccgccctgctgcccgccgagggcgccgtgttcctgaccacctacagagtgatcttcaccggcatgcccaccgaccccctggtgggcgagcaggtggtggtgagaagcttccccgtggccgccctgaccaaggagaagagaatcagcgtgcagacccccgtggaccagctgctgcaggacggcctgcagctgagaagctgcaccttccagctgctgaagatggccttcgacgaggaggtgggcagcgacagcgccgagctgttcagaaagcagctgcacaagctgagatacccccccgacatcagagccaccttcgccttcaccctgggcagcgcccacacccccggcagaccccccagagtgaccaaggacaagggccccagcctgagaaccctgagcagaaacctggtgaagaacgccaagaagaccatcggcagacagcacgtgaccagaaagaagtacaacccccccagctgggagcacagaggccagcccccccccgaggaccaggaggacgagatcagcgtgagcgaggagctggagcccagcaccctgacccccagcagcgccctgaagcccagcgacagaatgaccatgagcagcctggtggagagagcctgctgcagagactaccagagactgggcctgggcaccctgagcagcagcctgagcagagccaagagcgagcccttcagaatcagccccgtgaacagaatgtacgccatctgcagaagctaccccggcctgctgatcgtgccccagagcgtgcaggacaacgccctgcagagagtgagcagatgctacagacagaacagattccccgtggtgtgctggagaagcggcagaagcaaggccgtgctgctgagaagcggcggcctgcacggcaagggcgtggtgggcctgttcaaggcccagaacgcccccagccccggccagagccaggccgacagcagcagcctggagcaggagaagtacctgcaggccgtggtgagcagcatgcccagatacgccgacgccagcggcagaaacaccctgagcggcttcagcagcgcccacatgggcagccacgtgcccagccccagagccagagtgaccaccctgagcaaccccatggccgccagcgccagcagaagaaccgcccccagaggcaagtggggcagcgtgagaaccagcggcagaagcagcggcctgggcaccgacgtgggcagcagactggccggcagagacgccctggcccccccccaggccaacggcggcccccccgaccccggcttcctgagaccccagagagccgccctgtacatcctgggcgacaaggcccagctgaagggcgtgagaagcgaccccctgcagcagtgggagctggtgcccatcgaggtgttcgaggccagacaggtgaaggccagcttcaagaagctgctgaaggcctgcgtgcccggctgccccgccgccgagcccagccccgccagcttcctgagaagcctggaggacagcgagtggctgatccagatccacaagctgctgcaggtgagcgtgctggtggtggagctgctggacagcggcagcagcgtgctggtgggcctggaggacggctgggacatcaccacccaggtggtgagcctggtgcagctgctgagcgaccccttctacagaaccctggagggcttcagactgctggtggagaaggagtggctgagcttcggccacagattcagccacagaggcgcccacaccctggccggccagagcagcggcttcacccccgtgttcctgcagttcctggactgcgtgcaccaggtgcacctgcagttccccatggagttcgagttcagccagttctacctgaagttcctgggctaccaccacgtgagcagaagattcagaaccttcctgctggacagcgactacgagagaatcgagctgggcctgctgtacgaggagaagggcgagagaagaggccaggtgccctgcagaagcgtgtgggagtacgtggacagactgagcaagagaacccccgtgttccacaactacatgtacgcccccgaggacgccgaggtgctgagaccctacagcaacgtgagcaacctgaaggtgtgggacttctacaccgaggagaccctggccgagggccccccctacgactgggagctggcccagggcccccccgagccccccgaggaggagagaagcgacggcggcgccccccagagcagaagaagagtggtgtggccctgctacgacagctgccccagagcccagcccgacgccatcagcagactgctggaggagctgcagagactggagaccgagctgggccagcccgccgagagatggaaggacacctgggacagagtgaaggccgcccagagactggagggcagacccgacggcagaggcacccccagcagcctgctggtgagcaccgccccccaccacagaagaagcctgggcgtgtacctgcaggagggccccgtgggcagcaccctgagcctgagcctggacagcgaccagagcagcggcagcaccaccagcggcagcagacaggccgccagaagaagcaccagcaccctgtacagccagttccagaccgccgagagcgagaacagaagctacgagggcaccctgtacaagaagggcgccttcatgaagccctggaaggccagatggttcgtgctggacaagaccaagcaccagctgagatactacgaccacagagtggacaccgagtgcaagggcgtgatcgacctggccgaggtggaggccgtggcccccggcacccccaccatgggcgcccccaagaccgtggacgagaaggccttcttcgacgtgaagaccaccagaagagtgtacaacttctgcgcccaggacgtgcccagcgcccagcagtgggtggacagaatccagagctgcctgagcgacgcctag

SEQ ID NO: 98679 - DNA, 2697 bp, Artificial Sequence
  Description of Artificial Sequence: Synthetic coding sequence
atggccgccggcacctgggccgccgccgccgccgccgccgccgccgactacttcgtgctggtggccttcggcccccaccccagaggcagcggcgagggccagggccagatcctgcagagattccccgagaaggactgggaggacaaccccttcccccagggcatcgagctgttctgccagcccagcggctggcagctgtgccccgagagaaacccccccaccttcttcgtggccgtgctgaccgacatcaacagcgagagacactactgcgcctgcctgaccttctgggagcccgccgagcccagccagcaggagaccaccagagtggaggacgccaccgagagagaggaggagggcgacgagggcggccagacccacctgagccccaccgcccccgcccccagcgcccagctgttcgcccccaagaccctggtgctggtgagcagactggaccacaccgaggtgttcagaaacagcctgggcctgatctacgccatccacgtggagggcctgaacgtgtgcctggagaacgtgatcggcaacctgctgacctgcaccgtgcccctggccggcggcagccagagaaccatcagcctgggcgccggcgacagacaggtgatccagacccccctggccgacagcctgcccgtgagcagatgcagcgtggccctgctgttcagacagctgggcatcaccaacgtgctgagcctgttctgcgccgccctgaccgagcacaaggtgctgttcctgagcagaagctaccagagactggccgacgcctgcagaggcctgctggccctgctgttccccctgagatacagcttcacctacgtgcccatcctgcccgcccagctgctggaggtgctgagcacccccacccccttcatcatcggcgtgaacgccgccttccaggccgagacccaggagctgctggacgtgatcgtggccgacctggacggcggcaccgtgaccatccccgagtgcgtgcacatcccccccctgcccgagcccctgcagagccagacccacagcgtgctgagcatggtgctggaccccgagctggagctggccgacctggccttccccccccccaccaccagcaccagcagcctgaagatgcaggacaaggagctgagagccgtgttcctgagactgttcgcccagctgctgcagggctacagatggtgcctgcacgtggtgagaatccaccccgagcccgtgatcagattccacaaggccgccttcctgggccagagaggcctggtggaggacgacttcctgatgaaggtgctggagggcatggccttcgccggcttcgtgagcgagagaggcgtgccctacagacccaccgacctgttcgacgagctggtggcccacgaggtggccagaatgagagccgacgagaaccacccccagagagtgctgagacacgtgcaggagctggccgagcagctgtacaagaacgagaacccctaccccgccgtggccatgcacaaggtgcagagacccggcgagagcagccacctgagaagagtgcccagacccttccccagactggacgagggcaccgtgcagtggatcgtggaccaggccgccgccaagatgcagggcgccccccccgccgtgaaggccgagagaagaaccaccgtgcccagcggcccccccatgaccgccatcctggagagatgcagcggcctgcacgtgaacagcgccagaagactggaggtggtgagaaactgcatcagctacgtgttcgagggcaagatgctggaggccaagaagctgctgcccgccgtgctgagagccctgaagggcagagccgccagaagatgcctggcccaggagctgcacctgcacgtgcagcagaacagagccgtgctggaccaccagcagttcgacttcgtggtgagaatgatgaactgctgcctgcaggactgcaccagcctggacgagcacggcatcgccgccgccctgctgcccctggtgaccgccttctgcagaaagctgagccccggcgtgacccagttcgcctacagctgcgtgcaggagcacgtggtgtggagcaccccccagttctgggaggccatgttctacggcgacgtgcagacccacatcagagccctgtacctggagcccaccgaggacctggcccccgcccaggaggtgggcgaggcccccagccaggaggacgagagaagcgccctggacgtggccagcgagcagagaagactgtggcccaccctgagcagagagaagcagcaggagctggtgcagaaggaggagagcaccgtgttcagccaggccatccactacgccaacagaatgagctacctgctgctgcccctggacagcagcaagagcagactgctgagagagagagccggcctgggcgacctggagagcgccagcaacagcctggtgaccaacagcatggccggcagcgtggccgagagctacgacaccgagagcggcttcgaggacgccgagacctgcgacgtggccggcgccgtggtgagattcatcaacagattcgtggacaaggtgtgcaccgagagcggcgtgaccagcgaccacctgaagggcctgcacgtgatggtgcccgacatcgtgcagatgcacatcgagaccctggaggccgtgcagagagagagcagaagactgccccccatccagaagcccaagctgctgagaccctag

SEQ ID NO: 98680 - DNA, 5682 bp, Artificial Sequence
  Description of Artificial Sequence: Synthetic coding sequence
atggccagactggccgactacttcgtgctggtggccttcggcccccaccccagaggcagcggcgagggccagggccagatcctgcagagattccccgagaaggactgggaggacaaccccttcccccagggcatcgagctgttctgccagcccagcggctggcagctgtgccccgagagaaacccccccaccttcttcgtggccgtgctgaccgacatcaacagcgagagacactactgcgcctgcctgaccttctgggagcccgccgagcccagccaggagaccaccagagtggaggacgccaccgagagagaggaggagggcgacgagggcggccagacccacctgagccccaccgcccccgcccccagcgcccagctgttcgcccccaagaccctggtgctggtgagcagactggaccacaccgaggtgttcagaaacagcctgggcctgatctacgccatccacgtggagggcctgaacgtgtgcctggagaacgtgatcggcaacctgctgacctgcaccgtgcccctggccggcggcagccagagaaccatcagcctgggcgccggcgacagacaggtgatccagacccccctggccgacagcctgcccgtgagcagatgcagcgtggccctgctgttcagacagctgggcatcaccaacgtgctgagcctgttctgcgccgccctgaccgagcacaaggtgctgttcctgagcagaagctaccagagactggccgacgcctgcagaggcctgctggccctgctgttccccctgagatacagcttcacctacgtgcccatcctgcccgcccagctgctggaggtgctgagcacccccacccccttcatcatcggcgtgaacgccgccttccaggccgagacccaggagctgctggacgtgatcgtggccgacctggacggcggcaccgtgaccatccccgagtgcgtgcacatcccccccctgcccgagcccctgcagagccagacccacagcgtgctgagcatggtgctggaccccgagctggagctggccgacctggccttccccccccccaccaccagcaccagcagcctgaagatgcaggacaaggagctgagagccgtgttcctgagactgttcgcccagctgctgcagggctacagatggtgcctgcacgtggtgagaatccaccccgagcccgtgatcagattccacaaggccgccttcctgggccagagaggcctggtggaggacgacttcctgatgaaggtgctggagggcatggccttcgccggcttcgtgagcgagagaggcgtgccctacagacccaccgacctgttcgacgagctggtggcccacgaggtggccagaatgagagccgacgagaaccacccccagagagtgctgagacacgtgcaggagctggccgagcagctgtacaagaacgagaacccctaccccgccgtggccatgcacaaggtgcagagacccggcgagagcagccacctgagaagagtgcccagacccttccccagactggacgagggcaccgtgcagtggatcgtggaccaggccgccgccaagatgcagggcgccccccccgccgtgaaggccgagagaagaaccaccgtgcccagcggcccccccatgaccgccatcctggagagatgcagcggcctgcacgtgaacagcgccagaagactggaggtggtgagaaactgcatcagctacgtgttcgagggcaagatgctggaggccaagaagctgctgcccgccgtgctgagagccctgaagggcagagccgccagaagatgcctggcccaggagctgcacctgcacgtgcagcagaacagagccgtgctggaccaccagcagttcgacttcgtggtgagaatgatgaactgctgcctgcaggactgcaccagcctggacgagcacggcatcgccgccgccctgctgcccctggtgaccgccttctgcagaaagctgagccccggcgtgacccagttcgcctacagctgcgtgcaggagcacgtggtgtggagcaccccccagttctgggaggccatgttctacggcgacgtgcagacccacatcagagccctgtacctggagcccaccgaggacctggcccccgcccaggaggtgggcgaggcccccagccaggaggacgagagaagcgccctggacgtggccagcgagcagagaagactgtggcccaccctgagcagagagaagcagcaggagctggtgcagaaggaggagagcaccgtgttcagccaggccatccactacgccaacagaatgagctacctgctgctgcccctggacagcagcaagagcagactgctgagagagagagccggcctgggcgacctggagagcgccagcaacagcctggtgaccaacagcatggccggcagcgtggccgagagctacgacaccgagagcggcttcgaggacgccgagacctgcgacgtggccggcgccgtggtgagattcatcaacagattcgtggacaaggtgtgcaccgagagcggcgtgaccagcgaccacctgaagggcctgcacgtgatggtgcccgacatcgtgcagatgcacatcgagaccctggaggccgtgcagagagagagcagaagactgccccccatccagaagcccaagctgctgagacccagactgctgcccggcgaggagtgcgtgctggacggcctgagagtgtacctgctgcccgacggcagagaggagggcgccggcggcagcgccggcggccccgccctgctgcccgccgagggcgccgtgttcctgaccacctacagagtgatcttcaccggcatgcccaccgaccccctggtgggcgagcaggtggtggtgagaagcttccccgtggccgccctgaccaaggagaagagaatcagcgtgcagacccccgtggaccagctgctgcaggacggcctgcagctgagaagctgcaccttccagctgctgaagatggccttcgacgaggaggtgggcagcgacagcgccgagctgttcagaaagcagctgcacaagctgagatacccccccgacatcagagccaccttcgccttcaccctgggcagcgcccacacccccggcagaccccccagagtgaccaaggacaagggccccagcctgagaaccctgagcagaaacctggtgaagaacgccaagaagaccatcggcagacagcacgtgaccagaaagaagtacaacccccccagctgggagcacagaggccagcccccccccgaggaccaggaggacgagatcagcgtgagcgaggagctggagcccagcaccctgacccccagcagcgccctgaagcccagcgacagaatgaccatgagcagcctggtggagagagcctgctgcagagactaccagagactgggcctgggcaccctgagcagcagcctgagcagagccaagagcgagcccttcagaatcagccccgtgaacagaatgtacgccatctgcagaagctaccccggcctgctgatcgtgccccagagcgtgcaggacaacgccctgcagagagtgagcagatgctacagacagaacagattccccgtggtgtgctggagaagcggcagaagcaaggccgtgctgctgagaagcggcggcctgcacggcaagggcgtggtgggcctgttcaaggcccagaacgcccccagccccggccagagccaggccgacagcagcagcctggagcaggagaagtacctgcaggccgtggtgagcagcatgcccagatacgccgacgccagcggcagaaacaccctgagcggcttcagcagcgcccacatgggcagccacgtgcccagccccagagccagagtgaccaccctgagcaaccccatggccgccagcgccagcagaagaaccgcccccagaggcaagtggggcagcgtgagaaccagcggcagaagcagcggcctgggcaccgacgtgggcagcagactggccggcagagacgccctggcccccccccaggccaacggcggcccccccgaccccggcttcctgagaccccagagagccgccctgtacatcctgggcgacaaggcccagctgaagggcgtgagaagcgaccccctgcagcagtgggagctggtgcccatcgaggtgttcgaggccagacaggtgaaggccagcttcaagaagctgctgaaggcctgcgtgcccggctgccccgccgccgagcccagccccgccagcttcctgagaagcctggaggacagcgagtggctgatccagatccacaagctgctgcaggtgagcgtgctggtggtggagctgctggacagcggcagcagcgtgctggtgggcctggaggacggctgggacatcaccacccaggtggtgagcctggtgcagctgctgagcgaccccttctacagaaccctggagggcttcagactgctggtggagaaggagtggctgagcttcggccacagattcagccacagaggcgcccacaccctggccggccagagcagcggcttcacccccgtgttcctgcagttcctggactgcgtgcaccaggtgcacctgcagttccccatggagttcgagttcagccagttctacctgaagttcctgggctaccaccacgtgagcagaagattcagaaccttcctgctggacagcgactacgagagaatcgagctgggcctgctgtacgaggagaagggcgagagaagaggccaggtgccctgcagaagcgtgtgggagtacgtggacagactgagcaagagaacccccgtgttccacaactacatgtacgcccccgaggacgccgaggtgctgagaccctacagcaacgtgagcaacctgaaggtgtgggacttctacaccgaggagaccctggccgagggccccccctacgactgggagctggcccagggcccccccgagccccccgaggaggagagaagcgacggcggcgccccccagagcagaagaagagtggtgtggccctgctacgacagctgccccagagcccagcccgacgccatcagcagactgctggaggagctgcagagactggagaccgagctgggccagcccgccgagagatggaaggacacctgggacagagtgaaggccgcccagagactggagggcagacccgacggcagaggcacccccagcagcctgctggtgagcaccgccccccaccacagaagaagcctgggcgtgtacctgcaggagggccccgtgggcagcaccctgagcctgagcctggacagcgaccagagcagcggcagcaccaccagcggcagcagacaggccgccagaagaagcaccagcaccctgtacagccagttccagaccgccgagagcgagaacagaagctacgagggcaccctgtacaagaagggcgccttcatgaagccctggaaggccagatggttcgtgctggacaagaccaagcaccagctgagatactacgaccacagagtggacaccgagtgcaagggcgtgatcgacctggccgaggtggaggccgtggcccccggcacccccaccatgggcgcccccaagaccgtggacgagaaggccttcttcgacgtgaagaccaccagaagagtgtacaacttctgcgcccaggacgtgcccagcgcccagcagtgggtggacagaatccagagctgcctgagcgacgcctag

SEQ ID NO: 98681 - DNA, 5604 bp, Artificial Sequence
  Description of Artificial Sequence: Synthetic coding sequence
atggccagactggccgactacttcgtgctggtggccttcggcccccaccccagaggcagcggcgagggccagggccagatcctgcagagattccccgagaaggactgggaggacaaccccttcccccagggcatcgagctgttctgccagcccagcggctggcagctgtgccccgagagaaacccccccaccttcttcgtggccgtgctgaccgacatcaacagcgagagacactactgcgcctgcctgaccttctgggagcccgccgagcccagccaggagaccaccagagtggaggacgccaccgagagagaggaggagggcgacgagggcggccagacccacctgagccccaccgcccccgcccccagcgcccagctgttcgcccccaagaccctggtgctggtgagcagactggaccacaccgaggtgttcagaaacagcctgggcctgatctacgccatccacgtggagggcctgaacgtgtgcctggagaacgtgatcggcaacctgctgacctgcaccgtgcccctggccggcggcagccagagaaccatcagcctgggcgccggcgacagacaggtgatccagacccccctggccgacagcctgcccgtgagcagatgcagcgtggccctgctgttcagacagctgggcatcaccaacgtgctgagcctgttctgcgccgccctgaccgagcacaaggtgctgttcctgagcagaagctaccagagactggccgacgcctgcagaggcctgctggccctgctgttccccctgagatacagcttcacctacgtgcccatcctgcccgcccagctgctggaggtgctgagcacccccacccccttcatcatcggcgtgaacgccgccttccaggccgagacccaggagctgctggacgtgatcgtggccgacctggacggcggcaccgtgaccatccccgagtgcgtgcacatcccccccctgcccgagcccctgcagagccagacccacagcgtgctgagcatggtgctggaccccgagctggagctggccgacctggccttccccccccccaccaccagcaccagcagcctgaagatgcaggacaaggagctgagagccgtgttcctgagactgttcgcccagctgctgcagggctacagatggtgcctgcacgtggtgagaatccaccccgagcccgtgatcagattccacaaggccgccttcctgggccagagaggcctggtggaggacgacttcctgatgaaggtgctggagggcatggccttcgccggcttcgtgagcgagagaggcgtgccctacagacccaccgacctgttcgacgagctggtggcccacgaggtggccagaatgagagccgacgagaaccacccccagagagtgctgagacacgtgcaggagctggccgagcagctgtacaagaacgagaacccctaccccgccgtggccatgcacaaggtgcagagacccggcgagagcagccacctgagaagagtgcccagacccttccccagactggacgagggcaccgtgcagtggatcgtggaccaggccgccgccaagatgcagggcgccccccccgccgtgaaggccgagagaagaaccaccgtgcccagcggcccccccatgaccgccatcctggagagatgcagcggcctgcacgtgaacagcgccagaagactggaggtggtgagaaactgcatcagctacgtgttcgagggcaagatgctggaggccaagaagctgctgcccgccgtgctgagagccctgaagggcagagccgccagaagatgcctggcccaggagctgcacctgcacgtgcagcagaacagagccgtgctggaccaccagcagttcgacttcgtggtgagaatgatgaactgctgcctgcaggactgcaccagcctggacgagcacggcatcgccgccgccctgctgcccctggtgaccgccttctgcagaaagctgagccccggcgtgacccagttcgcctacagctgcgtgcaggagcacgtggtgtggagcaccccccagttctgggaggccatgttctacggcgacgtgcagacccacatcagagccctgtacctggagcccaccgaggacctggcccccgcccaggaggtgggcgaggcccccagccaggaggacgagagaagcgccctggacgtggccagcgagcagagaagactgtggcccaccctgagcagagagaagcagcaggagctggtgcagaaggaggagagcaccgtgttcagccaggccatccactacgccaacagaatgagctacctgctgctgcccctggacagcagcaagagcagactgctgagagagagagccggcctgggcgacctggagagcgccagcaacagcctggtgaccaacagcatggccggcagcgtggccgagagctacgacaccgagagcggcttcgaggacgccgagacctgcgacgtggccggcgccgtggtgagattcatcaacagattcgtggacaaggtgtgcaccgagagcggcgtgaccagcgaccacctgaagggcctgcacgtgatggtgcccgacatcgtgcagatgcacatcgagaccctggaggccgtgcagagagagagcagaagactgccccccatccagaagcccaagctgctgagacccagactgctgcccggcgaggagtgcgtgctggacggcctgagagtgtacctgctgcccgacggcagagaggagggcgccggcggcagcgccggcggccccgccctgctgcccgccgagggcgccgtgttcctgaccacctacagagtgatcttcaccggcatgcccaccgaccccctggtgggcgagcaggtggtggtgagaagcttccccgtggccgccctgaccaaggagaagagaatcagcgtgcagacccccgtggaccagctgctgcaggacggcctgcagctgagaagctgcaccttccagctgctgaagatggccttcgacgaggaggtgggcagcgacagcgccgagctgttcagaaagcagctgcacaagctgagatacccccccgacatcagagccaccttcgccttcaccctgggcagcgcccacacccccggcagaccccccagagtgaccaaggacaagggccccagcctgagaaccctgagcagaaacctggtgaagaacgccaagaagaccatcggcagacagcacgtgaccagaaagaagtacaacccccccagctgggagcacagaggccagcccccccccgaggaccaggaggacgagatcagcgtgagcgaggagctggagcccagcaccctgacccccagcagcgccctgaagcccagcgacagaatgaccatgagcagcctggtggagagagcctgctgcagagactaccagagactgggcctgggcaccctgagcagcagcctgagcagagccaagagcgagcccttcagaatcagccccgtgaacagaatgtacgccatctgcagaagctaccccggcctgctgatcgtgccccagagcgtgcaggacaacgccctgcagagagtgagcagatgctacagacagaacagattccccgtggtgtgctggagaagcggcagaagcaaggccgtgctgctgagaagcggcggcctgcacggcaagggcgtggtgggcctgttcaaggcccagaacgcccccagccccggccagagccaggccgacagcagcagcctggagcaggagaagtacctgcaggccgtggtgagcagcatgcccagatacgccgacgccagcggcagaaacaccctgagcggcttcagcagcgcccacatgggcagccacggcaagtggggcagcgtgagaaccagcggcagaagcagcggcctgggcaccgacgtgggcagcagactggccggcagagacgccctggcccccccccaggccaacggcggcccccccgaccccggcttcctgagaccccagagagccgccctgtacatcctgggcgacaaggcccagctgaagggcgtgagaagcgaccccctgcagcagtgggagctggtgcccatcgaggtgttcgaggccagacaggtgaaggccagcttcaagaagctgctgaaggcctgcgtgcccggctgccccgccgccgagcccagccccgccagcttcctgagaagcctggaggacagcgagtggctgatccagatccacaagctgctgcaggtgagcgtgctggtggtggagctgctggacagcggcagcagcgtgctggtgggcctggaggacggctgggacatcaccacccaggtggtgagcctggtgcagctgctgagcgaccccttctacagaaccctggagggcttcagactgctggtggagaaggagtggctgagcttcggccacagattcagccacagaggcgcccacaccctggccggccagagcagcggcttcacccccgtgttcctgcagttcctggactgcgtgcaccaggtgcacctgcagttccccatggagttcgagttcagccagttctacctgaagttcctgggctaccaccacgtgagcagaagattcagaaccttcctgctggacagcgactacgagagaatcgagctgggcctgctgtacgaggagaagggcgagagaagaggccaggtgccctgcagaagcgtgtgggagtacgtggacagactgagcaagagaacccccgtgttccacaactacatgtacgcccccgaggacgccgaggtgctgagaccctacagcaacgtgagcaacctgaaggtgtgggacttctacaccgaggagaccctggccgagggccccccctacgactgggagctggcccagggcccccccgagccccccgaggaggagagaagcgacggcggcgccccccagagcagaagaagagtggtgtggccctgctacgacagctgccccagagcccagcccgacgccatcagcagactgctggaggagctgcagagactggagaccgagctgggccagcccgccgagagatggaaggacacctgggacagagtgaaggccgcccagagactggagggcagacccgacggcagaggcacccccagcagcctgctggtgagcaccgccccccaccacagaagaagcctgggcgtgtacctgcaggagggccccgtgggcagcaccctgagcctgagcctggacagcgaccagagcagcggcagcaccaccagcggcagcagacaggccgccagaagaagcaccagcaccctgtacagccagttccagaccgccgagagcgagaacagaagctacgagggcaccctgtacaagaagggcgccttcatgaagccctggaaggccagatggttcgtgctggacaagaccaagcaccagctgagatactacgaccacagagtggacaccgagtgcaagggcgtgatcgacctggccgaggtggaggccgtggcccccggcacccccaccatgggcgcccccaagaccgtggacgagaaggccttcttcgacgtgaagaccaccagaagagtgtacaacttctgcgcccaggacgtgcccagcgcccagcagtgggtggacagaatccagagctgcctgagcgacgcctag

SEQ ID NO: 98682 - DNA, 5550 bp, Artificial Sequence
  Description of Artificial Sequence: Synthetic coding sequence
atggccagactggccgactacttcatcgtggtgggctacgaccacgagaagcccggcagcggcgagggcctgggcaagatcatccagagattcccccagaaggactgggacgacacccccttcccccagggcatcgagctgttctgccagcccggcggctggcagctgagcagagagagaaagcagcccaccttcttcgtggtggtgctgaccgacatcgacagcgacagacactactgcagctgcctgaccttctacgaggccgagatcaacctgcagggcaccaagaaggaggagatcgagggcgaggccaaggtgagcggcctgatccagcccgccgaggtgttcgcccccaagagcctggtgctggtgagcagactgtactaccccgagatcttcagagcctgcctgggcctgatctacaccgtgtacgtggacagcctgaacgtgagcctggagagcctgatcgccaacctgtgcgcctgcctggtgcccgccgccggcggcagccagaagctgttcagcctgggcgccggcgacagacagctgatccagacccccctgcacgacagcctgcccatcaccggcaccagcgtggccctgctgttccagcagctgggcatccagaacgtgctgagcctgttctgcgccgtgctgaccgagaacaaggtgctgttccacagcgccagcttccagagactgagcgacgcctgcagagccctggagagcctgatgttccccctgaagtacagctacccctacatccccatcctgcccgcccagctgctggaggtgctgagcagccccacccccttcatcatcggcgtgcacagcgtgttcaagaccgacgtgcacgagctgctggacgtgatcatcgccgacctggacggcggcaccatcaagatccccgagtgcatccacctgagcagcctgcccgagcccctgctgcaccagacccagagcgccctgagcctgatcctgcaccccgacctggaggtggccgaccacgccttccccccccccagaaccgccctgagccacagcaagatgctggacaaggaggtgagagccgtgttcctgagactgttcgcccagctgttccagggctacagaagctgcctgcagctgatcagaatccacgccgagcccgtgatccacttccacaagaccgccttcctgggccagagaggcctggtggagaacgacttcctgaccaaggtgctgagcggcatggccttcgccggcttcgtgagcgagagaggccccccctacagaagctgcgacctgttcgacgagctggtggccttcgaggtggagagaatcaaggtggaggagaacaaccccgtgaagatgatcaagcacgtgagagagctggccgagcagctgttcaagaacgagaaccccaacccccacatggccttccagaaggtgcccagacccaccgagggcagccacctgagagtgcacatcctgcccttccccgagatcaacgaggccagagtgcaggagctgatccaggagaacgtggccaagaaccagaacgccccccccgccaccagaatcgagaagaagtgcgtggtgcccgccggcccccccgtggtgagcatcatggacaaggtgaccaccgtgttcaacagcgcccagagactggaggtggtgagaaactgcatcagcttcatcttcgagaacaagatcctggagaccgagaagaccctgcccgccgccctgagagccctgaagggcaaggccgccagacagtgcctgaccgacgagctgggcctgcacgtgcagcagaacagagccatcctggaccaccagcagttcgactacatcatcagaatgatgaactgcaccctgcaggactgcagcagcctggaggagtacaacatcgccgccgccctgctgcccctgaccagcgccttctacagaaagctggcccccggcgtgagccagttcgcctacacctgcgtgcaggaccaccccatctggaccaaccagcagttctgggagaccaccttctacaacgccgtgcaggagcaggtgagaagcctgtacctgagcgccaaggaggacaaccacgccccccacctgaagcagaaggacaagctgcccgacgaccactaccaggagaagaccgccatggacctggccgccgagcagctgagactgtggcccaccctgagcaagagcacccagcaggagctggtgcagcacgaggagagcaccgtgttcagccaggccatccacttcgccaacctgatggtgaacctgctggtgcccctggacaccagcaagaacaagctgctgagaaccagcgcccccggcgactgggagagcggcagcaacagcatcgtgaccaacagcatcgccggcagcgtggccgagagctacgacaccgagagcggcttcgaggacagcgagaacaccgacatcgccaacagcgtggtgagattcatcaccagattcatcgacaaggtgtgcaccgagagcggcgtgacccaggaccacatcaagagcctgcactgcatgatccccggcatcgtggccatgcacatcgagaccctggaggccgtgcacagagagagcagaagactgccccccatccagaagcccaagatcctgagacccgccctgctgcccggcgaggagatcgtgtgcgagggcctgagagtgctgctggaccccgacggcagagaggaggccaccggcggcctgctgggcggcccccagctgctgcccgccgagggcgccctgttcctgaccacctacagaatcctgttcagaggcaccccccacgaccagctggtgggcgagcagaccgtggtgagaagcttccccatcgccagcatcaccaaggagaagaagatcaccatgcagaaccagctgcagcagaacatgcaggagggcctgcagatcaccagcgccagcttccagctgatcaaggtggccttcgacgaggaggtgagccccgaggtggtggagatcttcaagaagcagctgatgaagttcagatacccccagagcatcttcagcaccttcgccttcgccgccggccagaccaccccccagatcatcctgcccaagcagaaggagaagaacaccagcttcagaaccttcagcaagaccatcgtgaagggcgccaagagagccggcaagatgaccatcggcagacagtacctgctgaagaagaagaccggcaccatcgtggaggagagagtgaacagacccggctggaacgaggacgacgacgtgagcgtgagcgacgagagcgagctgcccaccagcaccaccctgaaggccagcgagaagagcaccatggagcagctggtggagaaggcctgcttcagagactaccagagactgggcctgggcaccatcagcggcagcagcagcagaagcagacccgagtacttcagaatcaccgccagcaacagaatgtacagcctgtgcagaagctaccccggcctgctggtggtgccccaggccgtgcaggacagcagcctgcccagagtggccagatgctacagacacaacagactgcccgtggtgtgctggaagaacagcagaagcggcaccctgctgctgagaagcggcggcttccacggcaagggcgtggtgggcctgttcaagagccagaacagcccccaggccgcccccaccagcagcctggagagcagcagcagcatcgagcaggagaagtacctgcaggccctgctgaacgccgtgagcgtgcaccagaagctgagaggcaacagcaccctgaccgtgagacccgccttcgccctgagccccggcgtgtgggccagcctgagaagcagcaccagactgatcagcagccccaccagcttcatcgacgtgggcgccagactggccggcaaggaccacagcgccagcttcagcaacagcagctacctgcagaaccagctgctgaagagacaggccgccctgtacatcttcggcgagaagagccagctgagaaacttcaaggtggagttcgccctgaactgcgagttcgtgcccgtggagttccacgagatcagacaggtgaaggccagcttcaagaagctgatgagagcctgcatccccagcaccatccccaccgacagcgaggtgaccttcctgaaggccctgggcgacagcgagtggttcccccagctgcacagaatcatgcagctggccgtggtggtgagcgaggtgctggagaacggcagcagcgtgctggtgtgcctggaggagggctgggacatcaccgcccaggtgaccagcctggtgcagctgctgagcgaccccttctacagaaccctggagggcttccagatgctggtggagaaggagtggctgagcttcggccacaagttcagccagagaagcagcctgaccctgaactgccagggcagcggcttcgcccccgtgttcctgcagttcctggactgcgtgcaccaggtgcacaaccagtaccccaccgagttcgagttcaacctgtactacctgaagttcctggccttccactacgtgagcaacagattcaagaccttcctgctggacagcgactacgagagactggagcacggcaccctgttcgacgacaagggcgagaagcacgccaagaagggcgtgtgcatctgggagtgcatcgacagaatgcacaagagaagccccatcttcttcaactacctgtacagccccctggagatcgaggccctgaagcccaacgtgaacgtgagcagcctgaagaagtgggactactacatcgaggagaccctgagcaccggccccagctacgactggatgatgctgacccccaagcacttccccagcgaggacagcgacctggccggcgaggccggccccagaagccagagaagaaccgtgtggccctgctacgacgacgtgagctgcacccagcccgacgccctgaccagcctgttcagcgagatcgagaagctggagcacaagctgaaccaggcccccgagaagtggcagcagctgtgggagagagtgaccgtggacctgaaggaggagcccagaaccgacagaagccagagacacctgagcagaagccccggcatcgtgagcaccaacctgcccagctaccagaagagaagcctgctgcacctgcccgacagcagcatgggcgaggagcagaacagcagcatcagccccagcaacggcgtggagagaagagccgccaccctgtacagccagtacaccagcaagaacgacgagaacagaagcttcgagggcaccctgtacaagagaggcgccctgctgaagggctggaagcccagatggttcgtgctggacgtgaccaagcaccagctgagatactacgacagcggcgaggacaccagctgcaagggccacatcgacctggccgaggtggagatggtgatccccgccggccccagcatgggcgcccccaagcacaccagcgacaaggccttcttcgacctgaagaccagcaagagagtgtacaacttctgcgcccaggacggccagagcgcccagcagtggatggacaagatccagagctgcatcagcgacgcctag

SEQ ID NO: 98683 - DNA, 4791 bp, Artificial Sequence
  Description of Artificial Sequence: Synthetic coding sequence
atggagagcagagagaccctgagcagcagcagacagagaggcggcgagagcgacttcctgcccgtgagcagcgccaagccccccgccgcccccggctgcgccggcgagcccctgctgagcacccccggccccggcaagggcatccccgtgggcggcgagagaatggagcccgaggaggaggacgagctgggcagcggcagagacgtggacagcaacagcaacgccgacagcgagaagtgggtggccggcgacggcctggaggagcaggagttcagcatcaaggaggccaacttcaccgagggcagcctgaagctgaagatccagaccaccaagagagccaagaagccccccaagaacctggagaactacatctgcccccccgagatcaagatcaccatcaagcagagcggcgaccagaaggtgagcagagccggcaagaacagcaaggccaccaaggaggaggagagaagccacagcaagaagaagctgctgaccgccagcgacctggccgccagcgacctgaagggcttccagccccaggcctacgagagaccccagaagcacagcaccctgcactacgacaccggcctgccccaggacttcaccggcgacaccctgaagcccaagcaccagcagaagagcagcagccagaaccacatggactggagcaccaacagcgacagcggccccgtgacccagaactgcttcatcagccccgagagcggcagagagaccgccagcaccagcaagatccccgccctggagcccgtggccagcttcgccaaggcccagggcaagaagggcagcgccggcaacacctggagccagctgagcaacaacaacaaggacctgctgctgggcggcgtggcccccagccccagcagccacagcagccccgccccccccagcagcagcgccgagtgcaacggcctgcagcccctggtggaccaggacggcggcggcaccaaggagccccccgagccccccaccgtgggcagcaagaagaagagcagcaagaaggacgtgatcagccagaccatccccaaccccgacctggactgggtgaagaacgcccagaaggccttcgacaacaccgagggcaagagagagggctacagcgccgacagcgcccaggaggccagccccgccagacagaacgtgagcagcgccagcaaccccgagaacgacagcagccacgtgagaatcaccatccccatcaaggcccccagcctggaccccaccaaccacaagagaaagaagagacagagcatcaaggccgtggtggagaagatcatgcccgagaaggccctggccagcggcatcaccatgagcagcgaggtggtgaacagaatcctgagcaacagcgagggcaacaagaaggaccccagagtgcccaagctgagcaagatgatcgagaacgagagccccagcgtgggcctggagaccggcggcaacgccgagaaggtgatccccggcggcgtgagcaagcccagaaagccccccatggtgatgaccccccccacctgcaccgaccacagccccagcagaaagctgcccgagatccagcaccccaagttcgccgccaagagaagatggacctgcagcaagcccaagcccagcaccatgctgagagaggccgtgatggccaccagcgacaagctgatgctggagccccccagcgcctaccccatcacccccagcagccccctgtacaccaacaccgacagcctgaccgtgatcacccccgtgaagaagaagagaggcagacccaagaagcagcccctgctgaccgtggagaccatccacgagggcaccagcaccagccccgtgagccccatcagcagagagttccccggcaccaagaagagaaagagaagaagaaacctggccaagctggcccagctggtgcccggcgaggacaagcccatgagcgagatgaagttccacaagaaggtgggcaagctgggcgtgctggacaagaagaccatcaagaccatcaacaagatgaagaccctgaagagaaagaacatcctgaaccagatcctgagctgcagcagcagcgtggccctgaaggccaaggccccccccgagaccagccccggcgccgccgccatcgagagcaagctgggcaagcagatcaacgtgagcaagagaggcaccatctacatcggcaagaagagaggcagaaagcccagagccgagctgcccccccccagcgaggagcccaagaccgccatcaagcaccccagacccgtgagcagccagcccgacgtgcccgccgtgcccagcaacttccagagcctggtggccagcagccccgccgccatgcaccccctgagcacccagctgggcggcagcaacggcaacctgagccccgccagcaccgagaccaacttcagcgagctgaagaccatgcccaacctgcagcccatcagcgccctgcccaccaagacccagaagggcatccacagcggcacctggaagctgagcccccccagactgatggccaacagccccagccacctgtgcgagatcggcagcctgaaggagatcaccctgagccccgtgagcgagagccacagcgaggagaccatccccagcgacagcggcatcggcaccgacaacaacagcaccagcgaccaggccgagaagagcagcgagagcagaagaagatacagcttcgacttctgcagcctggacaaccccgaggccatccccagcgacaccagcaccaagaacagacacggccacagacagaagcacctgatcgtggacaacttcctggcccacgagagcctgaagaagcccaagcacaagagaaagagaaagagcctgcagaacagagacgacctgcagttcctggccgacctggaggagctgatcaccaagttccaggtgttcagaatcagccacagaagctacaccttctaccacgagaacccctaccccagcatcttcagaatcaacttcgaccactactaccccgtgccctacatccagtacgaccccctgctgtacctgagaagaaccagcgacctgaagagcaagaagaagagaggcagacccgccaagaccaacgacaccatgaccaaggtgcccttcctgcagggcttcagctaccccatccccagcggcagctactacgccccctacggcatgccctacaccagcatgcccatgatgaacctgggctactacggccagtaccccgcccccctgtacctgagccacaccctgggcgccgccagccccttcatgagacccaccgtgccccccccccagttccacaccaacagccacgtgaagatgagcggcgccgccaagcacaaggccaagcacggcgtgcacctgcagggccccgtgagcatgggcctgggcgacatgcagcccagcctgaacccccccaaggtgggcagcgccagcctgagcagcggcagactgcacaagagaaagcacaagcacaagcacaagcacaaggaggacagaatcctgggcacccacgacaacctgagcggcctgttcgccggcaaggccaccggcttcagcagccacatcctgagcgagagactgagcagcgccgacaaggagctgcccctggtgagcgagaagaacaagcacaaggagaagcagaagcaccagcacagcgaggccggccacaaggccagcaagaacaacttcgaggtggacaccctgagcaccctgagcctgagcgacgcccagcactggacccaggccaaggagaagggcgacctgagcagcgagcccgtggacagctgcaccaagagatacagcggcagcggcggcgacggcggcagcaccagaagcgagaacctggacgtgttcagcgagatgaaccccagcaacgacaagtgggacagcgacgtgagcggcagcaagagaagaagctacgagggcttcggcacctacagagagaaggacatccaggccttcaagatgaacagaaaggagagaagcagctacgacagcagcatgagccccggcatgcccagcccccacctgaaggtggaccagaccgccgtgcacagcaagaacgagggcagcgtgcccaccatgatgaccagaaagaagcccgccgccgtggacagcgtgaccatcccccccgcccccgtgctgagcctgctggccgccagcgccgccaccagcgacgccgtgggcagcagcctgaagaagagattcaagagaagagagatcgaggccatccagtgcgaggtgagaaagatgtgcaactacaccaagatcctgagcaccaagaagaacctggaccacgtgaacaagatcctgaaggccaagagactgcagagacagagcaagaccggcaacaacttcgtgaagaagagaagaggcagacccagaaagcagcccacccagttcgacgaggacagcagagaccagatgcccgtgctggagaagtgcatcgacctgcccagcaagagaggccagaagcccagcctgagccccctggtgctggagcccgccgccagccaggacaccatcatggccaccatcgaggccgtgatccacatggccagagaggccccccccctgcccccccccccccccccccccctgcccccccccccccccccccccctgcccccccccccccccctgcccaagacccccagaggcggcaagagaaagcacaagccccaggcccccgcccagcccccccagcagagccccccccagcagcccctgccccaggaggaggaggtgaaggccaagagacagagaaagagcagaggcagcgagagcgaggtgctgccctag

SEQ ID NO: 98684 - DNA, 729 bp, Artificial Sequence
  Description of Artificial Sequence: Synthetic coding sequence
atggagagcagagagaccctgagcagcagcagacagagaggcggcgagagcgacttcctgcccgtgagcagcgccaagccccccgccgcccccggctgcgccggcgagcccctgctgagcacccccggccccggcaagggcatccccgtgggcggcgagagaatggagcccgaggaggaggacgagctgggcagcggcagagacgtggacagcaacagcaacgccgacagcgagaagtgggtggccggcgacggcctggaggagcaggagttcagcatcaaggaggccaacttcaccgagggcagcctgaagctgaagatccagaccaccaagagagccaagaagccccccaagaacctggagaactacatctgcccccccgagatcaagatcaccatcaagcagagcggcgaccagaaggtgagcagagccggcaagaacagcaaggccaccaaggaggaggagagaagccacagcaagaagaagctgctgaccgccagcgacctggccgccagcgacctgaagggcttccagccccagatcaaggacagcagcaaggaggaggtgtggaagagaagaggcggccagggcatccccttcaagaagcagttcctgagccaggagagagccatgtgcttcagctgccccagaaaccccttccccgccaagcccggcagcctgaccctgcccttccacagcgagcccgccgtgtgggcccaggaggtgtag

SEQ ID NO: 98685 - DNA, 414 bp, Artificial Sequence
  Description of Artificial Sequence: Synthetic coding sequence
atggagagcagagagaccctgagcagcagcagacagagaggcggcgagagcgacttcctgcccgtgagcagcgccaagccccccgccgcccccggctgcgccggcgagcccctgctgagcacccccggccccggcaagggcatccccgtgggcggcgagagaatggagcccgaggaggaggacgagctgggcagcggcagagacgtggacagcaacagcaacgccgacagcgagaagtgggtggccggcgacggcctggaggagcaggagttcagcatcaaggaggccaacttcaccgagggcagcctgaagctgaagatccagaccaccaagagagccaagaagccccccaagaacctggagaactacatctgcccccccgagatcaagatcaccatcaagcagagcggctag

SEQ ID NO: 98686 - DNA, 2055 bp, Artificial Sequence
  Description of Artificial Sequence: Synthetic coding sequence
atgttcgccgaggccgccaagaccaccagaccctgcggcatggccgagttcaaggagaagcccgaggcccccaccgagcagctggacgtggcctgcggccaggagaacctgcccgtgggcgcctggccccccggcgccgcccccgcccccttccagtacacccccgaccacgtggtgggccccggcgccgacatcgaccccacccagatcaccttccccggctgcatctgcgtgaagaccccctgcctgcccggcacctgcagctgcctgagacacggcgagaactacgacgacaacagctgcctgagagacatcggcagcggcggcaagtacgccgagcccgtgttcgagtgcaacgtgctgtgcagatgcagcgaccactgcagaaacagagtggtgcagaagggcctgcagttccacttccaggtgttcaagacccacaagaagggctggggcctgagaaccctggagttcatccccaagggcagattcgtgtgcgagtacgccggcgaggtgctgggcttcagcgaggtgcagagaagaatccacctgcagaccaagagcgacagcaactacatcatcgccatcagagagcacgtgtacaacggccaggtgatggagaccttcgtggaccccacctacatcggcaacatcggcagattcctgaaccacagctgcgagcccaacctgctgatgatccccgtgagaatcgacagcatggtgcccaagctggccctgttcgccgccaaggacatcgtgcccgaggaggagctgagctacgactacagcggcagatacctgaacctgaccgtgagcgaggacaaggagagactggaccacggcaagctgagaaagccctgctactgcggcgccaagagctgcaccgccttcctgcccttcgacagcagcctgtactgccccgtggagaagagcaacatcagctgcggcaacgagaaggagcccagcatgtgcggcagcgcccccagcgtgttccccagctgcaagagactgaccctggagaccatgaagatgatgctggacaagaagcagatcagagccatcttcctgttcgagttcaagatgggcagaaaggccgccgagaccaccagaaacatcaacaacgccttcggccccggcaccgccaacgagagaaccgtgcagtggtggttcaagaagttctgcaagggcgacgagagcctggaggacgaggagagaagcggcagacccagcgaggtggacaacgaccagctgagagccatcatcgaggccgaccccctgaccaccaccagagaggtggccgaggagctgaacgtgaaccacagcaccgtggtgagacacctgaagcagatcggcaaggtgaagaagctggacaagtgggtgccccacgagctgaccgagaaccagaagaacagaagattcgaggtgagcagcagcctgatcctgagaaaccacaacgagcccttcctggacagaatcgtgacctgcgacgagaagtggatcctgtacgacaacagaagaagaagcgcccagtggctggaccaggaggaggcccccaagcacttccccaagcccatcctgcaccccaagaaggtgatggtgaccatctggtggagcgccgccggcctgatccactacagcttcctgaaccccggcgagaccatcaccagcgagaagtacgcccaggagatcgacgagatgaaccagaagctgcagagactgcagctggccctggtgaacagaaagggccccatcctgctgcacgacaacgccagaccccacgtggcccagcccaccctgcagaagctgaacgagctgggctacgaggtgctgccccaccccccctacagccccgacctgctgcccaccaactaccacgtgttcaagcacctgaacaacttcctgcagggcaagagattccacaaccagcaggacgccgagaacgccttccaggagttcgtggagagccagagcaccgacttctacgccaccggcatcaaccagctgatcagcagatggcagaagtgcgtggactgcaacggcagctacttcgactag

SEQ ID NO: 98687 - DNA, 1098 bp, Artificial Sequence
  Description of Artificial Sequence: Synthetic coding sequence
atgttcgccgaggccgccaagaccaccagaccctgcggcatggccgagttcaaggagaagcccgaggcccccaccgagcagctggacgtggcctgcggccaggagaacctgcccgtgggcgcctggccccccggcgccgcccccgcccccttccagtacacccccgaccacgtggtgggccccggcgccgacatcgaccccacccagatcaccttccccggctgcatctgcgtgaagaccccctgcctgcccggcacctgcagctgcctgagacacggcgagaactacgacgacaacagctgcctgagagacatcggcagcggcggcaagtacgccgagcccgtgttcgagtgcaacgtgctgtgcagatgcagcgaccactgcagaaacagagtggtgcagaagggcctgcagttccacttccaggtgttcaagacccacaagaagggctggggcctgagaaccctggagttcatccccaagggcagattcgtgtgcgagtacgccggcgaggtgctgggcttcagcgaggtgcagagaagaatccacctgcagaccaagagcgacagcaactacatcatcgccatcagagagcacgtgtacaacggccaggtgatggagaccttcgtggaccccacctacatcggcaacatcggcagattcctgaaccacagctgcgagcccaacctgctgatgatccccgtgagaatcgacagcatggtgcccaagctggccctgttcgccgccaaggacatcgtgcccgaggaggagctgagctacgactacagcggcagatacctgaacctgaccgtgagcgaggacaaggagagactggaccacggcaagctgagaaagccctgctactgcggcgccaagagctgcaccgccttcctgcccttcgacagcagcctgtactgccccgtggagaagagcaacatcagctgcggcaacgagaaggagcccagcatgtgcggcagcgcccccagcgtgttccccagctgcaagagactgaccctggaggtgagcctgttcagcgacaagcagctggcccccccctacagcggcagacagtggctggccagcttcaccagcgcctag

SEQ ID NO: 98688 - DNA, 516 bp, Artificial Sequence
  Description of Artificial Sequence: Synthetic coding sequence
atgttcgccgaggccgccaagaccaccagaccctgcggcatggccgagttcaaggagaagcccgaggcccccaccgagcagctggacgtggcctgcggccaggagaacctgcccgtgggcgcctggccccccggcgccgcccccgcccccttccagtacacccccgaccacgtggtgggccccggcgccgacatcgaccccacccagatcaccttccccggctgcatctgcgtgaagaccccctgcctgcccggcacctgcagctgcctgagacacggcgagaactacgacgacaacagctgcctgagagacatcggcagcggcggcaagtacgccgagcccgtgttcgagtgcaacgtgctgtgcagatgcagcgaccactgcagaaacagagtggtgcagaagggcctgcagttccacttccaggtgttcaagacccacaagaagggctggggcctgagaaccctggagttcatccccaagggcagaaaggtggagcaccagctgtggaagtag

SEQ ID NO: 98689 - DNA, 1101 bp, Artificial Sequence
  Description of Artificial Sequence: Synthetic coding sequence
atggacagcgacgacgagatggtggaggaggccgtggagggccacctggacgacgacggcctgccccacggcttctgcaccgtgacctacagcagcaccgacagattcgagggcaacttcgtgcacggcgagaagaacggcagaggcaagttcttcttcttcgacggcagcaccctggagggctactacgtggacgacgccctgcagggccagggcgtgtacacctacgaggacggcggcgtgctgcagggcacctacgtggacggcgagctgaacggccccgcccaggagtacgacaccgacggcagactgatcttcaagggccagtacaaggacaacatcagacacggcgtgtgctggatctactaccccgacggcggcagcctggtgggcgaggtgaacgaggacggcgagatgaccggcgagaagatcgcctacgtgtaccccgacgagagaaccgccctgtacggcaagttcatcgacggcgagatgatcgagggcaagctggccaccctgatgagcaccgaggagggcagaccccacttcgagctgatgcccggcaacagcgtgtaccacttcgacaagagcaccagcagctgcatcagcaccaacgccctgctgcccgacccctacgagagcgagagagtgtacgtggccgagagcctgatcagcagcgccggcgagggcctgttcagcaaggtggccgtgggccccaacaccgtgatgagcttctacaacggcgtgagaatcacccaccaggaggtggacagcagagactgggccctgaacggcaacaccctgagcctggacgaggagaccgtgatcgacgtgcccgagccctacaaccacgtgagcaagtactgcgccagcctgggccacaaggccaaccacagcttcacccccaactgcatctacgacatgttcgtgcaccccagattcggccccatcaagtgcatcagaaccctgagagccgtggaggccgacgaggagctgaccgtggcctacggctacgaccacagcccccccggcaagagcggccccgaggcccccgagtggtaccaggtggagctgaaggccttccaggccacccagcagaagtag

SEQ ID NO: 98690 - DNA, 5124 bp, Artificial Sequence
  Description of Artificial Sequence: Synthetic coding sequence
atggaccaggagggcggcggcgacggccagaaggcccccagcttccagtggagaaactacaagctgatcgtggaccccgccctggaccccgccctgagaagacccagccagaaggtgtacagatacgacggcgtgcacttcagcgtgaacgacagcaagtacatccccgtggaggacctgcaggaccccagatgccacgtgagaagcaagaacagagacttcagcctgcccgtgcccaagttcaagctggacgagttctacatcggccagatccccctgaaggaggtgaccttcgccagactgaacgacaacgtgagagagaccttcctgaaggacatgtgcagaaagtacggcgaggtggaggaggtggagatcctgctgcaccccagaaccagaaagcacctgggcctggccagagtgctgttcaccagcaccagaggcgccaaggagaccgtgaagaacctgcacctgaccagcgtgatgggcaacatcatccacgcccagctggacatcaagggccagcagagaatgaagtactacgagctgatcgtgaacggcagctacaccccccagaccgtgcccaccggcggcaaggccctgagcgagaagttccagggcagcggcgccgccaccgagaccgccgagagcagaagaagaagcagcagcgacaccgccgcctaccccgccggcaccaccgccgtgggcacccccggcaacggcaccccctgcagccaggacaccagcttcagcagcagcagacaggacacccccagcagcttcggccagttcaccccccagagcagccagggcaccccctacaccagcagaggcagcaccccctacagccaggacagcgcctacagcagcagcaccaccagcaccagcttcaagcccagaagaagcgagaacagctaccaggacgccttcagcagaagacacttcagcgccagcagcgccagcaccaccgccagcaccgccatcgccgccaccaccgccgccaccgccagcagcagcgccagcagcagcagcctgagcagcagcagcagcagcagcagcagcagcagcagcagccagttcagaagcagcgacgccaactaccccgcctactacgagagctggaacagataccagagacacaccagctacccccccagaagagccaccagagaggagccccccggcgcccccttcgccgagaacaccgccgagagattcccccccagctacaccagctacctgccccccgagcccagcagacccaccgaccaggactacagaccccccgccagcgaggcccccccccccgagccccccgagcccggcggcggcggcggcggcggcggccccagccccgagagagaggaggtgagaaccagccccagacccgccagccccgccagaagcggcagccccgcccccgagaccaccaacgagagcgtgcccttcgcccagcacagcagcctggacagcagaatcgagatgctgctgaaggagcagagaagcaagttcagcttcctggccagcgacaccgaggaggaggaggagaacagcagcatggtgctgggcgccagagacaccggcagcgaggtgcccagcggcagcggccacggcccctgcacccccccccccgcccccgccaacttcgaggacgtggcccccaccggcagcggcgagcccggcgccaccagagagagccccaaggccaacggccagaaccaggccagcccctgcagcagcggcgacgacatggagatcagcgacgacgacagaggcggcagccccccccccgcccccacccccccccagcagccccccccccccccccccccccccccccccccccccccctacctggccagcctgcccctgggctaccccccccaccagcccgcctacctgctgccccccagacccgacggcccccccccccccgagtaccccccccccccccccccccccccccacatctacgacttcgtgaacagcctggagctgatggacagactgggcgcccagtggggcggcatgcccatgagcttccagatgcagacccagatgctgaccagactgcaccagctgagacagggcaagggcctgatcgccgccagcgccggcccccccggcggcgccttcggcgaggccttcctgcccttcccccccccccaggaggccgcctacggcctgccctacgccctgtacgcccagggccaggagggcagaggcgcctacagcagagaggcctaccacctgcccatgcccatggccgccgagcccctgcccagcagcagcgtgagcggcgaggaggccagactgccccccagagaggaggccgagctggccgagggcaagaccctgcccaccgccggcaccgtgggcagagtgctggccatgctggtgcaggagatgaagagcatcatgcagagagacctgaacagaaagatggtggagaacgtggccttcggcgccttcgaccagtggtgggagagcaaggaggagaaggccaagcccttccagaacgccgccaagcagcaggccaaggaggaggacaaggagaagaccaagctgaaggagcccggcctgctgagcctggtggactgggccaagagcggcggcaccaccggcatcgaggccttcgccttcggcagcggcctgagaggcgccctgagactgcccagcttcaaggtgaagagaaaggagcccagcgagatcagcgaggccagcgaggagaagagacccagacccagcacccccgccgaggaggacgaggacgaccccgagcaggagaaggaggccggcgagcccggcagacccggcaccaagccccccaagagagacgaggagagaggcaagacccagggcaagcacagaaagagcttcgccctggacagcgagggcgaggaggccagccaggagagcagcagcgagaaggacgaggaggacgacgaggaggacgaggaggacgaggacagagaggaggccgtggacaccaccaagaaggagaccgaggtgagcgacggcgaggacgaggagagcgacagcagcagcaagtgcagcctgtacgccgacagcgacggcgagaacgacagcaccagcgacagcgagagcagcagcagcagcagcagcagcagcagcagcagcagcagcagcagcagcagcagcagcagcagcagcagcgagagcagcagcgaggacgaggaggaggaggagagacccgccgccctgcccagcgccagccccccccccagagaggtgcccgtgcccacccccgcccccgtggaggtgcccgtgcccgagagagtggccggcagccccgtgacccccctgcccgagcaggaggccagccccgccagacccgccggccccaccgaggagagcccccccagcgcccccctgagaccccccgagccccccgccggcccccccgcccccgcccccagacccgacgagagacccagcagccccatccccctgctgcccccccccaagaagagaagaaagaccgtgagcttcagcgccatcgaggtggtgcccgcccccgagcccccccccgccacccccccccaggccaagttccccggccccgccagcagaaaggcccccagaggcgtggagagaaccatcagaaacctgcccctggaccacgccagcctggtgaagagctggcccgaggaggtgagcagaggcggcagaagcagagccggcggcagaggcagactgaccgaggaggaggaggccgagcccggcaccgaggtggacctggccgtgctggccgacctggccctgacccccgccagaagaggcctgcccgccctgcccgccgtggaggacagcgaggccaccgagaccagcgacgaggccgagagacccagacccctgctgagccacatcctgctggagcacaactacgccctggccgtgaagcccaccccccccgcccccgccctgagaccccccgagcccgtgcccgcccccgccgccctgttcagcagccccgccgacgaggtgctggaggcccccgaggtggtggtggccgaggccgaggagcccaagccccagcagctgcagcagcagagagaggagggcgaggaggagggcgaggaggagggcgaggaggaggaggaggagagcagcgacagcagcagcagcagcgacggcgagggcgccctgagaagaagaagcctgagaagccacgccagaagaagaagaccccccccccccccccccccccccccccccagagcctacgagcccagaagcgagttcgagcagatgaccatcctgtacgacatctggaacagcggcctggacagcgaggacatgagctacctgagactgacctacgagagactgctgcagcagaccagcggcgccgactggctgaacgacacccactgggtgcaccacaccatcaccaacctgaccacccccaagagaaagagaagaccccaggacggccccagagagcaccagaccggcagcgccagaagcgagggctactaccccatcagcaagaaggagaaggacaagtacctggacgtgtgccccgtgagcgccagacagctggagggcgtggacacccagggcaccaacagagtgctgagcgagagaagaagcgagcagagaagactgctgagcgccatcggcaccagcgccatcatggacagcgacctgctgaagctgaaccagctgaagttcagaaagaagaagctgagattcggcagaagcagaatccacgagtggggcctgttcgccatggagcccatcgccgccgacgagatggtgatcgagtacgtgggccagaacatcagacagatggtggccgacatgagagagaagagatacgtgcaggagggcatcggcagcagctacctgttcagagtggaccacgacaccatcatcgacgccaccaagtgcggcaacctggccagattcatcaaccactgctgcacccccaactgctacgccaaggtgatcaccatcgagagccagaagaagatcgtgatctacagcaagcagcccatcggcgtggacgaggagatcacctacgactacaagttccccctggaggacaacaagatcccctgcctgtgcggcaccgagagctgcagaggcagcctgaactag

SEQ ID NO: 98691 - DNA, 213 bp, Artificial Sequence
  Description of Artificial Sequence: Synthetic coding sequence
atggaccaggagggcggcggcgacggccagaaggcccccagcttccagtggagaaactacaagctgatcgtggaccccgccctggaccccgccctgagaagacccagccagaaggtgtacagatacgacggcgtgcacttcagcgtgaacgacagcaagtacatccccgtggaggacctgcaggaccccagatgccacgtgagaagcaagtag

SEQ ID NO: 98692 - DNA, 744 bp, Artificial Sequence
  Description of Artificial Sequence: Synthetic coding sequence
atggaccaggagggcggcggcgacggccagaaggcccccagcttccagtggagaaactacaagctgatcgtggaccccgccctggaccccgccctgagaagacccagccagaaggtgtacagatacgacggcgtgcacttcagcgtgaacgacagcaagtacatccccgtggaggacctgcaggaccccagatgccacgtgagaagcaagaacagagacttcagcctgcccgtgcccaagttcaagctggacgagttctacatcggccagatccccctgaaggaggtgaccttcgccagactgaacgacaacgtgagagagaccttcctgaaggacatgtgcagaaagtacggcgaggtggaggaggtggagatcctgctgcaccccagaaccagaaagcacctgggcctggccagagtgctgttcaccagcaccagaggcgccaaggagaccgtgaagaacctgcacctgaccagcgtgatgggcaacatcatccacgcccagctggacatcaagggccagcagagaatgaagtactacgagctgatcgtgaacggcagctacaccccccagaccgtgcccaccggcggcaaggccctgagcgagaagttccagggcagcggcgccgccaccgagaccgccgagagcagaagaagaagcagcagcgacaccgccgcctaccccgccggcaccaccgccgtgggcacccccggcaacggcaccccctgcagccaggacacctag

SEQ ID NO: 98693 - DNA, 5772 bp, Artificial Sequence
  Description of Artificial Sequence: Synthetic coding sequence
atggagaacagccaccccccccaccaccaccaccagcagccccccccccagcccggccccagcggcgagagaagaaaccaccactggagaagctacaagctgatgatcgaccccgccctgaagaagggccaccacaagctgtacagatacgacggccagcacttcagcctggccatgagcagcaacagacccgtggagatcgtggaggaccccagagtggtgggcatctggaccaagaacaaggagctggagctgagcgtgcccaagttcaagatcgacgagttctacgtgggccccgtgccccccaagcaggtgaccttcgccaagctgaacgacaacatcagagagaacttcctgagagacatgtgcaagaagtacggcgaggtggaggaggtggagatcctgtacaaccccaagaccaagaagcacctgggcatcgccaaggtggtgttcgccaccgtgagaggcgccaaggacgccgtgcagcacctgcacagcaccagcgtgatgggcaacatcatccacgtggagctggacaccaagggcgagaccagaatgagattctacgagctgctggtgaccggcagatacaccccccagaccctgcccgtgggcgagctggacgccgtgagccccatcgtgaacgagaccctgcagctgagcgacgccctgaagagactgaaggacggcggcctgagcgccggctgcggcagcggcagcagcagcgtgacccccaacagcggcggcacccccttcagccaggacaccgcctacagcagctgcagactggacacccccaacagctacggccagggcacccccctgacccccagactgggcacccccttcagccaggacagcagctacagcagcagacagcccacccccagctacctgttcagccaggaccccgccgtgaccttcaaggccagaagacacgagagcaagttcaccgacgcctacaacagaagacacgagcaccactacgtgcacaacagccccgccgtgaccgccgtggccggcgccaccgccgccttcagaggcagcagcgacctgcccttcggcgccgtgggcggcaccggcggcagcagcggcccccccttcaaggcccagccccaggacagcgccaccttcgcccacacccccccccccgcccaggccacccccgcccccggcttcaagagcgccttcagcccctaccagacccccgtggcccacttcccccccccccccgaggagcccaccgccaccgccgccttcggcgccagagacagcggcgagttcagaagagcccccgcccccccccccctgccccccgccgagcccctggccaaggagaagcccggcaccccccccggcccccccccccccgacaccaacagcatggagctgggcggcagacccaccttcggctggagccccgagccctgcgacagccccggcacccccaccctggagagcagccccgccggccccgagaagccccacgacagcctggacagcagaatcgagatgctgctgaaggagcagagaaccaagctgctgttcctgagagagcccgacagcgacaccgagctgcagatggagggcagccccatcagcagcagcagcagccagctgagccccctggcccccttcggcaccaacagccagcccggcttcagaggccccaccccccccagcagcagacccagcagcaccggcctggaggacatcagccccacccccctgcccgacagcgacgaggacgaggagctggacctgggcctgggccccagacccccccccgagcccggcccccccgaccccgccggcctgctgagccagaccgccgaggtggccctggacctggtgggcgacagaacccccaccagcgagaagatggacgagggccagcagagcagcggcgaggacatggagatcagcgacgacgagatgcccagcgcccccatcaccagcgccgactgccccaagcccatggtggtgacccccggcgccgccgccgtggccgcccccagcgtgctggcccccaccctgcccctgccccccccccccggcttcccccccctgccccccccccccccccccccccccccccagcccggcttccccatgcccccccccctgcccccccccccccccccccccccccccgcccaccccgccgtgaccgtgccccccccccccctgcccgccccccccggcgtgccccccccccccatcctgccccccctgccccccttcccccccggcctgttccccgtgatgcaggtggacatgagccacgtgctgggcggccagtggggcggcatgcccatgagcttccagatgcagacccaggtgctgagcagactgatgaccggccagggcgcctgcccctacccccccttcatggccgccgccgccgccgccgccagcgccggcctgcagttcgtgaacctgcccccctacagaggccccttcagcctgagcaacagcggccccggcagaggccagcactggccccccctgcccaagttcgaccccagcgtgcccccccccggctacatgcccagacaggaggacccccacaaggccaccgtggacggcgtgctgctggtggtgctgaaggagctgaaggccatcatgaagagagacctgaacagaaagatggtggaggtggtggccttcagagccttcgacgagtggtgggacaagaaggagagaatggccaaggccagcctgacccccgtgaagagcggcgagcacaaggacgaggacagacccaagcccaaggacagaatcgccagctgcctgctggagagctggggcaagggcgagggcctgggctacgagggcctgggcctgggcatcggcctgagaggcgccatcagactgcccagcttcaaggtgaagagaaaggagccccccgacaccaccagcagcggcgaccagaagagactgagacccagcaccagcgtggacgaggaggacgaggagagcgagagagagagagacagagacatggccgacaccccctgcgagctggccaagagagaccccaagggcgtgggcgtgagaagaagacccgccagacccctggagctggacagcggcggcgaggaggacgagaaggagagcctgagcgaggagcaggagagcaccgaggaggaggaggaggccgaggaggaggaggaggaggaggacgacgacgacgacgacagcgacgacagagacgagagcgagaacgacgacgaggacaccgccctgagcgaggccagcgagaaggacgagggcgacagcgacgaggaggagaccgtgagcatcgtgaccagcaaggccgaggccaccagcagcagcgagagcagcgagagcagcgagttcgagagcagcagcgagagcagccccagcagcagcgaggacgaggaggaggtggtggccagagaggaggaggaggaggaggaggaggaggagatggtggccgaggagagcatggccagcgccggccccgaggacttcgagcaggacggcgaggaggccgccctggcccccggcgcccccgccgtggacagcctgggcatggaggaggaggtggacatcgagaccgaggccgtggcccccgaggagagacccagcatgctggacgagccccccctgcccgtgggcgtggaggagcccgccgacagcagagagccccccgaggagcccggcctgagccaggagggcgccatgctgctgagccccgagccccccgccaaggaggtggaggccagaccccccctgagccccgagagagcccccgagcacgacctggaggtggagcccgagccccccatgatgctgcccctgcccctgcagccccccctgcccccccccagaccccccagaccccccagccccccccccgagcccgagaccaccgacgccagccaccccagcgtgccccccgagcccctggccgaggaccaccccccccacacccccggcctgtgcggcagcctggccaagagccagagcaccgagaccgtgcccgccacccccggcggcgagccccccctgagcggcggcagcagcggcctgagcctgagcagcccccaggtgcccggcagccccttcagctaccccgcccccagccccagcctgagcagcggcggcctgcccagaacccccggcagagacttcagcttcacccccaccttcagcgagcccagcggccccctgctgctgcccgtgtgccccctgcccaccggcagaagagacgagagaagcggccccctggccagccccgtgctgctggagaccggcctgcccctgcccctgcccctgcccctgcccctgcccctggccctgcccgccgtgctgagagcccaggccagagcccccacccccctgccccccctgctgcccgcccccctggccagctgccccccccccatgaagagaaagcccggcagacccagaagaagcccccccagcatgctgagcctggacggccccctggtgagaccccccgccggcgccgccctgggcagagagctgctgctgctgcccggccagccccagacccccgtgttccccagcacccacgaccccagaaccgtgaccctggacttcagaaacgccggcatccccgccccccccccccccctgcccccccagcccccccccccccccccccccccccccgtggagcccaccaagctgcccttcaaggagctggacaaccagtggcccagcgaggccatcccccccggccccagaggcagagacgaggtgaccgaggagtacatggagctggccaagagcagaggcccctggagaagaccccccaagaagagacacgaggacctggtgccccccgccggcagccccgagctgagccccccccagcccctgttcagacccagaagcgagttcgaggagatgaccatcctgtacgacatctggaacggcggcatcgacgaggaggacatcagattcctgtgcgtgacctacgagagactgctgcagcaggacaacggcatggactggctgaacgacaccctgtgggtgtaccaccccagcaccagcctgagcagcgccaagaagaagaagagagacgacggcatcagagagcacgtgaccggctgcgccagaagcgagggcttctacaccatcgacaagaaggacaagctgagatacctgaacagcagcagagccagcaccgacgagccccccgccgacacccagggcatgagcatccccgcccagccccacgccagcaccagagccggcagcgagagaagaagcgagcagagaagactgctgagcagcttcaccggcagctgcgacagcgacctgctgaagttcaaccagctgaagttcagaaagaagaagctgaagttctgcaagagccacatccacgactggggcctgttcgccatggagcccatcgccgccgacgagatggtgatcgagtacgtgggccagaacatcagacaggtgatcgccgacatgagagagaagagatacgaggacgagggcatcggcagcagctacatgttcagagtggaccacgacaccatcatcgacgccaccaagtgcggcaacttcgccagattcatcaaccacagctgcaaccccaactgctacgccaaggtgatcaccgtggagagccagaagaagatcgtgatctacagcaagcagcacatcaacgtgaacgaggagatcacctacgactacaagttccccatcgaggacgtgaagatcccctgcctgtgcggcagcgagaactgcagaggcaccctgaactag

SEQ ID NO: 98694 - DNA, 5772 bp, Artificial Sequence; identical to SEQ ID NO: 98693
  Description of Artificial Sequence: Synthetic coding sequence

SEQ ID NO: 98695 - DNA, 7695 bp, Artificial Sequence
  Description of Artificial Sequence: Synthetic coding sequence
atgaagcagctgcagccccagcccccccccaagatgggcgacttctacgaccccgagcaccccacccccgaggaggaggagaacgaggccaagatcgagaacgtgcagaagaccggcttcatcaagggccccatgttcaagggcgtggccagcagcagattcctgcccaagggcaccaagaccaaggtgaacctggaggagcagggcagacagaaggtgagcttcagcttcagcctgaccaagaagaccctgcagaacagattcctgaccgccctgggcaacgagaagcagagcgacacccccaacccccccgccgtgcccctgcaggtggacagcacccccaagatgaagatggagatcggcgacaccctgagcaccgccgaggagagcagcccccccaagagcagagtggagctgggcaagatccacttcaagaagcacctgctgcacgtgaccagcagacccctgctggccaccaccaccgccgtggccagcccccccacccacgccgcccccctgcccgccgtgatcgccgagagcaccaccgtggacagcccccccagcagccccccccccccccccccccccgcccaggccaccaccctgagcagccccgcccccgtgaccgagcccgtggccctgccccacacccccatcaccgtgctgatggccgcccccgtgcccctgcccgtggacgtggccgtgagaagcctgaaggagccccccatcatcatcgtgcccgagagcctggaggccgacaccaagcaggacaccatcagcaacagcctggaggagcacgtgacccagatcctgaacgagcaggccgacatcagcagcaagaaggaggacagccacatcggcaaggacgaggagatccccgacagcagcaagatcagcctgagctgcaagaagaccggcagcaagaagaagagcagccagagcgagggcatcttcctgggcagcgagagcgacgaggacagcgtgagaaccagcagcagccagagaagccacgacctgaagttcagcgccagcatcgagaaggagagagacttcaagaagagcagcgcccccctgaagagcgaggacctgggcaagcccagcagaagcaagaccgacagagacgacaagtacttcagctacagcaagctggagagagacaccagatacgtgagcagcagatgcagaagcgagagagagagaagaagaagcagaagccacagcagaagcgagagaggcagcagaaccaacctgagctacagcagaagcgagagaagccactactacgacagcgacagaagataccacagaagcagcccctacagagagagaaccagatacagcagaccctacaccgacaacagagccagagagagcagcgacagcgaggaggagtacaagaagacctacagcagaagaaccagcagccacagcagcagctacagagacctgagaaccagcagctacagcaagagcgacagagactgcaagaccgagaccagctacctggagatggagagaagaggcaagtacagcagcaagctggagagagagagcaagagaaccagcgagaacgaggccatcaagagatgctgcagcccccccaacgagctgggcttcagaagaggcagcagctacagcaagcacgacagcagcgccagcagatacaagagcaccctgagcaagcccatccccaagagcgacaagttcaagaacagcttctgctgcaccgagctgaacgaggagatcaagcagagccacagcttcagcctgcagaccccctgcagcaagggcagcgagctgagaatgatcaacaagaaccccgagagagagaaggccggcagccccgcccccagcaacagactgaacgacagccccaccctgaagaagctggacgagctgcccatcttcaagagcgagttcatcacccacgacagccacgacagcatcaaggagctggacagcctgagcaaggtgaagaacgaccagctgagaagcttctgccccatcgagctgaacatcaacggcagccccggcgccgagagcgacctggccaccttctgcaccagcaagaccgacgccgtgctgatgaccagcgacgacagcgtgaccggcagcgagctgagccccctggtgaaggcctgcatgctgagcagcaacggcttccagaacatcagcagatgcaaggagaaggacctggacgacacctgcatgctgcacaagaagagcgagagccccttcagagagaccgagcccctggtgagcccccaccaggacaagctgatgagcatgcccgtgatgaccgtggactacagcaagaccgtggtgaaggagcccgtggacaccagagtgagctgctgcaagaccaaggacagcgacatctactgcaccctgaacgacagcaaccccagcctgtgcaacagcgaggccgagaacatcgagcccagcgtgatgaagatcagcagcaacagcttcatgaacgtgcacctggagagcaagcccgtgatctgcgacagcagaaacctgaccgaccacagcaagttcgcctgcgaggagtacaagcagagcatcggcagcaccagcagcgccagcgtgaaccacttcgacgacctgtaccagcccatcggcagcagcggcatcgccagcagcctgcagagcctgccccccggcatcaaggtggacagcctgaccctgctgaagtgcggcgagaacaccagccccgtgctggacgccgtgctgaagagcaagaagagcagcgagttcctgaagcacgccggcaaggagaccatcgtggaggtgggcagcgacctgcccgacagcggcaagggcttcgccagcagagagaacagaagaaacaacggcctgagcggcaagtgcctgcaggaggcccaggaggagggcaacagcatcctgcccgagagaagaggcagacccgagatcagcctggacgagagaggcgagggcggccacgtgcacaccagcgacgacagcgaggtggtgttcagcagctgcgacctgaacctgaccatggaggacagcgacggcgtgacctacgccctgaagtgcgacagcagcggccacgcccccgagatcgtgagcaccgtgcacgaggactacagcggcagcagcgagagcagcaacgacgagagcgacagcgaggacaccgacagcgacgacagcagcatccccagaaacagactgcagagcgtggtggtggtgcccaagaacagcaccctgcccatggaggagaccagcccctgcagcagcagaagcagccagagctacagacactacagcgaccactgggaggacgagagactggagagcagaagacacctgtacgaggagaagttcgagagcatcgccagcaaggcctgcccccagaccgacaagttcttcctgcacaagggcaccgagaagaaccccgagatcagcttcacccagagcagcagaaagcagatcgacaacagactgcccgagctgagccacccccagagcgacggcgtggacagcaccagccacaccgacgtgaagagcgaccccctgggccaccccaacagcgaggagaccgtgaaggccaagatccccagcagacagcaggaggagctgcccatctacagcagcgacttcgaggacgtgcccaacaagagctggcagcagaccaccttccagaacagacccgacagcagactgggcaagaccgagctgagcttcagcagcagctgcgagatcccccacgtggacggcctgcacagcagcgaggagctgagaaacctgggctgggacttcagccaggagaagcccagcaccacctaccagcagcccgacagcagctacggcgcctgcggcggccacaagtaccagcagaacgccgagcagtacggcggcaccagagactactggcagggcaacggctactgggaccccagaagcggcagaccccccggcaccggcgtggtgtacgacagaacccagggccaggtgcccgacagcctgaccgacgacagagaggaggaggagaactgggaccagcaggacggcagccacttcagcgaccagagcgacaagttcctgctgagcctgcagaaggacaagggcagcgtgcaggcccccgagatcagcagcaacagcatcaaggacaccctggccgtgaacgagaagaaggacttcagcaagaacctggagaagaacgacatcaaggacagaggccccctgaagaagagaagacaggagatcgagagcgacagcgagagcgacggcgagctgcaggacagaaagaaggtgagagtggaggtggagcagggcgagaccagcgtgccccccggcagcgccctggtgggccccagctgcgtgatggacgacttcagagacccccagagatggaaggagtgcgccaagcagggcaagatgccctgctacttcgacctgatcgaggagaacgtgtacctgaccgagagaaagaagaacaagagccacagagacatcaagagaatgcagtgcgagtgcacccccctgagcaaggacgagagagcccagggcgagatcgcctgcggcgaggactgcctgaacagactgctgatgatcgagtgcagcagcagatgccccaacggcgactactgcagcaacagaagattccagagaaagcagcacgccgacgtggaggtgatcctgaccgagaagaagggctggggcctgagagccgccaaggacctgcccagcaacaccttcgtgctggagtactgcggcgaggtgctggaccacaaggagttcaaggccagagtgaaggagtacgccagaaacaagaacatccactactacttcatggccctgaagaacgacgagatcatcgacgccacccagaagggcaactgcagcagattcatgaaccacagctgcgagcccaactgcgagacccagaagtggaccgtgaacggccagctgagagtgggcttcttcaccaccaagctggtgcccagcggcagcgagctgaccttcgactaccagttccagagatacggcaaggaggcccagaagtgcttctgcggcagcgccaactgcagaggctacctgggcggcgagaacagagtgagcatcagagccgccggcggcaagatgaagaaggagagaagcagaaagaaggacagcgtggacggcgagctggaggccctgatggagaacggcgagggcctgagcgacaagaaccaggtgctgagcctgagcagactgatggtgagaatcgagaccctggagcagaagctgacctgcctggagctgatccagaacacccacagccagagctgcctgaagagcttcctggagagacacggcctgagcctgctgtggatctggatggccgagctgggcgacggcagagagagcaaccagaagctgcaggaggagatcatcaagaccctggagcacctgcccatccccaccaagaacatgctggaggagagcaaggtgctgcccatcatccagagatggagccagaccaagaccgccgtgccccccctgagcgagggcgacggctacagcagcgagaacaccagcagagcccacacccccctgaacacccccgaccccagcaccaagctgagcaccgaggccgacaccgacacccccaagaagctgatgttcagaagactgaagatcatcagcgagaacagcatggacagcgccatcagcgacgccaccagcgagctggagggcaaggacggcaaggaggacctggaccagctggagaacgtgcccgtggaggaggaggaggagctgcagagccagcagctgctgccccagcagctgcccgagtgcaaggtggacagcgagaccaacatcgaggccagcaagctgcccaccagcgagcccgaggccgacgccgagatcgagcccaaggagagcaacggcaccaagctggaggagcccatcaacgaggagacccccagccaggacgaggaggagggcgtgagcgacgtggagagcgagagaagccaggagcagcccgacaagaccgtggacatcagcgacctggccaccaagctgctggacagctggaaggacctgaaggaggtgtacagaatccccaagaagagccagaccgagaaggagaacaccaccaccgagagaggcagagacgccgtgggcttcagagaccagacccccgcccccaagacccccaacagaagcagagagagagaccccgacaagcagacccagaacaaggagaagagaaagagaagaagcagcctgagcccccccagcagcgcctacgagagaggcaccaagagacccgacgacagatacgacacccccaccagcaagaagaaggtgagaatcaaggacagaaacaagctgagcaccgaggagagaagaaagctgttcgagcaggaggtggcccagagagaggcccagaagcagcagcagcagatgcagaacctgggcatgaccagccccctgccctacgacagcctgggctacaacgccccccaccaccccttcgccggctacccccccggctaccccatgcaggcctacgtggaccccagcaaccccaacgccggcaaggtgctgctgcccacccccagcatggaccccgtgtgcagccccgccccctacgaccacgcccagcccctggtgggccacagcaccgagcccctgagcgcccccccccccgtgcccgtggtgccccacgtggccgcccccgtggaggtgagcagcagccagtacgtggcccagagcgacggcgtggtgcaccaggacagcagcgtggccgtgctgcccgtgcccgcccccggccccgtgcagggccagaactacagcgtgtgggacagcaaccagcagagcgtgagcgtgcagcagcagtacagccccgcccagagccaggccaccatctactaccagggccagacctgccccaccgtgtacggcgtgaccagcccctacagccagaccaccccccccatcgtgcagagctacgcccagcccagcctgcagtacatccagggccagcagatcttcaccgcccacccccagggcgtggtggtgcagcccgccgccgccgtgaccaccatcgtggcccccggccagccccagcccctgcagcccagcgagatggtggtgaccaacaacctgctggacctgcccccccccagcccccccaagcccaagaccatcgtgctgccccccaactggaagaccgccagagaccccgagggcaagatctactactaccacgtgatcaccagacagacccagtgggacccccccacctgggagagccccggcgacgacgccagcctggagcacgaggccgagatggacctgggcacccccacctacgacgagaaccccatgaaggccagcaagaagcccaagaccgccgaggccgacaccagcagcgagctggccaagaagagcaaggaggtgttcagaaaggagatgagccagttcatcgtgcagtgcctgaacccctacagaaagcccgactgcaaggtgggcagaatcaccaccaccgaggacttcaagcacctggccagaaagctgacccacggcgtgatgaacaaggagctgaagtactgcaagaaccccgaggacctggagtgcaacgagaacgtgaagcacaagaccaaggagtacatcaagaagtacatgcagaagttcggcgccgtgtacaagcccaaggaggacaccgagctggagtag

SEQ ID NO: 98696 - DNA, 7695 bp, Artificial Sequence
  Description of Artificial Sequence: Synthetic coding sequence
atgaagcagctgcagccccagcccccccccaagatgggcgacttctacgaccccgagcaccccacccccgaggagcaggagcccgaggccaagatcgagaacgtgcagaagaccggcttcatcaagggccccatgttcaagggcgtggccagcagcagattcctgcccaagggcaccaagaccaaggtgaacctggaggagcagggcagacagaaggtgagcttcagcttcagcctgaccaagaagaccctgcagaacagattcctgaccgccctgggcaacgagaagcagagcgacacccccaacccccccgccgtgcccctgcaggtggacagcacccccaagatgaagatggagatcggcgacaccctgagcaccgccgaggagagcagcccccccaagagcagagtggagctgggcaagatccacttcaagaagcacctgctgcacgtgaccagcagacccctgctggccaccaccaccgccgtggccagcccccccacccacgccgcccccctgcccgccgtgatcgccgagagcaccaccgtggacagcccccccagcagccccccccccccccccccccccgcccaggccaccaccctgagcagccccgcccccgtgaccgagcccgtggccctgccccacacccccatcaccgtgctgatggccgcccccgtgcccctgcccgtggacgtggccgtgagaagcctgaaggagccccccatcatcatcgtgcccgagagcctggaggccgacaccaagcaggacaccatcagcaacagcctggaggagcacgtgacccagatcctgaacgagcaggccgacatcagcagcaagaaggaggacagccacatcggcaaggacgaggagatccccgacagcagcaagatcagcctgagctgcaagaagaccggcagcaagaagaagagcagccagagcgagggcatcttcctgggcagcgagagcgacgaggacagcgtgagaaccagcagcagccagagaagccacgacctgaagttcagcgccagcatcgagaaggagagagacttcaagaagagcagcgcccccctgaagagcgaggacctgggcaagcccagcagaagcaagaccgacagagacgacaagtacttcagctacagcaagctggagagagacaccagatacgtgagcagcagatgcagaagcgagagagagagaagaagaagcagaagccacagcagaagcgagagaggcagcagaaccaacctgagctacagcagaagcgagagaagccactactacgacagcgacagaagataccacagaagcagcccctacagagagagaaccagatacagcagaccctacaccgacaacagagccagagagagcagcgacagcgaggaggagtacaagaagacctacagcagaagaaccagcagccacagcagcagctacagagacctgagaaccagcagctacagcaagagcgacagagactgcaagaccgagaccagctacctggagatggagagaagaggcaagtacagcagcaagctggagagagagagcaagagaaccagcgagaacgaggccatcaagagatgctgcagcccccccaacgagctgggcttcagaagaggcagcagctacagcaagcacgacagcagcgccagcagatacaagagcaccctgagcaagcccatccccaagagcgacaagttcaagaacagcttctgctgcaccgagctgaacgaggagatcaagcagagccacagcttcagcctgcagaccccctgcagcaagggcagcgagctgagaatgatcaacaagaaccccgagagagagaaggccggcagccccgcccccagcaacagactgaacgacagccccaccctgaagaagctggacgagctgcccatcttcaagagcgagttcatcacccacgacagccacgacagcatcaaggagctggacagcctgagcaaggtgaagaacgaccagctgagaagcttctgccccatcgagctgaacatcaacggcagccccggcgccgagagcgacctggccaccttctgcaccagcaagaccgacgccgtgctgatgaccagcgacgacagcgtgaccggcagcgagctgagccccctggtgaaggcctgcatgctgagcagcaacggcttccagaacatcagcagatgcaaggagaaggacctggacgacacctgcatgctgcacaagaagagcgagagccccttcagagagaccgagcccctggtgagcccccaccaggacaagctgatgagcatgcccgtgatgaccgtggactacagcaagaccgtggtgaaggagcccgtggacaccagagtgagctgctgcaagaccaaggacagcgacatctactgcaccctgaacgacagcaaccccagcctgtgcaacagcgaggccgagaacatcgagcccagcgtgatgaagatcagcagcaacagcttcatgaacgtgcacctggagagcaagcccgtgatctgcgacagcagaaacctgaccgaccacagcaagttcgcctgcgaggagtacaagcagagcatcggcagcaccagcagcgccagcgtgaaccacttcgacgacctgtaccagcccatcggcagcagcggcatcgccagcagcctgcagagcctgccccccggcatcaaggtggacagcctgaccctgctgaagtgcggcgagaacaccagccccgtgctggacgccgtgctgaagagcaagaagagcagcgagttcctgaagcacgccggcaaggagaccatcgtggaggtgggcagcgacctgcccgacagcggcaagggcttcgccagcagagagaacagaagaaacaacggcctgagcggcaagtgcctgcaggaggcccaggaggagggcaacagcatcctgcccgagagaagaggcagacccgagatcagcctggacgagagaggcgagggcggccacgtgcacaccagcgacgacagcgaggtggtgttcagcagctgcgacctgaacctgaccatggaggacagcgacggcgtgacctacgccctgaagtgcgacagcagcggccacgcccccgagatcgtgagcaccgtgcacgaggactacagcggcagcagcgagagcagcaacgacgagagcgacagcgaggacaccgacagcgacgacagcagcatccccagaaacagactgcagagcgtggtggtggtgcccaagaacagcaccctgcccatggaggagaccagcccctgcagcagcagaagcagccagagctacagacactacagcgaccactgggaggacgagagactggagagcagaagacacctgtacgaggagaagttcgagagcatcgccagcaaggcctgcccccagaccgacaagttcttcctgcacaagggcaccgagaagaaccccgagatcagcttcacccagagcagcagaaagcagatcgacaacagactgcccgagctgagccacccccagagcgacggcgtggacagcaccagccacaccgacgtgaagagcgaccccctgggccaccccaacagcgaggagaccgtgaaggccaagatccccagcagacagcaggaggagctgcccatctacagcagcgacttcgaggacgtgcccaacaagagctggcagcagaccaccttccagaacagacccgacagcagactgggcaagaccgagctgagcttcagcagcagctgcgagatcccccacgtggacggcctgcacagcagcgaggagctgagaaacctgggctgggacttcagccaggagaagcccagcaccacctaccagcagcccgacagcagctacggcgcctgcggcggccacaagtaccagcagaacgccgagcagtacggcggcaccagagactactggcagggcaacggctactgggaccccagaagcggcagaccccccggcaccggcgtggtgtacgacagaacccagggccaggtgcccgacagcctgaccgacgacagagaggaggaggagaactgggaccagcaggacggcagccacttcagcgaccagagcgacaagttcctgctgagcctgcagaaggacaagggcagcgtgcaggcccccgagatcagcagcaacagcatcaaggacaccctggccgtgaacgagaagaaggacttcagcaagaacctggagaagaacgacatcaaggacagaggccccctgaagaagagaagacaggagatcgagagcgacagcgagagcgacggcgagctgcaggacagaaagaaggtgagagtggaggtggagcagggcgagaccagcgtgccccccggcagcgccctggtgggccccagctgcgtgatggacgacttcagagacccccagagatggaaggagtgcgccaagcagggcaagatgccctgctacttcgacctgatcgaggagaacgtgtacctgaccgagagaaagaagaacaagagccacagagacatcaagagaatgcagtgcgagtgcacccccctgagcaaggacgagagagcccagggcgagatcgcctgcggcgaggactgcctgaacagactgctgatgatcgagtgcagcagcagatgccccaacggcgactactgcagcaacagaagattccagagaaagcagcacgccgacgtggaggtgatcctgaccgagaagaagggctggggcctgagagccgccaaggacctgcccagcaacaccttcgtgctggagtactgcggcgaggtgctggaccacaaggagttcaaggccagagtgaaggagtacgccagaaacaagaacatccactactacttcatggccctgaagaacgacgagatcatcgacgccacccagaagggcaactgcagcagattcatgaaccacagctgcgagcccaactgcgagacccagaagtggaccgtgaacggccagctgagagtgggcttcttcaccaccaagctggtgcccagcggcagcgagctgaccttcgactaccagttccagagatacggcaaggaggcccagaagtgcttctgcggcagcgccaactgcagaggctacctgggcggcgagaacagagtgagcatcagagccgccggcggcaagatgaagaaggagagaagcagaaagaaggacagcgtggacggcgagctggaggccctgatggagaacggcgagggcctgagcgacaagaaccaggtgctgagcctgagcagactgatggtgagaatcgagaccctggagcagaagctgacctgcctggagctgatccagaacacccacagccagagctgcctgaagagcttcctggagagacacggcctgagcctgctgtggatctggatggccgagctgggcgacggcagagagagcaaccagaagctgcaggaggagatcatcaagaccctggagcacctgcccatccccaccaagaacatgctggaggagagcaaggtgctgcccatcatccagagatggagccagaccaagaccgccgtgccccccctgagcgagggcgacggctacagcagcgagaacaccagcagagcccacacccccctgaacacccccgaccccagcaccaagctgagcaccgaggccgacaccgacacccccaagaagctgatgttcagaagactgaagatcatcagcgagaacagcatggacagcgccatcagcgacgccaccagcgagctggagggcaaggacggcaaggaggacctggaccagctggagaacgtgcccgtggaggaggaggaggagctgcagagccagcagctgctgccccagcagctgcccgagtgcaaggtggacagcgagaccaacatcgaggccagcaagctgcccaccagcgagcccgaggccgacgccgagatcgagcccaaggagagcaacggcaccaagctggaggagcccatcaacgaggagacccccagccaggacgaggaggagggcgtgagcgacgtggagagcgagagaagccaggagcagcccgacaagaccgtggacatcagcgacctggccaccaagctgctggacagctggaaggacctgaaggaggtgtacagaatccccaagaagagccagaccgagaaggagaacaccaccaccgagagaggcagagacgccgtgggcttcagagaccagacccccgcccccaagacccccaacagaagcagagagagagaccccgacaagcagacccagaacaaggagaagagaaagagaagaagcagcctgagcccccccagcagcgcctacgagagaggcaccaagagacccgacgacagatacgacacccccaccagcaagaagaaggtgagaatcaaggacagaaacaagctgagcaccgaggagagaagaaagctgttcgagcaggaggtggcccagagagaggcccagaagcagcagcagcagatgcagaacctgggcatgaccagccccctgccctacgacagcctgggctacaacgccccccaccaccccttcgccggctacccccccggctaccccatgcaggcctacgtggaccccagcaaccccaacgccggcaaggtgctgctgcccacccccagcatggaccccgtgtgcagccccgccccctacgaccacgcccagcccctggtgggccacagcaccgagcccctgagcgcccccccccccgtgcccgtggtgccccacgtggccgcccccgtggaggtgagcagcagccagtacgtggcccagagcgacggcgtggtgcaccaggacagcagcgtggccgtgctgcccgtgcccgcccccggccccgtgcagggccagaactacagcgtgtgggacagcaaccagcagagcgtgagcgtgcagcagcagtacagccccgcccagagccaggccaccatctactaccagggccagacctgccccaccgtgtacggcgtgaccagcccctacagccagaccaccccccccatcgtgcagagctacgcccagcccagcctgcagtacatccagggccagcagatcttcaccgcccacccccagggcgtggtggtgcagcccgccgccgccgtgaccaccatcgtggcccccggccagccccagcccctgcagcccagcgagatggtggtgaccaacaacctgctggacctgcccccccccagcccccccaagcccaagaccatcgtgctgccccccaactggaagaccgccagagaccccgagggcaagatctactactaccacgtgatcaccagacagacccagtgggacccccccacctgggagagccccggcgacgacgccagcctggagcacgaggccgagatggacctgggcacccccacctacgacgagaaccccatgaaggccagcaagaagcccaagaccgccgaggccgacaccagcagcgagctggccaagaagagcaaggaggtgttcagaaaggagatgagccagttcatcgtgcagtgcctgaacccctacagaaagcccgactgcaaggtgggcagaatcaccaccaccgaggacttcaagcacctggccagaaagctgacccacggcgtgatgaacaaggagctgaagtactgcaagaaccccgaggacctggagtgcaacgagaacgtgaagcacaagaccaaggagtacatcaagaagtacatgcagaagttcggcgccgtgtacaagcccaaggaggacaccgagctggagtag

SEQ ID NO: 98697 - DNA, 5145 bp, Artificial Sequence
  Description of Artificial Sequence: Synthetic coding sequence
atgaagcagctgcagccccagcccccccccaagatgggcgacttctacgaccccgagcaccccacccccgagaagaaggagagagaggccaagatcgagaacgtgcagaagaccggcttcatcaagggccccatgttcaagggcgtggccagcagcagattcctgcccaagggcaccaagaccaaggtgaacctggaggagcagggcagacagaaggtgagcttcagcttcagcctgaccaagaagaccctgcagaacagattcctgaccgccctgggcaacgagaagcagagcgacacccccaacccccccgccgtgcccctgcaggtggacagcacccccaagatgaagatggagatcggcgacaccctgagcaccgccgaggagagcagcccccccaagagcagagtggagctgggcaagatccacttcaagaagcacctgctgcacgtgaccagcagacccctgctggccaccaccaccgccgtggccagcccccccacccacgccgcccccctgcccgccgtgatcgccgagagcaccaccgtggacagcccccccagcagccccccccccccccccccccccgcccaggccaccaccctgagcagccccgcccccgtgaccgagcccgtggccctgccccacacccccatcaccgtgctgatggccgcccccgtgcccctgcccgtggacgtggccgtgagaagcctgaaggagccccccatcatcatcgtgcccgagagcctggaggccgacaccaagcaggacaccatcagcaacagcctggaggagcacgtgacccagatcctgaacgagcaggccgacatcagcagcaagaaggaggacagccacatcggcaaggacgaggagatccccgacagcagcaagatcagcctgagctgcaagaagaccggcagcaagaagaagagcagccagagcgagggcatcttcctgggcagcgagagcgacgaggacagcgtgagaaccagcagcagccagagaagccacgacctgaagttcagcgccagcatcgagaaggagagagacttcaagaagagcagcgcccccctgaagagcgaggacctgggcaagcccagcagaagcaagaccgacagagacgacaagtacttcagctacagcaagctggagagagacaccagatacgtgagcagcagatgcagaagcgagagagagagaagaagaagcagaagccacagcagaagcgagagaggcagcagaaccaacctgagctacagcagaagcgagagaagccactactacgacagcgacagaagataccacagaagcagcccctacagagagagaaccagatacagcagaccctacaccgacaacagagccagagagagcagcgacagcgaggaggagtacaagaagacctacagcagaagaaccagcagccacagcagcagctacagagacctgagaaccagcagctacagcaagagcgacagagactgcaagaccgagaccagctacctggagatggagagaagaggcaagtacagcagcaagctggagagagagagcaagagaaccagcgagaacgaggccatcaagagatgctgcagcccccccaacgagctgggcttcagaagaggcagcagctacagcaagcacgacagcagcgccagcagatacaagagcaccctgagcaagcccatccccaagagcgacaagttcaagaacagcttctgctgcaccgagctgaacgaggagatcaagcagagccacagcttcagcctgcagaccccctgcagcaagggcagcgagctgagaatgatcaacaagaaccccgagagagagaaggccggcagccccgcccccagcaacagactgaacgacagccccaccctgaagaagctggacgagctgcccatcttcaagagcgagttcatcacccacgacagccacgacagcatcaaggagctggacagcctgagcaaggtgaagaacgaccagctgagaagcttctgccccatcgagctgaacatcaacggcagccccggcgccgagagcgacctggccaccttctgcaccagcaagaccgacgccgtgctgatgaccagcgacgacagcgtgaccggcagcgagctgagccccctggtgaaggcctgcatgctgagcagcaacggcttccagaacatcagcagatgcaaggagaaggacctggacgacacctgcatgctgcacaagaagagcgagagccccttcagagagaccgagcccctggtgagcccccaccaggacaagctgatgagcatgcccgtgatgaccgtggactacagcaagaccgtggtgaaggagcccgtggacaccagagtgagctgctgcaagaccaaggacagcgacatctactgcaccctgaacgacagcaaccccagcctgtgcaacagcgaggccgagaacatcgagcccagcgtgatgaagatcagcagcaacagcttcatgaacgtgcacctggagagcaagcccgtgatctgcgacagcagaaacctgaccgaccacagcaagttcgcctgcgaggagtacaagcagagcatcggcagcaccagcagcgccagcgtgaaccacttcgacgacctgtaccagcccatcggcagcagcggcatcgccagcagcctgcagagcctgccccccggcatcaaggtggacagcctgaccctgctgaagtgcggcgagaacaccagccccgtgctggacgccgtgctgaagagcaagaagagcagcgagttcctgaagcacgccggcaaggagaccatcgtggaggtgggcagcgacctgcccgacagcggcaagggcttcgccagcagagagaacagaagaaacaacggcctgagcggcaagtgcctgcaggaggcccaggaggagggcaacagcatcctgcccgagagaagaggcagacccgagatcagcctggacgagagaggcgagggcggccacgtgcacaccagcgacgacagcgaggtggtgttcagcagctgcgacctgaacctgaccatggaggacagcgacggcgtgacctacgccctgaagtgcgacagcagcggccacgcccccgagatcgtgagcaccgtgcacgaggactacagcggcagcagcgagagcagcaacgacgagagcgacagcgaggacaccgacagcgacgacagcagcatccccagaaacagactgcagagcgtggtggtggtgcccaagaacagcaccctgcccatggaggagaccagcccctgcagcagcagaagcagccagagctacagacactacagcgaccactgggaggacgagagactggagagcagaagacacctgtacgaggagaagttcgagagcatcgccagcaaggcctgcccccagaccgacaagttcttcctgcacaagggcaccgagaagaaccccgagatcagcttcacccagagcagcagaaagcagatcgacaacagactgcccgagctgagccacccccagagcgacggcgtggacagcaccagccacaccgacgtgaagagcgaccccctgggccaccccaacagcgaggagaccgtgaaggccaagatccccagcagacagcaggaggagctgcccatctacagcagcgacttcgaggacgtgcccaacaagagctggcagcagaccaccttccagaacagacccgacagcagactgggcaagaccgagctgagcttcagcagcagctgcgagatcccccacgtggacggcctgcacagcagcgaggagctgagaaacctgggctgggacttcagccaggagaagcccagcaccacctaccagcagcccgacagcagctacggcgcctgcggcggccacaagtaccagcagaacgccgagcagtacggcggcaccagagactactggcagggcaacggctactgggaccccagaagcggcagaccccccggcaccggcgtggtgtacgacagaacccagggccaggtgcccgacagcctgaccgacgacagagaggaggaggagaactgggaccagcaggacggcagccacttcagcgaccagagcgacaagttcctgctgagcctgcagaaggacaagggcagcgtgcaggcccccgagatcagcagcaacagcatcaaggacaccctggccgtgaacgagaagaaggacttcagcaagaacctggagaagaacgacatcaaggacagaggccccctgaagaagagaagacaggagatcgagagcgacagcgagagcgacggcgagctgcaggacagaaagaaggtgagagtggaggtggagcagggcgagaccagcgtgccccccggcagcgccctggtgggccccagctgcgtgatggacgacttcagagacccccagagatggaaggagtgcgccaagcagggcaagatgccctgctacttcgacctgatcgaggagaacgtgtacctgaccgagagaaagaagaacaagagccacagagacatcaagagaatgcagtgcgagtgcacccccctgagcaaggacgagagagcccagggcgagatcgcctgcggcgaggactgcctgaacagactgctgatgatcgagtgcagcagcagatgccccaacggcgactactgcagcaacagaagattccagagaaagcagcacgccgacgtggaggtgatcctgaccgagaagaagggctggggcctgagagccgccaaggacctgcccagcaacaccttcgtgctggagtactgcggcgaggtgctggaccacaaggagttcaaggccagagtgaaggagtacgccagaaacaagaacatccactactacttcatggccctgaagaacgacgagatcatcgacgccacccagaagggcaactgcagcagattcatgaaccacagctgcgagcccaactgcgagacccagaagtggaccgtgaacggccagctgagagtgggcttcttcaccaccaagctggtgcccagcggcagcgagctgaccttcgactaccagttccagagatacggcaaggaggcccagaagtgcttctgcggcagcgccaactgcagaggctacctgggcggcgagaacagagtgagcatcagagccgccggcggcaagatgaagaaggagagaagcagaaagaaggacagctag

SEQ ID NO: 98698 - DNA, 3876 bp, Artificial Sequence
  Description of Artificial Sequence: Synthetic coding sequence
atgagcagcctgcccggctgcatcggcctggacgccgccaccgccaccgtggagagcgaggagatcgccgagctgcagcaggccgtggtggaggagctgggcatcagcatggaggagctgagacacttcatcgacgaggagctggagaagatggactgcgtgcagcagagaaagaagcagctggccgagctggagacctgggtgatccagaaggagagcgaggtggcccacgtggaccagctgttcgacgacgccagcagagccgtgaccaactgcgagagcctggtgaaggacttctacagcaagctgggcctgcagtacagagacagcagcagcgaggacgagagcagcagacccaccgagatcatcgagatccccgacgaggacgacgacgtgctgagcatcgacagcggcgacgccggcagcagaacccccaaggaccagaagctgagagaggccatggccgccctgagaaagagcgcccaggacgtgcagaagttcatggacgccgtgaacaagaagagcagcagccaggacctgcacaagggcaccctgagccagatgagcggcgagctgagcaaggacggcgacctgatcgtgagcatgagaatcctgggcaagaagagaaccaagacctggcacaagggcaccctgatcgccatccagaccgtgggccccggcaagaagtacaaggtgaagttcgacaacaagggcaagagcctgctgagcggcaaccacatcgcctacgactaccacccccccgccgacaagctgtacgtgggcagcagagtggtggccaagtacaaggacggcaaccaggtgtggctgtacgccggcatcgtggccgagacccccaacgtgaagaacaagctgagattcctgatcttcttcgacgacggctacgccagctacgtgacccagagcgagctgtaccccatctgcagacccctgaagaagacctgggaggacatcgaggacatcagctgcagagacttcatcgaggagtacgtgaccgcctaccccaacagacccatggtgctgctgaagagcggccagctgatcaagaccgagtgggagggcacctggtggaagagcagagtggaggaggtggacggcagcctggtgagaatcctgttcctggacgacaagagatgcgagtggatctacagaggcagcaccagactggagcccatgttcagcatgaagaccagcagcgccagcgccctggagaagaagcagggccagctgagaaccagacccaacatgggcgccgtgagaagcaagggccccgtggtgcagtacacccaggacctgaccggcaccggcacccagttcaagcccgtggagcccccccagcccaccgccccccccgccccccccttcccccccgccccccccctgagcccccaggccggcgacagcgacctggagagccagctggcccagagcagaaagcaggtggccaagaagagcaccagcttcagacccggcagcgtgggcagcggccacagcagccccaccagccccgccctgagcgagaacgtgagcggcggcaagcccggcatcaaccagacctacagaagccccctgggcagcaccgccagcgcccccgcccccagcgccctgcccgccccccccgccccccccgtgttccacggcatgctggagagagcccccgccgagcccagctacagagcccccatggagaagctgttctacctgccccacgtgtgcagctacacctgcctgagcagagtgagacccatgagaaacgagcagtacagaggcaagaaccccctgctggtgcccctgctgtacgacttcagaagaatgaccgccagaagaagagtgaacagaaagatgggcttccacgtgatctacaagaccccctgcggcctgtgcctgagaaccatgcaggagatcgagagatacctgttcgagaccggctgcgacttcctgttcctggagatgttctgcctggacccctacgtgctggtggacagaaagttccagccctacaagcccttctactacatcctggacatcacctacggcaaggaggacgtgcccctgagctgcgtgaacgagatcgacaccaccccccccccccaggtggcctacagcaaggagagaatccccggcaagggcgtgttcatcaacaccggccccgagttcctggtgggctgcgactgcaaggacggctgcagagacaagagcaagtgcgcctgccaccagctgaccatccaggccaccgcctgcacccccggcggccagatcaaccccaacagcggctaccagtacaagagactggaggagtgcctgcccaccggcgtgtacgagtgcaacaagagatgcaagtgcgaccccaacatgtgcaccaacagactggtgcagcacggcctgcaggtgagactgcagctgttcaagacccagaacaagggctggggcatcagatgcctggacgacatcgccaagggcagcttcgtgtgcatctacgccggcaagatcctgaccgacgacttcgccgacaaggagggcctggagatgggcgacgagtacttcgccaacctggaccacatcgagagcgtggagaacttcaaggagggctacgagagcgacgccccctgcagcagcgacagcagcggcgtggacctgaaggaccaggaggacggcaacagcggcaccgaggaccccgaggagagcaacgacgacagcagcgacgacaacttctgcaaggacgaggacttcagcaccagcagcgtgtggagaagctacgccaccagaagacagaccagaggccagaaggagaacggcctgagcgagaccaccagcaaggacagccacccccccgacctgggccccccccacatccccgtgccccccagcatccccgtgggcggctgcaacccccccagcagcgaggagacccccaagaacaaggtggccagctggctgagctgcaacagcgtgagcgagggcggcttcgccgacagcgacagccacagcagcttcaagaccaacgagggcggcgagggcagagccggcggcagcagaatggaggccgagaaggccagcaccagcggcctgggcatcaaggacgagggcgacatcaagcaggccaagaaggaggacaccgacgacagaaacaagatgagcgtggtgaccgagagcagcagaaactacggctacaaccccagccccgtgaagcccgagggcctgagaagaccccccagcaagaccagcatgcaccagagcagaagactgatggccagcgcccagagcaaccccgacgacgtgctgaccctgagcagcagcaccgagagcgagggcgagagcggcaccagcagaaagcccaccgccggccagaccagcgccaccgccgtggacagcgacgacatccagaccatcagcagcggcagcgagggcgacgacttcgaggacaagaagaacatgaccggccccatgaagagacaggtggccgtgaagagcaccagaggcttcgccctgaagagcacccacggcatcgccatcaagagcaccaacatggccagcgtggacaagggcgagagcgcccccgtgagaaagaacaccagacagttctacgacggcgaggagagctgctacatcatcgacgccaagctggagggcaacctgggcagatacctgaaccacagctgcagccccaacctgttcgtgcagaacgtgttcgtggacacccacgacctgagattcccctgggtggccttcttcgccagcaagagaatcagagccggcaccgagctgacctgggactacaactacgaggtgggcagcgtggagggcaaggagctgctgtgctgctgcggcgccatcgagtgcagaggcagactgctgtag

SEQ ID NO: 98699 - DNA, 1194 bp, Artificial Sequence
  Description of Artificial Sequence: Synthetic coding sequence
atgagcagcctgcccggctgcatcggcctggacgccgccaccgccaccgtggagagcgaggagatcgccgagctgcagcaggccgtggtggaggagctgggcatcagcatggaggagctgagacacttcatcgacgaggagctggagaagatggactgcgtgcagcagagaaagaagcagctggccgagctggagacctgggtgatccagaaggagagcgaggtggcccacgtggaccagctgttcgacgacgccagcagagccgtgaccaactgcgagagcctggtgaaggacttctacagcaagctgggcctgcagtacagagacagcagcagcgaggacgagagcagcagacccaccgagatcatcgagatccccgacgaggacgacgacgtgctgagcatcgacagcggcgacgccggcagcagaacccccaaggaccagaagctgagagaggccatggccgccctgagaaagagcgcccaggacgtgcagaagttcatggacgccgtgaacaagaagagcagcagccaggacctgcacaagggcaccctgagccagatgagcggcgagctgagcaaggacggcgacctgatcgtgagcatgagaatcctgggcaagaagagaaccaagacctggcacaagggcaccctgatcgccatccagaccgtgggccccggcaagaagtacaaggtgaagttcgacaacaagggcaagagcctgctgagcggcaaccacatcgcctacgactaccacccccccgccgacaagctgtacgtgggcagcagagtggtggccaagtacaaggacggcaaccaggtgtggctgtacgccggcatcgtggccgagacccccaacgtgaagaacaagctgagattcctgatcttcttcgacgacggctacgccagctacgtgacccagagcgagctgtaccccatctgcagacccctgaagaagacctgggaggacatcgaggacatcagctgcagagacttcatcgaggagtacgtgaccgcctaccccaacagacccatggtgctgctgaagagcggccagctgatcaagaccgagtgggagggcacctggtggaagagcagagtggaggaggtggacggcagcctggtgagaatcctgttcctggtgctgttcttcagcaccatcctggaggccgaggtgggcggcggcggcacctag

SEQ ID NO: 98700 - DNA, 750 bp, Artificial Sequence
  Description of Artificial Sequence: Synthetic coding sequence
atgagcagcctgcccggctgcatcggcctggacgccgccaccgccaccgtggagagcgaggagatcgccgagctgcagcaggccgtggtggaggagctgggcatcagcatggaggagctgagacacttcatcgacgaggagctggagaagatggactgcgtgcagcagagaaagaagcagctggccgagctggagacctgggtgatccagaaggagagcgaggtggcccacgtggaccagctgttcgacgacgccagcagagccgtgaccaactgcgagagcctggtgaaggacttctacagcaagctgggcctgcagtacagagacagcagcagcgaggacgagagcagcagacccaccgagatcatcgagatccccgacgaggacgacgacgtgctgagcatcgacagcggcgacgccggcagcagaacccccaaggaccagaagctgagagaggccatggccgccctgagaaagagcgcccaggacgtgcagaagttcatggacgccgtgaacaagaagagcagcagccaggacctgcacaagggcaccctgagccagatgagcggcgagctgagcaaggacggcgacctgatcgtgagcatgagaatcctgggcaagaagagaaccaagacctggcacaagggcaccctgatcgccatccagaccgtgggcttcagcttcagcctgatgatggccatgctgcccatgagccacagcagaaactgcatccccttcgccggccactag

SEQ ID NO: 98701 - DNA, 3873 bp, Artificial Sequence
  Description of Artificial Sequence: Synthetic coding sequence
atgagcagcctgcccggctgcatcggcctggacgccgccaccgccaccgtggagagcgaggagatcgccgagctgcagcaggccgtggtggaggagctgggcatcagcatggaggagctgagacacttcatcgacgaggagctggagaagatggactgcgtgcagcagagaaagaagcagctggccgagctggagacctgggtgatccagaaggagagcgaggtggcccacgtggaccagctgttcgacgacgccagcagagccgtgaccaactgcgagagcctggtgaaggacttctacagcaagctgggcctgcagtacagagacagcagcagcgaggacgagagcagcagacccaccgagatcatcgagatccccgacgaggacgacgacgtgctgagcatcgacagcggcgacgccggcagcagaacccccaaggaccagaagctgagagaggccatggccgccctgagaaagagcgcccaggacgtgcagaagttcatggacgccgtgaacaagaagagcagcagccaggacctgcacaagggcaccctgagccagatgagcggcgagctgagcaaggacggcgacctgatcgtgagcatgagaatcctgggcaagaagagaaccaagacctggcacaagggcaccctgatcgccatccagaccgtgggccccggcaagaagtacaaggtgaagttcgacaacaagggcaagagcctgctgagcggcaaccacatcgcctacgactaccacccccccgccgacaagctgtacgtgggcagcagagtggtggccaagtacaaggacggcaaccaggtgtggctgtacgccggcatcgtggccgagacccccaacgtgaagaacaagctgagattcctgatcttcttcgacgacggctacgccagctacgtgacccagagcgagctgtaccccatctgcagacccctgaagaagacctgggaggacatcgaggacatcagctgcagagacttcatcgaggagtacgtgaccgcctaccccaacagacccatggtgctgctgaagagcggccagctgatcaagaccgagtgggagggcacctggtggaagagcagagtggaggaggtggacggcagcctggtgagaatcctgttcctggacgacaagagatgcgagtggatctacagaggcagcaccagactggagcccatgttcagcatgaagaccagcagcgccagcgccctggagaagaagcagggccagctgagaaccagacccaacatgggcgccgtgagaagcaagggccccgtggtgcagtacacccaggacctgaccggcaccggcacccagttcaagcccgtggagcccccccagcccaccgccccccccgccccccccttcccccccgccccccccctgagcccccaggccggcgacagcgacctggagagccagctggcccagagcagaaagcaggtggccaagaagagcaccagcttcagacccggcagcgtgggcagcggccacagcagccccaccagccccgccctgagcgagaacgtgagcggcggcaagcccggcatcaaccagacctacagaagccccctgggcagcaccgccagcgcccccgcccccagcgccctgcccgccccccccgccccccccgtgttccacggcatgctggagagagcccccgccgagcccagctacagagcccccatggagaagctgttctacctgccccacgtgtgcagctacacctgcctgagcagagtgagacccatgagaaacgagcagtacagaggcaagaaccccctgctggtgcccctgctgtacgacttcagaagaatgaccgccagaagaagagtgaacagaaagatgggcttccacgtgatctacaagaccccctgcggcctgtgcctgagaaccatgcaggagatcgagagatacctgttcgagaccggctgcgacttcctgttcctggagatgttctgcctggacccctacgtgctggtggacagaaagttccagccctacaagcccttctactacatcctggacatcacctacggcaaggaggacgtgcccctgagctgcgtgaacgagatcgacaccaccccccccccccaggtggcctacagcaaggagagaatccccggcaagggcgtgttcatcaacaccggccccgagttcctggtgggctgcgactgcaaggacggctgcagagacaagagcaagtgcgcctgccaccagctgaccatccaggccaccgcctgcacccccggcggccagatcaaccccaacagcggctaccagtacaagagactggaggagtgcctgcccaccggcgtgtacgagtgcaacaagagatgcaagtgcgaccccaacatgtgcaccaacagactggtgcagcacggcctgcaggtgagactgcagctgttcaagacccagaacaagggctggggcatcagatgcctggacgacatcgccaagggcagcttcgtgtgcatctacgccggcaagatcctgaccgacgacttcgccgacaaggagggcctggagatgggcgacgagtacttcgccaacctggaccacatcgagagcgtggagaacttcaaggagggctacgagagcgacgccccctgcagcagcgacagcagcggcgtggacctgaaggaccaggaggacggcaacagcggcaccgaggaccccgaggagagcaacgacgacagcagcgacgacaacttctgcaaggacgaggacttcagcaccagcagcgtgtggagaagctacgccaccagaagacagaccagaggccagaaggagaacggcctgagcgagaccaccagcaaggacagccacccccccgacctgggccccccccacatccccgtgccccccagcatccccgtgggcggctgcaacccccccagcagcgaggagacccccaagaacaaggtggccagctggctgagctgcaacagcgtgagcgagggcggcttcgccgacagcgacagccacagcagcttcaagaccaacgagggcggcgagggcagagccggcggcagcagaatggaggccgagaaggccagcaccagcggcctgggcatcaaggacgagggcgacatcaagcaggccaagaaggaggacaccgacgacagaaacaagatgagcgtggtgaccgagagcagcagaaactacggctacaaccccagccccgtgaagcccgagggcctgagaagaccccccagcaagaccagcatgcaccagagcagaagactgatggccagcgcccagagcaaccccgacgacgtgctgaccctgagcagcagcaccgagagcgagggcgagagcggcaccagcagaaagcccaccgccggccagaccagcgccaccgccgtggacagcgacgacatccagaccatcagcagcggcagcgagggcgacgacttcgaggacaagaagaacatgaccggccccatgaagagacaggtggccgtgaagagcaccagaggcttcgccctgaagagcacccacggcatcgccatcaagagcaccaacatggccagcgtggacaagggcgagagcgcccccgtgagaaagaacaccagacagttctacgacggcgaggagagctgctacatcatcgacgccaagctggagggcaacctgggcagatacctgaaccacagctgcagccccaacctgttcgtgcagaacgtgttcgtggacacccacgacctgagattcccctgggtggccttcttcgccagcaagatcagagccggcaccgagctgacctgggactacaactacgaggtgggcagcgtggagggcaaggagctgctgtgctgctgcggcgccatcgagtgcagaggcagactgctgtag

SEQ ID NO: 98702 - DNA, 504 bp, Artificial Sequence
  Description of Artificial Sequence: Synthetic coding sequence
atgagcagcctgcccggctgcatcggcctggacgccgccaccgccaccgtggagagcgaggagatcgccgagctgcagcaggccgtggtggaggagctgggcatcagcatggaggagctgagacacttcatcgacgaggagctggagaagatggactgcgtgcagcagagaaagaagcagctggccgagctggagaccgtgggccccggcaagaagtacaaggtgaagttcgacaacaagggcaagagcctgctgagcggcaaccacatcgcctacgactaccacccccccgccgacaagctgtacgtgggcagcagagtggtggccaagtacaaggacggcaaccaggtgtggctgtacgccggcatcgtggccgagacccccaacgtgaagaacaagctgagattcctgatcttcttcgacgacggctacgccagctacgtgacccagagcgagctgtaccccatctgcagacccagagagtgcttcagcctgatcccctag

SEQ ID NO: 98703 - DNA, 471 bp, Artificial Sequence
  Description of Artificial Sequence: Synthetic coding sequence
atgagcagcctgcccggctgcatcggcctggacgccgccaccgccaccgtggagagcgaggagatcgccgagctgcagcaggccgtggtggaggagctgggcatcagcatggaggagctgagacacttcatcgacgaggagctggagaagatggactgcgtgcagcagagaaagaagcagctggccgagctggagacctgggtgatccagaaggagagcgaggtggcccacgtggaccagctgttcgacgacgccagcagagccgtgaccaactgcgagagcctggtgaaggacttctacagcaagctgggcctgcagtacagagacagcagcagcgaggacgagagcagcagacccaccgagatcatcgagatccccgacgaggacgacgacgtgctgagcatcgacagcggcgacgccggcagcagaacccccaaggaccagaagctgagagaggccatggccgcctag

SEQ ID NO: 98704 - DNA, 3780 bp, Artificial Sequence
  Description of Artificial Sequence: Synthetic coding sequence
atgagcagcctgcccggctgcatcggcctggacgccgccaccgccaccgtggagagcgaggagatcgccgagctgcagcaggccgtggtggaggagctgggcatcagcatggaggagctgagacacttcatcgacgaggagctggagaagatggactgcgtgcagcagagaaagaagcagctggccgagctggagacctgggtgatccagaaggagagcgaggtggcccacgtggaccagctgttcgacgacgccagcagagccgtgaccaactgcgagagcctggtgaaggacttctacagcaagctgggcctgcagtacagagacagcagcagcgaggacgagagcagcagacccaccgagatcatcgagatccccgacgaggacgacgacgtgctgagcatcgacagcggcgacgccggcagcagaacccccaaggaccagaagctgagagaggccatggccgccctgagaaagagcgcccaggacgtgcagaagttcatggacgccgtgaacaagaagagcagcagccaggacctgcacaagggcaccctgagccagatgagcggcgagctgagcaaggacggcgacctgatcgtgagcatgagaatcctgggcaagaagagaaccaagacctggcacaagggcaccctgatcgccatccagaccgtgggccccggcaagaagtacaaggtgaagttcgacaacaagggcaagagcctgctgagcggcaaccacatcgcctacgactaccacccccccgccgacaagctgtacgtgggcagcagagtggtggccaagtacaaggacggcaaccaggtgtggctgtacgccggcatcgtggccgagacccccaacgtgaagaacaagctgagattcctgatcttcttcgacgacggctacgccagctacgtgacccagagcgagctgtaccccatctgcagacccctgaagaagacctgggaggacatcgaggacatcagctgcagagacttcatcgaggagtacgtgaccgcctaccccaacagacccatggtgctgctgaagagcggccagctgatcaagaccgagtgggagggcacctggtggaagagcagagtggaggaggtggacggcagcctggtgagaatcctgttcctggacgacaagagatgcgagtggatctacagaggcagcaccagactggagcccatgttcagcatgaagaccagcagcgccagcgccctggagaagaagcagggccagctgagaaccagacccaacatgggcgccgtgagaagcaagggccccgtggtgcagtacacccaggacctgaccggcaccggcacccagttcaagcccgtggagcccccccagcccaccgccccccccgccccccccttcccccccgccccccccctgagcccccaggccggcgacagcgacctggagagccagctggcccagagcagaaagcaggtggccaagaagagcaccagcttcagacccggcagcgtgggcagcggccacagcagccccaccagccccgccctgagcgagaacgtgagcggcggcaagcccggcatcaaccagacctacagaagccccctgggcagcaccgccagcgcccccgcccccagcgccctgcccgccccccccgccccccccgtgttccacggcatgctggagagagcccccgccgagcccagctacagagcccccatggagaagctgttctacctgccccacgtgtgcagctacacctgcctgagcagagtgagacccatgagaaacgagcagtacagaggcaagaaccccctgctggtgcccctgctgtacgacttcagaagaatgaccgccagaagaagagtgaacagaaagatgggcttccacgtgatctacaagaccccctgcggcctgtgcctgagaaccatgcaggagatcgagagatacctgttcgagaccggctgcgacttcctgttcctggagatgttctgcctggacccctacgtgctggtggacagaaagttccagccctacaagcccttctactacatcctggacatcacctacggcaaggaggacgtgcccctgagctgcgtgaacgagatcgacaccaccccccccccccaggtggcctacagcaaggagagaatccccggcaagggcgtgttcatcaacaccggccccgagttcctggtgggctgcgactgcaaggacggctgcagagacaagagcaagtgcgcctgccaccagctgaccatccaggccaccgcctgcacccccggcggccagatcaaccccaacagcggctaccagtacaagagactggaggagtgcctgcccaccggcgtgtacgagtgcaacaagagatgcaagtgcgaccccaacatgtgcaccaacagactggtgcagcacggcctgcaggtgagactgcagctgttcaagacccagaacaagggctggggcatcagatgcctggacgacatcgccaagggcagcttcgtgtgcatctacgccggcaagatcctgaccgacgacttcgccgacaaggagggcctggagatgggcgacgagtacttcgccaacctggaccacatcgagagcgtggagaacttcaaggagggctacgagagcgacgccccctgcagcagcgacagcagcggcgtggacctgaaggaccaggaggacggcaacagcggcaccgaggaccccgaggagagcaacgacgacagcagcgacgacaacttctgcaaggacgaggacttcagcaccagcagcgtgtggagaagctacgccaccagaagacagaccagaggccagaaggagaacggcctgagcgagaccaccagcaaggacagccacccccccgacctgggccccccccacatccccgtgccccccagcatccccgtgggcggctgcaacccccccagcagcgaggagacccccaagaacaaggtggccagctggctgagctgcaacagcgtgagcgagggcggcttcgccgacagcgacagccacagcagcttcaagaccaacgagggcggcgagggcagagccggcggcagcagaatggaggccgagaaggccagcaccagcggcctgggcatcaaggacgagggcgacatcaagcaggccaagaaggaggacaccgacgacagaaacaagatgagcgtggtgaccgagagcagcagaaactacggctacaaccccagccccgtgaagcccgagggcctgagaagaccccccagcaagaccagcatgcaccagagcagaagactgatggccagcgcccagagcaaccccgacgacgtgctgaccctgagcagcagcaccgagagcgagggcgagagcggcaccagcagaaagcccaccgccggccagaccagcgccaccgccgtggacagcgacgacatccagaccatcagcagcggcagcgagggcgacgacttcgaggacaagaagaacatgaccggccccatgaagagacaggtggccgtgaagagcaccagaggcttcgccctgaagagcacccacggcatcgccatcaagagcaccaacatggccagcgtggacaagggcgagagcgcccccgtgagaaagaacaccagacagttctacgacggcgaggagagctgctacatcatcgacgccaagctggagggcaacctgggcagatacctgaacgtgagacccctgagcccccccctggacgccggcctgagccacggcccccagatcagcttcaacatcctgtacaagcccttcagctgctacaagctgctgatcagcaagtag

SEQ ID NO: 98705 - DNA, 492 bp, Artificial Sequence
  Description of Artificial Sequence: Synthetic coding sequence
atgagcagcctgcccggctgcatcggcctggacgccgccaccgccaccgtggagagcgaggagatcgccgagctgcagcaggccgtggtggaggagctgggcatcagcatggaggagctgagacacttcatcgacgaggagctggagaagatggactgcgtgcagcagagaaagaagcagctggccgagctggagacctgggtgatccagaaggagagcgaggtggcccacgtggaccagctgttcgacgacgccagcagagccgtgaccaactgcgagagcctggtgaaggacttctacagcaagctgggcctgcagtacagagacagcagcagcgaggacgagagcagcagacccaccgagatcatcgagatccccgacgaggacgacgacgtgctgagcatcgacagcggcgacgccggcagcagaacccccaaggaccagaagctgagagaggccatggccgccctgagaaagagcgcccaggactag

SEQ ID NO: 98706 - DNA, 1911 bp, Artificial Sequence
  Description of Artificial Sequence: Synthetic coding sequence
atgagcagcctgcccggctgcatcggcctggacgccgccaccgccaccgtggagagcgaggagatcgccgagctgcagcaggccgtggtggaggagctgggcatcagcatggaggagctgagacacttcatcgacgaggagctggagaagatggactgcgtgcagcagagaaagaagcagctggccgagctggagacctgggtgatccagaaggagagcgaggtggcccacgtggaccagctgttcgacgacgccagcagagccgtgaccaactgcgagagcctggtgaaggacttctacagcaagctgggcctgcagtacagagacagcagcagcgaggacgagagcagcagacccaccgagatcatcgagatccccgacgaggacgacgacgtgctgagcatcgacagcggcgacgccggcagcagaacccccaaggaccagaagctgagagaggccatggccgccctgagaaagagcgcccaggacgtgcagaagttcatggacgccgtgaacaagaagagcagcagccaggacctgcacaagggcaccctgagccagatgagcggcgagctgagcaaggacggcgacctgatcgtgagcatgagaatcctgggcaagaagagaaccaagacctggcacaagggcaccctgatcgccatccagaccgtgggccccggcaagaagtacaaggtgaagttcgacaacaagggcaagagcctgctgagcggcaaccacatcgcctacgactaccacccccccgccgacaagctgtacgtgggcagcagagtggtggccaagtacaaggacggcaaccaggtgtggctgtacgccggcatcgtggccgagacccccaacgtgaagaacaagctgagattcctgatcttcttcgacgacggctacgccagctacgtgacccagagcgagctgtaccccatctgcagacccctgaagaagacctgggaggacatcgaggacatcagctgcagagacttcatcgaggagtacgtgaccgcctaccccaacagacccatggtgctgctgaagagcggccagctgatcaagaccgagtgggagggcacctggtggaagagcagagtggaggaggtggacggcagcctggtgagaatcctgttcctggacgacaagagatgcgagtggatctacagaggcagcaccagactggagcccatgttcagcatgaagaccagcagcgccagcgccctggagaagaagcagggccagctgagaaccagacccaacatgggcgccgtgagaagcaagggccccgtggtgcagtacacccaggacctgaccggcaccggcacccagttcaagcccgtggagcccccccagcccaccgccccccccgccccccccttcccccccgccccccccctgagcccccaggccggcgacagcgagagcctggagagccagctggcccagagcagaaagcaggtggccaagaagagcaccagcttcagacccggcagcgtgggcagcggccacagcagccccaccagccccgccctgagcgagaacgtgagcggcggcaagcccggcatcaaccagacctacagaagccccctgggcagcaccgccagcgcccccgcccccagcgccctgcccgccccccccgccccccccgtgttccacggcatgctggagagagcccccgccgagcccagctacagagcccccatggagaagctgttctacctgccccacgtgtgcagctacacctgcctgagcagagtgagacccatgagaaacgagcagtacagaggcaagaaccccctgctggtgcccctgctgtacgacttcagaagaatgaccgccagaagaagagtgaacagaaagatgggcttccacgtgatctacaagaccccctgcggcctgtgcctgtag

SEQ ID NO: 98707 - DNA, 2160 bp, Artificial Sequence
  Description of Artificial Sequence: Synthetic coding sequence
atgggcgagaagaacggcgacgccaagaccttctggatggagctggaggacgacggcaaggtggacttcatcttcgagcaggtgcagaacgtgctgcagagcctgaagcagaagatcaaggacggcagcgccaccaacaaggagtacatccaggccatgatcctggtgaacgaggccaccatcatcaacagcagcaccagcatcaagggcgccagccagaaggaggtgaacgcccagagcagcgaccccatgcccgtgacccagaaggagcaggagaacaagagcaacgccttccccagcaccagctgcgagaacagcttccccgaggactgcaccttcctgaccaccgagaacaaggagatcctgagcctggaggacaaggtggtggacttcagagagaaggacagcagcagcaacctgagctaccagagccacgactgcagcggcgcctgcctgatgaagatgcccctgaacctgaagggcgagaaccccctgcagctgcccatcaagtgccacttccagagaagacacgccaagaccaacagccacagcagcgccctgcacgtgagctacaagaccccctgcggcagaagcctgagaaacgtggaggaggtgttcagatacctgctggagaccgagtgcaacttcctgttcaccgacaacttcagcttcaacacctacgtgcagctggccagaaactaccccaagcagaaggaggtggtgagcgacgtggacatcagcaacggcgtggagagcgtgcccatcagcttctgcaacgagatcgacagcagaaagctgccccagttcaagtacagaaagaccgtgtggcccagagcctacaacctgaccaacttcagcagcatgttcaccgacagctgcgactgcagcgagggctgcatcgacatcaccaagtgcgcctgcctgcagctgaccgccagaaacgccaagaccagccccctgagcagcgacaagatcaccaccggctacaagtacaagagactgcagagacagatccccaccggcatctacgagtgcagcctgctgtgcaagtgcaacagacagctgtgccagaacagagtggtgcagcacggcccccaggtgagactgcaggtgttcaagaccgagcagaagggctggggcgtgagatgcctggacgacatcgacagaggcaccttcgtgtgcatctacagcggcagactgctgagcagagccaacaccgagaagagctacggcatcgacgagaacggcagagacgagaacaccatgaagaacatcttcagcaagaagagaaagctggaggtggcctgcagcgactgcgaggtggaggtgctgcccctgggcctggagacccaccccagaaccgccaagaccgagaagtgcccccccaagttcagcaacaaccccaaggagctgaccgtggagaccaagtacgacaacatcagcagaatccagtaccacagcgtgatcagagaccccgagagcaagaccgccatcttccagcacaacggcaagaagatggagttcgtgagcagcgagagcgtgacccccgaggacaacgacggcttcaagccccccagagagcacctgaacagcaagaccaagggcgcccagaaggacagcagcagcaaccacgtggacgagttcgaggacaacctgctgatcgagagcgacgtgatcgacatcaccaagtacagagaggagaccccccccagaagcagatgcaaccaggccaccaccctggacaaccagaacatcaagaaggccatcgaggtgcagatccagaagccccaggagggcagaagcaccgcctgccagagacagcaggtgttctgcgacgaggagctgctgagcgagaccaagaacaccagcagcgacagcctgaccaagttcaacaagggcaacgtgttcctgctggacgccaccaaggagggcaacgtgggcagattcctgaaccacagctgctgccccaacctgctggtgcagaacgtgttcgtggagacccacaacagaaacttccccctggtggccttcttcaccaacagatacgtgaaggccagaaccgagctgacctgggactacggctacgaggccggcaccgtgcccgagaaggagatcttctgccagtgcggcgtgaacaagtgcagaaagaagatcctgtag

SEQ ID NO: 98708 - DNA, 2124 bp, Artificial Sequence
  Description of Artificial Sequence: Synthetic coding sequence
atgggcgagaagaacggcgacgccaagaccttctggatggagctggaggacgacggcaaggtggacttcatcttcgagcaggtgcagaacgtgctgcagagcctgaagcagaagatcaaggacggcagcgccaccaacaaggagtacatccaggccatgatcctggtgaacgaggccaccatcatcaacagcagcaccagcatcaaggaccccatgcccgtgacccagaaggagcaggagaacaagagcaacgccttccccagcaccagctgcgagaacagcttccccgaggactgcaccttcctgaccaccgagaacaaggagatcctgagcctggaggacaaggtggtggacttcagagagaaggacagcagcagcaacctgagctaccagagccacgactgcagcggcgcctgcctgatgaagatgcccctgaacctgaagggcgagaaccccctgcagctgcccatcaagtgccacttccagagaagacacgccaagaccaacagccacagcagcgccctgcacgtgagctacaagaccccctgcggcagaagcctgagaaacgtggaggaggtgttcagatacctgctggagaccgagtgcaacttcctgttcaccgacaacttcagcttcaacacctacgtgcagctggccagaaactaccccaagcagaaggaggtggtgagcgacgtggacatcagcaacggcgtggagagcgtgcccatcagcttctgcaacgagatcgacagcagaaagctgccccagttcaagtacagaaagaccgtgtggcccagagcctacaacctgaccaacttcagcagcatgttcaccgacagctgcgactgcagcgagggctgcatcgacatcaccaagtgcgcctgcctgcagctgaccgccagaaacgccaagaccagccccctgagcagcgacaagatcaccaccggctacaagtacaagagactgcagagacagatccccaccggcatctacgagtgcagcctgctgtgcaagtgcaacagacagctgtgccagaacagagtggtgcagcacggcccccaggtgagactgcaggtgttcaagaccgagcagaagggctggggcgtgagatgcctggacgacatcgacagaggcaccttcgtgtgcatctacagcggcagactgctgagcagagccaacaccgagaagagctacggcatcgacgagaacggcagagacgagaacaccatgaagaacatcttcagcaagaagagaaagctggaggtggcctgcagcgactgcgaggtggaggtgctgcccctgggcctggagacccaccccagaaccgccaagaccgagaagtgcccccccaagttcagcaacaaccccaaggagctgaccgtggagaccaagtacgacaacatcagcagaatccagtaccacagcgtgatcagagaccccgagagcaagaccgccatcttccagcacaacggcaagaagatggagttcgtgagcagcgagagcgtgacccccgaggacaacgacggcttcaagccccccagagagcacctgaacagcaagaccaagggcgcccagaaggacagcagcagcaaccacgtggacgagttcgaggacaacctgctgatcgagagcgacgtgatcgacatcaccaagtacagagaggagaccccccccagaagcagatgcaaccaggccaccaccctggacaaccagaacatcaagaaggccatcgaggtgcagatccagaagccccaggagggcagaagcaccgcctgccagagacagcaggtgttctgcgacgaggagctgctgagcgagaccaagaacaccagcagcgacagcctgaccaagttcaacaagggcaacgtgttcctgctggacgccaccaaggagggcaacgtgggcagattcctgaaccacagctgctgccccaacctgctggtgcagaacgtgttcgtggagacccacaacagaaacttccccctggtggccttcttcaccaacagatacgtgaaggccagaaccgagctgacctgggactacggctacgaggccggcaccgtgcccgagaaggagatcttctgccagtgcggcgtgaacaagtgcagaaagaagatcctgtag

SEQ ID NO: 98709 - DNA, 975 bp, Artificial Sequence
  Description of Artificial Sequence: Synthetic coding sequence
atgagcagacccagcagcaccggccccagcgccaacaagccctgcagcaagcagccccccccccagccccagcacacccccagccccgccgccccccccgccgccgccaccatcagcgccgccggccccggcagcagcgccgtgcccgccgccgccgccgtgatcagcggccccggcggcggcggcggcgccggccccgtgagcccccagcaccacgagctgaccagcctgttcgagtgccccgtgtgcttcgactacgtgctgccccccatcctgcagtgccaggccggccacctggtgtgcaaccagtgcagacagaagctgagctgctgccccacctgcagaggcgccctgacccccagcatcagaaacctggccatggagaaggtggccagcgccgtgctgttcccctgcaagtacgccaccaccggctgcagcctgaccctgcaccacaccgagaagcccgagcacgaggacatctgcgagtacagaccctacagctgcccctgccccggcgccagctgcaagtggcagggcagcctggaggccgtgatgagccacctgatgcacgcccacaagagcatcaccaccctgcagggcgaggacatcgtgttcctggccaccgacatcaacctgcccggcgccgtggactgggtgatgatgcagagctgcttcggccaccacttcatgctggtgctggagaagcaggagaagtacgagggccaccagcagttcttcgccatcgtgctgctgatcggcaccagaaagcaggccgagaacttcgcctacagactggagctgaacggcaacagaagaagactgacctgggaggccacccccagaagcatccacgacggcgtggccgccgccatcatgaacagcgactgcctggtgttcgacaccgccatcgcccacctgttcgccgacaacggcaacctgggcatcaacgtgaccatcagcacctgctgcccctag

SEQ ID NO: 98710 - DNA, 990 bp, Artificial Sequence
  Description of Artificial Sequence: Synthetic coding sequence
atgatgagcaacagcagcagcgagatcgacgtgatcaagaccagaatccccacctacgacgaggacgacaacaccatcctgtacgcctacgagaccaagcccgagttcgtgaacaaggagcccaacatcgtgagcgacgccagctgcaacaccgaggagcagctgaagaccgtggacgacgtgctgatccactgccaggtgatctacgacgccctgcagaacctggacaagaagatcgacgtgatcagaagaaaggtgagcaagatccagagattccacgccagaagcctgtggaccaaccacaagagatacggctacaagaagcacagctacagactggtgaagaagctgaagctgcagaagatgaagaagaacgaggtgtacgagaccttcagctaccccgagagctacagccccaccctgcccgtgagcagaagagagaacaacagccccagcaacctgcccagacccagcttctgcatggaggagtaccagagagccgagctggaggaggaccccatcctgagcagaacccccagccccgtgcaccccagcgacttcagcgagcacaactgccagccctactacgccagcgacggcgccacctacggcagcagcagcggcctgtgcctgggcaaccccagagccgacagcatccacaacacctacagcaccgaccacgccagcgccgccccccccagcgtgaccagaagccccgtggagaacgacggctacatcgaggagggcagcatcaccaagcaccccagcacctggagcgtggaggccgtggtgctgttcctgaagcagaccgaccccctggccctgtgccccctggtggacctgttcagaagccacgagatcgacggcaaggccctgctgctgctgaccagcgacgtgctgctgaagcacctgggcgtgaagctgggcaccgccgtgaagctgtgctactacatcgacagactgaagcagggcaagtgcttcgagaactag

SEQ ID NO: 98711 - DNA, 909 bp, Artificial Sequence
  Description of Artificial Sequence: Synthetic coding sequence
atgatgagcaacagcagcagcgagatcgacgtgcaggagcccaacatcgtgagcgacgccagctgcaacaccgaggagcagctgaagaccgtggacgacgtgctgatccactgccaggtgatctacgacgccctgcagaacctggacaagaagatcgacgtgatcagaagaaaggtgagcaagatccagagattccacgccagaagcctgtggaccaaccacaagagatacggctacaagaagcacagctacagactggtgaagaagctgaagctgcagaagatgaagaagaacgaggtgtacgagaccttcagctaccccgagagctacagccccaccctgcccgtgagcagaagagagaacaacagccccagcaacctgcccagacccagcttctgcatggaggagtaccagagagccgagctggaggaggaccccatcctgagcagaacccccagccccgtgcaccccagcgacttcagcgagcacaactgccagccctactacgccagcgacggcgccacctacggcagcagcagcggcctgtgcctgggcaaccccagagccgacagcatccacaacacctacagcaccgaccacgccagcgccgccccccccagcgtgaccagaagccccgtggagaacgacggctacatcgaggagggcagcatcaccaagcaccccagcacctggagcgtggaggccgtggtgctgttcctgaagcagaccgaccccctggccctgtgccccctggtggacctgttcagaagccacgagatcgacggcaaggccctgctgctgctgaccagcgacgtgctgctgaagcacctgggcgtgaagctgggcaccgccgtgaagctgtgctactacatcgacagactgaagcagggcaagtgcttcgagaactag

SEQ ID NO: 98712 - DNA, 627 bp, Artificial Sequence
  Description of Artificial Sequence: Synthetic coding sequence
atgaagaagaacgaggtgtacgagaccttcagctaccccgagagctacagccccaccctgcccgtgagcagaagagagaacaacagccccagcaacctgcccagacccagcttctgcatggaggagtaccagagagccgagctggaggaggaccccatcctgagcagaacccccagccccgtgcaccccagcgacttcagcgagcacaactgccagccctactacgccagcgacggcgccacctacggcagcagcagcggcctgtgcctgggcaaccccagagccgacagcatccacaacacctacagcaccgaccacgccagcgccgccccccccagcgtgaccagaagccccgtggagaacgacggctacatcgaggagggcagcatcaccaagcaccccagcacctggagcgtggaggccgtggtgctgttcctgaagcagaccgaccccctggccctgtgccccctggtggacctgttcagaagccacgagatcgacggcaaggccctgctgctgctgaccagcgacgtgctgctgaagcacctgggcgtgaagctgggcaccgccgtgaagctgtgctactacatcgacagactgaagcagggcaagtgcttcgagaactag

SEQ ID NO: 98713 - DNA, 627 bp, Artificial Sequence; identical to SEQ ID NO: 98712
  Description of Artificial Sequence: Synthetic coding sequence

SEQ ID NO: 98714 - DNA, 447 bp, Artificial Sequence
  Description of Artificial Sequence: Synthetic coding sequence
atgatgagcaacagcagcagcgagatcgacgtgcaggagcccaacatcgtgagcgacgccagctgcaacaccgaggagcagctgaagaccgtggacgacgtgctgatccactgccaggtgatctacgacgccctgcagaacctggacaagaagatcgacgtgatcagaagaaaggtgagcaagatccagagattccacgccagaagcctgtggaccaaccacaagagatacggctacaagaagcacagctacagactggtgaagaagctgaagctgcagaagatgaagaagaacgaggtgtacgagaccttcagctaccccgagagctacagccccaccctgcccgtgagcagaagagagaacaacagccccagcaacctgcccagacccagcttctgcatggaggagtaccagagagccgagctggaggaggaccccatcctgtag

SEQ ID NO: 98715 - DNA, 2103 bp, Artificial Sequence
  Description of Artificial Sequence: Synthetic coding sequence
atgggccagaccgtgaacgaggacagcatggacgtgaagaaggagaaccaggagaagaccccccagagcagcaccagcagcgtgcagagagacgacttccactgggaggagtacctgaaggagaccggcagcatcagcgcccccagcgagtgcttcagacagagccagatcccccccgtgaacgacttcaaggtgggcatgaagctggaggccagagaccccagaaacgccaccagcgtgtgcatcgccaccgtgatcggcatcaccggcgccagactgagactgagactggacggcagcgacaacagaaacgacttctggagactggtggacagccccgacatccagcccgtgggcacctgcgagaaggagggcgacctgctgcagccccccctgggctaccagatgaacaccagcagctggcccatgttcctgctgaagaccctgaacggcagcgagatggccagcgccaccctgttcaagaaggagccccccaagccccccctgaacaacttcaaggtgggcatgaagctggaggccatcgacaagaagaacccctacctgatctgccccgccaccatcggcgacgtgaagggcgacgaggtgcacatcaccttcgacggctggagcggcgccttcgactactggtgcaagtacgacagcagagacatcttccccgccggctggtgcagactgaccggcgacgtgctgcagccccccggcaccagcgtgcccatcgtgaagaacatcgccaagaccgagagcagccccagcgaggccagccagcacagcatgcagagcccccagaagaccaccctgatcctgcccacccagcaggtgagaagaagcagcagaatcaagccccccggccccaccgccgtgcccaagagaagcagcagcgtgaagaacatcacccccagaaagaagggccccaacagcggcaagaaggagaagcccctgcccgtgatctgcagcaccagcgccgccagcctgaagagcctgaccagagacagaggcatgctgtacaaggacgtggccagcggcccctgcaagatcgtgatgagcaccgtgtgcgtgtacgtgaacaagcacggcaacttcggcccccacctggaccccaagagaatccagcagctgcccgaccacttcggccccggccccgtgaacgtggtgctgagaagaatcgtgcaggcctgcgtggactgcgccctggagaccaagaccgtgttcggctacctgaagcccgacaacagaggcggcgaggtgatcaccgccagcttcgacggcgagacccacagcatccagctgccccccgtgaacagcgccagcttcgccctgagattcctggagaacttctgccacagcctgcagtgcgacaacctgctgagcagccagcccttcagcagcagcagaggccacacccacagcagcgccgagcacgacaagaaccagagcgccaaggaggacgtgaccgagagacagagcaccaagagaagcccccagcagaccgtgccctacgtggtgcccctgagccccaagctgcccaagaccaaggagtacgccagcgagggcgagcccctgttcgccggcggcagcgccatccccaaggaggagaacctgagcgaggacagcaagagcagcagcctgaacagcggcaactacctgaaccccgcctgcagaaaccccatgtacatccacaccagcgtgagccaggacttcagcagaagcgtgcccggcaccaccagcagccccctggtgggcgacatcagccccaagagcagcccccacgaggtgaagttccagatgcagagaaagagcgaggcccccagctacatcgccgtgcccgaccccagcgtgctgaagcagggcttcagcaaggaccccagcacctggagcgtggacgaggtgatccagttcatgaagcacaccgacccccagatcagcggccccctggccgacctgttcagacagcacgagatcgacggcaaggccctgttcctgctgaagagcgacgtgatgatgaagtacatgggcctgaagctgggccccgccctgaagctgtgctactacatcgagaagctgaaggagggcaagtacagctag

SEQ ID NO: 98716 - DNA, 1038 bp, Artificial Sequence
  Description of Artificial Sequence: Synthetic coding sequence
atgcagagcccccagaagaccaccctgatcctgcccacccagcaggtgagaagaagcagcagaatcaagccccccggccccaccgccgtgcccaagagaagcagcagcgtgaagaacatcacccccagaaagaagggccccaacagcggcaagaaggagaagcccctgcccgtgatctgcagcaccagcgccgccagcctgaagagcctgaccagagacagaggcatgctgtacaaggacgtggccagcggcccctgcaagatcgtgatgagcaccgtgtgcgtgtacgtgaacaagcacggcaacttcggcccccacctggaccccaagagaatccagcagctgcccgaccacttcggccccggccccgtgaacgtggtgctgagaagaatcgtgcaggcctgcgtggactgcgccctggagaccaagaccgtgttcggctacctgaagcccgacaacagaggcggcgaggtgatcaccgccagcttcgacggcgagacccacagcatccagctgccccccgtgaacagcgccagcttcgccctgagattcctggagaacttctgccacagcctgcagtgcgacaacctgctgagcagccagcccttcagcagcagcagaggccacacccacagcagcgccgagcacgacaagaaccagagcgccaaggaggacgtgaccgagagacagagcaccaagagaagcccccagcagaccgtgccctacgtggtgcccctgagccccaagctgcccaagaccaaggagtacgccagcgagggcgagcccctgttcgccggcggcagcgccatccccaaggaggagaacctgagcgaggacagcaagagcagcagcctgaacagcggcaactacctgaaccccgcctgcagaaaccccatgtacatccacaccagcgtgagccaggacttcagcagaagcgtgcccggcaccaccagcagccccctggtgggcgacatcagccccaagagcagcccccacgaggtgaagttccagatgcagagaaagagcgagggcaactag

SEQ ID NO: 98717 - DNA, 378 bp, Artificial Sequence
  Description of Artificial Sequence: Synthetic coding sequence
tgagccaaggaggacgtgaccgagagacagagcaccaagagaagcccccagcagaccgtgccctacgtggtgcccctgagccccaagctgcccaagaccaaggagtacgccagcgagggcgagcccctgttcgccggcggcagcgccatccccaaggaggagaacctgagcgaggacagcaagagcagcagcctgaacagcggcaactacctgaaccccgcctgcagaaaccccatgtacatccacaccagcgtgagccaggacttcagcagaagcgtgcccggcaccaccagcagccccctggtgggcgacatcagccccaagagcagcccccacgaggtgaagttccagatgcagagaaagagcgagggcaactag

SEQ ID NO: 98718 - DNA, 1734 bp, Artificial Sequence
  Description of Artificial Sequence: Synthetic coding sequence
atgggccagaccgtgaacgaggacagcatggacgtgaagaaggagaaccaggagaagaccccccagagccagatcccccccgtgaacgacttcaaggtgggcatgaagctggaggccagagaccccagaaacgccaccagcgtgtgcatcgccaccgtgatcggcatcaccggcgccagactgagactgagactggacggcagcgacaacagaaacgacttctggagactggtggacagccccgacatccagcccgtgggcacctgcgagaaggagggcgacctgctgcagccccccctgggctaccagatgaacaccagcagctggcccatgttcctgctgaagaccctgaacggcagcgagatggccagcgccaccctgttcaagaaggagccccccaagccccccctgaacaacttcaaggtgggcatgaagctggaggccatcgacaagaagaacccctacctgatctgccccgccaccatcggcgacgtgaagggcgacgaggtgcacatcaccttcgacggctggagcggcgccttcgactactggtgcaagtacgacagcagagacatcttccccgccggctggtgcagactgaccggcgacgtgctgcagccccccggcaccagcgtgcccatcgtgaagaacatcgccaagaccgagagcagccccagcgaggccagccagcacagcatgcagagcccccagaagaccaccctgatcctgcccacccagcaggtgagaagaagcagcagaatcaagccccccggccccaccgccgtgcccaagagaagcagcagcgtgaagaacatcacccccagaaagaagggccccaacagcggcaagaaggagaagcccctgcccgtgatctgcagcaccagcgccgccagcctgaagagcctgaccagagacagaggcatgctgtacaaggacgtggccagcggcccctgcaagatcgtgatgagcaccgtgtgcgtgtacgtgaacaagcacggcaacttcggcccccacctggaccccaagagaatccagcagctgcccgaccacttcggccccggccccgtgaacgtggtgctgagaagaatcgtgcaggcctgcgtggactgcgccctggagaccaagaccgtgttcggctacctgaagcccgacaacagaggcggcgaggtgatcaccgccagcttcgacggcgagacccacagcatccagctgccccccgtgaacagcgccagcttcgccctgagattcctggagaacttctgccacagcctgcagtgcgacaacctgctgagcagccagcccttcagcagcagcagaggccacacccacagcagcgccgagcacgacaagaaccagagcgccaaggaggacgtgaccgagagacagagcaccaagagaagcccccagcagaccgtgccctacgtggtgcccctgagccccaagctgcccaagaccaaggagtacgccagcgagggcgagcccctgttcgccggcggcagcgccatccccaaggaggagaacctgagcgaggacagcaagagcagcagcctgaacagcggcaactacctgaaccccgcctgcagaaaccccatgtacatccacaccagcgtgagccaggacttcagcagaagcgtgcccggcaccaccagcagccccctggtgggcgacatcagccccaagagcagcccccacgaggtgaagttccagatgcagagaaagagcgagggcaactag

SEQ ID NO: 98719 - DNA, 615 bp, Artificial Sequence
  Description of Artificial Sequence: Synthetic coding sequence
atgcagagctacgccagcgccatgctgagcgtgttcaacagcgacgactacagccccgccgtgcaggagaacatccccgccctgagaagaagcagcagcttcctgtgcaccgagagctgcaacagcaagtaccagtgcgagaccggcgagaacagcaagggcaacgtgcaggacagagtgaagagacccatgaacgccttcatcgtgtggagcagagaccagagaagaaagatggccctggagaaccccagaatgagaaacagcgagatcagcaagcagctgggctaccagtggaagatgctgaccgaggccgagaagtggcccttcttccaggaggcccagaagctgcaggccatgcacagagagaagtaccccaactacaagtacagacccagaagaaaggccaagatgctgcccaagaactgcagcctgctgcccgccgaccccgccagcgtgctgtgcagcgaggtgcagctggacaacagactgtacagagacgactgcaccaaggccacccacagcagaatggagcaccagctgggccacctgccccccatcaacgccgccagcagcccccagcagagagacagatacagccactggaccaagctgtag

SEQ ID NO: 98720 - DNA, 594 bp, Artificial Sequence
  Description of Artificial Sequence: Synthetic coding sequence
atgcagagctacgccagcgccatgctgagcgtgttcaacagcgacgactacagccccgccgtgcaggagaacatccccgccctgagaagaagcagcagcttcctgtgcaccgagagctgcaacagcaagtaccagtgcgagaccggcgagaacagcaagggcaacgtgcaggacagagtgaagagacccatgaacgccttcatcgtgtggagcagagaccagagaagaaagatggccctggagaaccccagaatgagaaacagcgagatcagcaagcagctgggctaccagtggaagatgctgaccgaggccgagaagtggcccttcttccaggaggcccagaagctgcaggccatgcacagagagaagtaccccaactacaagtacagacccagaagaaaggccaagatgctgcccaagaactgcagcctgctgcccgccgaccccgccagcgtgctgtgcagcgaggtgcagctggacaacagactgtacagagacgactgcaccaaggccacccacagcagaatggagcaccagctgggccacctgccccccatcaacgccgccagcgccgccaccggccccctgcagtag

SEQ ID NO: 98721 - DNA, 498 bp, Artificial Sequence
  Description of Artificial Sequence: Synthetic coding sequence
atgcagagctacgccagcgccatgctgagcgtgttcaacagcgacgactacagccccgccgtgcaggagaacatccccgccctgagaagaagcagcagcttcctgtgcaccgagagctgcaacagcaagtaccagtgcgagaccggcgagaacagcaagggcaacgtgcaggacagagtgaagagacccatgaacgccttcatcgtgtggagcagagaccagagaagaaagatggccctggagaaccccagaatgagaaacagcgagatcagcaagcagctgggctaccagtggaagatgctgaccgaggccgagaagtggcccttcttccaggaggcccagaagctgcaggccatgcacagagagaagtaccccaactacaagtacagacccagaagaaaggccaagatgctgcccaagaactgcagcctgctgcccgccgaccccgccagcgtgctgtgcagcgaggtgcagggccagcaggtggtgcagggctag

SEQ ID NO: 98722 - DNA, 3729 bp, Artificial Sequence
  Description of Artificial Sequence: Synthetic coding sequence
atgaagaacctgctgaccgagaagtgcatcagcagccacaacttccaccagaaggtgatcaagcagagaatggagaagaaggtggacagcagatacttcaaggacggcgccgtgaagaagccctacagcgccaagaccctgagcaacaagaagagcagcgccagcttcggcatcagaagagagctgcccagcaccagccacctggtgcagtacagaggcacccacacctgcaccagacagggcagactgagagagctgagaatcagatgcgtggccagaaagttcctgtacctgtggatcagaatgaccttcggcagagtgttccccagcaaggccagattctactacgagcagagactgctgagaaaggtgttcgaggagtggaaggaggagtggtgggtgttccagcacgagtggaagctgtgcgtgagagccgactgccactacagatactacctgtacaacctgatgttccagacctggaagacctacgtgagacagcagcaggagatgagaaacaagtacatcagagccgaggtgcacgacgccaagcagaagatgagacaggcctggaagagctggctgatctacgtggtggtgagaagaaccaagctgcagatgcagaccaccgccctggagttcagacagagaatcatcctgagagtgtggtggagcacctggagacagagactgggccaggtgagagtgagcagagccctgcacgccagcgccctgaagcacagagccctgagcctgcaggtgcaggcctggagccagtggagagagcagctgctgtacgtgcagaaggagaagcagaaggtggtgagcgccgtgaagcaccaccagcactggcagaagagaagattcctgaaggcctggctggagtacctgcaggtgagaagagtgaagagacagcagaacgagatggccgagagattccaccacgtgaccgtgctgcagatctacttctgcgactggcagcaggcctgggagagaagagagagcctgtacgcccaccacgcccaggtggagaagctggccagaaagatggccctgagaagagccttcacccactggaagcactacatgctgctgtgcgccgaggaggccgcccagttcgagatggccgaggagcaccacagacacagccagctgtacttctgcttcagagccctgaaggacaacgtgacccacgcccacctgcagcagatcagaagaaacctggcccaccagcagcacggcgtgaccctgctgcacagattctggaacctgtggagaagccagatcgagcagaagaaggagagagagctgctgcccctgctgcacgccgcctgggaccactacagaatcgccctgctgtgcaagtgcatcgagctgtggctgcagtacacccagaagagaagatacaagcagctgctgcaggccagagccgacggccacttccagcagagagccctgcccgccgccttccacacctggaacagactgtggagatggagacaccaggagaacgtgctgagcgccagagccaccagattccacagagagaccctggagaagcaggtgttcagcctgtggagacagaagatgttccagcacagagagaacagactggccgagagaatggccatcctgcacgccgagagacagctgctgtacagaagctggttcatgtggcaccagcaggccgccgccagacaccaggagcaggagtggcagaccgtggcctgcgcccaccacagacacggcagactgaagaaggccttctgcctgtggagagagagcgcccagggcctgagaaccgagagaaccggcagagtgagagccgccgagttccacatggcccagctgctgagatgggcctggagccagtggagagagtgcctggccctgagaggcgccgagagacagaagctgatgagagccgacctgcaccaccagcacagcgtgctgcacagagccctgcaggcctgggtgacctaccagggcagagtgagaagcatcctgagagaggtggccgccagagagagccagcacaacagacagctgctgagaggcgccctgagaagatggaaggagaacaccatggccagagtggacgaggccaagaagaccttccaggccagcacccactacagaagaaccatctgcagcaaggtgctggtgcagtggagagaggccgtgagcgtgcagatgtactacagacagcaggaggactgcgccatctgggaggcccagaaggtgctggacagaggctgcctgagaacctggttccagagatggtgggactgcagcagaagaagcgcccagcagagactgcagctggagagagccgtgcagcaccaccacagacagctgctgctggagggcctggccagatggaagacccaccacctgcagtgcgtgagaaagagactgctgcacagacagagcacccagctgctggcccagagactgagcagaacctgcttcagacagtggagacagcagctggccgccagaagacaggagcagagagccaccgtgagagccctgtggttctgggccttcagcctgcaggccaaggtgtgggccacctggctggccttcgtgctggagagaagaagaaagaaggccagactgcagtgggccctgcaggcctaccagggccagctgctgcaggagggcgccaccagactgctgagattcgccgccagcatgaaggccagcagacagcagctgcaggcccagcagcaggtgcaggccgcccacagcctgcacagagccgtgagaagatgcgccaccctgtggaagcagaaggtgctgggcagaggcggcaagccccagcccctggccgccatcgcccccagcagaaaggtgaccttcgagggccccctgctgaacagaatcgccgccggcgccggcgacggcaccctggagaccaagagaccccaggccagcagacccctgggcgccctgggcagactggccgccgaggagccccacgccctggagctgaacaccgcccacagcgccagaaagcagcccagaagaccccacttcctgctggagcccgcccagagccagagaccccagaagccccaggagcacggcctgggcatggcccagcccgccgcccccagcctgaccagacccttcctggccgaggcccccaccgccctggtgccccacagccccctgcccggcgccctgagcagcgcccccggccccaagcagccccccaccgccagcaccggccccgagctgctgctgctgcccctgagcagcttcatgccctgcggcgccgccgcccccgccagagtgagcgcccagagagccacccccagagacaagccccccgtgcccagcagcctggccagcgtgcccgacccccacctgctgctgcccggcgacttcagcgccaccagagccggccccggcctgagcaccgccggcagcctggacctggaggccgagctggaggagatccagcagcagctgctgcactaccagaccaccaagcagaacctgtggagctgcagaagacaggccagcagcctgagaagatggctggagctgaacagagaggagcccggccccgaggaccaggaggtggagcagcaggtgcagaaggagctggagcaggtggagatgcagatccagctgctggccgaggagctgcaggcccagagacagcccatcggcgcctgcgtggccagaatccaggccctgagacaggccctgtgctag

SEQ ID NO: 98723 - DNA, 3483 bp, Artificial Sequence
  Description of Artificial Sequence: Synthetic coding sequence
atgaagaacctgctgaccgagaagtgcatcagcagccacaacttccaccagaaggtgatcaagcagagaatggagaagaaggtggacagcagattctactacgagcagagactgctgagaaaggtgttcgaggagtggaaggaggagtggtgggtgttccagcacgagtggaagctgtgcgtgagagccgactgccactacagatactacctgtacaacctgatgttccagacctggaagacctacgtgagacagcagcaggagatgagaaacaagtacatcagagccgaggtgcacgacgccaagcagaagatgagacaggcctggaagagctggctgatctacgtggtggtgagaagaaccaagctgcagatgcagaccaccgccctggagttcagacagagaatcatcctgagagtgtggtggagcacctggagacagagactgggccaggtgagagtgagcagagccctgcacgccagcgccctgaagcacagagccctgagcctgcaggtgcaggcctggagccagtggagagagcagctgctgtacgtgcagaaggagaagcagaaggtggtgagcgccgtgaagcaccaccagcactggcagaagagaagattcctgaaggcctggctggagtacctgcaggtgagaagagtgaagagacagcagaacgagatggccgagagattccaccacgtgaccgtgctgcagatctacttctgcgactggcagcaggcctgggagagaagagagagcctgtacgcccaccacgcccaggtggagaagctggccagaaagatggccctgagaagagccttcacccactggaagcactacatgctgctgtgcgccgaggaggccgcccagttcgagatggccgaggagcaccacagacacagccagctgtacttctgcttcagagccctgaaggacaacgtgacccacgcccacctgcagcagatcagaagaaacctggcccaccagcagcacggcgtgaccctgctgcacagattctggaacctgtggagaagccagatcgagcagaagaaggagagagagctgctgcccctgctgcacgccgcctgggaccactacagaatcgccctgctgtgcaagtgcatcgagctgtggctgcagtacacccagaagagaagatacaagcagctgctgcaggccagagccgacggccacttccagcagagagccctgcccgccgccttccacacctggaacagactgtggagatggagacaccaggagaacgtgctgagcgccagagccaccagattccacagagagaccctggagaagcaggtgttcagcctgtggagacagaagatgttccagcacagagagaacagactggccgagagaatggccatcctgcacgccgagagacagctgctgtacagaagctggttcatgtggcaccagcaggccgccgccagacaccaggagcaggagtggcagaccgtggcctgcgcccaccacagacacggcagactgaagaaggccttctgcctgtggagagagagcgcccagggcctgagaaccgagagaaccggcagagtgagagccgccgagttccacatggcccagctgctgagatgggcctggagccagtggagagagtgcctggccctgagaggcgccgagagacagaagctgatgagagccgacctgcaccaccagcacagcgtgctgcacagagccctgcaggcctgggtgacctaccagggcagagtgagaagcatcctgagagaggtggccgccagagagagccagcacaacagacagctgctgagaggcgccctgagaagatggaaggagaacaccatggccagagtggacgaggccaagaagaccttccaggccagcacccactacagaagaaccatctgcagcaaggtgctggtgcagtggagagaggccgtgagcgtgcagatgtactacagacagcaggaggactgcgccatctgggaggcccagaaggtgctggacagaggctgcctgagaacctggttccagagatggtgggactgcagcagaagaagcgcccagcagagactgcagctggagagagccgtgcagcaccaccacagacagctgctgctggagggcctggccagatggaagacccaccacctgcagtgcgtgagaaagagactgctgcacagacagagcacccagctgctggcccagagactgagcagaacctgcttcagacagtggagacagcagctggccgccagaagacaggagcagagagccaccgtgagagccctgtggttctgggccttcagcctgcaggccaaggtgtgggccacctggctggccttcgtgctggagagaagaagaaagaaggccagactgcagtgggccctgcaggcctaccagggccagctgctgcaggagggcgccaccagactgctgagattcgccgccagcatgaaggccagcagacagcagctgcaggcccagcagcaggtgcaggccgcccacagcctgcacagagccgtgagaagatgcgccaccctgtggaagcagaaggtgctgggcagaggcggcaagccccagcccctggccgccatcgcccccagcagaaaggtgaccttcgagggccccctgctgaacagaatcgccgccggcgccggcgacggcaccctggagaccaagagaccccaggccagcagacccctgggcgccctgggcagactggccgccgaggagccccacgccctggagctgaacaccgcccacagcgccagaaagcagcccagaagaccccacttcctgctggagcccgcccagagccagagaccccagaagccccaggagcacggcctgggcatggcccagcccgccgcccccagcctgaccagacccttcctggccgaggcccccaccgccctggtgccccacagccccctgcccggcgccctgagcagcgcccccggccccaagcagccccccaccgccagcaccggccccgagctgctgctgctgcccctgagcagcttcatgccctgcggcgccgccgcccccgccagagtgagcgcccagagagccacccccagagacaagccccccgtgcccagcagcctggccagcgtgcccgacccccacctgctgctgcccggcgacttcagcgccaccagagccggccccggcctgagcaccgccggcagcctggacctggaggccgagctggaggagatccagcagcagctgctgcactaccagaccaccaagcagaacctgtggagctgcagaagacaggccagcagcctgagaagatggctggagctgaacagagaggagcccggccccgaggaccaggaggtggagcagcaggtgcagaaggagctggagcaggtggagatgcagatccagctgctggccgaggagctgcaggcccagagacagcccatcggcgcctgcgtggccagaatccaggccctgagacaggccctgtgctag

SEQ ID NO: 98724 - DNA, 3096 bp, Artificial Sequence
  Description of Artificial Sequence: Synthetic coding sequence
atgaagaacctgctgaccgagaagtgcatcagcagccacaacttccaccagaaggtgatcaagcagagaatggagaagaaggtggacagcagattctactacgagcagagactgctgagaaaggtgttcgaggagtggaaggaggagtggtgggtgttccagcacgagtggaagctgtgcgtgagagccgactgccactacagagtgtggtggagcacctggagacagagactgggccaggtgagagtgagcagagccctgcacgccagcgccctgaagcacagagccctgagcctgcaggtgcaggcctggagccagtggagagagcagctgctgtacgtgcagaaggagaagcagaaggtggtgagcgccgtgaagcaccaccagcactggcagaagagaagattcctgaaggcctggctggagtacctgcaggtgagaagagtgaagagacagcagaacgagatggccgagagattccaccacgtgaccgtgctgcagatctacttctgcgactggcagcaggcctgggagagaagagagagcctgtacgcccaccacgcccaggtggagaagctggccagaaagatggccctgagaagagccttcacccactggaagcactacatgctgctgtgcgccgaggaggccgcccagttcgagatggccgaggagcaccacagacacagccagctgtacttctgcttcagagccctgaaggacaacgtgacccacgcccacctgcagcagatcagaagaaacctggcccaccagcagcacggcgtgaccctgctgcacagattctggaacctgtggagaagccagatcgagcagaagaaggagagagagctgctgcccctgctgcacgccgcctgggaccactacagaatcgccctgctgtgcaagtgcatcgagctgtggctgcagtacacccagaagagaagatacaagcagctgctgcaggccagagccgacggccacttccagcagagagccctgcccgccgccttccacacctggaacagactgtggagatggagacaccaggagaacgtgctgagcgccagagccaccagattccacagagagaccctggagaagcaggtgttcagcctgtggagacagaagatgttccagcacagagagaacagactggccgagagaatggccatcctgcacgccgagagacagctgctgtacagaagctggttcatgtggcaccagcaggccgccgccagacaccaggagcaggagtggcagaccgtggcctgcgcccaccacagacacggcagactgaagaaggccttctgcctgtggagagagagcgcccagggcctgagaaccgagagaaccggcagagtgagagccgccgagttccacatggcccagctgctgagatgggcctggagccagtggagagagtgcctggccctgagaggcgccgagagacagaagctgatgagagccgacctgcaccaccagcacagcgtgctgcacagagccctgcaggcctgggtgacctaccagggcagagtgagaagcatcctgagagaggtggccgccagagagagccagcacaacagacagctgctgagaggcgccctgagaagatggaaggagaacaccatggccagagtggacgaggccaagaagaccttccaggccagcacccactacagaagaaccatctgcagcaaggtgctggtgcagtggagagaggccgtgagcgtgcagatgtactacagacagcaggaggactgcgccatctgggaggcccagaaggtgctggacagaggctgcctgagaacctggttccagagatggtgggactgcagcagaagaagcgcccagcagagactgcagctggagagagccgtgcagcaccaccacagacagctgctgctggagggcctggccagatggaagacccaccacctgcagtgcgtgagaaagagactgctgcacagacagagcacccagctgctggcccagagactgagcagaacctgcttcagacagtggagacagcagctggccgccagaagacaggagcagagagccaccgtgagagccctgtggttctgggccttcagcctgcaggccaaggtgtgggccacctggctggccttcgtgctggagagaagaagaaagaaggccagactgcagtgggccctgcaggcctaccagggccagctgctgcaggagggcgccaccagactgctgagattcgccgccagcatgaaggccagcagacagcagctgcaggcccagcagcaggtgcaggccgcccacagcctgcacagagccgtgagaagatgcgccaccctgtggaagcagaaggtgctgggcagaggcggcaagccccagcccctggccgccatcgcccccagcagaaaggtgaccttcgagggccccctgctgaacagaatcgccgccggcgccggcgacggcaccctggagaccaagagaccccaggccagcagacccctgggcgccctgggcagactggccgccgaggagccccacgccctggagctgaacaccgcccacagcgccagaaagcagcccagaagaccccacttcctgctggagcccgcccagagccagagaccccagaagccccaggagcacggcctgggcatggcccagcccgccgcccccagcctgaccagacccttcctggccgaggcccccaccgccctggtgccccacagccccctgcccggcgccctgagcagcgcccccggccccaagcagccccccaccgccagcaccggccccgagctgctgctgctgcccctgagcagcttcatgccctgcggcgccgccgcccccgccagagtgagcgcccagagagccacccccagagacaagccccccgtgcccagcagcctggccagcgtgcccgacccccacctgctgctgcccggcgacttcagcgccaccagagccggccccggcctgagcaccgccgcctggaccctgagactgaacctgagaagaagcagcagcaactactgcaccaccagaccccccagcagaaccagcggccccgtgggcggcaagagagccgcctgcgccggcggctggagctag

SEQ ID NO: 98725 - DNA, 2976 bp, Artificial Sequence
  Description of Artificial Sequence: Synthetic coding sequence
atgaagaacctgctgaccgagaagtgcatcagcagccacaacttccaccagaaggtgatcaagcagagaatggagaagaaggtggacagcagatacttcaaggacggcgccgtgaagaagccctacagcgccaagaccctgagcaacaagaagagcagcgccagcttcggcatcagaagagagctgcccagcaccagccacctggtgcagtacagaggcacccacacctgcaccagacagggcagactgagagagctgagaatcagattctactacgagcagagactgctgagaaaggtgttcgaggagtggaaggaggagtggtgggtgttccagcacgagtggaagctgtgcgtgagagccgactgccactacagatactacctgtacaacctgatgttccagacctggaagacctacgtgagacagcagcaggagatgagaaacaagtacatcagagccgaggtgcacgacgccaagcagaagatgagacaggcctggaagagctggctgatctacgtggtggtgagaagaaccaagctgcagatgcagaccaccgccctggagttcagacagagaatcatcctgagagtgtggtggagcacctggagacagagactgggccaggtgagagtgagcagagccctgcacgccagcgccctgaagcacagagccctgagcctgcaggtgcaggcctggagccagtggagagagcagctgctgtacgtgcagaaggagaagcagaaggtggtgagcgccgtgaagcaccaccagcactggcagaagagaagattcctgaaggcctggctggagtacctgcaggtgagaagagtgaagagacagcagaacgagatggccgagagattccaccacgtgaccgtgctgcagatctacttctgcgactggcagcaggcctgggagagaagagagagcctgtacgcccaccacgcccaggtggagaagctggccagaaagatggccctgagaagagccttcacccactggaagcactacatgctgctgtgcgccgaggaggccgcccagttcgagatggccgaggagcaccacagacacagccagctgtacttctgcttcagagccctgaaggacaacgtgacccacgcccacctgcagcagatcagaagaaacctggcccaccagcagcacggcgtgaccctgctgcacagattctggaacctgtggagaagccagatcgagcagaagaaggagagagagctgctgcccctgctgcacgccgcctgggaccactacagaatcgccctgctgtgcaagtgcatcgagctgtggctgcagtacacccagaagagaagatacaagcagctgctgcaggccagagccgacggccacttccagcagagagccctgcccgccgccttccacacctggaacagactgtggagatggagacaccaggagaacgtgctgagcgccagagccaccagattccacagagagaccctggagaagcaggtgttcagcctgtggagacagaagatgttccagcacagagagaacagactggccgagagaatggccatcctgcacgccgagagacagctgctgtacagaagctggttcatgtggcaccagcaggccgccgccagacaccaggagcaggagtggcagaccgtggcctgcgcccaccacagacacggcagactgaagaaggccttctgcctgtggagagagagcgcccagggcctgagaaccgagagaaccggcagagtgagagccgccgagttccacatggcccagctgctgagatgggcctggagccagtggagagagtgcctggccctgagaggcgccgagagacagaagctgatgagagccgacctgcaccaccagcacagcgtgctgcacagagccctgcaggcctgggtgacctaccagggcagagtgagaagcatcctgagagaggtggccgccagagagagccagcagctgcaggcccagcagcaggtgcaggccgcccacagcctgcacagagccgtgagaagatgcgccaccctgtggaagcagaaggtgctgggcagaggcggcaagccccagcccctggccgccatcgcccccagcagaaaggtgaccttcgagggccccctgctgaacagaatcgccgccggcgccggcgacggcaccctggagaccaagagaccccaggccagcagacccctgggcgccctgggcagactggccgccgaggagccccacgccctggagctgaacaccgcccacagcgccagaaagcagcccagaagaccccacttcctgctggagcccgcccagagccagagaccccagaagccccaggagcacggcctgggcatggcccagcccgccgcccccagcctgaccagacccttcctggccgaggcccccaccgccctggtgccccacagccccctgcccggcgccctgagcagcgcccccggccccaagcagccccccaccgccagcaccggccccgagctgctgctgctgcccctgagcagcttcatgccctgcggcgccgccgcccccgccagagtgagcgcccagagagccacccccagagacaagccccccgtgcccagcagcctggccagcgtgcccgacccccacctgctgctgcccggcgacttcagcgccaccagagccggccccggcctgagcaccgccggcagcctggacctggaggccgagctggaggagatccagcagcagctgctgcactaccagaccaccaagcagaacctgtggagctgcagaagacaggccagcagcctgagaagatggctggagctgaacagagaggagcccggccccgaggaccaggaggtggagcagcaggtgcagaaggagctggagcaggtggagatgcagatccagctgctggccgaggagctgcaggcccagagacagcccatcggcgcctgcgtggccagaatccaggccctgagacaggccctgtgctag

SEQ ID NO: 98726 - DNA, 3636 bp, Artificial Sequence
  Description of Artificial Sequence: Synthetic coding sequence
atgaagaacctgctgaccgagaagtgcatcagcagccacaacttccaccagaaggtgatcaagcagagaatggagaagaaggtggacagcagatacttcaaggacggcgccgtgaagaagccctacagcgccaagaccctgagcaacaagaagagcagcgccagcttcggcatcagaagagagctgcccagcaccagccacctggtgcagtacagaggcacccacacctgcaccagacagggcagactgagagagctgagaatcagatgcgtggccagaaagttcctgtacctgtggatcagaatgaccttcggcagagtgttccccagcaaggccagattctactacgagcagagactgctgagaaaggtgttcgaggagtggaaggaggagtggtgggtgttccagcacgagtggaagctgtgcgtgagagccgactgccactacagatactacctgtacaacctgatgttccagacctggaagacctacgtgagacagcagcaggagatgagaaacaagtacatcagagccgaggtgcacgacgccaagcagaagatgagacaggcctggaagagctggctgatctacgtggtggtgagaagaaccaagctgcagatgcagaccaccgccctggagttcagacagagaatcatcctgagagtgtggtggagcacctggagacagagactgggccaggtgagagtgagcagagccctgcacgccagcgccctgaagcacagagccctgagcctgcaggtgcaggcctggagccagtggagagagcagctgctgtacgtgcagaaggagaagcagaaggtggtgagcgccgtgaagcaccaccagcactggcagaagagaagattcctgaaggcctggctggagtacctgcaggtgagaagagtgaagagacagcagaacgagatggccgagagattccaccacgtgaccgtgctgcagatctacttctgcgactggcagcaggcctgggagagaagagagagcctgtacgcccaccacgcccaggtggagaagctggccagaaagatggccctgagaagagccttcacccactggaagcactacatgctgctgtgcgccgaggaggccgcccagttcgagatggccgaggagcaccacagacacagccagctgctgctgcacagattctggaacctgtggagaagccagatcgagcagaagaaggagagagagctgctgcccctgctgcacgccgcctgggaccactacagaatcgccctgctgtgcaagtgcatcgagctgtggctgcagtacacccagaagagaagatacaagcagctgctgcaggccagagccgacggccacttccagcagagagccctgcccgccgccttccacacctggaacagactgtggagatggagacaccaggagaacgtgctgagcgccagagccaccagattccacagagagaccctggagaagcaggtgttcagcctgtggagacagaagatgttccagcacagagagaacagactggccgagagaatggccatcctgcacgccgagagacagctgctgtacagaagctggttcatgtggcaccagcaggccgccgccagacaccaggagcaggagtggcagaccgtggcctgcgcccaccacagacacggcagactgaagaaggccttctgcctgtggagagagagcgcccagggcctgagaaccgagagaaccggcagagtgagagccgccgagttccacatggcccagctgctgagatgggcctggagccagtggagagagtgcctggccctgagaggcgccgagagacagaagctgatgagagccgacctgcaccaccagcacagcgtgctgcacagagccctgcaggcctgggtgacctaccagggcagagtgagaagcatcctgagagaggtggccgccagagagagccagcacaacagacagctgctgagaggcgccctgagaagatggaaggagaacaccatggccagagtggacgaggccaagaagaccttccaggccagcacccactacagaagaaccatctgcagcaaggtgctggtgcagtggagagaggccgtgagcgtgcagatgtactacagacagcaggaggactgcgccatctgggaggcccagaaggtgctggacagaggctgcctgagaacctggttccagagatggtgggactgcagcagaagaagcgcccagcagagactgcagctggagagagccgtgcagcaccaccacagacagctgctgctggagggcctggccagatggaagacccaccacctgcagtgcgtgagaaagagactgctgcacagacagagcacccagctgctggcccagagactgagcagaacctgcttcagacagtggagacagcagctggccgccagaagacaggagcagagagccaccgtgagagccctgtggttctgggccttcagcctgcaggccaaggtgtgggccacctggctggccttcgtgctggagagaagaagaaagaaggccagactgcagtgggccctgcaggcctaccagggccagctgctgcaggagggcgccaccagactgctgagattcgccgccagcatgaaggccagcagacagcagctgcaggcccagcagcaggtgcaggccgcccacagcctgcacagagccgtgagaagatgcgccaccctgtggaagcagaaggtgctgggcagaggcggcaagccccagcccctggccgccatcgcccccagcagaaaggtgaccttcgagggccccctgctgaacagaatcgccgccggcgccggcgacggcaccctggagaccaagagaccccaggccagcagacccctgggcgccctgggcagactggccgccgaggagccccacgccctggagctgaacaccgcccacagcgccagaaagcagcccagaagaccccacttcctgctggagcccgcccagagccagagaccccagaagccccaggagcacggcctgggcatggcccagcccgccgcccccagcctgaccagacccttcctggccgaggcccccaccgccctggtgccccacagccccctgcccggcgccctgagcagcgcccccggccccaagcagccccccaccgccagcaccggccccgagctgctgctgctgcccctgagcagcttcatgccctgcggcgccgccgcccccgccagagtgagcgcccagagagccacccccagagacaagccccccgtgcccagcagcctggccagcgtgcccgacccccacctgctgctgcccggcgacttcagcgccaccagagccggccccggcctgagcaccgccggcagcctggacctggaggccgagctggaggagatccagcagcagctgctgcactaccagaccaccaagcagaacctgtggagctgcagaagacaggccagcagcctgagaagatggctggagctgaacagagaggagcccggccccgaggaccaggaggtggagcagcaggtgcagaaggagctggagcaggtggagatgcagatccagctgctggccgaggagctgcaggcccagagacagcccatcggcgcctgcgtggccagaatccaggccctgagacaggccctgtgctag

SEQ ID NO: 98727 - DNA, 3483 bp, Artificial Sequence; identical to SEQ ID NO: 98723
  Description of Artificial Sequence: Synthetic coding sequence

SEQ ID NO: 98728 - DNA, 240 bp, Artificial Sequence
  Description of Artificial Sequence: Synthetic coding sequence
atgaagaacctgctgaccgagaagtgcatcagcagccacaacttccaccagaaggtgatcaagcagagaatggagaagaaggtggacagcagatacttcaaggacggcgccgtgaagaagccctacagcgccaagaccctgagcaacaagaagagcagcgccagcttcggcatcagaagagagctgcccagcaccagccacctggtgcagtacagaggcacccacacctgcaccagatag

SEQ ID NO: 98729 - DNA, 3564 bp, Artificial Sequence
  Description of Artificial Sequence: Synthetic coding sequence
atgaagaacctgctgaccgagaagtgcatcagcagccacaacttccaccagaaggtgatcaagcagagaatggagaagaaggtggacagcagatacttcaaggacggcgccgtgaagaagccctacagcgccaagaccctgagcaacaagaagagcagcgccagcttcggcatcagaagagagctgcccagcaccagccacctggtgcagtacagaggcacccacacctgcaccagacagggcagactgagagagctgagaatcagattctactacgagcagagactgctgagaaaggtgttcgaggagtggaaggaggagtggtgggtgttccagcacgagtggaagctgtgcgtgagagccgactgccactacagatactacctgtacaacctgatgttccagacctggaagacctacgtgagacagcagcaggagatgagaaacaagtacatcagagccgaggtgcacgacgccaagcagaagatgagacaggcctggaagagctggctgatctacgtggtggtgagaagaaccaagctgcagatgcagaccaccgccctggagttcagacagagaatcatcctgagagtgtggtggagcacctggagacagagactgggccaggtgagagtgagcagagccctgcacgccagcgccctgaagcacagagccctgagcctgcaggtgcaggcctggagccagtggagagagcagctgctgtacgtgcagaaggagaagcagaaggtggtgagcgccgtgaagcaccaccagcactggcagaagagaagattcctgaaggcctggctggagtacctgcaggtgagaagagtgaagagacagcagaacgagatggccgagagattccaccacgtgaccgtgctgcagatctacttctgcgactggcagcaggcctgggagagaagagagagcctgtacgcccaccacgcccaggtggagaagctggccagaaagatggccctgagaagagccttcacccactggaagcactacatgctgctgtgcgccgaggaggccgcccagttcgagatggccgaggagcaccacagacacagccagctgctgctgcacagattctggaacctgtggagaagccagatcgagcagaagaaggagagagagctgctgcccctgctgcacgccgcctgggaccactacagaatcgccctgctgtgcaagtgcatcgagctgtggctgcagtacacccagaagagaagatacaagcagctgctgcaggccagagccgacggccacttccagcagagagccctgcccgccgccttccacacctggaacagactgtggagatggagacaccaggagaacgtgctgagcgccagagccaccagattccacagagagaccctggagaagcaggtgttcagcctgtggagacagaagatgttccagcacagagagaacagactggccgagagaatggccatcctgcacgccgagagacagctgctgtacagaagctggttcatgtggcaccagcaggccgccgccagacaccaggagcaggagtggcagaccgtggcctgcgcccaccacagacacggcagactgaagaaggccttctgcctgtggagagagagcgcccagggcctgagaaccgagagaaccggcagagtgagagccgccgagttccacatggcccagctgctgagatgggcctggagccagtggagagagtgcctggccctgagaggcgccgagagacagaagctgatgagagccgacctgcaccaccagcacagcgtgctgcacagagccctgcaggcctgggtgacctaccagggcagagtgagaagcatcctgagagaggtggccgccagagagagccagcacaacagacagctgctgagaggcgccctgagaagatggaaggagaacaccatggccagagtggacgaggccaagaagaccttccaggccagcacccactacagaagaaccatctgcagcaaggtgctggtgcagtggagagaggccgtgagcgtgcagatgtactacagacagcaggaggactgcgccatctgggaggcccagaaggtgctggacagaggctgcctgagaacctggttccagagatggtgggactgcagcagaagaagcgcccagcagagactgcagctggagagagccgtgcagcaccaccacagacagctgctgctggagggcctggccagatggaagacccaccacctgcagtgcgtgagaaagagactgctgcacagacagagcacccagctgctggcccagagactgagcagaacctgcttcagacagtggagacagcagctggccgccagaagacaggagcagagagccaccgtgagagccctgtggttctgggccttcagcctgcaggccaaggtgtgggccacctggctggccttcgtgctggagagaagaagaaagaaggccagactgcagtgggccctgcaggcctaccagggccagctgctgcaggagggcgccaccagactgctgagattcgccgccagcatgaaggccagcagacagcagctgcaggcccagcagcaggtgcaggccgcccacagcctgcacagagccgtgagaagatgcgccaccctgtggaagcagaaggtgctgggcagaggcggcaagccccagcccctggccgccatcgcccccagcagaaaggtgaccttcgagggccccctgctgaacagaatcgccgccggcgccggcgacggcaccctggagaccaagagaccccaggccagcagacccctgggcgccctgggcagactggccgccgaggagccccacgccctggagctgaacaccgcccacagcgccagaaagcagcccagaagaccccacttcctgctggagcccgcccagagccagagaccccagaagccccaggagcacggcctgggcatggcccagcccgccgcccccagcctgaccagacccttcctggccgaggcccccaccgccctggtgccccacagccccctgcccggcgccctgagcagcgcccccggccccaagcagccccccaccgccagcaccggccccgagctgctgctgctgcccctgagcagcttcatgccctgcggcgccgccgcccccgccagagtgagcgcccagagagccacccccagagacaagccccccgtgcccagcagcctggccagcgtgcccgacccccacctgctgctgcccggcgacttcagcgccaccagagccggccccggcctgagcaccgccggcagcctggacctggaggccgagctggaggagatccagcagcagctgctgcactaccagaccaccaagcagaacctgtggagctgcagaagacaggccagcagcctgagaagatggctggagctgaacagagaggagcccggccccgaggaccaggaggtggagcagcaggtgcagaaggagctggagcaggtggagatgcagatccagctgctggccgaggagctgcaggcccagagacagcccatcggcgcctgcgtggccagaatccaggccctgagacaggccctgtgctag

SEQ ID NO: 98730 - DNA, 378 bp, Artificial Sequence
  Description of Artificial Sequence: Synthetic coding sequence
atggacgccgtggccgtgtaccacggcaagatcagcagagagaccggcgagaagctgctgctggccaccggcctggacggcagctacctgctgagagacagcgagagcgtgcccggcgtgtactgcctgtgcgtgctgtaccacggctacatctacacctacagagtgagccagaccgagaccggcagctggagcgccgagaccgcccccggcgtgcacaagagatacttcagaaagatcaagaacctgatcagcgccttccagaagcccgaccagggcatcgtgatccccctgcagtaccccgtggagaagaagagcagcgccagaagcacccagggcatcagagaggaccccgacgtgtgcctgaaggccccctag

SEQ ID NO: 98731 - DNA, 387 bp, Artificial Sequence
  Description of Artificial Sequence: Synthetic coding sequence
atggacgccgtggccgtgtaccacggcaagatcagcagagagaccggcgagaagctgctgctggccaccggcctggacggcagctacctgctgagagacagcgagagcgtgcccggcgtgtactgcctgtgcgtgctgtaccacggctacatctacacctacagagtgagccagaccgagaccggcagctggagcgccgagaccgcccccggcgtgcacaagagatacttcagaaagatcaagaacctgatcagcgccttccagaagcccgaccagggcatcgtgatccccctgcagtaccccgtggagaagaagagcagcgccagaagcacccagggcaccaccggcatcagagaggaccccgacgtgtgcctgaaggccccctag

SEQ ID NO: 98732 - DNA, 177 bp, Artificial Sequence
  Description of Artificial Sequence: Synthetic coding sequence
atggacgccgtggccgtgtaccacggcaagatcagcagagagaccggcgagaagctgctgctggccaccggcctggacggcagctacctgctgagagacagcgagagcgtgcccggcgtgtactgcctgtgcgtgctgcaccactggggctacatcaagttcatcaacaagctgtag

SEQ ID NO: 98733 - DNA, 234 bp, Artificial Sequence
  Description of Artificial Sequence: Synthetic coding sequence
atggacctgccctactaccacggcagactgaccaagcaggactgcgagaccctgctgctgaaggagggcgtggacggcaacttcctgctgagagacagcgagagcatccccggcgtgctgtgcctgtgcgtgagcttcaagaacatcgtgtacacctacagaatcttcagagagaagcacggctactacagaatccagaacagcaacagcgactacgtggacgtgctgccctag

SEQ ID NO: 98734 - DNA, 399 bp, Artificial Sequence
  Description of Artificial Sequence: Synthetic coding sequence
atggacctgccctactaccacggcagactgaccaagcaggactgcgagaccctgctgctgaaggagggcgtggacggcaacttcctgctgagagacagcgagagcatccccggcgtgctgtgcctgtgcgtgagcttcaagaacatcgtgtacacctacagaatcttcagagagaagcacggctactacagaatccagaccgccgagggcagccccaagcaggtgttccccagcctgaaggagctgatcagcaagttcgagaagcccaaccagggcatggtggtgcacctgctgaagcccatcaagagaaccagccccagcctgagatggagaggcctgaagctggagctggagaccttcgtgaacagcaacagcgactacgtggacgtgctgccctag

SEQ ID NO: 98735 - DNA, 2271 bp, Artificial Sequence
  Description of Artificial Sequence: Synthetic coding sequence
atgaacggcgcccccagccccgaggacggcgccagccccagcagcccccccctgccccccccccccccccccagctggagagagttctgcgagagccacgccagagccgccgccctggacttcgccagaagattcagactgtacctggccagccacccccagtacgccggccccggcgccgaggccgccttcagcagaagattcgccgagctgttcctgcagcacttcgaggccgaggtggccagagccagcggcagcctgagcccccccatcctggcccccctgagccccggcgccgagatcagcccccacgacctgagcctggagagctgcagagtgggcggccccctggccgtgctgggccccagcagaagcagcgaggacctggccggccccctgcccagcagcgtgagcagcagcagcaccaccagcagcaagcccaagctgaagaagagattcagcctgagaagcgtgggcagaagcgtgagaggcagcgtgagaggcatcctgcagtggagaggcaccgtggacccccccagcagcgccggccccctggagaccagcagcggcccccccgtgctgggcggcaacagcaacagcaacagcagcggcggcgccggcaccgtgggcagaggcctggtgagcgacggcaccagccccggcgagagatggacccacagattcgagagactgagactgagcagaggcggcggcgccctgaaggacggcgccggcatggtgcagagagaggagctgctgagcttcatgggcgccgaggaggccgcccccgaccccgccggcgtgggcagaggcggcggcgtggccggcccccccagcggcggcggcggccagccccagtggcagaagtgcagactgctgctgagaagcgagggcgagggcggcggcggcagcagactggagttcttcgtgccccccaaggccagcagacccagactgagcatcccctgcagcagcatcaccgacgtgagaaccaccaccgccctggagatgcccgacagagagaacaccttcgtggtgaaggtggagggccccagcgagtacatcatggagaccgtggacgcccagcacgtgaaggcctgggtgagcgacatccaggagtgcctgagccccggcccctgccccgccaccagccccagacccatgaccctgcccctggcccccggcaccagcttcctgaccagagagaacaccgacagcctggagctgagctgcctgaaccacagcgagagcctgcccagccaggacctgctgctgggccccagcgagagcaacgacagactgagccagggcgcctacggcggcctgagcgacagacccagcgccagcatcagccccagcagcgccagcatcgccgccagccacttcgacagcatggagctgctgccccccgagctgccccccagaatccccatcgaggagggcccccccaccggcaccgtgcaccccctgagcgccccctacccccccctggacacccccgagaccgccaccggcagcttcctgttccagggcgagcccgagggcggcgagggcgaccagcccctgagcggctacccctggttccacggcatgctgagcagactgaaggccgcccagctggtgctgaccggcggcaccggcagccacggcgtgttcctggtgagacagagcgagaccagaagaggcgagtacgtgctgaccttcaacttccagggcaaggccaagcacctgagactgagcctgaacgaggagggccagtgcagagtgcagcacctgtggttccagagcatcttcgacatgctggagcacttcagagtgcaccccatccccctggagagcggcggcagcagcgacgtggtgctggtgagctacgtgcccagcagccagagacagcaggagcccaccaccagccacgaccccccccagccccccgagccccccagctggaccgaccccccccagcccggcgccgaggaggccagcagagcccccgaggtggccgccgccgccgccgccgccgccaaggagagacaggagaaggagaaggccggcggcggcggcgtgcccgaggagctggtgcccgtggtggagctggtgcccgtggtggagctggaggaggccatcgcccccggcagcgaggcccagggcgccggcagcggcggcgacgccggcgtgccccccatggtgcagctgcagcagagccccctgggcggcgacggcgaggagggcggccaccccagagccatcaacaaccagtacagcttcgtgtag

SEQ ID NO: 98736 - DNA, 2016 bp, Artificial Sequence
  Description of Artificial Sequence: Synthetic coding sequence
atgaacggcgcccccagccccgaggacggcgccagccccagcagcccccccctgccccccccccccccccccagctggagagagttctgcgagagccacgccagagccgccgccctggacttcgccagaagattcagactgtacctggccagccacccccagtacgccggccccggcgccgaggccgccttcagcagaagattcgccgagctgttcctgcagcacttcgaggccgaggtggccagagccagcggcagcctgagcccccccatcctggcccccctgagccccggcgccgagatcagcccccacgacctgagcctggagagctgcagagtgggcggccccctggccgtgctgggccccagcagaagcagcgaggacctggccggccccctgcccagcagcgtgagcagcagcagcaccaccagcagcaagcccaagctgaagaagagattcagcctgagaagcgtgggcagaagcgtgagaggcagcgtgagaggcatcctgcagtggagaggcaccgtggacccccccagcagcgccggccccctggagaccagcagcggcccccccgtgctgggcggcaacagcaacagcaacagcagcggcggcgccggcaccgtgggcagaggcctggtgagcgacggcaccagccccggcgagagatggacccacagattcgagagactgagactgagcagaggcggcggcgccctgaaggacggcgccggcatggtgcagagagaggagctgctgagcttcatgggcgccgaggaggccgcccccgaccccgccggcgtgggcagaggcggcggcgtggccggcccccccagcggcggcggcggccagccccagtggcagaagtgcagactgctgctgagaagcgagggcgagggcggcggcggcagcagactggagttcttcgtgccccccaaggccagcagacccagactgagcatcccctgcagcagcatcaccgacgtgagaaccaccaccgccctggagatgcccgacagagagaacaccttcgtggtgaaggtggagggccccagcgagtacatcatggagaccgtggacgcccagcacgtgaaggcctgggtgagcgacatccaggagtgcctgagccccggcccctgccccgccaccagccccagacccatgaccctgcccctggcccccggcaccagcttcctgaccagagagaacaccgacagcctggagctgagctgcctgaaccacagcgagagcctgcccagccaggacctgctgctgggccccagcgagagcaacgacagactgagccagggcgcctacggcggcctgagcgacagacccagcgccagcatcagccccagcagcgccagcatcgccgccagccacttcgacagcatggagctgctgccccccgagctgccccccagaatccccatcgaggagggcccccccaccggcaccgtgcaccccctgagcgccccctacccccccctggacacccccgagaccgccaccggcagcttcctgttccagggcgagcccgagggcggcgagggcgaccagcccctgagcggctacccctggttccacggcatgctgagcagactgaaggccgcccagctggtgctgaccggcggcaccggcagccacggcgtgttcctggtgagacagagcgagaccagaagaggcgagtacgtgctgaccttcaacttccagggcaaggccaagcacctgagactgagcctgaacgaggagggccagtgcagagtgcagcacctgtggttccagagcatcttcgacatgctggagcacttcagagtgcaccccatccccctggagagcggcggcagcagcgacgtggtgctggtgagctacgtgcccagcagccagagacagcagggcagagagcaggccggcagccacgccggcgtgtgcgagggcgacggctgccaccccgacgccagctgcaccctgatgcccttcggcgccagcgactgcgtgaccgaccacctgccctag

SEQ ID NO: 98737 - DNA, 2052 bp, Artificial Sequence
  Description of Artificial Sequence: Synthetic coding sequence
atgaacggcgcccccagccccgaggacggcgccagccccagcagcccccccctgccccccccccccccccccagctggagagagttctgcgagagccacgccagagccgccgccctggacttcgccagaagattcagactgtacctggccagccacccccagtacgccggccccggcgccgaggccgccttcagcagaagattcgccgagctgttcctgcagcacttcgaggccgaggtggccagagccagcggcagcctgagcccccccatcctggcccccctgagccccggcgccgagatcagcccccacgacctgagcctggagagctgcagagtgggcggccccctggccgtgctgggccccagcagaagcagcgaggacctggccggccccctgcccagcagcgtgagcagcagcagcaccaccagcagcaagcccaagctgaagaagagattcagcctgagaagcgtgggcagaagcgtgagaggcagcgtgagaggcatcctgcagtggagaggcaccgtggacccccccagcagcgccggccccctggagaccagcagcggcccccccgtgctgggcggcaacagcaacagcaacagcagcggcggcgccggcaccgtgggcagaggcctggtgagcgacggcaccagccccggcgagagatggacccacagattcgagagactgagactgagcagaggcggcggcgccctgaaggacggcgccggcatggtgcagagagaggagctgctgagcttcatgggcgccgaggaggccgcccccgaccccgccggcgtgggcagaggcggcggcgtggccggcccccccagcggcggcggcggccagccccagtggcagaagtgcagactgctgctgagaagcgagggcgagggcggcggcggcagcagactggagttcttcgtgccccccaaggccagcagacccagactgagcatcccctgcagcagcatcaccgacgtgagaaccaccaccgccctggagatgcccgacagagagaacaccttcgtggtgaaggtggagggccccagcgagtacatcatggagaccgtggacgcccagcacgtgaaggcctgggtgagcgacatccaggagtgcctgagccccggcccctgccccgccaccagccccagacccatgaccctgcccctggcccccggcaccagcttcctgaccagagagaacaccgacagcctggagctgagctgcctgaaccacagcgagagcctgcccagccaggacctgctgctgggccccagcgagagcaacgacagactgagccagggcgcctacggcggcctgagcgacagacccagcgccagcatcagccccagcagcgccagcatcgccgccagccacttcgacagcatggagctgctgccccccgagctgccccccagaatccccatcgaggagggcccccccaccggcaccgtgcaccccctgagcgccccctacccccccctggacacccccgagaccgccaccggcagcttcctgttccagggcgagcccgagggcggcgagggcgaccagcccctgagcggctacccctggttccacggcatgctgagcagactgaaggccgcccagctggtgctgaccggcggcaccggcagccacggcgtgttcctggtgagacagagcgagaccagaagaggcgagtacgtgctgaccttcaacttccagggcaaggccaagcacctgagactgagcctgaacgaggagggccagtgcagagtgcagcacctgtggttccagagcatcttcgacatgctggagcacttcagagtgcaccccatccccctggagagcggcggcagcagcgacgtggtgctggtgagctacgtgcccagcagccagagacagcagggcgagcagagcagaagcgccggcgaggaggtgcccgtgcaccccagaagcgaggccggcagcagactgggcgccatgagaggctgcgccagagagatggacgccacccccatgccccccgcccccagctgccccagcgagagagtgaccgtgtag

SEQ ID NO: 98738 - DNA, 2016 bp, Artificial Sequence; identical to SEQ ID NO: 98736
  Description of Artificial Sequence: Synthetic coding sequence

SEQ ID NO: 98739 - DNA, 1008 bp, Artificial Sequence
  Description of Artificial Sequence: Synthetic coding sequence
atgcccgacagagagaacaccttcgtggtgaaggtggagggccccagcgagtacatcatggagaccgtggacgcccagcacgtgaaggcctgggtgagcgacatccaggagtgcctgagccccggcccctgccccgccaccagccccagacccatgaccctgcccctggcccccggcaccagcttcctgaccagagagaacaccgacagcctggagctgagctgcctgaaccacagcgagagcctgcccagccaggacctgctgctgggccccagcgagagcaacgacagactgagccagggcgcctacggcggcctgagcgacagacccagcgccagcatcagccccagcagcgccagcatcgccgccagccacttcgacagcatggagctgctgccccccgagctgccccccagaatccccatcgaggagggcccccccaccggcaccgtgcaccccctgagcgccccctacccccccctggacacccccgagaccgccaccggcagcttcctgttccagggcgagcccgagggcggcgagggcgaccagcccctgagcggctacccctggttccacggcatgctgagcagactgaaggccgcccagctggtgctgaccggcggcaccggcagccacggcgtgttcctggtgagacagagcgagaccagaagaggcgagtacgtgctgaccttcaacttccagggcaaggccaagcacctgagactgagcctgaacgaggagggccagtgcagagtgcagcacctgtggttccagagcatcttcgacatgctggagcacttcagagtgcaccccatccccctggagagcggcggcagcagcgacgtggtgctggtgagctacgtgcccagcagccagagacagcagggcagagagcaggccggcagccacgccggcgtgtgcgagggcgacggctgccaccccgacgccagctgcaccctgatgcccttcggcgccagcgactgcgtgaccgaccacctgccctag

SEQ ID NO: 98740 - DNA, 1122 bp, Artificial Sequence
  Description of Artificial Sequence: Synthetic coding sequence
atggccgaggccagcagacccagactgagcatcccctgcagcagcatcaccgacgtgagaaccaccaccgccctggagatgcccgacagagagaacaccttcgtggtgaaggtggagggccccagcgagtacatcatggagaccgtggacgcccagcacgtgaaggcctgggtgagcgacatccaggagtgcctgagccccggcccctgccccgccaccagccccagacccatgaccctgcccctggcccccggcaccagcttcctgaccagagagaacaccgacagcctggagctgagctgcctgaaccacagcgagagcctgcccagccaggacctgctgctgggccccagcgagagcaacgacagactgagccagggcgcctacggcggcctgagcgacagacccagcgccagcatcagccccagcagcgccagcatcgccgccagccacttcgacagcatggagctgctgccccccgagctgccccccagaatccccatcgaggagggcccccccaccggcaccgtgcaccccctgagcgccccctacccccccctggacacccccgagaccgccaccggcagcttcctgttccagggcgagcccgagggcggcgagggcgaccagcccctgagcggctacccctggttccacggcatgctgagcagactgaaggccgcccagctggtgctgaccggcggcaccggcagccacggcgtgttcctggtgagacagagcgagaccagaagaggcgagtacgtgctgaccttcaacttccagggcaaggccaagcacctgagactgagcctgaacgaggagggccagtgcagagtgcagcacctgtggttccagagcatcttcgacatgctggagcacttcagagtgcaccccatccccctggagagcggcggcagcagcgacgtggtgctggtgagctacgtgcccagcagccagagacagcagggcgagcagagcagaagcgccggcgaggaggtgcccgtgcaccccagaagcgaggccggcagcagactgggcgccatgagaggctgcgccagagagatggacgccacccccatgccccccgcccccagctgccccagcgagagagtgaccgtgtag

SEQ ID NO: 98741 - DNA, 1728 bp, Artificial Sequence
  Description of Artificial Sequence: Synthetic coding sequence
atgaacggccccgccctgcagcccagcagccccagcagcgcccccagcgccagccccgccgccgcccccagaggctggagcgagttctgcgagctgcacgccgtggccgccgccagagagctggccagacagtactggctgttcgccagagagcacccccagcacgcccccctgagagccgagctggtgagcctgcagttcaccgacctgttccagagatacttctgcagagaggtgagagacggcagagcccccggcagagactacagagacaccggcagaggcccccccgccaaggccgaggccagccccgagcccggccccggccccgccgcccccggcctgcccaaggccagaagcagcgaggagctggccccccccagaccccccggcccctgcagcttccagcacttcagaagaagcctgagacacatcttcagaagaagaagcgccggcgagctgcccgccgcccacaccgccgccgcccccggcacccccggcgaggccgccgagacccccgccagacccggcctggccaagaagttcctgccctggagcctggccagagagcccccccccgaggccctgaaggaggccgtgctgagatacagcctggccgacgaggccagcatggacagcggcgccagatggcagagaggcagactggccctgagaagagcccccggccccgacggccccgacagagtgctggagctgttcgacccccccaagagcagcagacccaagctgcaggccgcctgcagcagcatccaggaggtgagatggtgcaccagactggagatgcccgacaacctgtacaccttcgtgctgaaggtgaaggacagaaccgacatcatcttcgaggtgggcgacgagcagcagctgaacagctggatggccgagctgagcgagtgcaccggcagaggcctggagagcaccgaggccgagatgcacatccccagcgccctggagcccagcaccagcagcagccccagaggcagcaccgacagcctgaaccagggcgccagccccggcggcctgctggaccccgcctgccagaagaccgaccacttcctgagctgctacccctggttccacggccccatcagcagagtgaaggccgcccagctggtgcagctgcagggccccgacgcccacggcgtgttcctggtgagacagagcgagaccagaagaggcgagtacgtgctgaccttcaacttccagggcatcgccaagcacctgagactgagcctgaccgagagaggccagtgcagagtgcagcacctgcacttccccagcgtggtggacatgctgcaccacttccagagaagccccatccccctggagtgcggcgccgcctgcgacgtgagactgagcagctacgtggtggtggtgagccagccccccggcagctgcaacaccgtgctgttccccttcagcctgccccactgggacagcgagagcctgccccactggggcagcgagctgggcctgccccacctgagcagcagcggctgccccagaggcctgagccccgagggcctgcccggcagaagcagcccccccgagcagatcttccacctggtgcccagccccgaggagctggccaacagcctgcagcacctggagcacgagcccgtgaacagagccagagacagcgactacgagatggacagcagcagcagaagccacctgagagccatcgacaaccagtacacccccctgtag

SEQ ID NO: 98742 - DNA, 1122 bp, Artificial Sequence
  Description of Artificial Sequence: Synthetic coding sequence
atgggcttccccgtgctgtgcagaggctggagaagaacctggcccggctgcgccagctggctgggcgccccccccccccagaagcccctgctgagccccctgctgctgaaccacagaagcagcaagagcagcagacccaagctgcaggccgcctgcagcagcatccaggaggtgagatggtgcaccagactggagatgcccgacaacctgtacaccttcgtgctgaaggtgaaggacagaaccgacatcatcttcgaggtgggcgacgagcagcagctgaacagctggatggccgagctgagcgagtgcaccggcagaggcctggagagcaccgaggccgagatgcacatccccagcgccctggagcccagcaccagcagcagccccagaggcagcaccgacagcctgaaccagggcgccagccccggcggcctgctggaccccgcctgccagaagaccgaccacttcctgagctgctacccctggttccacggccccatcagcagagtgaaggccgcccagctggtgcagctgcagggccccgacgcccacggcgtgttcctggtgagacagagcgagaccagaagaggcgagtacgtgctgaccttcaacttccagggcatcgccaagcacctgagactgagcctgaccgagagaggccagtgcagagtgcagcacctgcacttccccagcgtggtggacatgctgcaccacttccagagaagccccatccccctggagtgcggcgccgcctgcgacgtgagactgagcagctacgtggtggtggtgagccagccccccggcagctgcaacaccgtgctgttccccttcagcctgccccactgggacagcgagagcctgccccactggggcagcgagctgggcctgccccacctgagcagcagcggctgccccagaggcctgagccccgagggcctgcccggcagaagcagcccccccgagcagatcttccacctggtgcccagccccgaggagctggccaacagcctgcagcacctggagcacgagcccgtgaacagagccagagacagcgactacgagatggacagcagcagcagaagccacctgagagccatcgacaaccagtacacccccctgtag

SEQ ID NO: 98743 - DNA, 1209 bp, Artificial Sequence
  Description of Artificial Sequence: Synthetic coding sequence
atgatcccccccagcagccccagagaggacggcgtggacggcctgcccaaggaggccgtgggcgccgagcagccccccagccccgccagcaccagcagccaggagagcaagctgcagaagctgaagagaagcctgagcttcaagaccaagagcctgagaagcaagagcgccgacaacttcttccagagaaccaacagcgaggacatgaagctgcaggcccacatggtggccgagatcagccccagcagcagccccctgcccgcccccggcagcctgaccagcacccccgccagagccggcctgcaccccggcggcaaggcccacgccttccaggagtacatcttcaagaagcccaccttctgcgacgtgtgcaaccacatgatcgtgggcaccaacgccaagcacggcctgagatgcaaggcctgcaagatgagcatccaccacaagtgcaccgacggcctggccccccagagatgcatgggcaagctgcccaagggcttcagaagatactacagcagccccctgctgatccacgagcagttcggctgcatcaaggaggtgatgcccatcgcctgcggcaacaaggtggaccccgtgtacgagaccctgagattcggcaccagcctggcccagagaaccaagaagggcagcagcggcagcggcagcgacagcccccacagaaccagcaccagcgacctggtggaggtgcccgaggaggccaacggccccggcggcggctacgacctgagaaagagaagcaacagcgtgttcacctaccccgagaacggcaccgacgacttcagagaccccgccaagaacatcaaccaccagggcagcctgagcaaggaccccctgcagatgaacacctacgtggccctgtacaagttcgtgccccaggagaacgaggacctggagatgagacccggcgacatcatcaccctgctggaggacagcaacgaggactggtggaagggcaagatccaggacagaatcggcttcttccccgccaacttcgtgcagagactgcagcagaacgagaagatcttcagatgcgtgagaaccttcatcggctgcaaggagcagggccagatcaccctgaaggagaaccagatctgcgtgagcagcgaggaggagcaggacggcttcatcagagtgctgagcggcaagaagaagggcctgatccccctggacgtgctggagaacatctag

SEQ ID NO: 98744 - DNA, 1005 bp, Artificial Sequence
  Description of Artificial Sequence: Synthetic coding sequence
atgaagctgcaggcccacatggtggccgagatcagccccagcagcagccccctgcccgcccccggcagcctgaccagcacccccgccagagccggcctgcaccccggcggcaaggcccacgccttccaggagtacatcttcaagaagcccaccttctgcgacgtgtgcaaccacatgatcgtgggcaccaacgccaagcacggcctgagatgcaaggcctgcaagatgagcatccaccacaagtgcaccgacggcctggccccccagagatgcatgggcaagctgcccaagggcttcagaagatactacagcagccccctgctgatccacgagcagttcggctgcatcaaggaggtgatgcccatcgcctgcggcaacaaggtggaccccgtgtacgagaccctgagattcggcaccagcctggcccagagaaccaagaagggcagcagcggcagcggcagcgacagcccccacagaaccagcaccagcgacctggtggaggtgcccgaggaggccaacggccccggcggcggctacgacctgagaaagagaagcaacagcgtgttcacctaccccgagaacggcaccgacgacttcagagaccccgccaagaacatcaaccaccagggcagcctgagcaaggaccccctgcagatgaacacctacgtggccctgtacaagttcgtgccccaggagaacgaggacctggagatgagacccggcgacatcatcaccctgctggaggacagcaacgaggactggtggaagggcaagatccaggacagaatcggcttcttccccgccaacttcgtgcagagactgcagcagaacgagaagatcttcagatgcgtgagaaccttcatcggctgcaaggagcagggccagatcaccctgaaggagaaccagatctgcgtgagcagcgaggaggagcaggacggcttcatcagagtgctgagcggcaagaagaagggcctgatccccctggacgtgctggagaacatctag

SEQ ID NO: 98745 - DNA, 4422 bp, Artificial Sequence
  Description of Artificial Sequence: Synthetic coding sequence
gtggccatcatcgccggcaacttcgagctggccgagtacatcaagaaccacaaggagaccgacatcgtgcccttcagagaggcccccgcctacagcaacagaagaagaagaccccccaacaccctggccgcccccagagtgctgctgagaagcaacagcgacaacaacctgaacgccagcgcccccgactgggccgtgtgcagcaccgccaccagccacagaagcctgagcccccagctgctgcagcagatgcccagcaagcccgagggcgccgccaagaccatcggcagctacgtgcccggccccagaagcagaagccccagcctgaacagactgggcggcgccggcgaggacggcaagagaccccagcccctgtggcacgtgggcagccccttcgccctgggcgccaacaaggacagcctgagcgccttcgagtaccccggccccaagagaaagctgtacagcgccgtgcccggcagactgttcgtggccgtgaagccctaccagccccaggtggacggcgagatccccctgcacagaggcgacagagtgaaggtgctgagcatcggcgagggcggcttctgggagggcagcgccagaggccacatcggctggttccccgccgagtgcgtggaggaggtgcagtgcaagcccagagacagccaggccgagaccagagccgacagaagcaagaagctgttcagacactacaccgtgggcagctacgacagcttcgacaccagcagcgactgcatcatcgaggagaagaccgtggtgctgcagaagaaggacaacgagggcttcggcttcgtgctgagaggcgccaaggccgacacccccatcgaggagttcacccccacccccgccttccccgccctgcagtacctggagagcgtggacgagggcggcgtggcctggcaggccggcctgagaaccggcgacttcctgatcgaggtgaacaacgagaacgtggtgaaggtgggccacagacaggtggtgaacatgatcagacagggcggcaaccacctggtgctgaaggtggtgaccgtgaccagaaacctggaccccgacgacaccgccagaaagaaggccccccccccccccaagagagcccccaccaccgccctgaccctgagaagcaagagcatgaccagcgagctggaggagctggtggacaaggacaagcccgaggagatcgtgcccgccagcaagcccagcagagccgccgagaacatggccgtggagcccagagtggccaccatcaagcagagacccagcagcagatgcttccccgccggcagcgacatgaacagcgtgtacgagagacagggcatcgccgtgatgacccccaccgtgcccggcagccccaaggcccccttcctgggcatccccagaggcaccatgagaagacagaagagcatcgacagcagaatcttcctgagcggcatcaccgaggaggagagacagttcctggccccccccatgctgaagttcaccagaagcctgagcatgcccgacaccagcgaggacatccccccccccccccagagcgtgccccccagcccccccccccccagccccaccacctacaactgccccaagagccccacccccagagtgtacggcaccatcaagcccgccttcaaccagaacagcgccgccaaggtgagccccgccaccagaagcgacaccgtggccaccatgatgagagagaagggcatgtacttcagaagagagctggacagatacagcctggacagcgaggacctgtacagcagaaacgccggcccccaggccaacttcagaaacaagagaggccagatgcccgagaacccctacagcgaggtgggcaagatcgccagcaaggccgtgtacgtgcccgccaagcccgccagaagaaagggcatgctggtgaagcagagcaacgtggaggacagccccgagaagacctgcagcatccccatccccaccatcatcgtgaaggagcccagcaccagcagcagcggcaagagcagccagggcagcagcatggagatcgacccccaggcccccgagccccccagccagctgagacccgacgagagcctgaccgtgagcagccccttcgccgccgccatcgccggcgccgtgagagacagagagaagagactggaggccagaagaaacagccccgccttcctgagcaccgacctgggcgacgaggacgtgggcctgggcccccccgcccccagaaccagacccagcatgttccccgaggagggcgacttcgccgacgaggacagcgccgagcagctgagcagccccatgcccagcgccacccccagagagcccgagaaccacttcgtgggcggcgccgaggccagcgcccccggcgaggccggcagacccctgaacagcaccagcaaggcccagggccccgagagcagccccgccgtgcccagcgccagcagcggcaccgccggccccggcaactacgtgcaccccctgaccggcagactgctggaccccagcagccccctggccctggccctgagcgccagagacagagccatgaaggagagccagcagggccccaagggcgaggcccccaaggccgacctgaacaagcccctgtacatcgacaccaagatgagacccagcctggacgccggcttccccaccgtgaccagacagaacaccagaggccccctgagaagacaggagaccgagaacaagtacgagaccgacctgggcagagacagaaagggcgacgacaagaagaacatgctgatcgacatcatggacaccagccagcagaagagcgccggcctgctgatggtgcacaccgtggacgccaccaagctggacaacgccctgcaggaggaggacgagaaggccgaggtggagatgaagcccgacagcagccccagcgaggtgcccgagggcgtgagcgagaccgagggcgccctgcagatcagcgccgcccccgagcccaccaccgtgcccggcagaaccatcgtggccgtgggcagcatggaggaggccgtgatcctgcccttcagaatcccccccccccccctggccagcgtggacctggacgaggacttcatcttcaccgagcccctgcccccccccctggagttcgccaacagcttcgacatccccgacgacagagccgccagcgtgcccgccctgagcgacctggtgaagcagaagaagagcgacaccccccagagccccagcctgaacagcagccagcccaccaacagcgccgacagcaagaagcccgccagcctgagcaactgcctgcccgccagcttcctgcccccccccgagagcttcgacgccgtggccgacagcggcatcgaggaggtggacagcagaagcagcagcgaccaccacctggagaccaccagcaccatcagcaccgtgagcagcatcagcaccctgagcagcgagggcggcgagaacgtggacacctgcaccgtgtacgccgacggccaggccttcatggtggacaagccccccgtgccccccaagcccaagatgaagcccatcatccacaagagcaacgccctgtaccaggacgccctggtggaggaggacgtggacagcttcgtgatccccccccccgcccccccccccccccccggcagcgcccagcccggcatggccaaggtgctgcagcccagaaccagcaagctgtggggcgacgtgaccgagatcaagagccccatcctgagcggccccaaggccaacgtgatcagcgagctgaacagcatcctgcagcagatgaacagagagaagctggccaagcccggcgagggcctggacagccccatgggcgccaagagcgccagcctggcccccagaagccccgagatcatgagcaccatcagcggcaccagaagcaccaccgtgaccttcaccgtgagacccggcaccagccagcccatcaccctgcagagcagaccccccgactacgagagcagaaccagcggcaccagaagagcccccagccccgtggtgagccccaccgagatgaacaaggagaccctgcccgcccccctgagcgccgccaccgccagccccagccccgccctgagcgacgtgttcagcctgcccagccagccccccagcggcgacctgttcggcctgaaccccgccggcagaagcagaagccccagccccagcatcctgcagcagcccatcagcaacaagcccttcaccaccaagcccgtgcacctgtggaccaagcccgacgtggccgactggctggagagcctgaacctgggcgagcacaaggaggccttcatggacaacgagatcgacggcagccacctgcccaacctgcagaaggaggacctgatcgacctgggcgtgaccagagtgggccacagaatgaacatcgagagagccctgaagcagctgctggacagatag

SEQ ID NO: 98746 - DNA, 5553 bp, Artificial Sequence
  Description of Artificial Sequence: Synthetic coding sequence
atgcccagaagccccaccagcagcgaggacgagatggcccagagcttcagcgactacagcgtgggcagcgagagcgacagcagcaaggaggagaccatctacgacaccatcagagccaccgccgagaagcccggcggcgccagaaccgaggagagccagggcaacaccctggtgatcagagtggtgatccacgacctgcagcagaccaagtgcatcagattcaaccccgacgccaccgtgtgggtggccaagcagagaatcctgtgcaccctgacccagagcctgaaggacgtgctgaactacggcctgttccagcccgccagcaacggcagagacggcaagttcctggacgaggagagactgctgagagagtacccccagcccgtgggcgagggcgtgcccagcctggagttcagatacaagaagagagtgtacaagcaggccagcctggacgagaagcagctggccaagctgcacaccaagaccaacctgaagaagtgcatggaccacatccagcacagactggtggagaagatcaccaagatgctggacagaggcctggaccccaacttccacgaccccgagaccggcgagacccccctgaccctggccgcccagctggacgacagcgtggaggtgatcaaggccctgaagaacggcggcgcccacctggacttcagagccaaggacggcatgaccgccctgcacaaggccgccagagccagaaaccaggtggccctgaagaccctgctggagctgggcgccagccccgactacaaggacagctacggcctgacccccctgtaccacaccgccatcgtgggcggcgacccctactgctgcgagctgctgctgcacgagcacgccaccgtgtgctgcaaggacgagaacggctggcacgagatccaccagagcagatgctggggccacatcagcgagccccaccacaccctgctgagcggcagcgccagaagccagcagagcagaagcgccagcagcgccctgcacgtgtgcgccatgtacagcagcttcagctgcgtgagaatcagcctgctgttccacggcagaatcaccgagctgaagcagtacaagaagagcacccccttccaggtggccatcatcgccggcaacttcgagctggccgagtacatcaagaaccacaaggagaccgacatcgtgcccttcagagaggcccccgcctacagcaacagaagaagaagaccccccaacaccctggccgcccccagagtgctgctgagaagcaacagcgacaacaacctgaacgccagcgcccccgactgggccgtgtgcagcaccgccaccagccacagaagcctgagcccccagctgctgcagcagatgcccagcaagcccgagggcgccgccaagaccatcggcagctacgtgcccggccccagaagcagaagccccagcctgaacagactgggcggcgccggcgaggacggcaagagaccccagcccctgtggcacgtgggcagccccttcgccctgggcgccaacaaggacagcctgagcgccttcgagtaccccggccccaagagaaagctgtacagcgccgtgcccggcagactgttcgtggccgtgaagccctaccagccccaggtggacggcgagatccccctgcacagaggcgacagagtgaaggtgctgagcatcggcgagggcggcttctgggagggcagcgccagaggccacatcggctggttccccgccgagtgcgtggaggaggtgcagtgcaagcccagagacagccaggccgagaccagagccgacagaagcaagaagctgttcagacactacaccgtgggcagctacgacagcttcgacaccagcagcgactgcatcatcgaggagaagaccgtggtgctgcagaagaaggacaacgagggcttcggcttcgtgctgagaggcgccaaggccgacacccccatcgaggagttcacccccacccccgccttccccgccctgcagtacctggagagcgtggacgagggcggcgtggcctggcaggccggcctgagaaccggcgacttcctgatcgaggtgaacaacgagaacgtggtgaaggtgggccacagacaggtggtgaacatgatcagacagggcggcaaccacctggtgctgaaggtggtgaccgtgaccagaaacctggaccccgacgacaccgccagaaagaaggccccccccccccccaagagagcccccaccaccgccctgaccctgagaagcaagagcatgaccagcgagctggaggagctggtggacaagggcgtgatcagaaaggtgagcgacaagcccgaggagatcgtgcccgccagcaagcccagcagagccgccgagaacatggccgtggagcccagagtggccaccatcaagcagagacccagcagcagatgcttccccgccggcagcgacatgaacagcgtgtacgagagacagggcatcgccgtgatgacccccaccgtgcccggcagccccaaggcccccttcctgggcatccccagaggcaccatgagaagacagaagagcatcgacagcagaatcttcctgagcggcatcaccgaggaggagagacagttcctggccccccccatgctgaagttcaccagaagcctgagcatgcccgacaccagcgaggacatccccccccccccccagagcgtgccccccagcccccccccccccagccccaccacctacaactgccccaagagccccacccccagagtgtacggcaccatcaagcccgccttcaaccagaacagcgccgccaaggtgagccccgccaccagaagcgacaccgtggccaccatgatgagagagaagggcatgtacttcagaagagagctggacagatacagcctggacagcgaggacctgtacagcagaaacgccggcccccaggccaacttcagaaacaagagaggccagatgcccgagaacccctacagcgaggtgggcaagatcgccagcaaggccgtgtacgtgcccgccaagcccgccagaagaaagggcatgctggtgaagcagagcaacgtggaggacagccccgagaagacctgcagcatccccatccccaccatcatcgtgaaggagcccagcaccagcagcagcggcaagagcagccagggcagcagcatggagatcgacccccaggcccccgagccccccagccagctgagacccgacgagagcctgaccgtgagcagccccttcgccgccgccatcgccggcgccgtgagagacagagagaagagactggaggccagaagaaacagccccgccttcctgagcaccgacctgggcgacgaggacgtgggcctgggcccccccgcccccagaaccagacccagcatgttccccgaggagggcgacttcgccgacgaggacagcgccgagcagctgagcagccccatgcccagcgccacccccagagagcccgagaaccacttcgtgggcggcgccgaggccagcgcccccggcgaggccggcagacccctgaacagcaccagcaaggcccagggccccgagagcagccccgccgtgcccagcgccagcagcggcaccgccggccccggcaactacgtgcaccccctgaccggcagactgctggaccccagcagccccctggccctggccctgagcgccagagacagagccatgaaggagagccagcagggccccaagggcgaggcccccaaggccgacctgaacaagcccctgtacatcgacaccaagatgagacccagcctggacgccggcttccccaccgtgaccagacagaacaccagaggccccctgagaagacaggagaccgagaacaagtacgagaccgacctgggcagagacagaaagggcgacgacaagaagaacatgctgatcgacatcatggacaccagccagcagaagagcgccggcctgctgatggtgcacaccgtggacgccaccaagctggacaacgccctgcaggaggaggacgagaaggccgaggtggagatgaagcccgacagcagccccagcgaggtgcccgagggcgtgagcgagaccgagggcgccctgcagatcagcgccgcccccgagcccaccaccgtgcccggcagaaccatcgtggccgtgggcagcatggaggaggccgtgatcctgcccttcagaatcccccccccccccctggccagcgtggacctggacgaggacttcatcttcaccgagcccctgcccccccccctggagttcgccaacagcttcgacatccccgacgacagagccgccagcgtgcccgccctgagcgacctggtgaagcagaagaagagcgacaccccccagagccccagcctgaacagcagccagcccaccaacagcgccgacagcaagaagcccgccagcctgagcaactgcctgcccgccagcttcctgcccccccccgagagcttcgacgccgtggccgacagcggcatcgaggaggtggacagcagaagcagcagcgaccaccacctggagaccaccagcaccatcagcaccgtgagcagcatcagcaccctgagcagcgagggcggcgagaacgtggacacctgcaccgtgtacgccgacggccaggccttcatggtggacaagccccccgtgccccccaagcccaagatgaagcccatcatccacaagagcaacgccctgtaccaggacgccctggtggaggaggacgtggacagcttcgtgatccccccccccgcccccccccccccccccggcagcgcccagcccggcatggccaaggtgctgcagcccagaaccagcaagctgtggggcgacgtgaccgagatcaagagccccatcctgagcggccccaaggccaacgtgatcagcgagctgaacagcatcctgcagcagatgaacagagagaagctggccaagcccggcgagggcctggacagccccatgggcgccaagagcgccagcctggcccccagaagccccgagatcatgagcaccatcagcggcaccagaagcaccaccgtgaccttcaccgtgagacccggcaccagccagcccatcaccctgcagagcagaccccccgactacgagagcagaaccagcggcaccagaagagcccccagccccgtggtgagccccaccgagatgaacaaggagaccctgcccgcccccctgagcgccgccaccgccagccccagccccgccctgagcgacgtgttcagcctgcccagccagccccccagcggcgacctgttcggcctgaaccccgccggcagaagcagaagccccagccccagcatcctgcagcagcccatcagcaacaagcccttcaccaccaagcccgtgcacctgtggaccaagcccgacgtggccgactggctggagagcctgaacctgggcgagcacaaggaggccttcatggacaacgagatcgacggcagccacctgcccaacctgcagaaggaggacctgatcgacctgggcgtgaccagagtgggccacagaatgaacatcgagagagccctgaagcagctgctggacagatag

SEQ ID NO: 98747 - DNA, 846 bp, Artificial Sequence
  Description of Artificial Sequence: Synthetic coding sequence
atgatgatgaacgtgcccggcggcggcgccgccgccgtgatgatgaccggctacaacaacggcagatgccccagaaacagcctgtacagcgactgcatcatcgaggagaagaccgtggtgctgcagaagaaggacaacgagggcttcggcttcgtgctgagaggcgccaaggccgacacccccatcgaggagttcacccccacccccgccttccccgccctgcagtacctggagagcgtggacgagggcggcgtggcctggcaggccggcctgagaaccggcgacttcctgatcgaggtgaacaacgagaacgtggtgaaggtgggccacagacaggtggtgaacatgatcagacagggcggcaaccacctggtgctgaaggtggtgaccgtgaccagaaacctggaccccgacgacaccgccagaaagaaggccccccccccccccaagagagcccccaccaccgccctgaccctgagaagcaagagcatgaccagcgagctggaggagctggtggacaagggcgtgatcagaaagggcaaggacaagcccgaggagatcgtgcccgccagcaagcccagcagagccgccgagaacatggccgtggagcccagagtggccaccatcaagcagagacccagcagcagatgcttccccgccggcagcgacatgaacagcgtgtacgagagacagggcatcgccgtgatgacccccaccgtgcccggcagccccaaggcccccttcctgggcatccccagaggcaccatgagaagacagaagagcatcggcaagaagtgcggcacccccccccagaagctgcccctgggcttccagacccagccctag

SEQ ID NO: 98748 - DNA, 3762 bp, Artificial Sequence
  Description of Artificial Sequence: Synthetic coding sequence
atgatgaacgtgcccggcggcggcgccgccgccgtgatgatgaccggctacaacaacggcagatgccccagaaacagcctgtacagcgactgcatcatcgaggagaagaccgtggtgctgcagaagaaggacaacgagggcttcggcttcgtgctgagaggcgccaaggccgacacccccatcgaggagttcacccccacccccgccttccccgccctgcagtacctggagagcgtggacgagggcggcgtggcctggcaggccggcctgagaaccggcgacttcctgatcgaggtgaacaacgagaacgtggtgaaggtgggccacagacaggtggtgaacatgatcagacagggcggcaaccacctggtgctgaaggtggtgaccgtgaccagaaacctggaccccgacgacaccgccagaaagaaggccccccccccccccaagagagcccccaccaccgccctgaccctgagaagcaagagcatgaccagcgagctggaggagctggtggacaaggacaagcccgaggagatcgtgcccgccagcaagcccagcagagccgccgagaacatggccgtggagcccagagtggccaccatcaagcagagacccagcagcagatgcttccccgccggcagcgacatgaacagcgtgtacgagagacagggcatcgccgtgatgacccccaccgtgcccggcagccccaaggcccccttcctgggcatccccagaggcaccatgagaagacagaagagcatcgacagcagaatcttcctgagcggcatcaccgaggaggagagacagttcctggccccccccatgctgaagttcaccagaagcctgagcatgcccgacaccagcgaggacatccccccccccccccagagcgtgccccccagcccccccccccccagccccaccacctacaactgccccaagagccccacccccagagtgtacggcaccatcaagcccgccttcaaccagaacagcgccgccaaggtgagccccgccaccagaagcgacaccgtggccaccatgatgagagagaagggcatgtacttcagaagagagctggacagatacagcctggacagcgaggacctgtacagcagaaacgccggcccccaggccaacttcagaaacaagagaggccagatgcccgagaacccctacagcgaggtgggcaagatcgccagcaaggccgtgtacgtgcccgccaagcccgccagaagaaagggcatgctggtgaagcagagcaacgtggaggacagccccgagaagacctgcagcatccccatccccaccatcatcgtgaaggagcccagcaccagcagcagcggcaagagcagccagggcagcagcatggagatcgacccccaggcccccgagccccccagccagctgagacccgacgagagcctgaccgtgagcagccccttcgccgccgccatcgccggcgccgtgagagacagagagaagagactggaggccagaagaaacagccccgccttcctgagcaccgacctgggcgacgaggacgtgggcctgggcccccccgcccccagaaccagacccagcatgttccccgaggagggcgacttcgccgacgaggacagcgccgagcagctgagcagccccatgcccagcgccacccccagagagcccgagaaccacttcgtgggcggcgccgaggccagcgcccccggcgaggccggcagacccctgaacagcaccagcaaggcccagggccccgagagcagccccgccgtgcccagcgccagcagcggcaccgccggccccggcaactacgtgcaccccctgaccggcagactgctggaccccagcagccccctggccctggccctgagcgccagagacagagccatgaaggagagccagcagggccccaagggcgaggcccccaaggccgacctgaacaagcccctgtacatcgacaccaagatgagacccagcctggacgccggcttccccaccgtgaccagacagaacaccagaggccccctgagaagacaggagaccgagaacaagtacgagaccgacctgggcagagacagaaagggcgacgacaagaagaacatgctgatcgacatcatggacaccagccagcagaagagcgccggcctgctgatggtgcacaccgtggacgccaccaagctggacaacgccctgcaggaggaggacgagaaggccgaggtggagatgaagcccgacagcagccccagcgaggtgcccgagggcgtgagcgagaccgagggcgccctgcagatcagcgccgcccccgagcccaccaccgtgcccggcagaaccatcgtggccgtgggcagcatggaggaggccgtgatcctgcccttcagaatcccccccccccccctggccagcgtggacctggacgaggacttcatcttcaccgagcccctgcccccccccctggagttcgccaacagcttcgacatccccgacgacagagccgccagcgtgcccgccctgagcgacctggtgaagcagaagaagagcgacaccccccagagccccagcctgaacagcagccagcccaccaacagcgccgacagcaagaagcccgccagcctgagcaactgcctgcccgccagcttcctgcccccccccgagagcttcgacgccgtggccgacagcggcatcgaggaggtggacagcagaagcagcagcgaccaccacctggagaccaccagcaccatcagcaccgtgagcagcatcagcaccctgagcagcgagggcggcgagaacgtggacacctgcaccgtgtacgccgacggccaggccttcatggtggacaagccccccgtgccccccaagcccaagatgaagcccatcatccacaagagcaacgccctgtaccaggacgccctggtggaggaggacgtggacagcttcgtgatccccccccccgcccccccccccccccccggcagcgcccagcccggcatggccaaggtgctgcagcccagaaccagcaagctgtggggcgacgtgaccgagatcaagagccccatcctgagcggccccaaggccaacgtgatcagcgagctgaacagcatcctgcagcagatgaacagagagaagctggccaagcccggcgagggcctggacagccccatgggcgccaagagcgccagcctggcccccagaagccccgagatcatgagcaccatcagcggcaccagaagcaccaccgtgaccttcaccgtgagacccggcaccagccagcccatcaccctgcagagcagaccccccgactacgagagcagaaccagcggcaccagaagagcccccagccccgtggtgagccccaccgagatgaacaaggagaccctgcccgcccccctgagcgccgccaccgccagccccagccccgccctgagcgacgtgttcagcctgcccagccagccccccagcggcgacctgttcggcctgaaccccgccggcagaagcagaagccccagccccagcatcctgcagcagcccatcagcaacaagcccttcaccaccaagcccgtgcacctgtggaccaagcccgacgtggccgactggctggagagcctgaacctgggcgagcacaaggaggccttcatggacaacgagatcgacggcagccacctgcccaacctgcagaaggaggacctgatcgacctgggcgtgaccagagtgggccacagaatgaacatcgagagagccctgaagcagctgctggacagatag

SEQ ID NO: 98749 - DNA, 843 bp, Artificial Sequence
  Description of Artificial Sequence: Synthetic coding sequence
atgatgaacgtgcccggcggcggcgccgccgccgtgatgatgaccggctacaacaacggcagatgccccagaaacagcctgtacagcgactgcatcatcgaggagaagaccgtggtgctgcagaagaaggacaacgagggcttcggcttcgtgctgagaggcgccaaggccgacacccccatcgaggagttcacccccacccccgccttccccgccctgcagtacctggagagcgtggacgagggcggcgtggcctggcaggccggcctgagaaccggcgacttcctgatcgaggtgaacaacgagaacgtggtgaaggtgggccacagacaggtggtgaacatgatcagacagggcggcaaccacctggtgctgaaggtggtgaccgtgaccagaaacctggaccccgacgacaccgccagaaagaaggccccccccccccccaagagagcccccaccaccgccctgaccctgagaagcaagagcatgaccagcgagctggaggagctggtggacaaggccagcgtgagaaagaagaaggacaagcccgaggagatcgtgcccgccagcaagcccagcagagccgccgagaacatggccgtggagcccagagtggccaccatcaagcagagacccagcagcagatgcttccccgccggcagcgacatgaacagcgtgtacgagagacagggcatcgccgtgatgacccccaccgtgcccggcagccccaaggcccccttcctgggcatccccagaggcaccatgagaagacagaagagcatcggcaagaagtgcggcacccccccccagaagctgcccctgggcttccagacccagccctag

SEQ ID NO: 98750 - DNA, 4413 bp, Artificial Sequence
  Description of Artificial Sequence: Synthetic coding sequence
atgaagagcctgctgaacgccttcaccaagaaggaggtgcccttcagagaggcccccgcctacagcaacagaagaagaagaccccccaacaccctggccgcccccagagtgctgctgagaagcaacagcgacaacaacctgaacgccagcgcccccgactgggccgtgtgcagcaccgccaccagccacagaagcctgagcccccagctgctgcagcagatgcccagcaagcccgagggcgccgccaagaccatcggcagctacgtgcccggccccagaagcagaagccccagcctgaacagactgggcggcgccggcgaggacggcaagagaccccagcccctgtggcacgtgggcagccccttcgccctgggcgccaacaaggacagcctgagcgccttcgagtaccccggccccaagagaaagctgtacagcgccgtgcccggcagactgttcgtggccgtgaagccctaccagccccaggtggacggcgagatccccctgcacagaggcgacagagtgaaggtgctgagcatcggcgagggcggcttctgggagggcagcgccagaggccacatcggctggttccccgccgagtgcgtggaggaggtgcagtgcaagcccagagacagccaggccgagaccagagccgacagaagcaagaagctgttcagacactacaccgtgggcagctacgacagcttcgacaccagcagcgactgcatcatcgaggagaagaccgtggtgctgcagaagaaggacaacgagggcttcggcttcgtgctgagaggcgccaaggccgacacccccatcgaggagttcacccccacccccgccttccccgccctgcagtacctggagagcgtggacgagggcggcgtggcctggcaggccggcctgagaaccggcgacttcctgatcgaggtgaacaacgagaacgtggtgaaggtgggccacagacaggtggtgaacatgatcagacagggcggcaaccacctggtgctgaaggtggtgaccgtgaccagaaacctggaccccgacgacaccgccagaaagaaggccccccccccccccaagagagcccccaccaccgccctgaccctgagaagcaagagcatgaccagcgagctggaggagctggtggacaaggccagcgtgagaaagaagaaggacaagcccgaggagatcgtgcccgccagcaagcccagcagagccgccgagaacatggccgtggagcccagagtggccaccatcaagcagagacccagcagcagatgcttccccgccggcagcgacatgaacagcgtgtacgagagacagggcatcgccgtgatgacccccaccgtgcccggcagccccaaggcccccttcctgggcatccccagaggcaccatgagaagacagaagagcatcgacagcagaatcttcctgagcggcatcaccgaggaggagagacagttcctggccccccccatgctgaagttcaccagaagcctgagcatgcccgacaccagcgaggacatccccccccccccccagagcgtgccccccagcccccccccccccagccccaccacctacaactgccccaagagccccacccccagagtgtacggcaccatcaagcccgccttcaaccagaacagcgccgccaaggtgagccccgccaccagaagcgacaccgtggccaccatgatgagagagaagggcatgtacttcagaagagagctggacagatacagcctggacagcgaggacctgtacagcagaaacgccggcccccaggccaacttcagaaacaagagaggccagatgcccgagaacccctacagcgaggtgggcaagatcgccagcaaggccgtgtacgtgcccgccaagcccgccagaagaaagggcatgctggtgaagcagagcaacgtggaggacagccccgagaagacctgcagcatccccatccccaccatcatcgtgaaggagcccagcaccagcagcagcggcaagagcagccagggcagcagcatggagatcgacccccaggcccccgagccccccagccagctgagacccgacgagagcctgaccgtgagcagccccttcgccgccgccatcgccggcgccgtgagagacagagagaagagactggaggccagaagaaacagccccgccttcctgagcaccgacctgggcgacgaggacgtgggcctgggcccccccgcccccagaaccagacccagcatgttccccgaggagggcgacttcgccgacgaggacagcgccgagcagctgagcagccccatgcccagcgccacccccagagagcccgagaaccacttcgtgggcggcgccgaggccagcgcccccggcgaggccggcagacccctgaacagcaccagcaaggcccagggccccgagagcagccccgccgtgcccagcgccagcagcggcaccgccggccccggcaactacgtgcaccccctgaccggcagactgctggaccccagcagccccctggccctggccctgagcgccagagacagagccatgaaggagagccagcagggccccaagggcgaggcccccaaggccgacctgaacaagcccctgtacatcgacaccaagatgagacccagcctggacgccggcttccccaccgtgaccagacagaacaccagaggccccctgagaagacaggagaccgagaacaagtacgagaccgacctgggcagagacagaaagggcgacgacaagaagaacatgctgatcgacatcatggacaccagccagcagaagagcgccggcctgctgatggtgcacaccgtggacgccaccaagctggacaacgccctgcaggaggaggacgagaaggccgaggtggagatgaagcccgacagcagccccagcgaggtgcccgagggcgtgagcgagaccgagggcgccctgcagatcagcgccgcccccgagcccaccaccgtgcccggcagaaccatcgtggccgtgggcagcatggaggaggccgtgatcctgcccttcagaatcccccccccccccctggccagcgtggacctggacgaggacttcatcttcaccgagcccctgcccccccccctggagttcgccaacagcttcgacatccccgacgacagagccgccagcgtgcccgccctgagcgacctggtgaagcagaagaagagcgacaccccccagagccccagcctgaacagcagccagcccaccaacagcgccgacagcaagaagcccgccagcctgagcaactgcctgcccgccagcttcctgcccccccccgagagcttcgacgccgtggccgacagcggcatcgaggaggtggacagcagaagcagcagcgaccaccacctggagaccaccagcaccatcagcaccgtgagcagcatcagcaccctgagcagcgagggcggcgagaacgtggacacctgcaccgtgtacgccgacggccaggccttcatggtggacaagccccccgtgccccccaagcccaagatgaagcccatcatccacaagagcaacgccctgtaccaggacgccctggtggaggaggacgtggacagcttcgtgatccccccccccgcccccccccccccccccggcagcgcccagcccggcatggccaaggtgctgcagcccagaaccagcaagctgtggggcgacgtgaccgagatcaagagccccatcctgagcggccccaaggccaacgtgatcagcgagctgaacagcatcctgcagcagatgaacagagagaagctggccaagcccggcgagggcctggacagccccatgggcgccaagagcgccagcctggcccccagaagccccgagatcatgagcaccatcagcggcaccagaagcaccaccgtgaccttcaccgtgagacccggcaccagccagcccatcaccctgcagagcagaccccccgactacgagagcagaaccagcggcaccagaagagcccccagccccgtggtgagccccaccgagatgaacaaggagaccctgcccgcccccctgagcgccgccaccgccagccccagccccgccctgagcgacgtgttcagcctgcccagccagccccccagcggcgacctgttcggcctgaaccccgccggcagaagcagaagccccagccccagcatcctgcagcagcccatcagcaacaagcccttcaccaccaagcccgtgcacctgtggaccaagcccgacgtggccgactggctggagagcctgaacctgggcgagcacaaggaggccttcatggacaacgagatcgacggcagccacctgcccaacctgcagaaggaggacctgatcgacctgggcgtgaccagagtgggccacagaatgaacatcgagagagccctgaagcagctgctggacagatag

SEQ ID NO: 98751 - DNA, 816 bp, Artificial Sequence
  Description of Artificial Sequence: Synthetic coding sequence
atgatgatgaacgtgcccggcggcggcgccgccgccgtgatgatgaccggctacaacaacggcagatgccccagaaacagcctgtacagcgactgcatcatcgaggagaagaccgtggtgctgcagaagaaggacaacgagggcttcggcttcgtgctgagaggcgccaaggccgacacccccatcgaggagttcacccccacccccgccttccccgccctgcagtacctggagagcgtggacgagggcggcgtggcctggcaggccggcctgagaaccggcgacttcctgatcgaggtgaacaacgagaacgtggtgaaggtgggccacagacaggtggtgaacatgatcagacagggcggcaaccacctggtgctgaaggtggtgaccgtgaccagaaacctggaccccgacgacaccgccagaaagaaggccccccccccccccaagagagcccccaccaccgccctgaccctgagaagcaagagcatgaccagcgagctggaggagctggacaagcccgaggagatcgtgcccgccagcaagcccagcagagccgccgagaacatggccgtggagcccagagtggccaccatcaagcagagacccagcagcagatgcttccccgccggcagcgacatgaacagcgtgtacgagagacagggcatcgccgtgatgacccccaccgtgcccggcagccccaaggcccccttcctgggcatccccagaggcaccatgagaagacagaagagcatcggcaagaagtgcggcacccccccccagaagctgcccctgggcttccagacccagccctag

SEQ ID NO: 98752 - DNA, 3765 bp, Artificial Sequence
  Description of Artificial Sequence: Synthetic coding sequence
atgatgatgaacgtgcccggcggcggcgccgccgccgtgatgatgaccggctacaacaacggcagatgccccagaaacagcctgtacagcgactgcatcatcgaggagaagaccgtggtgctgcagaagaaggacaacgagggcttcggcttcgtgctgagaggcgccaaggccgacacccccatcgaggagttcacccccacccccgccttccccgccctgcagtacctggagagcgtggacgagggcggcgtggcctggcaggccggcctgagaaccggcgacttcctgatcgaggtgaacaacgagaacgtggtgaaggtgggccacagacaggtggtgaacatgatcagacagggcggcaaccacctggtgctgaaggtggtgaccgtgaccagaaacctggaccccgacgacaccgccagaaagaaggccccccccccccccaagagagcccccaccaccgccctgaccctgagaagcaagagcatgaccagcgagctggaggagctggtggacaaggacaagcccgaggagatcgtgcccgccagcaagcccagcagagccgccgagaacatggccgtggagcccagagtggccaccatcaagcagagacccagcagcagatgcttccccgccggcagcgacatgaacagcgtgtacgagagacagggcatcgccgtgatgacccccaccgtgcccggcagccccaaggcccccttcctgggcatccccagaggcaccatgagaagacagaagagcatcgacagcagaatcttcctgagcggcatcaccgaggaggagagacagttcctggccccccccatgctgaagttcaccagaagcctgagcatgcccgacaccagcgaggacatccccccccccccccagagcgtgccccccagcccccccccccccagccccaccacctacaactgccccaagagccccacccccagagtgtacggcaccatcaagcccgccttcaaccagaacagcgccgccaaggtgagccccgccaccagaagcgacaccgtggccaccatgatgagagagaagggcatgtacttcagaagagagctggacagatacagcctggacagcgaggacctgtacagcagaaacgccggcccccaggccaacttcagaaacaagagaggccagatgcccgagaacccctacagcgaggtgggcaagatcgccagcaaggccgtgtacgtgcccgccaagcccgccagaagaaagggcatgctggtgaagcagagcaacgtggaggacagccccgagaagacctgcagcatccccatccccaccatcatcgtgaaggagcccagcaccagcagcagcggcaagagcagccagggcagcagcatggagatcgacccccaggcccccgagccccccagccagctgagacccgacgagagcctgaccgtgagcagccccttcgccgccgccatcgccggcgccgtgagagacagagagaagagactggaggccagaagaaacagccccgccttcctgagcaccgacctgggcgacgaggacgtgggcctgggcccccccgcccccagaaccagacccagcatgttccccgaggagggcgacttcgccgacgaggacagcgccgagcagctgagcagccccatgcccagcgccacccccagagagcccgagaaccacttcgtgggcggcgccgaggccagcgcccccggcgaggccggcagacccctgaacagcaccagcaaggcccagggccccgagagcagccccgccgtgcccagcgccagcagcggcaccgccggccccggcaactacgtgcaccccctgaccggcagactgctggaccccagcagccccctggccctggccctgagcgccagagacagagccatgaaggagagccagcagggccccaagggcgaggcccccaaggccgacctgaacaagcccctgtacatcgacaccaagatgagacccagcctggacgccggcttccccaccgtgaccagacagaacaccagaggccccctgagaagacaggagaccgagaacaagtacgagaccgacctgggcagagacagaaagggcgacgacaagaagaacatgctgatcgacatcatggacaccagccagcagaagagcgccggcctgctgatggtgcacaccgtggacgccaccaagctggacaacgccctgcaggaggaggacgagaaggccgaggtggagatgaagcccgacagcagccccagcgaggtgcccgagggcgtgagcgagaccgagggcgccctgcagatcagcgccgcccccgagcccaccaccgtgcccggcagaaccatcgtggccgtgggcagcatggaggaggccgtgatcctgcccttcagaatcccccccccccccctggccagcgtggacctggacgaggacttcatcttcaccgagcccctgcccccccccctggagttcgccaacagcttcgacatccccgacgacagagccgccagcgtgcccgccctgagcgacctggtgaagcagaagaagagcgacaccccccagagccccagcctgaacagcagccagcccaccaacagcgccgacagcaagaagcccgccagcctgagcaactgcctgcccgccagcttcctgcccccccccgagagcttcgacgccgtggccgacagcggcatcgaggaggtggacagcagaagcagcagcgaccaccacctggagaccaccagcaccatcagcaccgtgagcagcatcagcaccctgagcagcgagggcggcgagaacgtggacacctgcaccgtgtacgccgacggccaggccttcatggtggacaagccccccgtgccccccaagcccaagatgaagcccatcatccacaagagcaacgccctgtaccaggacgccctggtggaggaggacgtggacagcttcgtgatccccccccccgcccccccccccccccccggcagcgcccagcccggcatggccaaggtgctgcagcccagaaccagcaagctgtggggcgacgtgaccgagatcaagagccccatcctgagcggccccaaggccaacgtgatcagcgagctgaacagcatcctgcagcagatgaacagagagaagctggccaagcccggcgagggcctggacagccccatgggcgccaagagcgccagcctggcccccagaagccccgagatcatgagcaccatcagcggcaccagaagcaccaccgtgaccttcaccgtgagacccggcaccagccagcccatcaccctgcagagcagaccccccgactacgagagcagaaccagcggcaccagaagagcccccagccccgtggtgagccccaccgagatgaacaaggagaccctgcccgcccccctgagcgccgccaccgccagccccagccccgccctgagcgacgtgttcagcctgcccagccagccccccagcggcgacctgttcggcctgaaccccgccggcagaagcagaagccccagccccagcatcctgcagcagcccatcagcaacaagcccttcaccaccaagcccgtgcacctgtggaccaagcccgacgtggccgactggctggagagcctgaacctgggcgagcacaaggaggccttcatggacaacgagatcgacggcagccacctgcccaacctgcagaaggaggacctgatcgacctgggcgtgaccagagtgggccacagaatgaacatcgagagagccctgaagcagctgctggacagatag

SEQ ID NO: 98753 - DNA, 915 bp, Artificial Sequence
  Description of Artificial Sequence: Synthetic coding sequence
atgcccagaagccccaccagcagcgaggacgagatggcccagagcttcagcgactacagcgtgggcagcgagagcgacagcagcaaggaggagaccatctacgacaccatcagagccaccgccgagaagcccggcggcgccagaaccgaggagagccagggcaacaccctggtgatcagagtggtgatccacgacctgcagcagaccaagtgcatcagattcaaccccgacgccaccgtgtgggtggccaagcagagaatcctgtgcaccctgacccagagcctgaaggacgtgctgaactacggcctgttccagcccgccagcaacggcagagacggcaagttcctggacgaggagagactgctgagagagtacccccagcccgtgggcgagggcgtgcccagcctggagttcagatacaagaagagagtgtacaagcaggccagcctggacgagaagcagctggccaagctgcacaccaagaccaacctgaagaagtgcatggaccacatccagcacagactggtggagaagatcaccaagatgctggacagaggcctggaccccaacttccacgaccccgagaccggcgagacccccctgaccctggccgcccagctggacgacagcgtggaggtgatcaaggccctgaagaacggcggcgcccacctggacttcagagccaaggacggcatgaccgccctgcacaaggccgccagagccagaaaccaggtggccctgaagaccctgctggagctgggcgccagccccgactacaaggacagctacggcctgacccccctgtaccacaccgccatcgtgggcggcgacccctactgctgcgagctgctgctgcacgagcacgccaccgtgtgctgcaaggacgagaacggctggcacgagatccaccagtag

SEQ ID NO: 98754 - DNA, 5244 bp, Artificial Sequence
  Description of Artificial Sequence: Synthetic coding sequence
atggacggccccggcgccagcgccgtggtggtgagagtgggcatccccgacctgcagcagaccaagtgcctgagactggaccccgccgcccccgtgtgggccgccaagcagagagtgctgtgcgccctgaaccacagcctgcaggacgccctgaactacggcctgttccagccccccagcagaggcagagccggcaagttcctggacgaggagagactgctgcaggagtacccccccaacctggacacccccctgccctacctggagttcagatacaagagaagagtgtacgcccagaacctgatcgacgacaagcagttcgccaagctgcacaccaaggccaacctgaagaagttcatggactacgtgcagctgcacagcaccgacaaggtggccagactgctggacaagggcctggaccccaacttccacgaccccgacagcggcgagtgccccctgagcctggccgcccagctggacaacgccaccgacctgctgaaggtgctgaagaacggcggcgcccacctggacttcagaaccagagacggcctgaccgccgtgcactgcgccaccagacagagaaacgccgccgccctgaccaccctgctggacctgggcgccagccccgactacaaggacagcagaggcctgacccccctgtaccacagcgccctgggcggcggcgacgccctgtgctgcgagctgctgctgcacgaccacgcccagctgggcatcaccgacgagaacggctggcaggagatccaccaggcctgcagattcggccacgtgcagcacctggagcacctgctgttctacggcgccgacatgggcgcccagaacgccagcggcaacaccgccctgcacatctgcgccctgtacaaccaggagagctgcgccagagtgctgctgttcagaggcgccaacagagacgtgagaaactacaacagccagaccgccttccaggtggccatcatcgccggcaacttcgagctggccgaggtgatcaagacccacaaggacagcgacgtggtgcccttcagagagacccccagctacgccaagagaagaagactggccggccccagcggcctggccagccccagacccctgcagagaagcgccagcgacatcaacctgaagggcgaggcccagcccgccgccagccccggccccagcctgagaagcctgccccaccagctgctgctgcagagactgcaggaggagaaggacagagacagagacgccgaccaggagagcaacatcagcggccccctggccggcagagccggccagagcaagatcagcgaccccggccccggccccggcggcgtgggcggcgcccccctgcccccccccggcgcccccagaagctgcatcagaatcagagccagattccccgccccccccgccccccccgcccccccccccagaggccccaagagaaagctgtacagcgccgtgcccggcagaaagttcatcgccgtgaaggcccacagcccccagggcgagggcgagatccccctgcacagaggcgaggccgtgaaggtgctgagcatcggcgagggcggcttctgggagggcaccgtgaagggcagaaccggctggttccccgccgactgcgtggaggaggtgcagatgagacagcacgacaccagacccgagaccagagaggacagaaccaagagactgttcagacactacaccgtgggcagctacgacagcctgaccagccacagcgactacgtgatcgacgacaaggtggccgtgctgcagaagagagaccacgagggcttcggcttcgtgctgagaggcgccaaggccgagacccccatcgaggagttcacccccacccccgccttccccgccctgcagtacctggagagcgtggacgtggagggcgtggcctggagagccggcctgagaaccggcgacttcctgatcgaggtgaacggcgtgaacgtggtgaaggtgggccacaagcaggtggtggccctgatcagacagggcggcaacagactggtgatgaaggtggtgagcgtgaccagaaagcccgaggaggacggcgccagaagaagagccccccccccccccaagagagcccccagcaccaccctgaccctgagaagcaagagcatgaccgccgagctggaggagctggccagcatcagaagaagaaagggcgagaagctggacgagatgctggccgccgccgccgagcccaccctgagacccgacatcgccgacgccgacagcagagccgccaccgtgaagcagagacccaccagcagaagaatcacccccgccgagatcagcagcctgttcgagagacagggcctgcccggccccgagaagctgcccggcagcctgagaaagggcatccccagaaccaagagcgtgggcgaggacgagaagctggccagcctgctggagggcagattccccagaagcaccagcatgcaggaccccgtgagagagggcagaggcatccccccccccccccagaccgcccccccccccccccccgccccctactacttcgacagcggccccccccccgccttcagccccccccccccccccggcagagcctacgacaccgtgagaagcagcttcaagcccggcctggaggccagactgggcgccggcgccgccggcctgtacgagcccggcgccgccctgggccccctgccctaccccgagagacagaagagagccagaagcatgatcatcctgcaggacagcgcccccgagagcggcgacgcccccagacccccccccgccgccaccccccccgagagacccaagagaagacccagaccccccggccccgacagcccctacgccaacctgggcgccttcagcgccagcctgttcgcccccagcaagccccagagaagaaagagccccctggtgaagcagctgcaggtggaggacgcccaggagagagccgccctggccgtgggcagccccggccccggcggcggcagcttcgccagagagcccagccccacccacagaggccccagacccggcggcctggactacggcgccggcgacggccccggcctggccttcggcggccccggccccgccaaggacagaagactggaggagagaagaagaagcaccgtgttcctgagcgtgggcgccatcgagggcagcgcccccggcgccgacctgcccagcctgcagcccagcagaagcatcgacgagagactgctgggcaccggccccaccgccggcagagacctgctgctgcccagccccgtgagcgccctgaagcccctggtgagcggccccagcctgggccccagcggcagcaccttcatccaccccctgaccggcaagcccctggaccccagcagccccctggccctggccctggccgccagagagagagccctggccagccaggcccccagcagaagccccacccccgtgcacagccccgacgccgacagacccggccccctgttcgtggacgtgcaggccagagaccccgagagaggcagcctggccagccccgccttcagccccagaagccccgcctggatccccgtgcccgccagaagagaggccgagaaggtgcccagagaggagagaaagagccccgaggacaagaagagcatgatcctgagcgtgctggacaccagcctgcagagacccgccggcctgatcgtggtgcacgccaccagcaacggccaggagcccagcagactgggcggcgccgaggaggagagacccggcacccccgagctggcccccgcccccatgcagagcgccgccgtggccgagcccctgcccagccccagagcccagccccccggcggcacccccgccgacgccggccccggccagggcagcagcgaggaggagcccgagctggtgttcgccgtgaacctgccccccgcccagctgagcagcagcgacgaggagaccagagaggagctggccagaatcggcctggtgcccccccccgaggagttcgccaacggcgtgctgctggccacccccctggccggccccggccccagccccaccaccgtgcccagccccgccagcggcaagcccagcagcgagcccccccccgcccccgagagcgccgccgacagcggcgtggaggaggccgacaccagaagcagcagcgacccccacctggagaccaccagcaccatcagcaccgtgagcagcatgagcaccctgagcagcgagagcggcgagctgaccgacacccacaccagcttcgccgacggccacaccttcctgctggagaagccccccgtgccccccaagcccaagctgaagagccccctgggcaagggccccgtgaccttcagagaccccctgctgaagcagagcagcgacagcgagctgatggcccagcagcaccacgccgccagcgccggcctggccagcgccgccggccccgccagacccagatacctgttccagagaagaagcaagctgtggggcgaccccgtggagagcagaggcctgcccggccccgaggacgacaagcccaccgtgatcagcgagctgagcagcagactgcagcagctgaacaaggacaccagaagcctgggcgaggagcccgtgggcggcctgggcagcctgctggaccccgccaagaagagccccatcgccgccgccagactgttcagcagcctgggcgagctgagcagcatcagcgcccagagaagccccggcggccccggcggcggcgccagctacagcgtgagacccagcggcagataccccgtggccagaagagcccccagccccgtgaagcccgccagcctggagagagtggagggcctgggcgccggcgccggcggcgccggcagacccttcggcctgaccccccccaccatcctgaagagcagcagcctgagcatcccccacgagcccaaggaggtgagattcgtggtgagaagcgtgagcgccagaagcagaagccccagccccagccccctgcccagccccgccagcggccccggccccggcgcccccggccccagaagacccttccagcagaagcccctgcagctgtggagcaagttcgacgtgggcgactggctggagagcatccacctgggcgagcacagagacagattcgaggaccacgagatcgagggcgcccacctgcccgccctgaccaaggacgacttcgtggagctgggcgtgaccagagtgggccacagaatgaacatcgagagagccctgagacagctggacggcagctag

SEQ ID NO: 98755 - DNA, 5229 bp, Artificial Sequence
  Description of Artificial Sequence: Synthetic coding sequence
atggacggccccggcgccagcgccgtggtggtgagagtgggcatccccgacctgcagcagaccaagtgcctgagactggaccccgccgcccccgtgtgggccgccaagcagagagtgctgtgcgccctgaaccacagcctgcaggacgccctgaactacggcctgttccagccccccagcagaggcagagccggcaagttcctggacgaggagagactgctgcaggagtacccccccaacctggacacccccctgccctacctggagttcagatacaagagaagagtgtacgcccagaacctgatcgacgacaagcagttcgccaagctgcacaccaaggccaacctgaagaagttcatggactacgtgcagctgcacagcaccgacaaggtggccagactgctggacaagggcctggaccccaacttccacgaccccgacagcggcgagtgccccctgagcctggccgcccagctggacaacgccaccgacctgctgaaggtgctgaagaacggcggcgcccacctggacttcagaaccagagacggcctgaccgccgtgcactgcgccaccagacagagaaacgccgccgccctgaccaccctgctggacctgggcgccagccccgactacaaggacagcagaggcctgacccccctgtaccacagcgccctgggcggcggcgacgccctgtgctgcgagctgctgctgcacgaccacgcccagctgggcatcaccgacgagaacggctggcaggagatccaccaggcctgcagattcggccacgtgcagcacctggagcacctgctgttctacggcgccgacatgggcgcccagaacgccagcggcaacaccgccctgcacatctgcgccctgtacaaccaggagagctgcgccagagtgctgctgttcagaggcgccaacagagacgtgagaaactacaacagccagaccgccttccaggtggccatcatcgccggcaacttcgagctggccgaggtgatcaagacccacaaggacagcgacgtggtgcccttcagagagacccccagctacgccaagagaagaagactggccggccccagcggcctggccagccccagacccctgcagagaagcgccagcgacatcaacctgaagggcgaggcccagcccgccgccagccccggccccagcctgagaagcctgccccaccagctgctgctgcagagactgcaggaggagaaggacagagacagagacgccgaccaggagagcaacatcagcggccccctggccggcagagccggccagagcaagatcagcgagcccggcgcccccagaagctgcatcagaatcagagccagattccccgccccccccgccccccccgcccccccccccagaggccccaagagaaagctgtacagcgccgtgcccggcagaaagttcatcgccgtgaaggcccacagcccccagggcgagggcgagatccccctgcacagaggcgaggccgtgaaggtgctgagcatcggcgagggcggcttctgggagggcaccgtgaagggcagaaccggctggttccccgccgactgcgtggaggaggtgcagatgagacagcacgacaccagacccgagaccagagaggacagaaccaagagactgttcagacactacaccgtgggcagctacgacagcctgaccagccacagcgactacgtgatcgacgacaaggtggccgtgctgcagaagagagaccacgagggcttcggcttcgtgctgagaggcgccaaggccgagacccccatcgaggagttcacccccacccccgccttccccgccctgcagtacctggagagcgtggacgtggagggcgtggcctggagagccggcctgagaaccggcgacttcctgatcgaggtgaacggcgtgaacgtggtgaaggtgggccacaagcaggtggtggccctgatcagacagggcggcaacagactggtgatgaaggtggtgagcgtgaccagaaagcccgaggaggacggcgccagaagaagagccccccccccccccaagagagcccccagcaccaccctgaccctgagaagcaagagcatgaccgccgagctggaggagctgggcgagtggagaggcagagagggcagcgagaagctggacgagatgctggccgccgccgccgagcccaccctgagacccgacatcgccgacgccgacagcagagccgccaccgtgaagcagagacccaccagcagaagaatcacccccgccgagatcagcagcctgttcgagagacagggcctgcccggccccgagaagctgcccggcagcctgagaaagggcatccccagaaccaagagcgtgggcgaggacgagaagctggccagcctgctggagggcagattccccagaagcaccagcatgcaggaccccgtgagagagggcagaggcatccccccccccccccagaccgcccccccccccccccccgccccctactacttcgacagcggccccccccccgccttcagccccccccccccccccggcagagcctacgacaccgtgagaagcagcttcaagcccggcctggaggccagactgggcgccggcgccgccggcctgtacgagcccggcgccgccctgggccccctgccctaccccgagagacagaagagagccagaagcatgatcatcctgcaggacagcgcccccgagagcggcgacgcccccagacccccccccgccgccaccccccccgagagacccaagagaagacccagaccccccggccccgacagcccctacgccaacctgggcgccttcagcgccagcctgttcgcccccagcaagccccagagaagaaagagccccctggtgaagcagctgcaggtggaggacgcccaggagagagccgccctggccgtgggcagccccggccccggcggcggcagcttcgccagagagcccagccccacccacagaggccccagacccggcggcctggactacggcgccggcgacggccccggcctggccttcggcggccccggccccgccaaggacagaagactggaggagagaagaagaagcaccgtgttcctgagcgtgggcgccatcgagggcagcgcccccggcgccgacctgcccagcctgcagcccagcagaagcatcgacgagagactgctgggcaccggccccaccgccggcagagacctgctgctgcccagccccgtgagcgccctgaagcccctggtgagcggccccagcctgggccccagcggcagcaccttcatccaccccctgaccggcaagcccctggaccccagcagccccctggccctggccctggccgccagagagagagccctggccagccaggcccccagcagaagccccacccccgtgcacagccccgacgccgacagacccggccccctgttcgtggacgtgcaggccagagaccccgagagaggcagcctggccagccccgccttcagccccagaagccccgcctggatccccgtgcccgccagaagagaggccgagaaggtgcccagagaggagagaaagagccccgaggacaagaagagcatgatcctgagcgtgctggacaccagcctgcagagacccgccggcctgatcgtggtgcacgccaccagcaacggccaggagcccagcagactgggcggcgccgaggaggagagacccggcacccccgagctggcccccgcccccatgcagagcgccgccgtggccgagcccctgcccagccccagagcccagccccccggcggcacccccgccgacgccggccccggccagggcagcagcgaggaggagcccgagctggtgttcgccgtgaacctgccccccgcccagctgagcagcagcgacgaggagaccagagaggagctggccagaatcggcctggtgcccccccccgaggagttcgccaacggcgtgctgctggccacccccctggccggccccggccccagccccaccaccgtgcccagccccgccagcggcaagcccagcagcgagcccccccccgcccccgagagcgccgccgacagcggcgtggaggaggccgacaccagaagcagcagcgacccccacctggagaccaccagcaccatcagcaccgtgagcagcatgagcaccctgagcagcgagagcggcgagctgaccgacacccacaccagcttcgccgacggccacaccttcctgctggagaagccccccgtgccccccaagcccaagctgaagagccccctgggcaagggccccgtgaccttcagagaccccctgctgaagcagagcagcgacagcgagctgatggcccagcagcaccacgccgccagcgccggcctggccagcgccgccggccccgccagacccagatacctgttccagagaagaagcaagctgtggggcgaccccgtggagagcagaggcctgcccggccccgaggacgacaagcccaccgtgatcagcgagctgagcagcagactgcagcagctgaacaaggacaccagaagcctgggcgaggagcccgtgggcggcctgggcagcctgctggaccccgccaagaagagccccatcgccgccgccagatgcagaagccccatggtgggcctgagactgttcagcagcctgggcgagctgagcagcatcagcgcccagagaagccccggcggccccggcggcggcgccagctacagcgtgagacccagcggcagataccccgtggccagaagagcccccagccccgtgaagcccgccagcctggagagagtggagggcctgggcgccggcgccggcggcgccggcagacccttcggcctgaccccccccaccatcctgaagagcagcagcctgagcatcccccacgagcccaaggaggtgagattcgtggtgagaagcgtgagcgccagaagcagaagccccagccccagccccctgcccagccccgccagcggccccggccccggcgcccccggccccagaagacccttccagcagaagcccctgcagctgtggagcaagttcgacgtgggcgactggctggagagcatccacctgggcgagcacagagacagattcgaggaccacgagatcgagggcgcccacctgcccgccctgaccaaggacgacttcgtggagctgggcgtgaccagagtgggccacagaatgaacatcgagagagccctgagacagctggacggcagctag

SEQ ID NO: 98756 - DNA, 2736 bp, Artificial Sequence
  Description of Artificial Sequence: Synthetic coding sequence
atgccccccagaagaagcatcgtggaggtgaaggtgctggacgtgcagaagagaagagtgcccaacaagcactacgtgtacatcatcagagtgacctggagcagcggcagcaccgaggccatctacagaagatacagcaagttcttcgacctgcagatgcagatgctggacaagttccccatggagggcggccagaaggaccccaagcagagaatcatccccttcctgcccggcaagatcctgttcagaagaagccacatcagagacgtggccgtgaagagactgatccccatcgacgagtactgcaaggccctgatccagctgcccccctacatcagccagtgcgacgaggtgctgcagttcttcgagaccagacccgaggacctgaacccccccaaggaggagcacatcggcaagaagaagagcggcggcgaccagaccagcgtggaccccatggtgctggagcagtacgtggtggtggccaactaccagaagcaggagagcagcgagatcagcctgagcgtgggccaggtggtggacatcatcgagaagaacgagagcggctggtggttcgtgagcaccgccgaggagcagggctgggtgcccgccacctgcctggagggccaggacggcgtgcaggacgagttcagcctgcagcccgaggaggaggagaagtacaccgtgatctacccctacaccgccagagaccaggacgagatgaacctggagagaggcgccgtggtggaggtgatccagaagaacctggagggctggtggaagatcagataccagggcaaggagggctgggcccccgccagctacctgaagaagaacagcggcgagcccctgccccccaagcccggccccggcagccccagccaccccggcgccctggacctggacggcgtgagcagacagcagaacgccgtgggcagagagaaggagctgctgagcagccagagagacggcagattcgagggcagacccgtgcccgacggcgacgccaagcagagaagccccaagatgagacagagacccccccccagaagagacatgaccatccccagaggcctgaacctgcccaagccccccatccccccccaggtggaggaggagtactacaccatcgccgagttccagaccaccatccccgacggcatcagcttccaggccggcctgaaggtggaggtgatcgagaagaacctgagcggctggtggtacatccagatcgaggacaaggagggctgggcccccgccaccttcatcgacaagtacaagaagaccagcaacgccagcagacccaacttcctggcccccctgccccacgaggtgacccagctgagactgggcgaggccgccgccctggagaacaacaccggcagcgaggccaccggccccagcagacccctgcccgacgccccccacggcgtgatggacagcggcctgccctggagcaaggactggaagggcagcaaggacgtgctgagaaaggccagcagcgacatgagcgccagcgccggctacgaggagatcagcgaccccgacatggaggagaagcccagcctgccccccagaaaggagagcatcatcaagagcgagggcgagctgctggagagagagagagagagacagagaaccgagcagctgagaggccccacccccaagccccccggcgtgatcctgcccatgatgcccgccaagcacatcccccccgccagagacagcagaagacccgagcccaagcccgacaagagcagactgttccagctgaagaacgacatgggcctggagtgcggccacaaggtgctggccaaggaggtgaagaagcccaacctgagacccatcagcaagagcaagaccgacctgcccgaggagaagcccgacgccaccccccagaaccccttcctgaagagcagaccccaggtgagacccaagcccgcccccagccccaagaccgagcccccccagggcgaggaccaggtggacatctgcaacctgagaagcaagctgagacccgccaagagccaggacaagagcctgctggacggcgagggcccccaggccgtgggcggccaggacgtggccttcagcagaagcttcctgcccggcgagggccccggcagagcccaggacagaaccggcaagcaggacggcctgagccccaaggagatcagctgcagagccccccccagacccgccaagaccaccgaccccgtgagcaagagcgtgcccgtgcccctgcaggaggccccccagcagagacccgtggtgccccccagaagaccccccccccccaagaagaccagcagcagcagcagacccctgcccgaggtgagaggcccccagtgcgagggccacgagagcagagccgcccccacccccggcagagccctgctggtgccccccaaggccaagcccttcctgagcaacagcctgggcggccaggacgacaccagaggcaagggcagcctgggcccctggggcaccggcaagatcggcgagaacagagagaaggccgccgccgccagcgtgcccaacgccgacggcctgaaggacagcctgtacgtggccgtggccgacttcgagggcgacaaggacaccagcagcttccaggagggcaccgtgttcgaggtgagagagaagaacagcagcggctggtggttctgccaggtgctgagcggcgcccccagctgggagggctggatccccagcaactacctgagaaagaagccctag

SEQ ID NO: 98757 - DNA, 2805 bp, Artificial Sequence
  Description of Artificial Sequence: Synthetic coding sequence
atggaggagatctggaagttcagcacctacctgaacctgggctacgtgagcatgtgcctggagcacctgctgttcgaccacaagtactggctgaactgcatcctggtggaggacaccgagatccaggtgagcgtggacgacaagcacctggagaccatctacctgggcctgctgatccaggagggccacttcttctgcagagccctgtgcagcgtgaccccccccgccgagaaggagggcgagtgcctgaccctgtgcaagaacgagctgatcagcgtgaagatggccgaggccggcagcgagctggagggcgtgagcctggtgaccggccagagaggcctggtgctggtgagcgccctggagcccctgcccctgcccttccaccagtggttcctgaagaactaccccggcagctgcggcctgagcagaaagagagactggaccggcagctaccagatcggcagaggcagatgcaaggccctgaccggctacgagcccggcgagaaggacgagctgaacttctaccagggcgagagcatcgagatcatcggcttcgtgatccccggcctgcagtggttcatcggcaagagcaccagcagcggccaggtgggcttcgtgcccaccagaaacatcgaccccgacagctacagccccatgagcagaaacagcgccttcctgagcgacgaggagagatgcagcctgctggccctgggcagcgacaagcagaccgagtgcagcagcttcctgcacaccctggccagaaccgacatcaccagcgtgtacagactgagcggcttcgagagcatccagaacccccccaacgacctgagcgccagccagcccgagggcttcaaggaggtgagacccggcagagcctgggaggagcaccaggccgtgggcagcagacagagcagcagcagcgaggacagcagcctggaggaggagctgctgagcgccaccagcgacagctacagactgcccgagcccgacgacctggacgaccccgagctgctgatggacctgagcaccggccaggaggaggaggccgagaacttcgcccccatcctggccttcctggaccacgagggctacgccgaccacttcaagagcctgtacgacttcagcttcagcttcctgaccagcagcttctacagcttcagcgaggaggacgagttcgtggcctacctggaggccagcagaaagtgggccaagaagagccacatgacctgggcccacgccagactgtgcttcctgctgggcagactgagcatcagaaaggtgaagctgagccaggccagagtgtacttcgaggaggccatccacatcctgaacggcgccttcgaggacctgagcctggtggccaccctgtacatcaacctggccgccatctacctgaagcagagactgagacacaagggcagcgccctgctggagaaggccggcgccctgctggcctgcctgcccgacagagagagcagcgccaagcacgagctggacgtggtggcctacgtgctgagacagggcatcgtggtgggcagcagccccctggaggccagagcctgcttcctggccatcagactgctgctgagcctgggcagacacgaggaggtgctgcccttcgccgagagactgcagctgctgagcggccacccccccgccagcgaggccgtggccagcgtgctgagcttcctgtacgacaagaagtacctgccccacctggccgtggccagcgtgcagcagcacggcatccagagcgcccagggcatgagcctgcccatctggcaggtgcacctggtgctgcagaacaccaccaagctgctgggcttccccagccccggctggggcgaggtgagcgccctggcctgccccatgctgagacaggccctggccgcctgcgaggagctggccgacagaagcacccagagagccctgtgcctgatcctgagcaaggtgtacctggagcacagaagccccgacggcgccatccactacctgagccaggccctggtgctgggccagctgctgggcgagcaggagagcttcgagagcagcctgtgcctggcctgggcctacctgctggccagccaggccaagaaggccctggacgtgctggagcccctgctgtgcagcctgaaggagaccgagagcctgacccagagaggcgtgatctacaacctgctgggcctggccctgcagggcgagggcagagtgaacagagccgccaagagctacctgagagccctgaacagagcccaggaggtgggcgacgtgcacaaccaggccgtggccatggccaacctgggccacctgagcctgaagagctgggcccagcaccccgccagaaactacctgctgcaggccgtgagactgtactgcgagctgcaggccagcaaggagaccgacatggagctggtgcaggtgttcctgtggctggcccaggtgctggtgagcggccaccagctgacccacggcctgctgtgctacgagatggccctgctgttcggcctgagacacagacacctgaagagcaagtacgtgccctgctgctgggaggccatcgagaagagcgtgggcagcagcttcatccacttcctgagccaggtgatcagcttcatgagcctgctgtgcgtgcaggtgagcttcagaccccccaaccccagcgccatcagcaccgccctgtgcccccagaccctgagacacgccagccccaccatgagcaccggctggccctggctgagcaacagcggcaccggcagatggaagggcggctgctggagcccctggggcagcttcatcggcacctag

SEQ ID NO: 98758 - DNA, 453 bp, Artificial Sequence
  Description of Artificial Sequence: Synthetic coding sequence
atgagcgagcagatgatgcagagcgtgggctgcagaatcagcctgagcgtgttccagttcctgggcgaccagagacaggagctggtggccttccacagactggccaccgtgtactacagcctgcacatgtacgagatggccgaggactgctacctgaagaccctgagcctgtgccccccctggctgcagagccccaaggaggccctgtactacgccaaggtgtactacagactgggcagactgaccttctgccagctgaaggacgcccacgacgccaccgagtacttcctgctggccctggccgccgccgtgctgctgggcgacgaggagctgcaggacaccatcagaagcagactggacaacatctgccagagccccctgtggcacagcagacccagcggctgcagcagcgagagagccagatggctgagcggcggcggcctggccctgtag

SEQ ID NO: 98759 - DNA, 3867 bp, Artificial Sequence
  Description of Artificial Sequence: Synthetic coding sequence
atgggcggctgcttctgcatccccagagagagaagcctgaccagaggccccggcaaggagacccccagcaaggaccccaccgtgagcagcgagtgcatcgccagcagcgagtacaaggagaagtgcttcctgccccagaacatcaaccccgacctgaccctgagcttctgcgtgaagagcagaagcagaagatgcgtgaacggccccctgcaggaggccgccagaagaagactgtgggccctggagaacgaggaccaggaggtgagaatgctgttcaaggacctgagcgccagactggtgagcatccagagccagagagcccagttcctgatcaccttcaagaccatggaggagatctggaagttcagcacctacctgaacctgggctacgtgagcatgtgcctggagcacctgctgttcgaccacaagtactggctgaactgcatcctggtggaggacaccgagatccaggtgagcgtggacgacaagcacctggagaccatctacctgggcctgctgatccaggagggccacttcttctgcagagccctgtgcagcgtgaccccccccgccgagaaggagggcgagtgcctgaccctgtgcaagaacgagctgatcagcgtgaagatggccgaggccggcagcgagctggagggcgtgagcctggtgaccggccagagaggcctggtgctggtgagcgccctggagcccctgcccctgcccttccaccagtggttcctgaagaactaccccggcagctgcggcctgagcagaaagagagactggaccggcagctaccagatcggcagaggcagatgcaaggccctgaccggctacgagcccggcgagaaggacgagctgaacttctaccagggcgagagcatcgagatcatcggcttcgtgatccccggcctgcagtggttcatcggcaagagcaccagcagcggccaggtgggcttcgtgcccaccagaaacatcgaccccgacagctacagccccatgagcagaaacagcgccttcctgagcgacgaggagagatgcagcctgctggccctgggcagcgacaagcagaccgagtgcagcagcttcctgcacaccctggccagaaccgacatcaccagcgtgtacagactgagcggcttcgagagcatccagaacccccccaacgacctgagcgccagccagcccgagggcttcaaggaggtgagacccggcagagcctgggaggagcaccaggccgtgggcagcagacagagcagcagcagcgaggacagcagcctggaggaggagctgctgagcgccaccagcgacagctacagactgcccgagcccgacgacctggacgaccccgagctgctgatggacctgagcaccggccaggaggaggaggccgagaacttcgcccccatcctggccttcctggaccacgagggctacgccgaccacttcaagagcctgtacgacttcagcttcagcttcctgaccagcagcttctacagcttcagcgaggaggacgagttcgtggcctacctggaggccagcagaaagtgggccaagaagagccacatgacctgggcccacgccagactgtgcttcctgctgggcagactgagcatcagaaaggtgaagctgagccaggccagagtgtacttcgaggaggccatccacatcctgaacggcgccttcgaggacctgagcctggtggccaccctgtacatcaacctggccgccatctacctgaagcagagactgagacacaagggcagcgccctgctggagaaggccggcgccctgctggcctgcctgcccgacagagagagcagcgccaagcacgagctggacgtggtggcctacgtgctgagacagggcatcgtggtgggcagcagccccctggaggccagagcctgcttcctggccatcagactgctgctgagcctgggcagacacgaggaggtgctgcccttcgccgagagactgcagctgctgagcggccacccccccgccagcgaggccgtggccagcgtgctgagcttcctgtacgacaagaagtacctgccccacctggccgtggccagcgtgcagcagcacggcatccagagcgcccagggcatgagcctgcccatctggcaggtgcacctggtgctgcagaacaccaccaagctgctgggcttccccagccccggctggggcgaggtgagcgccctggcctgccccatgctgagacaggccctggccgcctgcgaggagctggccgacagaagcacccagagagccctgtgcctgatcctgagcaaggtgtacctggagcacagaagccccgacggcgccatccactacctgagccaggccctggtgctgggccagctgctgggcgagcaggagagcttcgagagcagcctgtgcctggcctgggcctacctgctggccagccaggccaagaaggccctggacgtgctggagcccctgctgtgcagcctgaaggagaccgagagcctgacccagagaggcgtgatctacaacctgctgggcctggccctgcagggcgagggcagagtgaacagagccgccaagagctacctgagagccctgaacagagcccaggaggtgggcgacgtgcacaaccaggccgtggccatggccaacctgggccacctgagcctgaagagctgggcccagcaccccgccagaaactacctgctgcaggccgtgagactgtactgcgagctgcaggccagcaaggagaccgacatggagctggtgcaggtgttcctgtggctggcccaggtgctggtgagcggccaccagctgacccacggcctgctgtgctacgagatggccctgctgttcggcctgagacacagacacctgaagagccagctgcaggccaccaagagcctgtgccacttctacagcagcgtgagccccaaccccgaggcctgcatcacctaccacgagcactggctggccctggcccagcagctgagagacagagagatggagggcagactgctggagagcctgggccagctgtacagaaacctgaacaccgccagaagcctgagaagaagcctgacctgcatcaaggagagcctgagaatcttcatcgacctgggcgagaccgacaaggccgccgaggcctggctgggcgccggcagactgcactacctgatgcaggaggacgagctggtggagctgtgcctgcaggccgccatccagaccgccctgaagagcgaggagcccctgctggccctgaagctgtacgaggaggccggcgacgtgttcttcaacggcaccagacacagacaccacgccgtggagtactacagagccggcgccgtgcccctggccagaagactgaaggccgtgagaaccgagctgagaatcttcaacaagctgaccgagctgcagatcagcctggagggctacgagaaggccctggagttcgccaccctggccgccagactgagcaccgtgaccggcgaccagagacaggagctggtggccttccacagactggccaccgtgtactacagcctgcacatgtacgagatggccgaggactgctacctgaagaccctgagcctgtgccccccctggctgcagagccccaaggaggccctgtactacgccaaggtgtactacagactgggcagactgaccttctgccagctgaaggacgcccacgacgccaccgagtacttcctgctggccctggccgccgccgtgctgctgggcgacgaggagctgcaggacaccatcagaagcagactggacaacatctgccagagccccctgtggcacagcagacccagcggctgcagcagcgagagagccagatggctgagcggcggcggcctggccctgtag

SEQ ID NO: 98760 - DNA, 2181 bp, Artificial Sequence
  Description of Artificial Sequence: Synthetic coding sequence
atggacctgagcaccggccaggaggaggaggccgagaacttcgcccccatcctggccttcctggaccacgagggctacgccgaccacttcaagagcctgtacgacttcagcttcagcttcctgaccagcagcttctacagcttcagcgaggaggacgagttcgtggcctacctggaggccagcagaaagtgggccaagaagagccacatgacctgggcccacgccagactgtgcttcctgctgggcagactgagcatcagaaaggtgaagctgagccaggccagagtgtacttcgaggaggccatccacatcctgaacggcgccttcgaggacctgagcctggtggccaccctgtacatcaacctggccgccatctacctgaagcagagactgagacacaagggcagcgccctgctggagaaggccggcgccctgctggcctgcctgcccgacagagagagcagcgccaagcacgagctggacgtggtggcctacgtgctgagacagggcatcgtggtgggcagcagccccctggaggccagagcctgcttcctggccatcagactgctgctgagcctgggcagacacgaggaggtgctgcccttcgccgagagactgcagctgctgagcggccacccccccgccagcgaggccgtggccagcgtgctgagcttcctgtacgacaagaagtacctgccccacctggccgtggccagcgtgcagcagcacggcatccagagcgcccagggcatgagcctgcccatctggcaggtgcacctggtgctgcagaacaccaccaagctgctgggcttccccagccccggctggggcgaggtgagcgccctggcctgccccatgctgagacaggccctggccgcctgcgaggagctggccgacagaagcacccagagagccctgtgcctgatcctgagcaaggtgtacctggagcacagaagccccgacggcgccatccactacctgagccaggccctggtgctgggccagctgctgggcgagcaggagagcttcgagagcagcctgtgcctggcctgggcctacctgctggccagccaggccaagaaggccctggacgtgctggagcccctgctgtgcagcctgaaggagaccgagagcctgacccagagaggcgtgatctacaacctgctgggcctggccctgcagggcgagggcagagtgaacagagccgccaagagctacctgagagccctgaacagagcccaggaggtgggcgacgtgcacaaccaggccgtggccatggccaacctgggccacctgagcctgaagagctgggcccagcaccccgccagaaactacctgctgcaggccgtgagactgtactgcgagctgcaggccagcaaggagaccgacatggagctggtgcaggtgttcctgtggctggcccaggtgctggtgagcggccaccagctgacccacggcctgctgtgctacgagatggccctgctgttcggcctgagacacagacacctgaagagccagctgcaggccaccaagagcctgtgccacttctacagcagcgtgagccccaaccccgaggcctgcatcacctaccacgagcactggctggccctggcccagcagctgagagacagagagatggagggcagactgctggagagcctgggccagctgtacagaaacctgaacaccgccagaagcctgagaagaagcctgacctgcatcaaggagagcctgagaatcttcatcgacctgggcgagaccgacaaggccgccgaggcctggctgggcgccggcagactgcactacctgatgcaggaggacgagctggtggagctgtgcctgcaggccgccatccagaccgccctgaagagcgaggagcccctgctggccctgaagctgtacgaggaggccggcgacgtgttcttcaacggcaccagacacagacaccacgccgtggagtactacagagccggcgccgtgcccctggccagaagactgaaggccgtgagaaccgagctgagaatcttcaacaagctgaccgagctgcagatcagcctggagggctacgagaaggccctggagttcgccaccctggccgccagactgagcaccgtgaccgaggccagagccggcggcctgagcccccccggctacagcgtgctgctgcccgcccacgtgtag

SEQ ID NO: 98761 - DNA, 720 bp, Artificial Sequence
  Description of Artificial Sequence: Synthetic coding sequence
atgcccctgctgctgctgggcgagaccgagcccctgaagctggagagagactgcagaagccccgtggacccctgggccgccgccagccccgacctggccctggcctgcctgtgccactgccaggacctgagcagcggcgccttccccgacagaggcgtgctgggcggcgtgctgttccccaccgtggagatggtgatcaaggtgttcgtggccaccagcagcggcagcatcgccatcagaaagaagcagcaggaggtggtgggcttcctggaggccaacaagatcgacttcaaggagctggacatcgccggcgacgaggacaacagaagatggatgagagagaacgtgcccggcgagaagaagccccagaacggcatccccctgcccccccagatcttcaacgaggagcagtactgcggcgacttcgacagcttcttcagcgccaaggaggagaacatcatctacagcttcctgggcctggcccccccccccgacagcaagggcagcgagaaggccgaggagggcggcgagaccgaggcccagaaggagggcagcgaggacgtgggcaacctgcccgaggcccaggagaagaacgaggaggagggcgagaccgccaccgaggagaccgaggagatcgccatggagggcgccgagggcgaggccgaggaggaggaggagaccgccgagggcgaggagcccggcgaggacgaggacagctag

SEQ ID NO: 98762 - DNA, 387 bp, Artificial Sequence
  Description of Artificial Sequence: Synthetic coding sequence
atgagagagaacgtgcccggcgagaagaagccccagaacggcatccccctgcccccccagatcttcaacgaggagcagtactgcggcgacttcgacagcttcttcagcgccaaggaggagaacatcatctacagcttcctgggcctggcccccccccccgacagcaagggcagcgagaaggccgaggagggcggcgagaccgaggcccagaaggagggcagcgaggacgtgggcaacctgcccgaggcccaggagaagaacgaggaggagggcgagaccgccaccgaggagaccgaggagatcgccatggagggcgccgagggcgaggccgaggaggaggaggagaccgccgagggcgaggagcccggcgaggacgaggacagctag

SEQ ID NO: 98763 - DNA, 387 bp, Artificial Sequence; identical to SEQ ID NO: 98762
  Description of Artificial Sequence: Synthetic coding sequence

SEQ ID NO: 98764 - DNA, 387 bp, Artificial Sequence; identical to SEQ ID NO: 98762
  Description of Artificial Sequence: Synthetic coding sequence

SEQ ID NO: 98765 - DNA, 321 bp, Artificial Sequence
  Description of Artificial Sequence: Synthetic coding sequence
atgagagagaacgtgcccggcgagaagaagccccagaacggcatccccctgcccccccagatcttcaacgaggagcagtactgcggcgacttcgacagcttcttcagcgccaaggaggagaacatcatctacagcttcctgggcctggcccccccccccgacagcaagggcagcgagaaggccgaggagggcggcgagaccgaggcccagaaggagggcagcgaggacgtgggcaacctgcccgaggcccaggagaagaacgaggaggagggcgagaccgccaccgaggagaccgaggagatcgccatggagggcgcctag

SEQ ID NO: 98766 - DNA, 2373 bp, Artificial Sequence
  Description of Artificial Sequence: Synthetic coding sequence
atgaacatcatgaacaccgagcagagccagaacagcatcgtgagcagaatcaaggtgttcgagggccagaccaacatcgagaccagcggcctgcccaagaagcccgagatcacccccagaagcctgccccccaagcccaccgtgagcagcggcaagcccagcgtggcccccaagcccgccgccaacagagccagcggcgagtgggacagcggcaccgagaacagactgaaggtgaccagcaaggagggcctgaccccctacccccccctgcaggaggccggcagcatccccgtgaccaagcccgagctgcccaagaagcccaaccccggcctgatcagaagcgtgaaccccgagatccccggcagaggccccctggccgagagcagcgacagcggcaagaaggtgcccacccccgcccccagacccctgctgctgaagaagagcgtgagcagcgagaaccccacctaccccagcgcccccctgaagcccgtgaccgtgccccccagactggccggcgccagccaggccaaggcctacaagagcctgggcgagggcccccccgccaacccccccgtgcccgtgctgcagagcaagcccctggtggacatcgacctgatcagcttcgacgacgacgtgctgcccacccccagcggcaacctggccgaggagagcgtgggcagcgagatggtgctggaccccttccagctgcccgccaagaccgagcccatcaaggagagagccgtgcagcccgcccccaccagaaagcccaccgtgatcagaatccccgccaagcccggcaagtgcctgcacgaggacccccagagccccccccccctgcccgccgagaagcccatcggcaacaccttcagcaccgtgagcggcaagctgagcaacgtggagagaaccagaaacctggagagcaaccaccccggccagaccggcggcttcgtgagagtgccccccagactgccccccagacccgtgaacggcaagaccatccccacccagcagccccccaccaaggtgccccccgagagaccccccccccccaagctgagcgccaccagaagaagcaacaagaagctgcccttcaacagaagcagcagcgacatggacctgcagaagaagcagagcaacctggccaccggcctgagcaaggccaagagccaggtgttcaagaaccaggaccccgtgctgccccccagacccaagcccggccaccccctgtacagcaagtacatgctgagcgtgccccacggcatcgccaacgaggacatcgtgagccagaaccccggcgagctgagctgcaagagaggcgacgtgctggtgatgctgaagcagaccgagaacaactacctggagtgccagaagggcgaggacaccggcagagtgcacctgagccagatgaagatcatcacccccctggacgagcacctgagaagcagacccaacgaccccagccacgcccagaagcccgtggacagcggcgccccccacgccgtggtgctgcacgacttccccgccgagcaggtggacgacctgaacctgaccagcggcgagatcgtgtacctgctggagaagatcgacaccgactggtacagaggcaactgcagaaaccagatcggcatcttccccgccaactacgtgaaggtgatcatcgacatccccgagggcggcaacggcaagagagagtgcgtgagcagccactgcgtgaagggcagcagatgcgtggccagattcgagtacatcggcgagcagaaggacgagctgagcttcagcgagggcgagatcatcatcctgaaggagtacgtgaacgaggagtgggccagaggcgaggtgagaggcagaaccggcatcttccccctgaacttcgtggagcccgtggaggactaccccaccagcggcgccaacgtgctgagcaccaaggtgcccctgaagaccaagaaggaggacagcggcagcaacagccaggtgaacagcctgcccgccgagtggtgcgaggccctgcacagcttcaccgccgagaccagcgacgacctgagcttcaagagaggcgacagaatccagatcctggagagactggacagcgactggtgcagaggcagactgcaggacagagagggcatcttccccgccgtgttcgtgagaccctgccccgccgaggccaagagcatgctggccatcgtgcccaagggcagaaaggccaaggccctgtacgacttcagaggcgagaacgaggacgagctgagcttcaaggccggcgacatcatcaccgagctggagagcgtggacgacgactggatgagcggcgagctgatgggcaagagcggcatcttccccaagaactacatccagttcctgcagatcagctag

SEQ ID NO: 98767 - DNA, 2373 bp, Artificial Sequence; identical to SEQ ID NO: 98766
  Description of Artificial Sequence: Synthetic coding sequence

SEQ ID NO: 98768 - DNA, 2304 bp, Artificial Sequence
  Description of Artificial Sequence: Synthetic coding sequence
atgaacatcatgaacaccgagcagagccagaacagcatcgtgagcagaatcaaggtgttcgagggccagaccaacatcgagaccagcggcctgcccaagaagcccgagatcacccccagaagcctgccccccaagcccaccgtgagcagcggcaagcccagcgtggcccccaagcccgccgccaacagagccagcggcgagtgggacagcggcaccgagaacagactgaaggtgaccagcaaggagggcctgaccccctacccccccctgcaggaggccggcagcatccccgtgaccaagcccgagctgcccaagaagcccaaccccggcctgatcagaagcgtgaaccccgagatccccggcagaggccccctggccgagagcagcgacagcggcaagaaggtgcccacccccgcccccagacccctgctgctgaagaagagcgtgagcagcgagaaccccacctaccccagcgcccccctgaagcccgtgaccgtgccccccagactggccggcgccagccaggccaaggcctacaagagcctgggcgagggcccccccgccaacccccccgtgcccgtgctgcagagcaagcccctggtggacatcgacctgatcagcttcgacgacgacgtgctgcccacccccagcggcaacctggccgaggagagcgtgggcagcgagatggtgctggaccccttccagctgcccgccaagaccgagcccatcaaggagagagccgtgcagcccgcccccaccagaaagcccaccgtgatcagaatccccgccaagcccggcaagtgcctgcacgaggacccccagagccccccccccctgcccgccgagaagcccatcggcaacaccttcagcaccgtgagcggcaagctgagcaacgtggagagaaccagaaacctggagagcaaccaccccggccagaccggcggcttcgtgagagtgccccccagactgccccccagacccgtgaacggcaagaccatccccacccagcagccccccaccaaggtgccccccgagagaccccccccccccaagctgagcgccaccagaagaagcaacaagaagctgcccttcaacagaagcagcagcgacatggacctgcagaagaagcagagcaacctggccaccggcctgagcaaggccaagagccaggtgttcaagaaccaggaccccgtgctgccccccagacccaagcccggccaccccctgtacagcaagtacatgagaggcgacgtgctggtgatgctgaagcagaccgagaacaactacctggagtgccagaagggcgaggacaccggcagagtgcacctgagccagatgaagatcatcacccccctggacgagcacctgagaagcagacccaacgaccccagccacgcccagaagcccgtggacagcggcgccccccacgccgtggtgctgcacgacttccccgccgagcaggtggacgacctgaacctgaccagcggcgagatcgtgtacctgctggagaagatcgacaccgactggtacagaggcaactgcagaaaccagatcggcatcttccccgccaactacgtgaaggtgatcatcgacatccccgagggcggcaacggcaagagagagtgcgtgagcagccactgcgtgaagggcagcagatgcgtggccagattcgagtacatcggcgagcagaaggacgagctgagcttcagcgagggcgagatcatcatcctgaaggagtacgtgaacgaggagtgggccagaggcgaggtgagaggcagaaccggcatcttccccctgaacttcgtggagcccgtggaggactaccccaccagcggcgccaacgtgctgagcaccaaggtgcccctgaagaccaagaaggaggacagcggcagcaacagccaggtgaacagcctgcccgccgagtggtgcgaggccctgcacagcttcaccgccgagaccagcgacgacctgagcttcaagagaggcgacagaatccagatcctggagagactggacagcgactggtgcagaggcagactgcaggacagagagggcatcttccccgccgtgttcgtgagaccctgccccgccgaggccaagagcatgctggccatcgtgcccaagggcagaaaggccaaggccctgtacgacttcagaggcgagaacgaggacgagctgagcttcaaggccggcgacatcatcaccgagctggagagcgtggacgacgactggatgagcggcgagctgatgggcaagagcggcatcttccccaagaactacatccagttcctgcagatcagctag

SEQ ID NO: 98769 - DNA, 2196 bp, Artificial Sequence
  Description of Artificial Sequence: Synthetic coding sequence
atgaacatcatgaacaccgagcagagccagaacagcatcgtgagcagaatcaaggtgttcgagggccagaccaacatcgagaccagcggcctgcccaagaagcccgagatcacccccagaagcctgccccccaagcccaccgtgagcagcggcaagcccagcgtggcccccaagcccgccgccaacagagccagcggcgagtgggacagcggcaccgagaacagactgaaggtgaccagcaaggagggcctgaccccctacccccccctgcaggaggccggcagcatccccgtgaccaagcccgagctgcccaagaagcccaaccccggcctgatcagaagcgtgaaccccgagatccccggcagaggccccctggccgagagcagcgacagcggcaagaaggtgcccacccccgcccccagacccctgctgctgaagaagagcgtgagcagcgagaaccccacctaccccagcgcccccctgaagcccgtgaccgtgccccccagactggccggcgccagccaggccaaggcctacaagagcctgggcgagggcccccccgccaacccccccgtgcccgtgctgcagagcaagcccctggtggacatcgacctgatcagcttcgacgacgacgtgctgcccacccccagcggcaacctggccgaggagagcgtgggcagcgagatggtgctgggcctgcacgaggacccccagagccccccccccctgcccgccgagaagcccatcggcaacaccttcagcaccgtgagcggcaagctgagcaacgtggagagaaccagaaacctggagagcaaccaccccggccagaccggcggcttcgtgagagtgccccccagactgccccccagacccgtgaacggcaagaccatccccacccagcagccccccaccaaggtgccccccgagagaccccccccccccaagctgagcgccaccagaagaagcaacaagaagctgcccttcaacagaagcagcagcgacatggacctgcagaagaagcagagcaacctggccaccggcctgagcaaggccaagagccaggtgttcaagaaccaggaccccgtgctgccccccagacccaagcccggccaccccctgtacagcaagtacatgagaggcgacgtgctggtgatgctgaagcagaccgagaacaactacctggagtgccagaagggcgaggacaccggcagagtgcacctgagccagatgaagatcatcacccccctggacgagcacctgagaagcagacccaacgaccccagccacgcccagaagcccgtggacagcggcgccccccacgccgtggtgctgcacgacttccccgccgagcaggtggacgacctgaacctgaccagcggcgagatcgtgtacctgctggagaagatcgacaccgactggtacagaggcaactgcagaaaccagatcggcatcttccccgccaactacgtgaaggtgatcatcgacatccccgagggcggcaacggcaagagagagtgcgtgagcagccactgcgtgaagggcagcagatgcgtggccagattcgagtacatcggcgagcagaaggacgagctgagcttcagcgagggcgagatcatcatcctgaaggagtacgtgaacgaggagtgggccagaggcgaggtgagaggcagaaccggcatcttccccctgaacttcgtggagcccgtggaggactaccccaccagcggcgccaacgtgctgagcaccaaggtgcccctgaagaccaagaaggaggacagcggcagcaacagccaggtgaacagcctgcccgccgagtggtgcgaggccctgcacagcttcaccgccgagaccagcgacgacctgagcttcaagagaggcgacagaatccagatcctggagagactggacagcgactggtgcagaggcagactgcaggacagagagggcatcttccccgccgtgttcgtgagaccctgccccgccgaggccaagagcatgctggccatcgtgcccaagggcagaaaggccaaggccctgtacgacttcagaggcgagaacgaggacgagctgagcttcaaggccggcgacatcatcaccgagctggagagcgtggacgacgactggatgagcggcgagctgatgggcaagagcggcatcttccccaagaactacatccagttcctgcagatcagctag

SEQ ID NO: 98770 - DNA, 2196 bp, Artificial Sequence; identical to SEQ ID NO: 98769
  Description of Artificial Sequence: Synthetic coding sequence

SEQ ID NO: 98771 - DNA, 2304 bp, Artificial Sequence; identical to SEQ ID NO: 98768
  Description of Artificial Sequence: Synthetic coding sequence

SEQ ID NO: 98772 - DNA, 2304 bp, Artificial Sequence; identical to SEQ ID NO: 98768
  Description of Artificial Sequence: Synthetic coding sequence

SEQ ID NO: 98773 - DNA, 2190 bp, Artificial Sequence
  Description of Artificial Sequence: Synthetic coding sequence
atggacgacctgaccctgctggacctgctggagtgccccgtgtgcttcgagaagctggacgtgaccgccaaggtgctgccctgccagcacaccttctgcaagccctgcctgcagagagtgttcaaggcccacaaggagctgagatgccccgagtgcagaacccccgtgttcagcaacatcgaggccctgcccgccaacctgctgctggtgagactgctggacggcgtgagaagcggccagagcagcggcagaggcggcagcttcagaagacccggcaccatgaccctgcaggacggcagaaagagcagaaccaaccccagaagactgcaggccagccccttcagactggtgcccaacgtgagaatccacatggacggcgtgcccagagccaaggccctgtgcaactacagaggccagaaccccggcgacctgagattcaacaagggcgacatcatcctgctgagaagacagctggacgagaactggtaccagggcgagatcaacggcatcagcggcaacttccccgccagcagcgtggaggtgatcaagcagctgccccagcccccccccctgtgcagagccctgtacaacttcgacctgagaggcaaggacaagagcgagaaccaggactgcctgaccttcctgaaggacgacatcatcaccgtgatcagcagagtggacgagaactgggccgagggcaagctgggcgacaaggtgggcatcttccccatcctgttcgtggagcccaacctgaccgccagacacctgctggagaagaacaagggcagacagagcagcagaaccaagaacctgagcctggtgagcagcagcagcagaggcaacaccagcaccctgagaagaggccccggcagcagaagaaaggtgcccggccagttcagcatcaccaccgccctgaacaccctgaacagaatggtgcacagccccagcggcagacacatggtggagatcagcacccccgtgctgatcagcagcagcaaccccagcgtgatcacccagcccatggagaaggccgacgtgcccagcagctgcgtgggccaggtgagcacctaccaccccgcccccgtgagccccggccacagcaccgccgtggtgagcctgcccggcagccagcagcacctgagcgccaacatgttcgtggccctgcacagctacagcgcccacggccccgacgagctggacctgcagaagggcgagggcgtgagagtgctgggcaagtgccaggacggctggctgagaggcgtgagcctggtgaccggcagagtgggcatcttccccaacaactacgtgatccccatcttcagaaagaccagcagcttccccgacagcagaagccccggcctgtacaccacctggaccctgagcaccagcagcgtgagcagccagggcagcatcagcgagggcgaccccagacagagcagacccttcaagagcgtgttcgtgcccaccgccatcgtgaaccccgtgagaagcaccgccggccccggcaccctgggccagggcagcctgagaaagggcagaagcagcatgagaaagaacggcagcctgcagagacccctgcagagcggcatccccaccctggtggtgggcagcctgagaagaagccccaccatggtgctgagaccccagcagttccagttctaccagccccagggcatccccagcagccccagcgccgtggtggtggagatgggcagcaagcccgccctgaccggcgagcccgccctgacctgcatcagcagaggcagcgaggcctggatccacagcgccgccagcagcctgatcatggaggacaaggagatccccatcaagagcgagcccctgcccaagccccccgccagcgccccccccagcatcctggtgaagcccgagaacagcagaaacggcatcgagaagcaggtgaagaccgtgagattccagaactacagccccccccccaccaagcactacaccagccaccccaccagcggcaagcccgagcagcccgccaccctgaaggccagccagcccgaggccgccagcctgggccccgagatgaccgtgctgttcgcccacagaagcggctgccacagcggccagcagaccgacctgagaagaaagagcgccctgggcaaggccaccaccctggtgagcaccgccagcggcacccagaccgtgttccccagcaagtag

SEQ ID NO: 98774 - DNA, 2190 bp, Artificial Sequence; identical to SEQ ID NO: 98773
  Description of Artificial Sequence: Synthetic coding sequence

SEQ ID NO: 98775 - DNA, 387 bp, Artificial Sequence
  Description of Artificial Sequence: Synthetic coding sequence
atggaggacaaggagatccccatcaagagcgagcccctgcccaagccccccgccagcgccccccccagcatcctggtgaagcccgagaacagcagaaacggcatcgagaagcaggtgaagaccgtgagattccagaactacagccccccccccaccaagcactacaccagccaccccaccagcggcaagcccgagcagcccgccaccctgaaggccagccagcccgaggccgccagcctgggccccgagatgaccgtgctgttcgcccacagaagcggctgccacagcggccagcagaccgacctgagaagaaagagcgccctgggcaaggccaccaccctggtgagcaccgccagcggcacccagaccgtgttccccagcaagtag

SEQ ID NO: 98776 - DNA, 1686 bp, Artificial Sequence
  Description of Artificial Sequence: Synthetic coding sequence
atggccgccgaggagatgcactggcccgtgcccatgaaggccatcggcgcccagaacctgctgaccatgcccggcggcgtggccaaggccggctacctgcacaagaagggcggcacccagctgcagctgctgaagtggcccctgagattcgtgatcatccacaagagatgcgtgtactacttcaagagcagcaccagcgccagcccccagggcgccttcagcctgagcggctacaacagagtgatgagagccgccgaggagaccaccagcaacaacgtgttccccttcaagatcatccacatcagcaagaagcacagaacctggttcttcagcgccagcagcgaggaggagagaaagagctggatggccctgctgagaagagagatcggccacttccacgagaagaaggacctgcccctggacaccagcgacagcagcagcgacaccgacagcttctacggcgccgtggagagacccgtggacatcagcctgagcccctaccccaccgacaacgaggactacgagcacgacgacgaggacgacagctacctggagcccgacagccccgagcccggcagactggaggacgccctgatgcacccccccgcctacccccccccccccgtgcccacccccagaaagcccgccttcagcgacatgcccagagcccacagcttcaccagcaagggccccggccccctgctgcccccccccccccccaagcacggcctgcccgacgtgggcctggccgccgaggacagcaagagagaccccctgtgccccagaagagccgagccctgccccagagtgcccgccacccccagaagaatgagcgacccccccctgagcaccatgcccaccgcccccggcctgagaaagcccccctgcttcagagagagcgccagccccagccccgagccctggacccccggccacggcgcctgcagcaccagcagcgccgccatcatggccaccgccaccagcagaaactgcgacaagctgaagagcttccacctgagccccagaggcccccccaccagcgagcccccccccgtgcccgccaacaagcccaagttcctgaagatcgccgaggaggacccccccagagaggccgccatgcccggcctgttcgtgccccccgtggcccccagaccccccgccctgaagctgcccgtgcccgaggccatggccagacccgccgtgctgcccagacccgagaagccccagctgccccacctgcagagaagcccccccgacggccagagcttcagaagcttcagcttcgagaagcccagacagcccagccaggccgacaccggcggcgacgacagcgacgaggactacgagaaggtgcccctgcccaacagcgtgttcgtgaacaccaccgagagctgcgaggtggagagactgttcaaggccaccagccccagaggcgagccccaggacggcctgtactgcatcagaaacagcagcaccaagagcggcaaggtgctggtggtgtgggacgagaccagcaacaaggtgagaaactacagaatcttcgagaaggacagcaagttctacctggagggcgaggtgctgttcgtgagcgtgggcagcatggtggagcactaccacacccacgtgctgcccagccaccagagcctgctgctgagacacccctacggctacaccggccccagatag

SEQ ID NO: 98777 - DNA, 294 bp, Artificial Sequence
  Description of Artificial Sequence: Synthetic coding sequence
atggccgccgaggagatgcactggcccgtgcccatgaaggccatcggcgcccagaacctgctgaccatgcccggcggcgtggccaaggccggctacctgcacaagaagggcggcacccagctgcagctgctgaagtggcccctgagattcgtgatcatccacaagagatgcgtgtactacttcaagagcagcaccagcgccagcccccagggcgccttcagcctgagcggctacaacagacagcccagaccccagcccgcccaggccctgagccagaccgaggccggcccctag

SEQ ID NO: 98778 - DNA, 1686 bp, Artificial Sequence; identical to SEQ ID NO: 98776
  Description of Artificial Sequence: Synthetic coding sequence

SEQ ID NO: 98779 - DNA, 1770 bp, Artificial Sequence
  Description of Artificial Sequence: Synthetic coding sequence
atggccagcctgggccccagaacccccgcccccagcagaagcagaggcagaagagccatgtgctgggtgagcaccatcagcttcatggccgccgaggagatgcactggcccgtgcccatgaaggccatcggcgcccagaacctgctgaccatgcccggcggcgtggccaaggccggctacctgcacaagaagggcggcacccagctgcagctgctgaagtggcccctgagattcgtgatcatccacaagagatgcgtgtactacttcaagagcagcaccagcgccagcccccagggcgccttcagcctgagcggctacaacagagtgatgagagccgccgaggagaccaccagcaacaacgtgttccccttcaagatcatccacatcagcaagaagcacagaacctggttcttcagcgccagcagcgaggaggagagaaagagctggatggccctgctgagaagagagatcggccacttccacgagaagaaggacctgcccctggacaccagcgacagcagcagcgacaccgacagcttctacggcgccgtggagagacccgtggacatcagcctgagcccctaccccaccgacaacgaggactacgagcacgacgacgaggacgacagctacctggagcccgacagccccgagcccggcagactggaggacgccctgatgcacccccccgcctacccccccccccccgtgcccacccccagaaagcccgccttcagcgacatgcccagagcccacagcttcaccagcaagggccccggccccctgctgcccccccccccccccaagcacggcctgcccgacgtgggcctggccgccgaggacagcaagagagaccccctgtgccccagaagagccgagccctgccccagagtgcccgccacccccagaagaatgagcgacccccccctgagcaccatgcccaccgcccccggcctgagaaagcccccctgcttcagagagagcgccagccccagccccgagccctggacccccggccacggcgcctgcagcaccagcagcgccgccatcatggccaccgccaccagcagaaactgcgacaagctgaagagcttccacctgagccccagaggcccccccaccagcgagcccccccccgtgcccgccaacaagcccaagttcctgaagatcgccgaggaggacccccccagagaggccgccatgcccggcctgttcgtgccccccgtggcccccagaccccccgccctgaagctgcccgtgcccgaggccatggccagacccgccgtgctgcccagacccgagaagccccagctgccccacctgcagagaagcccccccgacggccagagcttcagaagcttcagcttcgagaagcccagacagcccagccaggccgacaccggcggcgacgacagcgacgaggactacgagaaggtgcccctgcccaacagcgtgttcgtgaacaccaccgagagctgcgaggtggagagactgttcaaggccaccagccccagaggcgagccccaggacggcctgtactgcatcagaaacagcagcaccaagagcggcaaggtgctggtggtgtgggacgagaccagcaacaaggtgagaaactacagaatcttcgagaaggacagcaagttctacctggagggcgaggtgctgttcgtgagcgtgggcagcatggtggagcactaccacacccacgtgctgcccagccaccagagcctgctgctgagacacccctacggctacaccggccccagatag

SEQ ID NO: 98780 - DNA, 1686 bp, Artificial Sequence; identical to SEQ ID NO: 98776
  Description of Artificial Sequence: Synthetic coding sequence

SEQ ID NO: 98781 - DNA, 429 bp, Artificial Sequence
  Description of Artificial Sequence: Synthetic coding sequence
atggccgccgaggagatgcactggcccgtgcccatgaaggccatcggcgcccagaacctgctgaccatgcccggcggcgtggccaaggccggctacctgcacaagaagggcggcacccagctgcagctgctgaagtggcccctgagattcgtgatcatccacaagagatgcgtgtactacttcaagagcagcaccagcgccagcccccagggcgccttcagcctgagcggctacaacagagtgatgagagccgccgaggagaccaccagcaacaacgtgttccccttcaagatcatccacatcagcaagaagcacagaacctggttcttcagcgccagcagcgaggaggagagaaagagctggatggccctgctgagaagagagatcggccacttccacgagaagaaggacctgcccctggacacctag

SEQ ID NO: 98782 - DNA, 429 bp, Artificial Sequence; identical to SEQ ID NO: 98781
  Description of Artificial Sequence: Synthetic coding sequence

SEQ ID NO: 98783 - DNA, 1857 bp, Artificial Sequence
  Description of Artificial Sequence: Synthetic coding sequence
atggccggcagcggccccagacccagaagctggggcagaagagaggccggcgccagagacgaggccgccgccgccggcggcagaggccccggcccctgcagatgcagccagggcagaagagcctggatcgcccccggcaagcccgccatgcccgccgcctggacccccttcatggccgccgaggagatgcactggcccgtgcccatgaaggccatcggcgcccagaacctgctgaccatgcccggcggcgtggccaaggccggctacctgcacaagaagggcggcacccagctgcagctgctgaagtggcccctgagattcgtgatcatccacaagagatgcgtgtactacttcaagagcagcaccagcgccagcccccagggcgccttcagcctgagcggctacaacagagtgatgagagccgccgaggagaccaccagcaacaacgtgttccccttcaagatcatccacatcagcaagaagcacagaacctggttcttcagcgccagcagcgaggaggagagaaagagctggatggccctgctgagaagagagatcggccacttccacgagaagaaggacctgcccctggacaccagcgacagcagcagcgacaccgacagcttctacggcgccgtggagagacccgtggacatcagcctgagcccctaccccaccgacaacgaggactacgagcacgacgacgaggacgacagctacctggagcccgacagccccgagcccggcagactggaggacgccctgatgcacccccccgcctacccccccccccccgtgcccacccccagaaagcccgccttcagcgacatgcccagagcccacagcttcaccagcaagggccccggccccctgctgcccccccccccccccaagcacggcctgcccgacgtgggcctggccgccgaggacagcaagagagaccccctgtgccccagaagagccgagccctgccccagagtgcccgccacccccagaagaatgagcgacccccccctgagcaccatgcccaccgcccccggcctgagaaagcccccctgcttcagagagagcgccagccccagccccgagccctggacccccggccacggcgcctgcagcaccagcagcgccgccatcatggccaccgccaccagcagaaactgcgacaagctgaagagcttccacctgagccccagaggcccccccaccagcgagcccccccccgtgcccgccaacaagcccaagttcctgaagatcgccgaggaggacccccccagagaggccgccatgcccggcctgttcgtgccccccgtggcccccagaccccccgccctgaagctgcccgtgcccgaggccatggccagacccgccgtgctgcccagacccgagaagccccagctgccccacctgcagagaagcccccccgacggccagagcttcagaagcttcagcttcgagaagcccagacagcccagccaggccgacaccggcggcgacgacagcgacgaggactacgagaaggtgcccctgcccaacagcgtgttcgtgaacaccaccgagagctgcgaggtggagagactgttcaaggccaccagccccagaggcgagccccaggacggcctgtactgcatcagaaacagcagcaccaagagcggcaaggtgctggtggtgtgggacgagaccagcaacaaggtgagaaactacagaatcttcgagaaggacagcaagttctacctggagggcgaggtgctgttcgtgagcgtgggcagcatggtggagcactaccacacccacgtgctgcccagccaccagagcctgctgctgagacacccctacggctacaccggccccagatag

SEQ ID NO: 98784 - DNA, 519 bp, Artificial Sequence
  Description of Artificial Sequence: Synthetic coding sequence
atggccgccgaggagatgcactggcccgtgcccatgaaggccatcggcgcccagaacctgctgaccatgcccggcggcgtggccaaggccggctacctgcacaagaagggcggcacccagctgcagctgctgaagtggcccctgagattcgtgatcatccacaagagatgcgtgtactacttcaagagcagcaccagcgccagcccccagggcgccttcagcctgagcggctacaacagagtgatgagagccgccgaggagaccaccagcaacaacgtgttccccttcaagatcatccacatcagcaagaagcacagaacctggttcttcagcgccagcagcgaggaggagagaaagagctggatggccctgctgagaagagagatcggccacttccacgagaagaaggacctgcccctggacaccagcgacagcagcagcgacaccgacagcttctacggcgccgtggagagacccgtggacatcagcctgagcccctaccccaccgacaacgagtag

SEQ ID NO: 98785 - DNA, 567 bp, Artificial Sequence
  Description of Artificial Sequence: Synthetic coding sequence
atggccgccgaggagatgcactggcccgtgcccatgaaggccatcggcgcccagaacctgctgaccatgcccggcggcgtggccaaggccggctacctgcacaagaagggcggcacccagctgcagctgctgaagtggcccctgagattcgtgatcatccacaagagatgcgtgtactacttcaagagcagcaccagcgccagcccccagggcgccttcagcctgagcggctacaacagagtgatgagagccgccgaggagaccaccagcaacaacgtgttccccttcaagatcatccacatcagcaagaagcacagaacctggttcttcagcgccagcagcgaggaggagagaaagagctggatggccctgctgagaagagagatcggccacttccacgagaagaaggacctgcccctggacaccagcgacagcagcagcgacaccgacagcttctacggcgccgtggagagacccgtggacatcagcctgagcccctaccccaccgacaacgaggactacgagcacgacgacgaggacgacagctacctggagcccgacagctag

SEQ ID NO: 98786 - DNA, 1686 bp, Artificial Sequence; identical to SEQ ID NO: 98776
  Description of Artificial Sequence: Synthetic coding sequence

SEQ ID NO: 98787 - DNA, 585 bp, Artificial Sequence
  Description of Artificial Sequence: Synthetic coding sequence
atggccgccgaggagatgcactggcccgtgcccatgaaggccatcggcgcccagaacctgctgaccatgcccggcggcgtggccaaggccggctacctgcacaagaagggcggcacccagctgcagctgctgaagtggcccctgagattcgtgatcatccacaagagatgcgtgtactacttcaagagcagcaccagcgccagcccccagggcgccttcagcctgagcggctacaacagagtgatgagagccgccgaggagaccaccagcaacaacgtgttccccttcaagatcatccacatcagcaagaagcacagaacctggttcttcagcgccagcagcgaggaggagagaaagagctggatggccctgctgagaagagagatcggccacttccacgagaagaaggacctgcccctggacaccagcgacagcagcagcgacaccgacagcttctacggcgccgtggagagacccgtggacatcagcctgagcccctaccccaccgacaacgaggactacgagcacgacgacgaggacgacagctacctggagcccgacagccccgagcccggcagactgtag

SEQ ID NO: 98788 - DNA, 411 bp, Artificial Sequence
  Description of Artificial Sequence: Synthetic coding sequence
atggccgccgaggagatgcactggcccgtgcccatgaaggccatcggcgcccagaacctgctgaccatgcccggcggcgtggccaaggccggctacctgcacaagaagggcggcacccagctgcagctgctgaagtggcccctgagattcgtgatcatccacaagagatgcgtgtactacttcaagagcagcaccagcgccagcccccagggcgccttcagcctgagcggctacaacagagtgatgagagccgccgaggagaccaccagcaacaacgtgttccccttcaagatcatccacatcagcaagaagcacagaacctggttcttcagcgccagcagcgaggaggagagaaagagctggatggccctgctgagaagagagatcggccacttccacgagaagaagtag

SEQ ID NO: 98789 - DNA, 2892 bp, Artificial Sequence
  Description of Artificial Sequence: Synthetic coding sequence
atggccgcccagagaatcagagccgccaacagcaacggcctgcccagatgcaagagcgagggcaccctgatcgacctgagcgagggcttcagcgagaccagcttcaacgacatcaaggtgcccagccccagcgccctgctggtggacaaccccacccccttcggcaacgccaaggaggtgatcgccatcaaggactactgccccaccaacttcaccaccctgaagttcagcaagggcgaccacctgtacgtgctggacaccagcggcggcgagtggtggtacgcccacaacaccaccgagatgggctacatccccagcagctacgtgcagcccctgaactacagaaacagcaccctgagcgacagcggcatgatcgacaacctgcccgacagccccgacgaggtggccaaggagctggagctgctgggcggctggaccgacgacaagaaggtgcccggcagaatgtacagcaacaaccccttctggaacggcgtgcagaccaaccccttcctgaacggcaacgtgcccgtgatgcccagcctggacgagctgaaccccaagagcaccgtggacctgctgctgttcgacgccggcaccagcagcttcaccgagagcagcagcgccaccaccaacagcaccggcaacatcttcgacgagctgcccgtgaccaacggcctgcacgccgagccccccgtgagaagagacaaccccttcttcagaagcaagagaagctacagcctgagcgagctgagcgtgctgcaggccaagagcgacgcccccaccagcagcagcttcttcaccggcctgaagagccccgcccccgagcagttccagagcagagaggacttcagaaccgcctggctgaaccacagaaagctggccagaagctgccacgacctggacctgctgggccagagccccggctggggccagacccaggccgtggagaccaacatcgtgtgcaagctggacagcagcggcggcgccgtgcagctgcccgacaccagcatcagcatccacgtgcccgagggccacgtggcccccggcgagacccagcagatcagcatgaaggccctgctggacccccccctggagctgaacagcgacagaagctgcagcatcagccccgtgctggaggtgaagctgagcaacctggaggtgaagaccagcatcatcctggagatgaaggtgagcgccgagatcaagaacgacctgttcagcaagagcaccgtgggcctgcagtgcctgagaagcgacagcaaggagggcccctacgtgagcgtgcccctgaactgcagctgcggcgacaccgtgcaggcccagctgcacaacctggagccctgcatgtacgtggccgtggtggcccacggccccagcatcctgtaccccagcaccgtgtgggacttcatcaacaagaaggtgaccgtgggcctgtacggccccaagcacatccaccccagcttcaagaccgtggtgaccatcttcggccacgactgcgcccccaagaccctgctggtgagcgaggtgaccagacaggcccccaaccccgcccccgtggccctgcagctgtggggcaagcaccagttcgtgctgagcagaccccaggacctgaaggtgtgcatgttcagcaacatgaccaactacgaggtgaaggccagcgagcaggccaaggtggtgagaggcttccagctgaagctgggcaaggtgagcagactgatcttccccatcaccagccagaaccccaacgagctgagcgacttcaccctgagagtgcaggtgaaggacgaccaggaggccatcctgacccagttctgcgtgcagaccccccagcccccccccaagagcgccatcaagcccagcggccagagaagattcctgaagaagaacgaggtgggcaagatcatcctgagccccttcgccaccaccaccaagtaccccaccttccaggacagacccgtgagcagcctgaagttcggcaagctgctgaagaccgtggtgagacagaacaagaaccactacctgctggagtacaagaagggcgacggcatcgccctgctgagcgaggagagagtgagactgagaggccagctgtggaccaaggagtggtacatcggctactaccagggcagagtgggcctggtgcacaccaagaacgtgctggtggtgggcagagccagacccagcctgtgcagcggccccgagctgagcaccagcgtgctgctggagcagatcctgagaccctgcaagttcctgacctacatctacgccagcgtgagaaccctgctgatggagaacatcagcagctggagaagcttcgccgacgccctgggctacgtgaacctgcccctgaccttcttctgcagagccgagctggacagcgagcccgagagagtggccagcgtgctggagaagctgaaggaggactgcaacaacaccgagaacaaggagagaaagagcttccagaaggagctggtgatggccctgctgaagatggactgccagggcctggtggtgagactgatccaggacttcgtgctgctgaccaccgccgtggaggtggcccagagatggagagagctggccgagaagctggccaaggtgagcaagcagcagatggacgcctacgagagcccccacagagacagaaacggcgtggtggacagcgaggccatgtggaagcccgcctacgacttcctgctgacctggagccaccagatcggcgacagctacagagacgtgatccaggagctgcacctgggcctggacaagatgaagaaccccatcaccaagagatggaagcacctgaccggcaccctgatcctggtgaacagcctggacgtgctgagagccgccgccttcagccccgccgaccaggacgacttcgtgatctag

SEQ ID NO: 98790 - DNA, 2892 bp, Artificial Sequence; identical to SEQ ID NO: 98789
  Description of Artificial Sequence: Synthetic coding sequence

SEQ ID NO: 98791 - DNA, 2892 bp, Artificial Sequence; identical to SEQ ID NO: 98789
  Description of Artificial Sequence: Synthetic coding sequence

SEQ ID NO: 98792 - DNA, 369 bp, Artificial Sequence
  Description of Artificial Sequence: Synthetic coding sequence
atggccgcccagagaatcagagccgccaacagcaacggcctgcccagatgcaagagcgagggcaccctgatcgacctgagcgagggcttcagcgagaccagcttcaacgacatcaaggtgcccagccccagcgccctgctggtggacaaccccacccccttcggcaacgccaaggaggtgatcgccatcaaggactactgccccaccaacttcaccaccctgaagttcagcaagggcgaccacctgtacgtgctggacaccagcggcggcgagtggtggtacgcccacaacaccaccgagatgggctacatccccagcagctacgtgcagcccctgaactacagaaacagcaccctgagcgacagctag

SEQ ID NO: 98793 - DNA, 1662 bp, Artificial Sequence
  Description of Artificial Sequence: Synthetic coding sequence
atggccgcccagagaatcagagccgccaacagcaacggcctgcccagatgcaagagcgagggcaccctgatcgacctgagcgagggcttcagcgagaccagcttcaacgacatcaaggtgcccagccccagcgccctgctggtggacaaccccacccccttcggcaacgccaaggaggtgatcgccatcaaggactactgccccaccaacttcaccaccctgaagttcagcaagggcgaccacctgtacgtgctggacaccagcggcggcgagtggtggtacgcccacaacaccaccgagatgggctacatccccagcagctacgtgcagcccctgaactacagaaacagcaccctgagcgacagcggcatgatcgacaacctgcccgacagccccgacgaggtggccaaggagctggagctgctgggcggctggaccgacgacaagaaggtgcccggcagaatgtacagcaacaaccccttctggaacggcgtgcagaccaaccccttcctgaacggcaacgtgcccgtgatgcccagcctggacgagctgaaccccaagagcaccgtggacctgctgctgttcgacgccggcaccagcagcttcaccgagagcagcagcgccaccaccaacagcaccggcaacatcttcgacgagctgcccgtgaccaacggcctgcacgccgagccccccgtgagaagagacaaccccttcttcagaagcaagagaagctacagcctgagcgagctgagcgtgctgcaggccaagagcgacgcccccaccagcagcagcttcttcaccggcctgaagagccccgcccccgagcagttccagagcagagaggacttcagaaccgcctggctgaaccacagaaagctggccagaagctgccacgacctggacctgctgggccagagccccggctggggccagacccaggccgtggagaccaacatcgtgtgcaagctggacagcagcggcggcgccgtgcagctgcccgacaccagcatcagcatccacgtgcccgagggccacgtggcccccggcgagacccagcagatcagcatgaaggccctgctggacccccccctggagctgaacagcgacagaagctgcagcatcagccccgtgctggaggtgaagctgagcaacctggaggtgaagaccagcatcatcctggagatgaaggtgagcgccgagatcaagaacgacctgttcagcaagagcaccgtgggcctgcagtgcctgagaagcgacagcaaggagggcccctacgtgagcgtgcccctgaactgcagctgcggcgacaccgtgcaggcccagctgcacaacctggagccctgcatgtacgtggccgtggtggcccacggccccagcatcctgtaccccagcaccgtgtgggacttcatcaacaagaaggtgaccgtgggcctgtacggccccaagcacatccaccccagcttcaagaccgtggtgaccatcttcggccacgactgcgcccccaagaccctgctggtgagcgaggtgaccagacaggcccccaacccccccatcaccaagagatggaagcacctgaccggcaccctgatcctggtgaacagcctggacgtgctgagagccgccgccttcagccccgccgaccaggacgacttcgtgatctag

SEQ ID NO: 98794 - DNA, 171 bp, Artificial Sequence
  Description of Artificial Sequence: Synthetic coding sequence
atggccgcccagagaatcagagccgccaacagcaacggcctgcccagatgcaagagcgagggcaccctgatcgacctgagcgagggcttcagcgagaccagcttcaacgacatcaaggtgcccagccccagcgccctgctggtggacaaccccacccccttcggcaactag

SEQ ID NO: 98795 - DNA, 522 bp, Artificial Sequence
  Description of Artificial Sequence: Synthetic coding sequence
atggccgcccagagaatcagagccgccaacagcaacggcctgcccagatgcaagagcgagggcaccctgatcgacctgagcgagggcttcagcgagaccagcttcaacgacatcaaggtgcccagccccagcgccctgctggtggacaaccccacccccttcggcaacgccaaggaggtgatcgccatcaaggactactgccccaccaacttcaccaccctgaagttcagcaagggcgaccacctgtacgtgctggacaccagcggcggcgagtggtggtacgcccacaacaccaccgagatgggctacatccccagcagctacgtgcagcccctgaactacagaaacagcaccctgagcgacagcggcatgatcgacaacctgcccgacagccccgacgaggtggccaaggagctggagctgctgggcggctggaccgacgacaagaaggtgcccggcagaatgtacagcaacaaccccttctggaacggcgtgcagaccaaccccttcctgaacggctag

SEQ ID NO: 98796 - DNA, 174 bp, Artificial Sequence
  Description of Artificial Sequence: Synthetic coding sequence
atggccgcccagagaatcagagccgccaacagcaacggcctgcccagatgcaagagcgagggcaccctgatcgacctgagcgagggcttcagcgagaccagcttcaacgacatcaaggtgcccagccccagcgccctgctggtggacaaccccacccccttcggcaacgcctag

SEQ ID NO: 98797 - DNA, 606 bp, Artificial Sequence
  Description of Artificial Sequence: Synthetic coding sequence
atggagaacatcagcagctggagaagcttcgccgacgccctgggctacgtgaacctgcccctgaccttcttctgcagagccgagctggacagcgagcccgagagagtggccagcgtgctggagaagctgaaggaggactgcaacaacaccgagaacaaggagagaaagagcttccagaaggagctggtgatggccctgctgaagatggactgccagggcctggtggtgagactgatccaggacttcgtgctgctgaccaccgccgtggaggtggcccagagatggagagagctggccgagaagctggccaaggtgagcaagcagcagatggacgcctacgagagcccccacagagacagaaacggcgtggtggacagcgaggccatgtggaagcccgcctacgacttcctgctgacctggagccaccagatcggcgacagctacagagacgtgatccaggagctgcacctgggcctggacaagatgaagaaccccatcaccaagagatggaagcacctgaccggcaccctgatcctggtgaacagcctggacgtgctgagagccgccgccttcagccccgccgaccaggacgacttcgtgatctag

SEQ ID NO: 98798 - DNA, 897 bp, Artificial Sequence
  Description of Artificial Sequence: Synthetic coding sequence
atgctgaaccacgccacccagagagtgatggaggccgagcagaccaagaccagaagcgagctggtgcacaaggagaccgccgccagatacaacgccgccatgggcagaatgagacagctggagaagaagctgaagagagccatcaacaagagcaagccctacttcgagctgaaggccaagtactacgtgcagctggagcagctgaagaagaccgtggacgacctgcaggccaagctgaccctggccaagggcgagtacaagatggccctgaagaacctggagatgatcagcgacgagatccacgagagaagaagaagcagcgccatgggccccagaggctgcggcgtgggcgccgagggcagcagcaccagcgtggaggacctgcccggcagcaagcccgagcccgacgccatcagcgtggccagcgaggccttcgaggacgacagctgcagcaacttcgtgagcgaggacgacagcgagacccagagcgtgagcagcttcagcagcggccccaccagccccagcgagatgcccgaccagttccccgccgtggtgagacccggcagcctggacctgcccagccccgtgagcctgagcgagttcggcatgatgttccccgtgctgggccccagaagcgagtgcagcggcgccagcagccccgagtgcgaggtggagagaggcgacagagccgagggcgccgagaacaagaccagcgacaaggccaacaacaacagaggcctgagcagcagcagcggcagcggcggcagcagcaagagccagagcagcaccagccccgagggccaggccctggagaacagaatgaagcagctgagcctgcagtgcagcaagggcagagacggcatcatcgccgacatcaagatggtgcagatcggctag

SEQ ID NO: 98799 - DNA, 387 bp, Artificial Sequence
  Description of Artificial Sequence: Synthetic coding sequence
atgctgaaccacgccacccagagagtgatggaggccgagcagaccaagaccagaagcgagctggtgcacaaggagaccgccgccagatacaacgccgccatgggcagaatgagacagctggagaagaagctgaagagagccatcaacaagagcaagccctacttcgagctgaaggccaagtactacgtgcagctggagcagctgaagaagaccgtggacgacctgcaggccaagctgaccctggccaagggcgagtacaagatggccctgaagaacctggagatgatcagcgacgagatccacgagagaagaagaagcagcgccatgggccccagaggctgcggcgtgggcgccgagggcagcagcaccagcgtggaggacctgtag

SEQ ID NO: 98800 - DNA, 1368 bp, Artificial Sequence
  Description of Artificial Sequence: Synthetic coding sequence
atggacgccgccctgaagagaagcagaagcgaggagcccgccgagatcctgccccccgccagagacgaggaggaggaggaggaggagggcatggagcagggcctggaggaggaggaggaggtggaccccagaatccagggcgagctggagaagctgaaccagagcaccgacgacatcaacagaagagagaccgagctggaggacgccagacagaagttcagaagcgtgctggtggaggccaccgtgaagctggacgagctggtgaagaagatcggcaaggccgtggaggacagcaagccctactgggaggccagaagagtggccagacaggcccagctggaggcccagaaggccacccaggacttccagagagccaccgaggtgctgagagccgccaaggagaccatcagcctggccgagcagagactgctggaggacgacaagagacagttcgacagcgcctggcaggagatgctgaaccacgccacccagagagtgatggaggccgagcagaccaagaccagaagcgagctggtgcacaaggagaccgccgccagatacaacgccgccatgggcagaatgagacagctggagaagaagctgaagagagccatcaacaagagcaagccctacttcgagctgaaggccaagtactacgtgcagctggagcagctgaagaagaccgtggacgacctgcaggccaagctgaccctggccaagggcgagtacaagatggccctgaagaacctggagatgatcagcgacgagatccacgagagaagaagaagcagcgccatgggccccagaggctgcggcgtgggcgccgagggcagcagcaccagcgtggaggacctgcccggcagcaagcccgagcccgacgccatcagcgtggccagcgaggccttcgaggacgacagctgcagcaacttcgtgagcgaggacgacagcgagacccagagcgtgagcagcttcagcagcggccccaccagccccagcgagatgcccgaccagttccccgccgtggtgagacccggcagcctggacctgcccagccccgtgagcctgagcgagttcggcatgatgttccccgtgctgggccccagaagcgagtgcagcggcgccagcagccccgagtgcgaggtggagagaggcgacagagccgagggcgccgagaacaagaccagcgacaaggccaacaacaacagaggcctgagcagcagcagcggcagcggcggcagcagcaagagccagagcagcaccagccccgagggccaggccctggagaacagaatgaagcagctgagcctgcagtgcagcaagggcagagacggcatcatcgccgacatcaagatggtgcagatcggctag

SEQ ID NO: 98801 - DNA, 897 bp, Artificial Sequence; identical to SEQ ID NO: 98798
  Description of Artificial Sequence: Synthetic coding sequence

SEQ ID NO: 98802 - DNA, 156 bp, Artificial Sequence
  Description of Artificial Sequence: Synthetic coding sequence
atgctgaaccacgccacccagagagtgatggaggccgagcagaccaagaccagaagcgagctggtgcacaaggagaccgccgccagatacaacgccgccatgggcagaatgagacagctggagaagaagctgaagagagccatcaacaagagctag

SEQ ID NO: 98803 - DNA, 897 bp, Artificial Sequence; identical to SEQ ID NO: 98798
  Description of Artificial Sequence: Synthetic coding sequence

SEQ ID NO: 98804 - DNA, 2580 bp, Artificial Sequence
  Description of Artificial Sequence: Synthetic coding sequence
atgatggagggcctgaagaagagaaccagaaaggccttcggcatcagaaagaaggagaaggacaccgacagcaccggcagccccgacagagacggcatccagggcaagaagaagacccagaagacccagctgctgctgaccagctgcttctggctgagagccctgagcctgaccctgagccagaagaagagcaacggcgcccccaacggcttctacgccgagatcgactgggagagatacaacagccccgagctggacgaggagggctacagcatcagacccgaggagcccggcagcaccaagggcaagcacttctacagcagcagcgagagcgaggaggaggaggagagccacaagaagttcaacatcaagatcaagcccctgcagagcaaggacatcctgaagaacgccgccaccgtggacgagctgaaggccagcatcggcaacatcgccctgagccccagccccgtgagaaagagccccagaagaagccccggcgccatcaagagaaacctgagcagcgaggaggtggccagacccagaagaagcacccccacccccgagctgatcagcaagaagccccccgacgacaccaccgccctggcccccctgttcggcccccccctggagagcgccttcgacgagcagaagaccgaggtgctgctggaccagcccgagatctggggcagcggccagcccatcaaccccagcatggagagccccaagctgaccagacccttccccaccggcacccccccccccctgccccccaagaacgtgcccgccaccccccccagaaccggcagccccctgaccatcggccccggcaacgaccagagcgccaccgaggtgaagatcgagaagctgcccagcatcaacgacctggacagcatcttcggccccgtgctgagccccaagagcgtggccgtgaacgccgaggagaagtgggtgcacttcagcgacaccagccccgagcacgtgacccccgagctgacccccagagagaaggtggtgagcccccccgccacccccgacaaccccgccgacagccccgcccccggccccctgggcccccccggccccaccggcccccccggcccccccggcccccccagaaacgtgctgagccccctgaacctggaggaggtgcagaagaaggtggccgagcagaccttcatcaaggacgactacctggagaccatcagcagccccaaggacttcggcctgggccagagagccacccccccccccccccccccccccacctacagaaccgtggtgagcagccccggccccggcagcggccccggccccggcaccaccagcgacggcaagaccgaggcccagagataccaggtgatctgccccagcctgcaggccggcggcaacgagctggacagctacagcggcgccagcagccccgccagacccgccacccccctggtgccctgcagaagcaccaccccccccccccccccccccagaccccccagcagacccaagctgccccccggcaagcccggcgtgggcgacgtgagcagacccttcagcccccccatccacagcagcagccccccccccatcgcccccctggccagagccgagagcaccagcagcatcagcagcaccaacagcctgagcgccgccaccacccccaccgtggagaacgagcagcccagcctggtgtggttcgacagaggcaagttctacctgaccttcgagggcagcagcagaggccccagccccctgaccatgggcgcccaggacaccctgcccgtggccgccgccttcaccgagaccgtgaacgcctacttcaagggcgccgaccccagcaagtgcatcgtgaagatcaccggcgagatggtgctgagcttccccgccggcatcaccagacacttcgccaacaaccccagccccgccgccctgaccttcagagtgatcaacttcagcagactggagcacgtgctgcccaacccccagctgctgtgctgcgacaacacccagaacgacgccaacaccaaggagttctgggtgaacatgcccaacctgatgacccacctgaagaaggtgagcgagcagaagccccaggccacctactacaacgtggacatgctgaagtaccaggtgagcgcccagggcatccagagcacccccctgaacctggccgtgaactggagatgcgagcccagcagcaccgacctgagaatcgactacaagtacaacaccgacgccatgaccaccgccgtggccctgaacaacgtgcagttcctggtgcccatcgacggcggcgtgaccaagctgcaggccgtgctgccccccgccgtgtggaacgccgagcagcagagaatcctgtggaagatccccgacatcagccagaagagcgagaacggcggcgtgggcagcctgctggccagattccagctgagcgagggccccagcaagcccagccccctggtggtgcagttcaccagcgagggcagcaccctgagcggctgcgacatcgagctggtgggcgccggctacagattcagcctgatcaagaagagattcgccgccggcaagtacctggccgacaactag

SEQ ID NO: 98805 - DNA, 1857 bp, Artificial Sequence
  Description of Artificial Sequence: Synthetic coding sequence
atgatggagggcctgaagaagagaaccagaaaggccttcggcatcagaaagaaggagaaggacaccgacagcaccggcagccccgacagagacggcatcaacagccccgagctggacgaggagggctacagcatcagacccgaggagcccggcagcaccaagggcaagcacttctacagcagcagcgagagcgaggaggaggaggagagccacaagaagttcaacatcaagatcaagcccctgcagagcaaggacatcctgaagaacgccgccaccgtggacgagctgaaggccagcatcggcaacatcgccctgagccccagccccgtgagaaagagccccagaagaagccccggcgccatcaagagaaacctgagcagcgaggaggtggccagacccagaagaagcacccccacccccgagctgatcagcaagaagccccccgacgacaccaccgccctggcccccctgttcggcccccccctggagagcgccttcgacgagcagaagaccgaggtgctgctggaccagcccgagatctggggcagcggccagcccatcaaccccagcatggagagccccaagctgaccagacccttccccaccggcacccccccccccctgccccccaagaacgtgcccgccaccccccccagaaccggcagccccctgaccatcggccccggcgccagcagccccgccagacccgccacccccctggtgccctgcagaagcaccaccccccccccccccccccccagaccccccagcagacccaagctgccccccggcaagcccggcgtgggcgacgtgagcagacccttcagcccccccatccacagcagcagccccccccccatcgcccccctggccagagccgagagcaccagcagcatcagcagcaccaacagcctgagcgccgccaccacccccaccgtggagaacgagcagcccagcctggtgtggttcgacagaggcaagttctacctgaccttcgagggcagcagcagaggccccagccccctgaccatgggcgcccaggacaccctgcccgtggccgccgccttcaccgagaccgtgaacgcctacttcaagggcgccgaccccagcaagtgcatcgtgaagatcaccggcgagatggtgctgagcttccccgccggcatcaccagacacttcgccaacaaccccagccccgccgccctgaccttcagagtgatcaacttcagcagactggagcacgtgctgcccaacccccagctgctgtgctgcgacaacacccagaacgacgccaacaccaaggagttctgggtgaacatgcccaacctgatgacccacctgaagaaggtgagcgagcagaagccccaggccacctactacaacgtggacatgctgaagtaccaggtgagcgcccagggcatccagagcacccccctgaacctggccgtgaactggagatgcgagcccagcagcaccgacctgagaatcgactacaagtacaacaccgacgccatgaccaccgccgtggccctgaacaacgtgcagttcctggtgcccatcgacggcggcgtgaccaagctgcaggccgtgctgccccccgccgtgtggaacgccgagcagcagagaatcctgtggaagatccccgacatcagccagaagagcgagaacggcggcgtgggcagcctgctggccagattccagctgagcgagggccccagcaagcccagccccctggtggtgcagttcaccagcgagggcagcaccctgagcggctgcgacatcgagctggtgggcgccggctacagattcagcctgatcaagaagagattcgccgccggcaagtacctggccgacaactag

SEQ ID NO: 98806 - DNA, 1893 bp, Artificial Sequence
  Description of Artificial Sequence: Synthetic coding sequence
atggagggcctgaagaagagaaccagaaaggccttcggcatcagaaagaaggagaaggacaccgacagcaccggcagccccgacagagacggcatcaagaagagcaacggcgcccccaacggcttctacgccgagatcgactgggagagatacaacagccccgagctggacgaggagggctacagcatcagacccgaggagcccggcagcaccaagggcaagcacttctacagcagcagcgagagcgaggaggaggaggagagccacaagaagttcaacatcaagatcaagcccctgcagagcaaggacatcctgaagaacgccgccaccgtggacgagctgaaggccagcatcggcaacatcgccctgagccccagccccgtgggcgccatcaagagaaacctgagcagcgaggaggtggccagacccagaagaagcacccccacccccgagctgatcagcaagaagccccccgacgacaccaccgccctggcccccctgttcggcccccccctggagagcgccttcgacgagcagaagaccgaggtgctgctggaccagcccgagatctggggcagcggccagcccatcaaccccagcatggagagccccaagctgaccagacccttccccaccggcacccccccccccctgccccccaagaacgtgcccgccaccccccccagaaccggcagccccctgaccatcggccccggcgccagcagccccgccagacccgccacccccctggtgccctgcagaagcaccaccccccccccccccccccccagaccccccagcagacccaagctgccccccggcaagcccggcgtgggcgacgtgagcagacccttcagcccccccatccacagcagcagccccccccccatcgcccccctggccagagccgagagcaccagcagcatcagcagcaccaacagcctgagcgccgccaccacccccaccgtggtgagcgaggacgacgtgttctacgacaagctgcccagcttcgagagaagatgcgagacccccgccggcagcagcagaggccccagccccctgaccatgggcgcccaggacaccctgcccgtggccgccgccttcaccgagaccgtgaacgcctacttcaagggcgccgaccccagcaagtgcatcgtgaagatcaccggcgagatggtgctgagcttccccgccggcatcaccagacacttcgccaacaaccccagccccgccgccctgaccttcagagtgatcaacttcagcagactggagcacgtgctgcccaacccccagctgctgtgctgcgacaacacccagaacgacgccaacaccaaggagttctgggtgaacatgcccaacctgatgacccacctgaagaaggtgagcgagcagaagccccaggccacctactacaacgtggacatgctgaagtaccaggtgagcgcccagggcatccagagcacccccctgaacctggccgtgaactggagatgcgagcccagcagcaccgacctgagaatcgactacaagtacaacaccgacgccatgaccaccgccgtggccctgaacaacgtgcagttcctggtgcccatcgacggcggcgtgaccaagctgcaggccgtgctgccccccgccgtgtggaacgccgagcagcagagaatcctgtggaagatccccgacatcagccagaagagcgagaacggcggcgtgggcagcctgctggccagattccagctgagcgagggccccagcaagcccagccccctggtggtgcagttcaccagcgagggcagcaccctgagcggctgcgacatcgagctggtgggcgccggctacagattcagcctgatcaagaagagattcgccgccggcaagtacctggccgacaactag

SEQ ID NO: 98807 - DNA, 2487 bp, Artificial Sequence
  Description of Artificial Sequence: Synthetic coding sequence
atgatggagggcctgaagaagagaaccagaaaggccttcggcatcagaaagaaggagaaggacaccgacagcaccggcagccccgacagagacggcatccagcccagcccccacgagcccccctacaacagcaaggccgagtgcgccagagagggcggcaagaaggtgagcaagaagagcaacggcgcccccaacggcttctacgccgagatcgactgggagagatacaacagccccgagctggacgaggagggctacagcatcagacccgaggagcccggcagcaccaagggcaagcacttctacagcagcagcgagagcgaggaggaggaggagagccacaagaagttcaacatcaagatcaagcccctgcagagcaaggacatcctgaagaacgccgccaccgtggacgagctgaaggccagcatcggcaacatcgccctgagccccagccccgtgagaaagagccccagaagaagccccggcgccatcaagagaaacctgagcagcgaggaggtggccagacccagaagaagcacccccacccccgagctgatcagcaagaagccccccgacgacaccaccgccctggcccccctgttcggcccccccctggagagcgccttcgacgagcagaagaccgaggtgctgctggaccagcccgagatctggggcagcggccagcccatcaaccccagcatggagagccccaagctgaccagacccttccccaccggcacccccccccccctgccccccaagaacgtgcccgccaccccccccagaaccggcagccccctgaccatcggccccggcaacgaccagagcgccaccgaggtgaagatcgagaagctgcccagcatcaacgacctggacagcatcttcggccccgtgctgagccccaagagcgtggccgtgaacgccgaggagaagtgggtgcacttcagcgacaccagccccgagcacgtgacccccgagctgacccccagagagaaggtggtgagcccccccgccacccccgacaaccccgccgacagccccgcccccggccccctgggcccccccggccccaccggcccccccggcccccccggcccccccagaaacgtgctgagccccctgaacctggaggaggtgcagaagaaggtggccgagcagaccttcatcaaggacgactacctggagaccatcagcagccccaaggacttcggcctgggccagagagccacccccccccccccccccccccccacctacagaaccgtggtgagcagccccggccccggcagcggccccggccccggcaccaccagcggcgccagcagccccgccagacccgccacccccctggtgccctgcagaagcaccaccccccccccccccccccccagaccccccagcagacccaagctgccccccggcaagcccggcgtgggcgacgtgagcagacccttcagcccccccatccacagcagcagccccccccccatcgcccccctggccagagccgagagcaccagcagcatcagcagcaccaacagcctgagcgccgccaccacccccaccgtggagaacgagcagcccagcctggtgtggttcgacagaggcaagttctacctgaccttcgagggcagcagcagaggccccagccccctgaccatgggcgcccaggacaccctgcccgtggccgccgccttcaccgagaccgtgaacgcctacttcaagggcgccgaccccagcaagtgcatcgtgaagatcaccggcgagatggtgctgagcttccccgccggcatcaccagacacttcgccaacaaccccagccccgccgccctgaccttcagagtgatcaacttcagcagactggagcacgtgctgcccaacccccagctgctgtgctgcgacaacacccagaacgacgccaacaccaaggagttctgggtgaacatgcccaacctgatgacccacctgaagaaggtgagcgagcagaagccccaggccacctactacaacgtggacatgctgaagtaccaggtgagcgcccagggcatccagagcacccccctgaacctggccgtgaactggagatgcgagcccagcagcaccgacctgagaatcgactacaagtacaacaccgacgccatgaccaccgccgtggccctgaacaacgtgcagttcctggtgcccatcgacggcggcgtgaccaagctgcaggccgtgctgccccccgccgtgtggaacgccgagcagcagagaatcctgtggaagatccccgacatcagccagaagagcgagaacggcggcgtgggcagcctgctggccagattccagctgagcgagggccccagcaagcccagccccctggtggtgcagttcaccagcgagggcagcaccctgagcggctgcgacatcgagctggtgggcgccggctacagattcagcctgatcaagaagagattcgccgccggcaagtacctggccgacaactag

SEQ ID NO: 98808 - DNA, 2577 bp, Artificial Sequence
  Description of Artificial Sequence: Synthetic coding sequence
atggagggcctgaagaagagaaccagaaaggccttcggcatcagaaagaaggagaaggacaccgacagcaccggcagccccgacagagacggcatccagggcaagaagaagacccagaagacccagctgctgctgaccagctgcttctggctgagagccctgagcctgaccctgagccagaagaagagcaacggcgcccccaacggcttctacgccgagatcgactgggagagatacaacagccccgagctggacgaggagggctacagcatcagacccgaggagcccggcagcaccaagggcaagcacttctacagcagcagcgagagcgaggaggaggaggagagccacaagaagttcaacatcaagatcaagcccctgcagagcaaggacatcctgaagaacgccgccaccgtggacgagctgaaggccagcatcggcaacatcgccctgagccccagccccgtgagaaagaaggagagaagagagaagggcgccatcaagagaaacctgagcagcgaggaggtggccagacccagaagaagcacccccacccccgagctgatcagcaagaagccccccgacgacaccaccgccctggcccccctgttcggcccccccctggagagcgccttcgacgagcagaagaccgaggtgctgctggaccagcccgagatctggggcagcggccagcccatcaaccccagcatggagagccccaagctgaccagacccttccccaccggcacccccccccccctgccccccaagaacgtgcccgccaccccccccagaaccggcagccccctgaccatcggccccggcaacgaccagagcgccaccgaggtgaagatcgagaagctgcccagcatcaacgacctggacagcatcttcggccccgtgctgagccccaagagcgtggccgtgaacgccgaggagaagtgggtgcacttcagcgacaccagccccgagcacgtgacccccgagctgacccccagagagaaggtggtgagcccccccgccacccccgacaaccccgccgacagccccgcccccggccccctgggcccccccggccccaccggcccccccggcccccccggcccccccagaaacgtgctgagccccctgaacctggaggaggtgcagaagaaggtggccgagcagaccttcatcaaggacgactacctggagaccatcagcagccccaaggacttcggcctgggccagagagccacccccccccccccccccccccccacctacagaaccgtggtgagcagccccggccccggcagcggccccggccccggcaccaccagcgacggcaagaccgaggcccagagataccaggtgatctgccccagcctgcaggccggcggcaacgagctggacagctacagcggcgccagcagccccgccagacccgccacccccctggtgccctgcagaagcaccaccccccccccccccccccccagaccccccagcagacccaagctgccccccggcaagcccggcgtgggcgacgtgagcagacccttcagcccccccatccacagcagcagccccccccccatcgcccccctggccagagccgagagcaccagcagcatcagcagcaccaacagcctgagcgccgccaccacccccaccgtggagaacgagcagcccagcctggtgtggttcgacagaggcaagttctacctgaccttcgagggcagcagcagaggccccagccccctgaccatgggcgcccaggacaccctgcccgtggccgccgccttcaccgagaccgtgaacgcctacttcaagggcgccgaccccagcaagtgcatcgtgaagatcaccggcgagatggtgctgagcttccccgccggcatcaccagacacttcgccaacaaccccagccccgccgccctgaccttcagagtgatcaacttcagcagactggagcacgtgctgcccaacccccagctgctgtgctgcgacaacacccagaacgacgccaacaccaaggagttctgggtgaacatgcccaacctgatgacccacctgaagaaggtgagcgagcagaagccccaggccacctactacaacgtggacatgctgaagtaccaggtgagcgcccagggcatccagagcacccccctgaacctggccgtgaactggagatgcgagcccagcagcaccgacctgagaatcgactacaagtacaacaccgacgccatgaccaccgccgtggccctgaacaacgtgcagttcctggtgcccatcgacggcggcgtgaccaagctgcaggccgtgctgccccccgccgtgtggaacgccgagcagcagagaatcctgtggaagatccccgacatcagccagaagagcgagaacggcggcgtgggcagcctgctggccagattccagctgagcgagggccccagcaagcccagccccctggtggtgcagttcaccagcgagggcagcaccctgagcggctgcgacatcgagctggtgggcgccggctacagattcagcctgatcaagaagagattcgccgccggcaagtacctggccgacaactag

SEQ ID NO: 98809 - DNA, 1896 bp, Artificial Sequence
  Description of Artificial Sequence: Synthetic coding sequence
atgatggagggcctgaagaagagaaccagaaaggccttcggcatcagaaagaaggagaaggacaccgacagcaccggcagccccgacagagacggcatcaagaagagcaacggcgcccccaacggcttctacgccgagatcgactgggagagatacaacagccccgagctggacgaggagggctacagcatcagacccgaggagcccggcagcaccaagggcaagcacttctacagcagcagcgagagcgaggaggaggaggagagccacaagaagttcaacatcaagatcaagcccctgcagagcaaggacatcctgaagaacgccgccaccgtggacgagctgaaggccagcatcggcaacatcgccctgagccccagccccgtgggcgccatcaagagaaacctgagcagcgaggaggtggccagacccagaagaagcacccccacccccgagctgatcagcaagaagccccccgacgacaccaccgccctggcccccctgttcggcccccccctggagagcgccttcgacgagcagaagaccgaggtgctgctggaccagcccgagatctggggcagcggccagcccatcaaccccagcatggagagccccaagctgaccagacccttccccaccggcacccccccccccctgccccccaagaacgtgcccgccaccccccccagaaccggcagccccctgaccatcggccccggcgccagcagccccgccagacccgccacccccctggtgccctgcagaagcaccaccccccccccccccccccccagaccccccagcagacccaagctgccccccggcaagcccggcgtgggcgacgtgagcagacccttcagcccccccatccacagcagcagccccccccccatcgcccccctggccagagccgagagcaccagcagcatcagcagcaccaacagcctgagcgccgccaccacccccaccgtggtgagcgaggacgacgtgttctacgacaagctgcccagcttcgagagaagatgcgagacccccgccggcagcagcagaggccccagccccctgaccatgggcgcccaggacaccctgcccgtggccgccgccttcaccgagaccgtgaacgcctacttcaagggcgccgaccccagcaagtgcatcgtgaagatcaccggcgagatggtgctgagcttccccgccggcatcaccagacacttcgccaacaaccccagccccgccgccctgaccttcagagtgatcaacttcagcagactggagcacgtgctgcccaacccccagctgctgtgctgcgacaacacccagaacgacgccaacaccaaggagttctgggtgaacatgcccaacctgatgacccacctgaagaaggtgagcgagcagaagccccaggccacctactacaacgtggacatgctgaagtaccaggtgagcgcccagggcatccagagcacccccctgaacctggccgtgaactggagatgcgagcccagcagcaccgacctgagaatcgactacaagtacaacaccgacgccatgaccaccgccgtggccctgaacaacgtgcagttcctggtgcccatcgacggcggcgtgaccaagctgcaggccgtgctgccccccgccgtgtggaacgccgagcagcagagaatcctgtggaagatccccgacatcagccagaagagcgagaacggcggcgtgggcagcctgctggccagattccagctgagcgagggccccagcaagcccagccccctggtggtgcagttcaccagcgagggcagcaccctgagcggctgcgacatcgagctggtgggcgccggctacagattcagcctgatcaagaagagattcgccgccggcaagtacctggccgacaactag

SEQ ID NO: 98810 - DNA, 2496 bp, Artificial Sequence
  Description of Artificial Sequence: Synthetic coding sequence
atggagggcctgaagaagagaaccagaaaggccttcggcatcagaaagaaggagaaggacaccgacagcaccggcagccccgacagagacggcatccagggcaagaagaagacccagaagacccagctgctgctgaccagctgcttctggctgagagccctgagcctgaccctgagccagaagaagagcaacggcgcccccaacggcttctacgccgagatcgactgggagagatacaacagccccgagctggacgaggagggctacagcatcagacccgaggagcccggcagcaccaagggcaagcacttctacagcagcagcgagagcgaggaggaggaggagagccacaagaagttcaacatcaagatcaagcccctgcagagcaaggacatcctgaagaacgccgccaccgtggacgagctgaaggccagcatcggcaacatcgccctgagccccagccccgtgagaaagaaggagagaagagagaagggcgccatcaagagaaacctgagcagcgaggaggtggccagacccagaagaagcacccccacccccgagctgatcagcaagaagccccccgacgacaccaccgccctggcccccctgttcggcccccccctggagagcgccttcgacgagcagaagaccgaggtgctgctggaccagcccgagatctggggcagcggccagcccatcaaccccagcatggagagccccaagctgaccagacccttccccaccggcacccccccccccctgccccccaagaacgtgcccgccaccccccccagaaccggcagccccctgaccatcggccccggcaacgaccagagcgccaccgaggtgaagatcgagaagctgcccagcatcaacgacctggacagcatcttcggccccgtgctgagccccaagagcgtggccgtgaacgccgaggagaagtgggtgcacttcagcgacaccagccccgagcacgtgacccccgagctgacccccagagagaaggtggtgagcccccccgccacccccgacaaccccgccgacagccccgcccccggccccctgggcccccccggccccaccggcccccccggcccccccggcccccccagaaacgtgctgagccccctgaacctggaggaggtgcagaagaaggtggccgagcagaccttcatcaaggacgactacctggagaccatcagcagccccaaggacttcggcctgggccagagagccacccccccccccccccccccccccacctacagaaccgtggtgagcagccccggccccggcagcggccccggccccggcaccaccagcggcgccagcagccccgccagacccgccacccccctggtgccctgcagaagcaccaccccccccccccccccccccagaccccccagcagacccaagctgccccccggcaagcccggcgtgggcgacgtgagcagacccttcagcccccccatccacagcagcagccccccccccatcgcccccctggccagagccgagagcaccagcagcatcagcagcaccaacagcctgagcgccgccaccacccccaccgtggagaacgagcagcccagcctggtgtggttcgacagaggcaagttctacctgaccttcgagggcagcagcagaggccccagccccctgaccatgggcgcccaggacaccctgcccgtggccgccgccttcaccgagaccgtgaacgcctacttcaagggcgccgaccccagcaagtgcatcgtgaagatcaccggcgagatggtgctgagcttccccgccggcatcaccagacacttcgccaacaaccccagccccgccgccctgaccttcagagtgatcaacttcagcagactggagcacgtgctgcccaacccccagctgctgtgctgcgacaacacccagaacgacgccaacaccaaggagttctgggtgaacatgcccaacctgatgacccacctgaagaaggtgagcgagcagaagccccaggccacctactacaacgtggacatgctgaagtaccaggtgagcgcccagggcatccagagcacccccctgaacctggccgtgaactggagatgcgagcccagcagcaccgacctgagaatcgactacaagtacaacaccgacgccatgaccaccgccgtggccctgaacaacgtgcagttcctggtgcccatcgacggcggcgtgaccaagctgcaggccgtgctgccccccgccgtgtggaacgccgagcagcagagaatcctgtggaagatccccgacatcagccagaagagcgagaacggcggcgtgggcagcctgctggccagattccagctgagcgagggccccagcaagcccagccccctggtggtgcagttcaccagcgagggcagcaccctgagcggctgcgacatcgagctggtgggcgccggctacagattcagcctgatcaagaagagattcgccgccggcaagtacctggccgacaactag

SEQ ID NO: 98811 - DNA, 783 bp, Artificial Sequence
  Description of Artificial Sequence: Synthetic coding sequence
atgatggagggcctgaagaagagaaccagaaaggccttcggcatcagaaagaaggagaaggacaccgacagcaccggcagccccgacagagacggcatccagcccagcccccacgagcccccctacaacagcaaggccgagtgcgccagagagggcggcaagaaggtgagcaagaagagcaacggcgcccccaacggcttctacgccgagatcgactgggagagatacaacagccccgagctggacgaggagggctacagcatcagacccgaggagcccggcagcaccaagggcaagcacttctacagcagcagcgagagcgaggaggaggaggagagccacaagaagttcaacatcaagatcaagcccctgcagagcaaggacatcctgaagaacgccgccaccgtggacgagctgaaggccagcatcggcaacatcgccctgagccccagccccgtgggcgccatcaagagaaacctgagcagcgaggaggtggccagacccagaagaagcacccccacccccgagctgatcagcaagaagccccccgacgacaccaccgccctggcccccctgttcggcccccccctggagagcgccttcgacgagcagaagaccgaggtgctgctggaccagcccgagatctggggcagcggccagcccatcaaccccagcatggagagccccaagctgaccagacccttccccaccggcacccccccccccctgccccccaagaacgtgcccgccaccccccccagaaccggcagccccctgacctag

SEQ ID NO: 98812 - DNA, 1002 bp, Artificial Sequence
  Description of Artificial Sequence: Synthetic coding sequence
atgacctgcagcgtgacccacatcgtgagcttcagcctgcccttcctgaaccccagccaccccgccagcacccccggccacaccgagaacgagcagcccagcctggtgtggttcgacagaggcaagttctacctgaccttcgagggcagcagcagaggccccagccccctgaccatgggcgcccaggacaccctgcccgtggccgccgccttcaccgagaccgtgaacgcctacttcaagggcgccgaccccagcaagtgcatcgtgaagatcaccggcgagatggtgctgagcttccccgccggcatcaccagacacttcgccaacaaccccagccccgccgccctgaccttcagagtgatcaacttcagcagactggagcacgtgctgcccaacccccagctgctgtgctgcgacaacacccagaacgacgccaacaccaaggagttctgggtgaacatgcccaacctgatgacccacctgaagaaggtgagcgagcagaagccccaggccacctactacaacgtggacatgctgaagtaccaggtgagcgcccagggcatccagagcacccccctgaacctggccgtgaactggagatgcgagcccagcagcaccgacctgagaatcgactacaagtacaacaccgacgccatgaccaccgccgtggccctgaacaacgtgcagttcctggtgcccatcgacggcggcgtgaccaagctgcaggccgtgctgccccccgccgtgtggaacgccgagcagcagagaatcctgtggaagatccccgacatcagccagaagagcgagaacggcggcgtgggcagcctgctggccagattccagctgagcgagggccccagcaagcccagccccctggtggtgcagttcaccagcgagggcagcaccctgagcggctgcgacatcgagctggtgggcgccggctacagattcagcctgatcaagaagagattcgccgccggcaagtacctggccgacaactag

SEQ ID NO: 98813 - DNA, 1107 bp, Artificial Sequence
  Description of Artificial Sequence: Synthetic coding sequence
atgagcgtggccggcctgaagaagcagttctacaaggccagccagctggtgagcgagaaggtgggcggcgccgagggcaccaagctggacgacgacttcaaggagatggagaagaaggtggacgtgaccagcaaggccgtgaccgaggtgctggccagaaccatcgagtacctgcagcccaaccccgccagcagagccaagctgaccatgctgaacaccgtgagcaagatcagaggccaggtgaagaaccccggctacccccagagcgagggcctgctgggcgagtgcatgatcagacacggcaaggagctgggcggcgagagcaacttcggcgacgccctgctggacgccggcgagagcatgaagagactggccgaggtgaaggacagcctggacatcgaggtgaagcagaacttcatcgaccccctgcagaacctgtgcgagaaggacctgaaggagatccagcaccacctgaagaagctggagggcagaagactggacttcgactacaagaagaagagacagggcaagatccccgacgaggagctgagacaggccctggagaagttcgaggagagcaaggaggtggccgagaccagcatgcacaacctgctggagaccgacatcgagcaggtgagccagctgagcgccctggtggacgcccagctggactaccacagacaggccgtgcagatcctggacgagctggccgagaagctgaagagaagaatgagagaggccagcagcagacccaagagagagtacaagcccaagcccagagagcccttcgacctgggcgagcccgagcagagcaacggcggcttcccctgcaccaccgcccccaagatcgccgccagcagcagcttcagaagcagcgacaagcccatcagaacccccagcagaagcatgccccccctggaccagcccagctgcaaggccctgtacgacttcgagcccgagaacgacggcgagctgggcttccacgagggcgacgtgatcaccctgaccaaccagatcgacgagaactggtacgagggcatgctggacggccagagcggcttcttccccctgagctacgtggaggtgctggtgcccctgccccagtag

SEQ ID NO: 98814 - DNA, 963 bp, Artificial Sequence
  Description of Artificial Sequence: Synthetic coding sequence
atgagcgtggccggcctgaagaagcagttctacaaggccagccagctggtgagcgagaaggtgggcggcgccgagggcaccaagctggacgacgacttcaaggagatggagaagaaggtggacgtgaccagcaaggccgtgaccgaggtgctggccagaaccatcgagtacctgcagcccaaccccggcgacgccctgctggacgccggcgagagcatgaagagactggccgaggtgaaggacagcctggacatcgaggtgaagcagaacttcatcgaccccctgcagaacctgtgcgagaaggacctgaaggagatccagcaccacctgaagaagctggagggcagaagactggacttcgactacaagaagaagagacagggcaagatccccgacgaggagctgagacaggccctggagaagttcgaggagagcaaggaggtggccgagaccagcatgcacaacctgctggagaccgacatcgagcaggtgagccagctgagcgccctggtggacgcccagctggactaccacagacaggccgtgcagatcctggacgagctggccgagaagctgaagagaagaatgagagaggccagcagcagacccaagagagagtacaagcccaagcccagagagcccttcgacctgggcgagcccgagcagagcaacggcggcttcccctgcaccaccgcccccaagatcgccgccagcagcagcttcagaagcagcgacaagcccatcagaacccccagcagaagcatgccccccctggaccagcccagctgcaaggccctgtacgacttcgagcccgagaacgacggcgagctgggcttccacgagggcgacgtgatcaccctgaccaaccagatcgacgagaactggtacgagggcatgctggacggccagagcggcttcttccccctgagctacgtggaggtgctggtgcccctgccccagtag

SEQ ID NO: 98815 - DNA, 915 bp, Artificial Sequence
  Description of Artificial Sequence: Synthetic coding sequence
atgagcgtggccggcctgaagaagcagttctacaaggccagccagctggtgagcgagaaggtgggcggcgccgagggcaccaagctggacgacgacttcaaggagatggagaagaaggtggacgtgaccagcaaggccgtgaccgaggtgctggccagaaccatcgagtacctgcagcccaaccccgccagcagagccaagctgaccatgctgaacaccgtgagcaagatcagaggccagaacctgtgcgagaaggacctgaaggagatccagcaccacctgaagaagctggagggcagaagactggacttcgactacaagaagaagagacagggcaagatccccgacgaggagctgagacaggccctggagaagttcgaggagagcaaggaggtggccgagaccagcatgcacaacctgctggagaccgacatcgagcaggtgagccagctgagcgccctggtggacgcccagctggactaccacagacaggccgtgcagatcctggacgagctggccgagaagctgaagagaagaatgagagaggccagcagcagacccaagagagagtacaagcccaagcccagagagcccttcgacctgggcgagcccgagcagagcaacggcggcttcccctgcaccaccgcccccaagatcgccgccagcagcagcttcagaagcagcgacaagcccatcagaacccccagcagaagcatgccccccctggaccagcccagctgcaaggccctgtacgacttcgagcccgagaacgacggcgagctgggcttccacgagggcgacgtgatcaccctgaccaaccagatcgacgagaactggtacgagggcatgctggacggccagagcggcttcttccccctgagctacgtggaggtgctggtgcccctgccccagtag

SEQ ID NO: 98816 - DNA, 1059 bp, Artificial Sequence
  Description of Artificial Sequence: Synthetic coding sequence
atgagcgtggccggcctgaagaagcagttccacaaggccacccagaaggtgagcgagaaggtgggcggcgccgagggcaccaagctggacgacgacttcaaggagatggagagaaaggtggacgtgaccagcagagccgtgatggagatcatgaccaagaccatcgagtacctgcagcccaaccccgccagcagagccaagctgagcatgatcaacaccatgagcaagatcagaggccaggagaagggccccggctacccccaggccgaggccctgctggccgaggccatgctgaagttcggcagagagctgggcgacgactgcaacttcggccccgccctgggcgaggtgggcgaggccatgagagagctgagcgaggtgaaggacagcctggacatcgaggtgaagcagaacttcatcgaccccctgcagaacctgcacgacaaggacctgagagagatccagcaccacctgaagaagctggagggcagaagactggacttcgactacaagaagaagagacagggcaagatccccgacgaggagctgagacaggccctggagaagttcgacgagagcaaggagatcgccgagagcagcatgttcaacctgctggagatggacatcgagcaggtgagccagctgagcgccctggtgcaggcccagctggagtaccacaagcaggccgtgcagatcctgcagcaggtgaccgtgagactggaggagagaatcagacaggccagcagccagcccagaagagagtaccagcccaagcccagaatgagcctggagttccccaccggcgacagcacccagcccaacggcggcctgagccacaccggcacccccaagcccagcggcgtgcagatggaccagccctgctgcagagccctgtacgacttcgagcccgagaacgagggcgagctgggcttcaaggagggcgacatcatcaccctgaccaaccagatcgacgagaactggtacgagggcatgctgcacggccacagcggcttcttccccatcaactacgtggagatcctggtggccctgccccactag

SEQ ID NO: 98817 - DNA, 678 bp, Artificial Sequence
  Description of Artificial Sequence: Synthetic coding sequence
atgagcgtggccggcctgaagaagcagttccacaaggccacccagaaggtgagcgagaaggtgggcggcgccgagggcaccaagctggacgacgacttcaaggagatggagagaaaggtggacgtgaccagcagagccgtgatggagatcatgaccaagaccatcgagtacctgcagcccaaccccggcagcctggaggccgaggccctgctggccgaggccatgctgaagttcggcagagagctgggcgacgactgcaacttcggccccgccctgggcgaggtgggcgaggccatgagagagctgagcgaggtgaaggacagcctggacatcgaggtgaagcagaacttcatcgaccccctgcagaacctgcacgacaaggacctgagagagatccagcaccacctgaagaagctggagggcagaagactggacttcgactacaagaagaagagacagggcaagatccccgacgaggagctgagacaggccctggagaagttcgacgagagcaaggagatcgccgagagcagcatgttcaacctgctggagatggacatcgagcaggtgagccagctgagcgccctggtgcaggcccagctggagtaccacaagcaggccgtgcagatcctgcagcaggtgaccgtgagactggaggagagaatcagacaggcctag

SEQ ID NO: 98818 - DNA, 918 bp, Artificial Sequence
  Description of Artificial Sequence: Synthetic coding sequence
atggagatcatgaccaagaccatcgagtacctgcagcccaaccccgccagcagagccaagctgagcatgatcaacaccatgagcaagatcagaggccaggagaagggccccggctacccccaggccgaggccctgctggccgaggccatgctgaagttcggcagagagctgggcgacgactgcaacttcggccccgccctgggcgaggtgggcgaggccatgagagagctgagcgaggtgaaggacagcctggacatcgaggtgaagcagaacttcatcgaccccctgcagaacctgcacgacaaggacctgagagagatccagcaccacctgaagaagctggagggcagaagactggacttcgactacaagaagaagagacagggcaagatccccgacgaggagctgagacaggccctggagaagttcgacgagagcaaggagatcgccgagagcagcatgttcaacctgctggagatggacatcgagcaggtgagccagctgagcgccctggtgcaggcccagctggagtaccacaagcaggccgtgcagatcctgcagcaggtgaccgtgagactggaggagagaatcagacaggccagcagccagcccagaagagagtaccagcccaagcccagaatgagcctggagttccccaccggcgacagcacccagcccaacggcggcctgagccacaccggcacccccaagcccagcggcgtgcagatggaccagccctgctgcagagccctgtacgacttcgagcccgagaacgagggcgagctgggcttcaaggagggcgacatcatcaccctgaccaaccagatcgacgagaactggtacgagggcatgctgcacggccacagcggcttcttccccatcaactacgtggagatcctggtggccctgccccactag

SEQ ID NO: 98819 - DNA, 546 bp, Artificial Sequence
  Description of Artificial Sequence: Synthetic coding sequence
atgagcgtggccggcctgaagaagcagttccacaaggccacccagaaggtgagcgagaaggtgggcggcgccgagggcaccaagctggacgacgacttcaaggagatggagatcgagcaggtgagccagctgagcgccctggtgcaggcccagctggagtaccacaagcaggccgtgcagatcctgcagcaggtgaccgtgagactggaggagagaatcagacaggccagcagccagcccagaagagagtaccagcccaagcccagaatgagcctggagttccccaccggcgacagcacccagcccaacggcggcctgagccacaccggcacccccaagcccagcggcgtgcagatggaccagccctgctgcagagccctgtacgacttcgagcccgagaacgagggcgagctgggcttcaaggagggcgacatcatcaccctgaccaaccagatcgacgagaactggtacgagggcatgctgcacggccacagcggcttcttccccatcaactacgtggagatcctggtggccctgccccactag

SEQ ID NO: 98820 - DNA, 1068 bp, Artificial Sequence
  Description of Artificial Sequence: Synthetic coding sequence
atggacggcatcttcgccggcatcatctgcaaccaggccaacagatgcctgacctggaccagccagcagctgttcagcgagaagatcagcggcgccgagggcaccaagctggacgacgagttcctggacatggagagaaagatcgacgtgaccaacaaggtggtggccgagatcctgagcaagaccaccgagtacctgcagcccaaccccgcctacagagccaagctgggcatgctgaacaccgtgagcaagatcagaggccaggtgaagaccaccggctacccccagaccgagggcctgctgggcgactgcatgctgaagtacggcaaggagctgggcgaggacagcaccttcggcaacgccctgatcgaggtgggcgagagcatgaagctgatggccgaggtgaaggacagcctggacatcaacgtgaagcagaccttcatcgaccccctgcagctgctgcaggacaaggacctgaaggagatcggccaccacctgaagaagctggagggcagaagactggactacgactacaagaagaagagagtgggcaagatccccgacgaggaggtgagacaggccgtggagaagttcgaggagagcaaggagctggccgagagaagcatgttcaacttcctggagaacgacgtggagcaggtgagccagctggccgtgttcatcgaggccgccctggactaccacagacagagcaccgagatcctgcaggagctgcagagcaagctgcagatgagaatcagcgccgccagcagcgtgcccagaagagagtacaagcccagacccgtgaagagaagcagcagcgagctgaacggcgtgagcaccaccagcgtggtgaagaccaccggcagcaacatccccatggaccagccctgctgcagaggcctgtacgacttcgagcccgagaaccagggcgagctgggcttcaaggagggcgacatcatcaccctgaccaaccagatcgacgagaactggtacgagggcatgatccacggcgagagcggcttcttccccatcaactacgtggaggtgatcgtgcccctgccccagtag

SEQ ID NO: 98821 - DNA, 1044 bp, Artificial Sequence
  Description of Artificial Sequence: Synthetic coding sequence
atgagcgtggccggcctgaagaagcagttccacaaggccagccagctgttcagcgagaagatcagcggcgccgagggcaccaagctggacgacgagttcctggacatggagagaaagatcgacgtgaccaacaaggtggtggccgagatcctgagcaagaccaccgagtacctgcagcccaaccccgcctacagagccaagctgggcatgctgaacaccgtgagcaagatcagaggccaggtgaagaccaccggctacccccagaccgagggcctgctgggcgactgcatgctgaagtacggcaaggagctgggcgaggacagcaccttcggcaacgccctgatcgaggtgggcgagagcatgaagctgatggccgaggtgaaggacagcctggacatcaacgtgaagcagaccttcatcgaccccctgcagctgctgcaggacaaggacctgaaggagatcggccaccacctgaagaagctggagggcagaagactggactacgactacaagaagaagagagtgggcaagatccccgacgaggaggtgagacaggccgtggagaagttcgaggagagcaaggagctggccgagagaagcatgttcaacttcctggagaacgacgtggagcaggtgagccagctggccgtgttcatcgaggccgccctggactaccacagacagagcaccgagatcctgcaggagctgcagagcaagctgcagatgagaatcagcgccgccagcagcgtgcccagaagagagtacaagcccagacccgtgaagagaagcagcagcgagctgaacggcgtgagcaccaccagcgtggtgaagaccaccggcagcaacatccccatggaccagccctgctgcagaggcctgtacgacttcgagcccgagaaccagggcgagctgggcttcaaggagggcgacatcatcaccctgaccaaccagatcgacgagaactggtacgagggcatgatccacggcgagagcggcttcttccccatcaactacgtggaggtgatcgtgcccctgccccagtag

SEQ ID NO: 98822 - DNA, 1068 bp, Artificial Sequence; identical to SEQ ID NO: 98820
  Description of Artificial Sequence: Synthetic coding sequence

SEQ ID NO: 98823 - DNA, 867 bp, Artificial Sequence
  Description of Artificial Sequence: Synthetic coding sequence
atgagcgtggccggcctgaagaagcagttccacaaggccagccagctgttcagcgagaagatcagcggcgccgagggcaccaagctggacgacgagttcctggacatggagagaaagatcgacgtgaccaacaaggtggtggccgagatcctgagcaagaccaccgagtacctgcagcccaaccccgcctacagagccaagctgggcatgctgaacaccgtgagcaagatcagaggccaggtgaagaccaccggctacccccagaccgagggcctgctgggcgactgcatgctgaagtacggcaaggagctgggcgaggacagcaccttcggcaacgccctgatcgaggtgggcgagagcatgaagctgatggccgaggtgaaggacagcctggacatcaacgtgaagcagaccttcatcgaccccctgcagctgctgcaggacaaggacctgaaggagatcggccaccacctgaagaagctggagggcagaagactggactacgactacaagaagaagagagtgggcaagatccccgacgaggaggtgagacaggccgtggagaagttcgaggagagcaaggagctggccgagagaagcatgttcaacttcctggagaacgacgtggagcaggtgagccagctggccgtgttcatcgaggccgccctggactaccacagacagagcaccgagatcctgcaggagctgcagagcaagctgcagatgagaatcagcgccgccagcagcgtgcccagaagagagtacaagcccagacccgtgaagagaagcagcagcgagctgaacggcgtgagcaccaccagcgtggtgaagaccaccgcctacagcagactggagcccgccgactag

SEQ ID NO: 98824 - DNA, 1662 bp, Artificial Sequence
  Description of Artificial Sequence: Synthetic coding sequence
atggtggaggccatcgtggagttcgactaccaggcccagcacgacgacgagctgaccatcagcgtgggcgagatcatcaccaacatcagaaaggaggacggcggctggtgggagggccagatcaacggcagaagaggcctgttccccgacaacttcgtgagagagatcaagaaggagatgaagaaggaccccctgaccaacaaggcccccgagaagcccctgcacgaggtgcccagcggcaacagcctgctgagcagcgagaccatcctgagaaccaacaagagaggcgagagaagaagaagaagatgccaggtggccttcagctacctgccccagaacgacgacgagctggagctgaaggtgggcgacatcatcgaggtggtgggcgaggtggaggagggctggtgggagggcgtgctgaacggcaagaccggcatgttccccagcaacttcatcaaggagctgagcggcgagagcgacgagctgggcatcagccaggacgagcagctgagcaagagcagacccgagggcctgccccccgccagcctgctgcccttccccgcccacggcgccaagggcaagaccaccttcgagggcaccatcctgtacagagccgcccccggcaagaccgagggccacagaagatactacagcctgagagagaccaccggcagcgagagcgacggcggcgacagcagcagcaccaagagcgagggcgccaacggcaccgtggccaccgccgccatccagcccaagaaggtgaagggcgtgggcttcggcgacatcttcaaggacaagcccatcaagctgagacccagaagcatcgaggtggagaacgacttcctgcccgtggagaagaccatcggcaagaagctgcccgccaccaccgccacccccgacagcagcaagaccgagatggacagcagaaccaagagcaaggactactgcaaggtgatcttcccctacgaggcccagaacgacgacgagctgaccatcaaggagggcgacatcgtgaccctgatcaacaaggactgcatcgacgtgggctggtgggagggcgagctgaacggcagaagaggcgtgttccccgacaacttcgtgaagctgctgccccccgacttcgagaaggagggcaacagacccaagaagccccccccccccagcgcccccgtgatcaagcagggcgccggcaccaccgagagaaagcacgagatcaagaagatcccccccgagagacccgagatgctgcccaacagaaccgaggagaaggagagacccgagagagagcccaagctggacctgcagaagcccagcgtgcccgccatcccccccaagaagcccagaccccccaagaccaacagcctgagcagacccggcgccctgccccccagaagacccgagagacccgtgggccccctgacccacaccagatactgctgcgccctgaccagcggcgccggcgtgggctggctgtggaaggagcacagaagaggcaccgactgccacagaccctgggaggagggcagaggcgagggcggcgcccaggccagcctgctgcacccccccgccaagctgagcgaggacaccggccacttctgcccctgcagctgcacccaggccggcgtgagcgtgagactgagaggcgccgtgtgggtgagctag

SEQ ID NO: 98825 - DNA, 1887 bp, Artificial Sequence
  Description of Artificial Sequence: Synthetic coding sequence
atggaggtgagcgccgccaaggcccccagcgccgccgacctgagcgagatcgagatcaagaaggagatgaagaaggaccccctgaccaacaaggcccccgagaagcccctgcacgaggtgcccagcggcaacagcctgctgagcagcgagaccatcctgagaaccaacaagagaggcgagagaagaagaagaagatgccaggtggccttcagctacctgccccagaacgacgacgagctggagctgaaggtgggcgacatcatcgaggtggtgggcgaggtggaggagggctggtgggagggcgtgctgaacggcaagaccggcatgttccccagcaacttcatcaaggagctgagcggcgagagcgacgagctgggcatcagccaggacgagcagctgagcaagagcagcctgagagagaccaccggcagcgagagcgacggcggcgacagcagcagcaccaagagcgagggcgccaacggcaccgtggccaccgccgccatccagcccaagaaggtgaagggcgtgggcttcggcgacatcttcaaggacaagcccatcaagctgagacccagaagcatcgaggtggagaacgacttcctgcccgtggagaagaccatcggcaagaagctgcccgccaccaccgccacccccgacagcagcaagaccgagatggacagcagaaccaagagcaaggactactgcaaggtgatcttcccctacgaggcccagaacgacgacgagctgaccatcaaggagggcgacatcgtgaccctgatcaacaaggactgcatcgacgtgggctggtgggagggcgagctgaacggcagaagaggcgtgttccccgacaacttcgtgaagctgctgccccccgacttcgagaaggagggcaacagacccaagaagccccccccccccagcgcccccgtgatcaagcagggcgccggcaccaccgagagaaagcacgagatcaagaagatcccccccgagagacccgagatgctgcccaacagaaccgaggagaaggagagacccgagagagagcccaagctggacctgcagaagcccagcgtgcccgccatcccccccaagaagcccagaccccccaagaccaacagcctgagcagacccggcgccctgccccccagaagacccgagagacccgtgggccccctgacccacaccagaggcgacagccccaagatcgacctggccggcagcagcctgagcggcatcctggacaaggacctgagcgacagaagcaacgacatcgacctggagggcttcgacagcgtggtgagcagcaccgagaagctgagccaccccaccaccagcagacccaaggccaccggcagaagaccccccagccagagcctgaccagcagcagcctgagcagccccgacatcttcgacagccccagccccgaggaggacaaggaggagcacatcagcctggcccacagaggcgtggacgccagcaagaagaccagcaagaccgtgaccatcagccaggtgagcgacaacaaggccagcctgccccccaagcccggcaccatggccgccggcggcggcggccccgcccccctgagcagcgccgcccccagccccctgagcagcagcctgggcaccgccggccacagagccaacagccccagcctgttcggcaccgagggcaagcccaagatggagcccgccgccagcagccaggccgccgtggaggagctgagaacccaggtgagagagctgagaagcatcatcgagaccatgaaggaccagcagaagagagagatcaagcagctgctgagcgagctggacgaggagaagaagatcagactgagactgcagatggaggtgaacgacatcaagaaggccctgcagagcaagtag

SEQ ID NO: 98826 - DNA, 1953 bp, Artificial Sequence
  Description of Artificial Sequence: Synthetic coding sequence
atgaagaaggaccccctgaccaacaaggcccccgagaagcccctgcacgaggtgcccagcggcaacagcctgctgagcagcgagaccatcctgagaaccaacaagagaggcgagagaagaagaagaagatgccaggtggccttcagctacctgccccagaacgacgacgagctggagctgaaggtgggcgacatcatcgaggtggtgggcgaggtggaggagggctggtgggagggcgtgctgaacggcaagaccggcatgttccccagcaacttcatcaaggagctgagcggcgagagcgacgagctgggcatcagccaggacgagcagctgagcaagagcagacccgagggcctgccccccgccagcctgctgcccttccccgcccacggcgccaagggcaagaccaccttcgagggcaccatcctgtacagagccgcccccggcaagaccgagggccacagaagatactacagcctgagagagaccaccggcagcgagagcgacggcggcgacagcagcagcaccaagagcgagggcgccaacggcaccgtggccaccgccgccatccagcccaagaaggtgaagggcgtgggcttcggcgacatcttcaaggacaagcccatcaagctgagacccagaagcatcgaggtggagaacgacttcctgcccgtggagaagaccatcggcaagaagctgcccgccaccaccgccacccccgacagcagcaagaccgagatggacagcagaaccaagagcaaggactactgcaaggtgatcttcccctacgaggcccagaacgacgacgagctgaccatcaaggagggcgacatcgtgaccctgatcaacaaggactgcatcgacgtgggctggtgggagggcgagctgaacggcagaagaggcgtgttccccgacaacttcgtgaagctgctgccccccgacttcgagaaggagggcaacagacccaagaagccccccccccccagcgcccccgtgatcaagcagggcgccggcaccaccgagagaaagcacgagatcaagaagatcccccccgagagacccgagatgctgcccaacagaaccgaggagaaggagagacccgagagagagcccaagctggacctgcagaagcccagcgtgcccgccatcccccccaagaagcccagaccccccaagaccaacagcctgagcagacccggcgccctgccccccagaagacccgagagacccgtgggccccctgacccacaccagaggcgacagccccaagatcgacctggccggcagcagcctgagcggcatcctggacaaggacctgagcgacagaagcaacgacatcgacctggagggcttcgacagcgtggtgagcagcaccgagaagctgagccaccccaccaccagcagacccaaggccaccggcagaagaccccccagccagagcctgaccagcagcagcctgagcagccccgacatcttcgacagccccagccccgaggaggacaaggaggagcacatcagcctggcccacagaggcgtggacgccagcaagaagaccagcaagaccgtgaccatcagccaggtgagcgacaacaaggccagcctgccccccaagcccggcaccatggccgccggcggcggcggccccgcccccctgagcagcgccgcccccagccccctgagcagcagcctgggcaccgccggccacagagccaacagccccagcctgttcggcaccgagggcaagcccaagatggagcccgccgccagcagccaggccgccgtggaggagctgagaacccaggtgagagagctgagaagcatcatcgagaccatgaaggaccagcagaagagagagatcaagcagctgctgagcgagctggacgaggagaagaagatcagactgagactgcagatggaggtgaacgacatcaagaaggccctgcagagcaagtag

SEQ ID NO: 98827 - DNA, 1284 bp, Artificial Sequence
  Description of Artificial Sequence: Synthetic coding sequence
atgggcgaggagaccatcggcaagaagctgcccgccaccaccgccacccccgacagcagcaagaccgagatggacagcagaaccaagagcaaggactactgcaaggtgatcttcccctacgaggcccagaacgacgacgagctgaccatcaaggagggcgacatcgtgaccctgatcaacaaggactgcatcgacgtgggctggtgggagggcgagctgaacggcagaagaggcgtgttccccgacaacttcgtgaagctgctgccccccgacttcgagaaggagggcaacagacccaagaagccccccccccccagcgcccccgtgatcaagcagggcgccggcaccaccgagagaaagcacgagatcaagaagatcccccccgagagacccgagatgctgcccaacagaaccgaggagaaggagagacccgagagagagcccaagctggacctgcagaagcccagcgtgcccgccatcccccccaagaagcccagaccccccaagaccaacagcctgagcagacccggcgccctgccccccagaagacccgagagacccgtgggccccctgacccacaccagaggcgacagccccaagatcgacctggccggcagcagcctgagcggcatcctggacaaggacctgagcgacagaagcaacgacatcgacctggagggcttcgacagcgtggtgagcagcaccgagaagctgagccaccccaccaccagcagacccaaggccaccggcagaagaccccccagccagagcctgaccagcagcagcctgagcagccccgacatcttcgacagccccagccccgaggaggacaaggaggagcacatcagcctggcccacagaggcgtggacgccagcaagaagaccagcaagaccgtgaccatcagccaggtgagcgacaacaaggccagcctgccccccaagcccggcaccatggccgccggcggcggcggccccgcccccctgagcagcgccgcccccagccccctgagcagcagcctgggcaccgccggccacagagccaacagccccagcctgttcggcaccgagggcaagcccaagatggagcccgccgccagcagccaggccgccgtggaggagctgagaacccaggtgagagagctgagaagcatcatcgagaccatgaaggaccagcagaagagagagatcaagcagctgctgagcgagctggacgaggagaagaagatcagactgagactgcagatggaggtgaacgacatcaagaaggccctgcagagcaagtag

SEQ ID NO: 98828 - DNA, 1938 bp, Artificial Sequence
  Description of Artificial Sequence: Synthetic coding sequence
ctgaccaacaaggcccccgagaagcccctgcacgaggtgcccagcggcaacagcctgctgagcagcgagaccatcctgagaaccaacaagagaggcgagagaagaagaagaagatgccaggtggccttcagctacctgccccagaacgacgacgagctggagctgaaggtgggcgacatcatcgaggtggtgggcgaggtggaggagggctggtgggagggcgtgctgaacggcaagaccggcatgttccccagcaacttcatcaaggagctgagcggcgagagcgacgagctgggcatcagccaggacgagcagctgagcaagagcagacccgagggcctgccccccgccagcctgctgcccttccccgcccacggcgccaagggcaagaccaccttcgagggcaccatcctgtacagagccgcccccggcaagaccgagggccacagaagatactacagcctgagagagaccaccggcagcgagagcgacggcggcgacagcagcagcaccaagagcgagggcgccaacggcaccgtggccaccgccgccatccagcccaagaaggtgaagggcgtgggcttcggcgacatcttcaaggacaagcccatcaagctgagacccagaagcatcgaggtggagaacgacttcctgcccgtggagaagaccatcggcaagaagctgcccgccaccaccgccacccccgacagcagcaagaccgagatggacagcagaaccaagagcaaggactactgcaaggtgatcttcccctacgaggcccagaacgacgacgagctgaccatcaaggagggcgacatcgtgaccctgatcaacaaggactgcatcgacgtgggctggtgggagggcgagctgaacggcagaagaggcgtgttccccgacaacttcgtgaagctgctgccccccgacttcgagaaggagggcaacagacccaagaagccccccccccccagcgcccccgtgatcaagcagggcgccggcaccaccgagagaaagcacgagatcaagaagatcccccccgagagacccgagatgctgcccaacagaaccgaggagaaggagagacccgagagagagcccaagctggacctgcagaagcccagcgtgcccgccatcccccccaagaagcccagaccccccaagaccaacagcctgagcagacccggcgccctgccccccagaagacccgagagacccgtgggccccctgacccacaccagaggcgacagccccaagatcgacctggccggcagcagcctgagcggcatcctggacaaggacctgagcgacagaagcaacgacatcgacctggagggcttcgacagcgtggtgagcagcaccgagaagctgagccaccccaccaccagcagacccaaggccaccggcagaagaccccccagccagagcctgaccagcagcagcctgagcagccccgacatcttcgacagccccagccccgaggaggacaaggaggagcacatcagcctggcccacagaggcgtggacgccagcaagaagaccagcaagaccgtgaccatcagccaggtgagcgacaacaaggccagcctgccccccaagcccggcaccatggccgccggcggcggcggccccgcccccctgagcagcgccgcccccagccccctgagcagcagcctgggcaccgccggccacagagccaacagccccagcctgttcggcaccgagggcaagcccaagatggagcccgccgccagcagccaggccgccgtggaggagctgagaacccaggtgagagagctgagaagcatcatcgagaccatgaaggaccagcagaagagagagatcaagcagctgctgagcgagctggacgaggagaagaagatcagactgagactgcagatggaggtgaacgacatcaagaaggccctgcagagcaagtag

SEQ ID NO: 98829 - DNA, 450 bp, Artificial Sequence
  Description of Artificial Sequence: Synthetic coding sequence
ttcgagaccagcgagagaagaagaagaagatgccaggtggccttcagctacctgccccagaacgacgacgagctggagctgaaggtgggcgacatcatcgaggtggtgggcgaggtggaggagggctggtgggagggcgtgctgaacggcaagaccggcatgttccccagcaacttcatcaaggagctgagcggcgagagcgacgagctgggcatcagccaggacgagcagctgagcaagagcagcctgagagagaccaccggcagcgagagcgacggcggcgacagcagcagcaccaagagcgagggcgccaacggcaccgtggccaccgccgccatccagcccaagaaggtgaagggcgtgggcttcggcgacatcttcaaggacaagcccatcaagctgagacccagaagcatcgaggtggagaacgacttcctgcccgtggagtag

SEQ ID NO: 98830 - DNA, 1998 bp, Artificial Sequence
  Description of Artificial Sequence: Synthetic coding sequence
atggtggaggccatcgtggagttcgactaccaggcccagcacgacgacgagctgaccatcagcgtgggcgagatcatcaccaacatcagaaaggaggacggcggctggtgggagggccagatcaacggcagaagaggcctgttccccgacaacttcgtgagagagatcaagaaggagatgaagaaggaccccctgaccaacaaggcccccgagaagcccctgcacgaggtgcccagcggcaacagcctgctgagcagcgagaccatcctgagaaccaacaagagaggcgagagaagaagaagaagatgccaggtggccttcagctacctgccccagaacgacgacgagctggagctgaaggtgggcgacatcatcgaggtggtgggcgaggtggaggagggctggtgggagggcgtgctgaacggcaagaccggcatgttccccagcaacttcatcaaggagctgagcggcgagagcgacgagctgggcatcagccaggacgagcagctgagcaagagcagcctgagagagaccaccggcagcgagagcgacggcggcgacagcagcagcaccaagagcgagggcgccaacggcaccgtggccaccgccgccatccagcccaagaaggtgaagggcgtgggcttcggcgacatcttcaaggacaagcccatcaagctgagacccagaagcatcgaggtggagaacgacttcctgcccgtggagaagaccatcggcaagaagctgcccgccaccaccgccacccccgacagcagcaagaccgagatggacagcagaaccaagagcaaggactactgcaaggtgatcttcccctacgaggcccagaacgacgacgagctgaccatcaaggagggcgacatcgtgaccctgatcaacaaggactgcatcgacgtgggctggtgggagggcgagctgaacggcagaagaggcgtgttccccgacaacttcgtgaagctgctgccccccgacttcgagaaggagggcaacagacccaagaagccccccccccccagcgcccccgtgatcaagcagggcgccggcaccaccgagagaaagcacgagatcaagaagatcccccccgagagacccgagatgctgcccaacagaaccgaggagaaggagagacccgagagagagcccaagctggacctgcagaagcccagcgtgcccgccatcccccccaagaagcccagaccccccaagaccaacagcctgagcagacccggcgccctgccccccagaagacccgagagacccgtgggccccctgacccacaccagaggcgacagccccaagatcgacctggccggcagcagcctgagcggcatcctggacaaggacctgagcgacagaagcaacgacatcgacctggagggcttcgacagcgtggtgagcagcaccgagaagctgagccaccccaccaccagcagacccaaggccaccggcagaagaccccccagccagagcctgaccagcagcagcctgagcagccccgacatcttcgacagccccagccccgaggaggacaaggaggagcacatcagcctggcccacagaggcgtggacgccagcaagaagaccagcaagaccgtgaccatcagccaggtgagcgacaacaaggccagcctgccccccaagcccggcaccatggccgccggcggcggcggccccgcccccctgagcagcgccgcccccagccccctgagcagcagcctgggcaccgccggccacagagccaacagccccagcctgttcggcaccgagggcaagcccaagatggagcccgccgccagcagccaggccgccgtggaggagctgagaacccaggtgagagagctgagaagcatcatcgagaccatgaaggaccagcagaagagagagatcaagcagctgctgagcgagctggacgaggagaagaagatcagactgagactgcagatggaggtgaacgacatcaagaaggccctgcagagcaagtag

SEQ ID NO: 98831 - DNA, 450 bp, Artificial Sequence
  Description of Artificial Sequence: Synthetic coding sequence
atggagagaagcgagagaagaagaagaagatgccaggtggccttcagctacctgccccagaacgacgacgagctggagctgaaggtgggcgacatcatcgaggtggtgggcgaggtggaggagggctggtgggagggcgtgctgaacggcaagaccggcatgttccccagcaacttcatcaaggagctgagcggcgagagcgacgagctgggcatcagccaggacgagcagctgagcaagagcagcctgagagagaccaccggcagcgagagcgacggcggcgacagcagcagcaccaagagcgagggcgccaacggcaccgtggccaccgccgccatccagcccaagaaggtgaagggcgtgggcttcggcgacatcttcaaggacaagcccatcaagctgagacccagaagcatcgaggtggagaacgacttcctgcccgtggagtag

SEQ ID NO: 98832 - DNA, 627 bp, Artificial Sequence
  Description of Artificial Sequence: Synthetic coding sequence
atggagatcaagaaggagatgaagaaggaccccctgaccaacaaggcccccgagaagcccctgcacgaggtgcccagcggcaacagcctgctgagcagcgagaccatcctgagaaccaacaagagaggcgagagaagaagaagaagatgccaggtggccttcagctacctgccccagaacgacgacgagctggagctgaaggtgggcgacatcatcgaggtggtgggcgaggtggaggagggctggtgggagggcgtgctgaacggcaagaccggcatgttccccagcaacttcatcaaggagctgagcggcgagagcgacgagctgggcatcagccaggacgagcagctgagcaagagcagcctgagagagaccaccggcagcgagagcgacggcggcgacagcagcagcaccaagagcgagggcgccaacggcaccgtggccaccgccgccatccagcccaagaaggtgaagggcgtgggcttcggcgacatcttcaaggacaagcccatcaagctgagacccagaagcatcgaggtggagaacgacttcctgcccgtggagaagaccatcggcaagaagctgcccgccaccaccgccacccccgacagcagcaagaccgagtag

SEQ ID NO: 98833 - DNA, 1215 bp, Artificial Sequence
  Description of Artificial Sequence: Synthetic coding sequence
atggacagcagaaccaagagcaaggactactgcaaggtgatcttcccctacgaggcccagaacgacgacgagctgaccatcaaggagggcgacatcgtgaccctgatcaacaaggactgcatcgacgtgggctggtgggagggcgagctgaacggcagaagaggcgtgttccccgacaacttcgtgaagctgctgccccccgacttcgagaaggagggcaacagacccaagaagccccccccccccagcgcccccgtgatcaagcagggcgccggcaccaccgagagaaagcacgagatcaagaagatcccccccgagagacccgagatgctgcccaacagaaccgaggagaaggagagacccgagagagagcccaagctggacctgcagaagcccagcgtgcccgccatcccccccaagaagcccagaccccccaagaccaacagcctgagcagacccggcgccctgccccccagaagacccgagagacccgtgggccccctgacccacaccagaggcgacagccccaagatcgacctggccggcagcagcctgagcggcatcctggacaaggacctgagcgacagaagcaacgacatcgacctggagggcttcgacagcgtggtgagcagcaccgagaagctgagccaccccaccaccagcagacccaaggccaccggcagaagaccccccagccagagcctgaccagcagcagcctgagcagccccgacatcttcgacagccccagccccgaggaggacaaggaggagcacatcagcctggcccacagaggcgtggacgccagcaagaagaccagcaagaccgtgaccatcagccaggtgagcgacaacaaggccagcctgccccccaagcccggcaccatggccgccggcggcggcggccccgcccccctgagcagcgccgcccccagccccctgagcagcagcctgggcaccgccggccacagagccaacagccccagcctgttcggcaccgagggcaagcccaagatggagcccgccgccagcagccaggccgccgtggaggagctgagaacccaggtgagagagctgagaagcatcatcgagaccatgaaggaccagcagaagagagagatcaagcagctgctgagcgagctggacgaggagaagaagatcagactgagactgcagatggaggtgaacgacatcaagaaggccctgcagagcaagtag

SEQ ID NO: 98834 - DNA, 456 bp, Artificial Sequence
  Description of Artificial Sequence: Synthetic coding sequence
atgaactgggcccccgccacctgctgggccctgctgctggccgccgccttcctgtgcgacagcggcgccgccaagggcggcagaggcggcgccagaggcagcgccagaggcggcgtgagaggcggcgccagaggcgccagcagagtgagagtgagacccgcccagagatacggcgcccccggcagcagcctgagagtggccgccgccggcgccgccgccggcgccgccgccggcgccgccgccggcctggccgccggcagcggctggagaagagccgccggccccggcgagagaggcctggaggacgaggaggacggcgtgcccggcggcaacggcaccggccccggcatctacagctacagagcctggaccagcggcgccggccccaccagaggccccagactgtgcctggtgctgggcggcgccctgggcgccctgggcctgctgagaccctag

SEQ ID NO: 98835 - DNA, 456 bp, Artificial Sequence; identical to SEQ ID NO: 98834
  Description of Artificial Sequence: Synthetic coding sequence

SEQ ID NO: 98836 - DNA, 981 bp, Artificial Sequence
  Description of Artificial Sequence: Synthetic coding sequence
atggccccccccgccggcggcgccgccgccgccgccagcgacctgggcagcgccgccgtgctgctggccgtgcacgccgccgtgagacccctgggcgccggccccgacgccgaggcccagctgagaagactgcagctgagcgccgaccccgagagacccggcagattcagactggagctgctgggcgccggccccggcgccgtgaacctggagtggcccctggagagcgtgagctacaccatcagaggccccacccagcacgagctgcagcccccccccggcggccccggcaccctgagcctgcacttcctgaacccccaggaggcccagagatgggccgtgctggtgagaggcgccaccgtggagggccagaacggcagcaagagcaacagcccccccgccctgggccccgaggcctgccccgtgagcctgcccagcccccccgaggccagcaccctgaagggccccccccccgaggccgacctgcccagaagccccggcaacctgaccgagagagaggagctggccggcagcctggccagagccatcgccggcggcgacgagaagggcgccgcccaggtggccgccgtgctggcccagcacagagtggccctgagcgtgcagctgcaggaggcctgcttcccccccggccccatcagactgcaggtgaccctggaggacgccgccagcgccgccagcgccgccagcagcgcccacgtggccctgcaggtgcacccccactgcaccgtggccgccctgcaggagcaggtgttcagcgagctgggcttcccccccgccgtgcagagatgggtgatcggcagatgcctgtgcgtgcccgagagaagcctggccagctacggcgtgagacaggacggcgaccccgccttcctgtacctgctgagcgcccccagagaggcccccgcccagctggtgctgagcttcctgcacctgcaccagtgccccagacccccctggctgtag

SEQ ID NO: 98837 - DNA, 1164 bp, Artificial Sequence
  Description of Artificial Sequence: Synthetic coding sequence
atggccccccccgccggcggcgccgccgccgccgccagcgacctgggcagcgccgccgtgctgctggccgtgcacgccgccgtgagacccctgggcgccggccccgacgccgaggcccagctgagaagactgcagctgagcgccgaccccgagagacccggcagattcagactggagctgctgggcgccggccccggcgccgtgaacctggagtggcccctggagagcgtgagctacaccatcagaggccccacccagcacgagctgcagcccccccccggcggccccggcaccctgagcctgcacttcctgaacccccaggaggcccagagatgggccgtgctggtgagaggcgccaccgtggagggccagaacggcagcaagagcaacagcccccccgccctgggccccgaggcctgccccgtgagcctgcccagcccccccgaggccagcaccctgaagggccccccccccgaggccgacctgcccagaagccccggcaacctgaccgagagagaggagctggccggcagcctggccagagccatcgccggcggcgacgagaagggcgccgcccaggtggccgccgtgctggcccagcacagagtggccctgagcgtgcagctgcaggaggcctgcttcccccccggccccatcagactgcaggtgaccctggaggacgccgccagcgccgccagcgccgccagcagcgcccacgtggccctgcaggtgcacccccactgcaccgtggccgccctgcaggagcaggtgttcagcgagctgggcttcccccccgccgtgcagagatgggtgatcggcagatgcctgtgcgtgcccgagagaagcctggccagctacggcgtgagacaggacggcgaccccgccttcctgtacctgctgagcgcccccagagaggcccccgccaccggccccagcccccagcacccccagaagatggacggcgagctgggcagactgttcccccccagcctgggcctgccccccggcccccagcccgccgccagcagcctgcccagccccctgcagcccagctggagctgccccagctgcaccttcatcaacgcccccgacagacccggctgcgagatgtgcagcacccagagaccctgcacctgggaccccctggccgccgccagcacctag

SEQ ID NO: 98838 - DNA, 2019 bp, Artificial Sequence
  Description of Artificial Sequence: Synthetic coding sequence
atggccgacggcagcctgaccggcggcggcctggaggccgccgccatggcccccgagagaatgggctgggccgtggagcaggagctggccagcctggagaagggcctgttccaggacgaggacagctgcagcgactgcagctacagagacaagcccggcagcagcctgcagagcttcatgcccgagggcaagaccttcttccccgagatcttccagaccaaccagctgctgttctacgagagattcagagcctaccaggactacatcctggccgactgcaaggccagcgaggtgcaggagttcaccgccgagttcctggagaaggtgctggagcccagcggctggagagccgtgtggcacaccaacgtgttcaaggtgctggtggagatcaccgacgtggacttcgccgccctgaaggccgtggtgagactggccgagccctacctgtgcgacagccaggtgagcaccttcaccatggagtgcatgaaggagctgctggacctgaaggagcacagactgcccctgcaggagctgtgggtggtgttcgacgacagcggcgtgttcgaccagaccgccctggccatcgagcacgtgagattcttctaccagaacatctggagaagctgggacgaggaggaggaggacgagtacgactacttcgtgagatgcgtggagcccagactgagactgcactacgacatcctggaggacagagtgcccagcggcctgatcgtggactaccacaacctgctgagccagtgcgaggagagctacagaaagttcctgaacctgagaagcagcctgagcaactgcaacagcgacagcgagcaggagaacatcagcatggtggagggcctgaagctgtacagcgagatggagcagctgaagcagaagctgaagctgatcgagaaccccctgctgagatacgtgttcggctaccagaagaacagcaacatccaggccaagggcgtgagaagcagcggccagaagatcacccacgtggtgagcagcaccatgatggccggcctgctgagaagcctgctgaccgacagactgtgccaggagcccggcgaggaggagagagagatccagttccacagcgaccccctgagcgccatcaacgcctgcttcgagggcgacaccgtgatcgtgtgccccggccactacgtggtgcacggcaccttcagcatcgccgacagcatcgagctggagggctacggcctgcccgacgacatcgtgatcgagaagagaggcaagggcgacaccttcgtggactgcaccggcgccgacatcaagatcagcggcatcaagttcgtgcagcacgacgccgtggagggcatcctgatcgtgcacagaggcaagaccaccctggagaactgcgtgctgcagtgcgagaccaccggcgtgaccgtgagaaccagcgccgagttcctgatgaagaacagcgacctgtacggcgccaagggcgccggcatcgagatctaccccggcagccagtgcaccctgagcgacaacggcatccaccactgcaaggagggcatcctgatcaaggacttcctggacgagcactacgacatccccaagatcagcatggtgaacaacatcatccacaacaacgagggctacggcgtggtgctggtgaagcccaccatcttcagcgacctgcaggagaacgccgaggacggcaccgaggagaacaaggccctgaagatccagaccagcggcgagcccgacgtggccgagagagtggacctggaggagctgatcgagtgcgccaccggcaagatggagctgtgcgccagaaccgaccccagcgagcaggtggagggcaactgcgagatcgtgaacgagctgatcgccgccagcacccagaagggccagatcaagaagaagagactgagcgagctgggcatcacccaggccgacgacaacctgatgagccaggagatgttcgtgggcatcgtgggcaaccagttcaagtggaacggcaagggcagcttcggcaccttcctgttctag

SEQ ID NO: 98839 - DNA, 723 bp, Artificial Sequence
  Description of Artificial Sequence: Synthetic coding sequence
atgaccgcccccgtgcccgcccccagaatcctgctgcccctgctgctgctgctgctgctgacccccccccccggcgccagaggcgaggtgtgcatggccagcagaggcctgagcctgttccccgagagctgccccgacttctgctgcggcacctgcgacgaccagtactgctgcagcgacgtgctgaagaagttcgtgtggagcgaggagagatgcgccgtgcccgaggccagcgtgcccgccagcgtggagcccgtggagcagctgggcagcgccctgagattcagacccggctacaacgaccccatgagcggcttcggcgccaccctggccgtgggcctgaccatcttcgtgctgagcgtggtgaccatcatcatctgcttcacctgcagctgctgctgcctgtacaagacctgcagaagacccagacccgtggtgaccaccaccaccagcaccaccgtggtgcacgccccctacccccagccccccagcgtgccccccagctaccccggccccagctaccagggctaccacaccatgcccccccagcccggcatgcccgccgccccctaccccatgcagtacccccccccctaccccgcccagcccatgggcccccccgcctaccacgagaccctggccggcggcgccgccgccccctaccccgccagccagcccccctacaaccccgcctacatggacgcccccaaggccgccctgtag

SEQ ID NO: 98840 - DNA, 339 bp, Artificial Sequence
  Description of Artificial Sequence: Synthetic coding sequence
atggccagcagaggcctgagcctgttccccgagagctgccccgacttctgctgcggcacctgcgacgaccagtactgctgcagcgacgtgctgaagaagttcgtgtggagcgaggagagatgcgccgtgcccgaggccagcgtgcccgccagcgtggagcccgtggagcagctgggcagcgccctgagattcagacccggctacaacgaccccatgagcggcttcggcgccaccctggccgtgggcctgaccatcttcgtgctgagcgtggtgaccatcatcatctgcttcacctgcagctgctgctgcctgtacaagacctgcagaagacccagatag

SEQ ID NO: 98841 - DNA, 414 bp, Artificial Sequence
  Description of Artificial Sequence: Synthetic coding sequence
atgggcttcggcgccaccctggccgtgggcctgaccatcttcgtgctgagcgtggtgaccatcatcatctgcttcacctgcagctgctgctgcctgtacaagacctgcagaagacccagacccgtggtgaccaccaccaccagcaccaccgtggtgcacgccccctacccccagccccccagcgtgccccccagctaccccggccccagctaccagggctaccacaccatgcccccccagcccggcatgcccgccgccccctaccccatgcagtacccccccccctaccccgcccagcccatgggcccccccgcctaccacgagaccctggccggcggcgccgccgccccctaccccgccagccagcccccctacaaccccgcctacatggacgcccccaaggccgccctgtag

SEQ ID NO: 98842 - DNA, 630 bp, Artificial Sequence
  Description of Artificial Sequence: Synthetic coding sequence
atggccagcagaggcctgagcctgttccccgagagctgccccgacttctgctgcggcacctgcgacgaccagtactgctgcagcgacgtgctgaagaagttcgtgtggagcgaggagagatgcgccgtgcccgaggccagcgtgcccgccagcgtggagcccgtggagcagctgggcagcgccctgagattcagacccggctacaacgaccccatgagcggcttcggcgccaccctggccgtgggcctgaccatcttcgtgctgagcgtggtgaccatcatcatctgcttcacctgcagctgctgctgcctgtacaagacctgcagaagacccagacccgtggtgaccaccaccaccagcaccaccgtggtgcacgccccctacccccagccccccagcgtgccccccagctaccccggccccagctaccagggctaccacaccatgcccccccagcccggcatgcccgccgccccctaccccatgcagtacccccccccctaccccgcccagcccatgggcccccccgcctaccacgagaccctggccggcggcgccgccgccccctaccccgccagccagcccccctacaaccccgcctacatggacgcccccaaggccgccctgtag

SEQ ID NO: 98843 - DNA, 630 bp, Artificial Sequence; identical to SEQ ID NO: 98842
  Description of Artificial Sequence: Synthetic coding sequence

SEQ ID NO: 98844 - DNA, 513 bp, Artificial Sequence
  Description of Artificial Sequence: Synthetic coding sequence
atgcccccccagcccggctgccagcagcaccccacccagtgcagcacccaccacctgacccagcccagcccctgggcccacagacccaccaccagaccctggctggaggagcagcccagacccaccccccccgccagcctgctgaccaccagacccacctggatgcccagaggcggccccctgagcatcccctggcccctgtggctgcccctgggctacgtggtgtgcgtgagagagtggtgcgccggcgccgtgccctacgccccctgcgtgctgtgcgtgagctgcctgtacatgtggctgcccctgatgctgaccagatggggcaccatcctggccagagtgggctgggaccagaccctgttcagcagcagccccgagatcatgctgcccaagatcagcagccagacccagagaatgggctggtggggcgccccctgcgaggtggcccccgagagatggggccccctgcagggcaccagcggcgtgctgctgcagctgaccctgggctag

SEQ ID NO: 98845 - DNA, 666 bp, Artificial Sequence
  Description of Artificial Sequence: Synthetic coding sequence
atgagaagagtgctgagactgctgctgggctgcttcctgaccgagctgtgcgccagagtgtgcagagcccaggagagagccggccacggccagctggcccagctgggcggcgtgctgctgctggccggcggcaacagaagcggcgccgccagcggcgaggccagcgagggcgccgaggccagcgacgccccccccaccagagcccccacccccgacttctgcagaggctacttcgacgtgatgggccagtgggacccccccttcaactgcagcagcggcgacttcatcttctgctgcggcacctgcggcttcagattctgctgcaccttcaagaagagaagactgaaccagagcacctgcaccaactacgacacccccctgtggctgaacaccggcaagccccccgccagaaaggacgaccccctgcacgaccccaccaaggacaagaccaacctgatcgtgtacatcatctgcggcgtggtggccgtgatggtgctggtgggcatcttcaccaagctgggcctggagaaggcccacagaccccagagagagcacatgagcagactgtacgacaacctgctgttcatggaggcccagatcagcttccaggaggacgagcccgcccccggcgagtggagcgtgggcctgcagacctggaccgtgtag

SEQ ID NO: 98846 - DNA, 1275 bp, Artificial Sequence
  Description of Artificial Sequence: Synthetic coding sequence
atgagaagagtgctgagactgctgctgggctgcttcctgaccgagctgtgcgccagagtgtgcagagcccaggagagagccggccacggccagctggcccagctgggcggcgtgctgctgctggccggcggcaacagaagcggcgccgccagcggcgaggccagcgagggcgccgaggccagcgacgccccccccaccagagcccccacccccgacttctgcagaggctacttcgacgtgatgggccagtgggacccccccttcaactgcagcagcggcgacttcatcttctgctgcggcacctgcggcttcagattctgctgcaccttcaagaagagaagactgaaccagagcacctgcaccaactacgacacccccctgtggctgaacaccggcaagccccccgccagaaaggacgaccccctgcacgaccccaccaaggacaagaccaacctgatcgtgtacatcatctgcggcgtggtggccgtgatggtgctggtgggcatcttcaccaagctgggcctggagaaggcccacagaccccagagagagcacatgagcagagccctggccgacgtgatgagaccccagggccactgcaacaccgaccacatggagagagacctgaacatcgtggtgcacgtgcagcactacgagaacatggacaccagaacccccatcaacaacctgcacgccacccagatgaacaacgccgtgcccaccagccccctgctgcagcagatgggccacccccacagctaccccaacctgggccagatcagcaacccctacgagcagcagccccccggcaaggagctgaacaagtacgccagcctgaaggccgtgggcagcagcgacggcgactgggccgtgagcaccctgaagagccccaaggccgacaaggtgaacgacgacttctacaccaagagaagacacctggccgagctggccgccaagggcaacctgcccctgcaccccgtgagagtggaggacgagcccagagccttcagccccgagcacggccccgccaagcagaacggccagaagagcagaaccaacaagatgcccccccaccccctggcctacaccagcaccaccaacttcaagggctgggaccccaacgagcagagcctgagaagacaggcctacagcaacaagggcaagctgggcaccgccgagaccggcagcagcgaccccctgggcaccagaccccagcactacccccccccccagccctacttcatcaccaacagcaagaccgaggtgaccgtgtag

SEQ ID NO: 98847 - DNA, 789 bp, Artificial Sequence
  Description of Artificial Sequence: Synthetic coding sequence
atgtgcggccccagaagactggccgcccccggcagcagcctgggcagcttcggcagagccagcagaggcggcagaagaggcagcagcggcggcagagccgccgagcccggcctgggcgacaccatgagaagagtgctgagactgctgctgggctgcttcctgaccgagctgtgcgccagagtgtgcagagcccaggagagagccggccacggccagctggcccagctgggcggcgtgctgctgctggccggcggcaacagaagcggcgccgccagcggcgaggccagcgagggcgccgaggccagcgacgccccccccaccagagcccccacccccgacttctgcagaggctacttcgacgtgatgggccagtgggacccccccttcaactgcagcagcggcgacttcatcttctgctgcggcacctgcggcttcagattctgctgcaccttcaagaagagaagactgaaccagagcacctgcaccaactacgacacccccctgtggctgaacaccggcaagccccccgccagaaaggacgaccccctgcacgaccccaccaaggacaagaccaacctgatcgtgtacatcatctgcggcgtggtggccgtgatggtgctggtgggcatcttcaccaagctgggcctggagaaggcccacagaccccagagagagcacatgagcagactgtacgacaacctgctgttcatggaggcccagatcagcttccaggaggacgagcccgcccccggcgagtggagcgtgggcctgcagacctggaccgtgtag

SEQ ID NO: 98848 - DNA, 1398 bp, Artificial Sequence
  Description of Artificial Sequence: Synthetic coding sequence
atgtgcggccccagaagactggccgcccccggcagcagcctgggcagcttcggcagagccagcagaggcggcagaagaggcagcagcggcggcagagccgccgagcccggcctgggcgacaccatgagaagagtgctgagactgctgctgggctgcttcctgaccgagctgtgcgccagagtgtgcagagcccaggagagagccggccacggccagctggcccagctgggcggcgtgctgctgctggccggcggcaacagaagcggcgccgccagcggcgaggccagcgagggcgccgaggccagcgacgccccccccaccagagcccccacccccgacttctgcagaggctacttcgacgtgatgggccagtgggacccccccttcaactgcagcagcggcgacttcatcttctgctgcggcacctgcggcttcagattctgctgcaccttcaagaagagaagactgaaccagagcacctgcaccaactacgacacccccctgtggctgaacaccggcaagccccccgccagaaaggacgaccccctgcacgaccccaccaaggacaagaccaacctgatcgtgtacatcatctgcggcgtggtggccgtgatggtgctggtgggcatcttcaccaagctgggcctggagaaggcccacagaccccagagagagcacatgagcagagccctggccgacgtgatgagaccccagggccactgcaacaccgaccacatggagagagacctgaacatcgtggtgcacgtgcagcactacgagaacatggacaccagaacccccatcaacaacctgcacgccacccagatgaacaacgccgtgcccaccagccccctgctgcagcagatgggccacccccacagctaccccaacctgggccagatcagcaacccctacgagcagcagccccccggcaaggagctgaacaagtacgccagcctgaaggccgtgggcagcagcgacggcgactgggccgtgagcaccctgaagagccccaaggccgacaaggtgaacgacgacttctacaccaagagaagacacctggccgagctggccgccaagggcaacctgcccctgcaccccgtgagagtggaggacgagcccagagccttcagccccgagcacggccccgccaagcagaacggccagaagagcagaaccaacaagatgcccccccaccccctggcctacaccagcaccaccaacttcaagggctgggaccccaacgagcagagcctgagaagacaggcctacagcaacaagggcaagctgggcaccgccgagaccggcagcagcgaccccctgggcaccagaccccagcactacccccccccccagccctacttcatcaccaacagcaagaccgaggtgaccgtgtag

SEQ ID NO: 98849 - DNA, 678 bp, Artificial Sequence
  Description of Artificial Sequence: Synthetic coding sequence
atggaggagctgaccgccttcgtgagcaagagcttcgaccagaagagcaaggacggcaacggcggcggcggcggcggcggcggcaagaaggacagcatcacctacagagaggtgctggagagcggcctggccagaagcagagagctgggcaccagcgacagcagcctgcaggacatcaccgagggcggcggccactgccccgtgcacctgttcaaggaccacgtggacaacgacaaggagaagctgaaggagttcggcaccgccagagtggccgagggcatctacgagtgcaaggagaagagagaggacgtgaagagcgaggacgaggacggccagaccaagctgaagcagagaagaagcagaaccaacttcaccctggagcagctgaacgagctggagagactgttcgacgagacccactaccccgacgccttcatgagagaggagctgagccagagactgggcctgagcgaggccagagtgcaggtgtggttccagaacagaagagccaagtgcagaaagcaggagaaccagatgcacaagggcgtgatcctgggcaccgccaaccacctggacgcctgcagagtggccccctacgtgaacatgggcgccctgagaatgcccttccagcagatggagttctgcagctgcagacccggctggagcatcatggcctag

SEQ ID NO: 98850 - DNA, 678 bp, Artificial Sequence; identical to SEQ ID NO: 98849
  Description of Artificial Sequence: Synthetic coding sequence

SEQ ID NO: 98851 - DNA, 879 bp, Artificial Sequence
  Description of Artificial Sequence: Synthetic coding sequence
atggaggagctgaccgccttcgtgagcaagagcttcgaccagaagagcaaggacggcaacggcggcggcggcggcggcggcggcaagaaggacagcatcacctacagagaggtgctggagagcggcctggccagaagcagagagctgggcaccagcgacagcagcctgcaggacatcaccgagggcggcggccactgccccgtgcacctgttcaaggaccacgtggacaacgacaaggagaagctgaaggagttcggcaccgccagagtggccgagggcatctacgagtgcaaggagaagagagaggacgtgaagagcgaggacgaggacggccagaccaagctgaagcagagaagaagcagaaccaacttcaccctggagcagctgaacgagctggagagactgttcgacgagacccactaccccgacgccttcatgagagaggagctgagccagagactgggcctgagcgaggccagagtgcaggtgtggttccagaacagaagagccaagtgcagaaagcaggagaaccagatgcacaagggcgtgatcctgggcaccgccaaccacctggacgcctgcagagtggccccctacgtgaacatgggcgccctgagaatgcccttccagcaggtgcaggcccagctgcagctggagggcgtggcccacgcccacccccacctgcacccccacctggccgcccacgccccctacctgatgttcccccccccccccttcggcctgcccatcgccagcctggccgagagcgccagcgccgccgccgtggtggccgccgccgccaagagcaacagcaagaacagcagcatcgccgacctgagactgaaggccagaaagcacgccgaggccctgggcctgtag

SEQ ID NO: 98852 - DNA, 879 bp, Artificial Sequence; identical to SEQ ID NO: 98851
  Description of Artificial Sequence: Synthetic coding sequence

SEQ ID NO: 98853 - DNA, 573 bp, Artificial Sequence
  Description of Artificial Sequence: Synthetic coding sequence
atggaggacgagggccagaccaagatcaagcagagaagaagcagaaccaacttcaccctggagcagctgaacgagctggagagactgttcgacgagacccactaccccgacgccttcatgagagaggagctgagccagagactgggcctgagcgaggccagagtgcaggtgtggttccagaacagaagagccaagtgcagaaagcaggagaaccagctgcacaagggcgtgctgatcggcgccgccagccagttcgaggcctgcagagtggccccctacgtgaacgtgggcgccctgagaatgcccttccagcaggtgcaggcccagctgcagctggacagcgccgtggcccacgcccaccaccacctgcacccccacctggccgcccacgccccctacatgatgttccccgccccccccttcggcctgcccctggccaccctggccgccgacagcgccagcgccgccagcgtggtggccgccgccgccgccgccaagaccaccagcaagaacagcagcatcgccgacctgagactgaaggccaagaagcacgccgccgccctgggcctgtag

SEQ ID NO: 98854 - DNA, 996 bp, Artificial Sequence
  Description of Artificial Sequence: Synthetic coding sequence
atggaggagctgaccgccttcgtgagcaagagcttcgaccagaaggtgaaggagaagaaggaggccatcacctacagagaggtgctggagagcggccccctgagaggcgccaaggagcccaccggctgcaccgaggccggcagagacgacagaagcagccccgccgtgagagccgccggcggcggcggcggcggcggcggcggcggcggcggcggcggcggcggcggcggcgtgggcggcggcggcgccggcggcggcgccggcggcggcagaagccccgtgagagagctggacatgggcgccgccgagagaagcagagagcccggcagccccagactgaccgaggtgagccccgagctgaaggacagaaaggaggacgccaagggcatggaggacgagggccagaccaagatcaagcagagaagaagcagaaccaacttcaccctggagcagctgaacgagctggagagactgttcgacgagacccactaccccgacgccttcatgagagaggagctgagccagagactgggcctgagcgaggccagagtgcaggtgtggttccagaacagaagagccaagtgcagaaagcaggagaaccagctgcacaagggcgtgctgatcggcgccgccagccagttcgaggcctgcagagtggccccctacgtgaacgtgggcgccctgagaatgcccttccagcaggacagccactgcaacgtgacccccctgagcttccaggtgcaggcccagctgcagctggacagcgccgtggcccacgcccaccaccacctgcacccccacctggccgcccacgccccctacatgatgttccccgccccccccttcggcctgcccctggccaccctggccgccgacagcgccagcgccgccagcgtggtggccgccgccgccgccgccaagaccaccagcaagaacagcagcatcgccgacctgagactgaaggccaagaagcacgccgccgccctgggcctgtag

SEQ ID NO: 98855 - DNA, 1068 bp, Artificial Sequence
  Description of Artificial Sequence: Synthetic coding sequence
atggaggagctgaccgccttcgtgagcaagagcttcgaccagaaggtgaaggagaagaaggaggccatcacctacagagaggtgctggagagcggccccctgagaggcgccaaggagcccaccggctgcaccgaggccggcagagacgacagaagcagccccgccgtgagagccgccggcggcggcggcggcggcggcggcggcggcggcggcggcggcggcggcggcggcgtgggcggcggcggcgccggcggcggcgccggcggcggcagaagccccgtgagagagctggacatgggcgccgccgagagaagcagagagcccggcagccccagactgaccgagggcagaagaaagcccaccaaggccgaggtgcaggccaccctgctgctgcccggcgaggccttcagattcctggtgagccccgagctgaaggacagaaaggaggacgccaagggcatggaggacgagggccagaccaagatcaagcagagaagaagcagaaccaacttcaccctggagcagctgaacgagctggagagactgttcgacgagacccactaccccgacgccttcatgagagaggagctgagccagagactgggcctgagcgaggccagagtgcaggtgtggttccagaacagaagagccaagtgcagaaagcaggagaaccagctgcacaagggcgtgctgatcggcgccgccagccagttcgaggcctgcagagtggccccctacgtgaacgtgggcgccctgagaatgcccttccagcaggacagccactgcaacgtgacccccctgagcttccaggtgcaggcccagctgcagctggacagcgccgtggcccacgcccaccaccacctgcacccccacctggccgcccacgccccctacatgatgttccccgccccccccttcggcctgcccctggccaccctggccgccgacagcgccagcgccgccagcgtggtggccgccgccgccgccgccaagaccaccagcaagaacagcagcatcgccgacctgagactgaaggccaagaagcacgccgccgccctgggcctgtag

SEQ ID NO: 98856 - DNA, 573 bp, Artificial Sequence; identical to SEQ ID NO: 98853
  Description of Artificial Sequence: Synthetic coding sequence

SEQ ID NO: 98857 - DNA, 573 bp, Artificial Sequence; identical to SEQ ID NO: 98853
  Description of Artificial Sequence: Synthetic coding sequence

SEQ ID NO: 98858 - DNA, 1734 bp, Artificial Sequence
  Description of Artificial Sequence: Synthetic coding sequence
atgctgacccccgccttcgacctgagccaggaccccgacttcctgaccatcgccatcagagtgccctacgccagagtgagcgagttcgacgtgtacttcgagggcagcgacttcaagttctacgccaagccctacttcctgagactgaccctgcccggcagaatcgtggagaacggcagcgagcagggcagctacgacgccgacaagggcatcttcaccatcagactgcccaaggagacccccggccagcacttcgagggcctgaacatgctgaccgccctgctggcccccagaaagagcagaaccgccaagcccctggtggaggagatcggcgccagcgagatccccgaggaggtggtggacgacgaggagttcgactgggagatcgagcagaccccctgcgaggaggtgagcgagagcgccctgaacccccagtgccactacggcttcggcaacctgagaagcggcgtgctgcagagactgcaggacgagctgagcgacgtgatcgacatcaaggaccccgacttcacccccgccgccgagagaagacagaagagactggccgccgagctggccaagttcgaccccgaccactacctggccgacttcttcgaggacgaggccatcgagcagatcctgaagtacaacccctggtggaccgacaagtacagcaagatgatggccttcctggagaagagccaggagcaggagaaccacgccaccctggtgagcttcagcgaggaggagaagtaccagctgagaaagttcgtgaacaagagctacctgctggacaagagagcctgcagacaggtgtgctacagcctgatcgacatcctgctggcctactgctacgagaccagagtgaccgagggcgagaagaacgtggagagcgcctggaacatcagaaagctgagccccaccctgtgctggttcgagacctggaccaacgtgcacgacatcatggtgagcttcggcagaagagtgctgtgctaccccctgtacagacacttcaagctggtgatgaaggcctacagagacaccatcaagatcctgcagctgggcaagagcgccgtgctgaagtgcctgctggacatccacaagatcttccaggagaacgaccccgcctacatcctgaacgacctgtacatcagcgactactgcgtgtggatccagaaggtgaagagcaagaagctggccgccctggccgaggccctgaaggaggtgagcctgaccaaggcccagctgggcctggagctggaggagctggaggccgccgccctgctggtgcaggaggaggagaccgccctgaaggccgcccacagcgtgagcggccagcagaccctgtgcagcagcagcgaggccagcgacagcgaggacagcgacagcagcgtgagcagcggcaacgaggacagcggcagcgacagcgagcaggacgagctgaaggacagccccagcgagaccgtgagcagcctgcagggccccttcctggaggagagcagcgccttcctgatcgtggacggcggcgtgagaagaaacaccgccatccaggagagcgacgccagccagggcaagcccctggccagcagctggcccctgggcgtgagcggccccctgatcgaggagctgggcgagcagctgaagaccaccgtgcaggtgagcgagcccaagggcaccaccgccgtgaacagaagcaacatccaggagagagacggctgccagacccccaacaactag

SEQ ID NO: 98859 - DNA, 4851 bp, Artificial Sequence
  Description of Artificial Sequence: Synthetic coding sequence
atggagggcgccgagcccagagccagacccgagagactggccgaggccgagaccagagccgccgacggcggcagactggtggaggtgcagctgagcggcggcgccccctggggcttcaccctgaagggcggcagagagcacggcgagcccctggtgatcaccaagatcgaggagggcagcaaggccgccgccgtggacaagctgctggccggcgacgagatcgtgggcatcaacgacatcggcctgagcggcttcagacaggaggccatctgcctggtgaagggcagccacaagaccctgaagctggtggtgaagagaagaagcgagctgggctggagaccccacagctggcacgccaccaagttcagcgacagccaccccgagctggccgccagccccttcaccagcaccagcggctgccccagctggagcggcagacaccacgccagcagcagcagccacgacctgagcagcagctgggagcagaccaacctgcagagaaccctggaccacttcagcagcctgggcagcgtggacagcctggaccaccccagcagcagactgagcgtggccaagagcaacagcagcatcgaccacctgggcagccacagcaagagagacagcgcctacggcagcttcagcaccagcagcagcacccccgaccacaccctgagcaaggccgacaccagcagcgccgagaacatcctgtacaccgtgggcctgtgggaggcccccagacagggcggcagacaggcccaggccgccggcgacccccagggcagcgaggagaagctgagctgcttcccccccagagtgcccggcgacagcggcaagggccccagacccgagtacaacgccgagcccaagctggccgcccccggcagaagcaacttcggccccgtgtggtacgtgcccgacaagaagaaggcccccagcagccccccccccccccccccccccctgagaagcgacagcttcgccgccaccaagagccacgagaaggcccagggccccgtgttcagcgaggccgccgccgcccagcacttcaccgccctggcccaggcccagcccagaggcgacagaagacccgagctgaccgacagaccctggagaagcgcccaccccggcagcctgggcaagggcagcggcggccccggctgcccccaggaggcccacgccgacggcagctggccccccagcaaggacggcgccagcagcagactgcaggccagcctgagcagcagcgacgtgagattcccccagagcccccacagcggcagacacccccccctgtacagcgaccacagccccctgtgcgccgacagcctgggccaggagcccggcgccgccagcttccagaacgacagccccccccaggtgagaggcctgagcagctgcgaccagaagctgggcagcggctggcagggccccagaccctgcgtgcagggcgacctgcaggccgcccagctgtgggccggctgctggcccagcgacaccgccctgggcgccctggagagcctgcccccccccaccgtgggccagagccccagacaccacctgccccagcccgagggcccccccgacgccagagagaccggcagatgctaccccctggacaagggcgccgagggctgcagcgccggcgcccaggagccccccagagccagcagagccgagaaggccagccagagactggccgccagcatcacctgggccgacggcgagagcagcagaatctgcccccaggagacccccctgctgcacagcctgacccaggagggcaagagaagacccgagagcagccccgaggacagcgccaccagacccccccccttcgacgcccacgtgggcaagcccaccagaagaagcgacagattcgccaccaccctgagaaacgagatccagatgcacagagccaagctgcagaagagcagaagcaccgtggccctgaccgccgccggcgaggccgaggacggcaccggcagatggagagccggcctgggcggcggcacccaggagggccccctggccggcacctacaaggaccacctgaaggaggcccaggccagagtgctgagagccaccagcttcaagagaagagacctggaccccaaccccggcgacctgtaccccgagagcctggagcacagaatgggcgaccccgacaccgtgccccacttctgggaggccggcctggcccagccccccagcagcaccagcggcggcccccacccccccagaatcggcggcagaagaagattcaccgccgagcagaagctgaagagctacagcgagcccgagaagatgaacgaggtgggcctgaccagaggctacagcccccaccagcaccccagaaccagcgaggacaccgtgggcaccttcgccgacagatggaagttcttcgaggagaccagcaagcccgtgccccagagacccgcccagaagcaggccctgcacggcatccccagagacaagcccgagagacccagaaccgccggcagaacctgcgagggcaccgagccctggagcagaaccaccagcctgggcgacagcctgaacgcccacagcgccgccgagaaggccggcaccagcgacctgcccagaagactgggcaccttcgccgagtaccaggccagctggaaggagcagagaaagcccctggaggccagaagcagcggcagatgccacagcgccgacgacatcctggacgtgagcctggacccccaggagagaccccagcacgtgcacggcagaagcagaagcagccccagcaccgaccactacaagcaggaggccagcgtggagctgagaagacaggccggcgaccccggcgagcccagagaggagctgcccagcgccgtgagagccgaggagggccagagcacccccagacaggccgacgcccagtgcagagagggcagccccggcagccagcagcacccccccagccagaaggcccccaacccccccaccttcagcgagctgagccactgcagaggcgcccccgagctgcccagagagggcagaggcagagccggcaccctgcccagagactacagatacagcgaggagagcacccccgccgacctgggccccagagcccagagccccggcagccccctgcacgccagaggccaggacagctggcccgtgagcagcgccctgctgagcaagagacccgccccccagagaccccccccccccaagagagagcccagaagatacagagccaccgacggcgcccccgccgacgcccccgtgggcgtgctgggcagacccttccccacccccagccccgccagcctggacgtgtacgtggccagactgagcctgagccacagccccagcgtgttcagcagcgcccagccccaggacacccccaaggccaccgtgtgcgagagaggcagccagcacgtgagcggcgacgccagcagacccctgcccgaggccctgctgccccccaagcagcagcacctgagactgcagaccgccaccatggagaccagcagaagccccagcccccagttcgccccccagaagctgaccgacaagccccccctgctgatccaggacgaggacagcaccagaatcgagagagtgatggacaacaacaccaccgtgaagatggtgcccatcaagatcgtgcacagcgagagccagcccgagaaggagagcagacagagcctggcctgccccgccgagccccccgccctgccccacggcctggagaaggaccagatcaagaccctgagcaccagcgagcagttctacagcagattctgcctgtacaccagacagggcgccgagcccgaggccccccacagagcccagcccgccgagccccagcccctgggcacccaggtgccccccgagaaggacagatgcaccagcccccccggcctgagctacatgaaggccaaggagaagaccgtggaggacctgaagagcgaggagctggccagagagatcgtgggcaaggacaagagcctggccgacatcctggaccccagcgtgaagatcaagaccaccatggacctgatggagggcatcttccccaaggacgagcacctgctggaggaggcccagcagagaagaaagctgctgcccaagatccccagccccagaagcaccgaggagagaaaggaggagcccagcgtgcccgccgccgtgagcctggccaccaacagcacctactacagcaccagcgcccccaaggccgagctgctgatcaagatgaaggacctgcaggagcagcaggagcacgaggaggacagcggcagcgacctggaccacgacctgagcgtgaagaagcaggagctgatcgagagcatcagcagaaagctgcaggtgctgagagaggccagagagagcctgctggaggacgtgcaggccaacaccgtgctgggcgccgaggtggaggccatcgtgaagggcgtgtgcaagcccagcgagttcgacaagttcagaatgttcatcggcgacctggacaaggtggtgaacctgctgctgagcctgagcggcagactggccagagtggagaacgccctgaacaacctggacgacggcgccagccccggcgacagacagagcctgctggagaagcagagagtgctgatccagcagcacgaggacgccaaggagctgaaggagaacctggacagaagagagagaatcgtgttcgacatcctggccaactacctgagcgaggagagcctggccgactacgagcacttcgtgaagatgaagagcgccctgatcatcgagcagagagagctggaggacaagatccacctgggcgaggagcagctgaagtgcctgctggacagcctgcagcccgagagaggcaagtag

SEQ ID NO: 98860 - DNA, 1356 bp, Artificial Sequence
  Description of Artificial Sequence: Synthetic coding sequence
atggagaccagcagaagccccagcccccagttcgccccccagaagctgaccgacaagccccccctgctgatccaggacgaggacagcaccagaatcgagagagtgatggacaacaacaccaccgtgaagatggtgcccatcaagatcgtgcacagcgagagccagcccgagaaggagagcagacagagcctggcctgccccgccgagccccccgccctgccccacggcctggagaaggaccagatcaagaccctgagcaccagcgagcagttctacagcagattctgcctgtacaccagacagggcgccgagcccgaggccccccacagagcccagcccgccgagccccagcccctgggcacccaggtgccccccgagaaggacagatgcaccagcccccccggcctgagctacatgaaggccaaggagaagaccgtggaggacctgaagagcgaggagctggccagagagatcgtgggcaaggacaagagcctggccgacatcctggaccccagcgtgaagatcaagaccaccatggacctgatggagggcatcttccccaaggacgagcacctgctggaggaggcccagcagagaagaaagctgctgcccaagatccccagccccagaagcaccgaggagagaaaggaggagcccagcgtgcccgccgccgtgagcctggccaccaacagcacctactacagcaccagcgcccccaaggccgagctgctgatcaagatgaaggacctgcaggagcagcaggagcacgaggaggacagcggcagcgacctggaccacgacctgagcgtgaagaagcaggagctgatcgagagcatcagcagaaagctgcaggtgctgagagaggccagagagagcctgctggaggacgtgcaggccaacaccgtgctgggcgccgaggtggaggccatcgtgaagggcgtgtgcaagcccagcgagttcgacaagttcagaatgttcatcggcgacctggacaaggtggtgaacctgctgctgagcctgagcggcagactggccagagtggagaacgccctgaacaacctggacgacggcgccagccccggcgacagacagagcctgctggagaagcagagagtgctgatccagcagcacgaggacgccaaggagctgaaggagaacctggacagaagagagagaatcgtgttcgacatcctggccaactacctgagcgaggagagcctggccgactacgagcacttcgtgaagatgaagagcgccctgatcatcgagcagagagagctggaggacaagatccacctgggcgaggagcagctgaagtgcctgctggacagcctgcagcccgagagaggcaagtag

SEQ ID NO: 98861 - DNA, 1128 bp, Artificial Sequence
  Description of Artificial Sequence: Synthetic coding sequence
atggagaccagcagaagccccagcccccagttcgccccccagaagctgaccgacaagccccccctgctgatccaggacgaggacagcaccagaatcgagagagtgatggacaacaacaccaccgtgaagatggtgcccatcaagatcgtgcacagcgagagccagcccgagaaggagagcagacagagcctggcctgccccgccgagccccccgccctgccccacggcctggagaaggaccagatcaagaccctgagcaccagcgagcagttctacagcagattctgcctgtacaccagacagggcgccgagcccgaggccccccacagagcccagcccgccgagccccagcccctgggcacccaggtgccccccgagaaggacagatgcaccagcccccccggcctgagctacatgaaggccaaggagaagaccgtggaggacctgaagagcgaggagctggccagagagatcgtgggcaaggacaagagcctggccgacatcctggaccccagcgtgaagatcaagaccaccatggacctgatggagggcatcttccccaaggacgagcacctgctggaggaggcccagcagagaagaaagctgctgcccaagatccccagccccagaagcaccgaggagagaaaggaggagcccagcgtgcccgccgccgtgagcctggccaccaacagcacctactacagcaccagcgcccccaaggccgagctgctgatcaagatgaaggacctgcaggagcagcaggagcacgaggaggacagcggcagcgacctggaccacgacctgagcgtgaagaagcaggagctgatcgagagcatcagcagaaagctgcaggtgctgagagaggccagagagagcctgctggaggacgtgcaggccaacaccgtgctgggcgccgaggtggaggccatcgtgaagggcgtgtgcaagcccagcgagttcgacaagttcagaatgttcatcggcgacctggacaaggtggtgaacctgctgctgagcctgagcggcagactggccagagtggagaacgccctgaacaacctggacgacggcgccagccccggcgacagacagagcctgctggagaagcagagagtgctgatccagtag

SEQ ID NO: 98862 - DNA, 1203 bp, Artificial Sequence
  Description of Artificial Sequence: Synthetic coding sequence
atggagaccagcagaagccccagcccccagttcgccccccagaagctgaccgacaagccccccctgctgatccaggacgaggacagcaccagaatcgagagagtgatggacaacaacaccaccgtgaagatggtgcccatcaagatcgtgcacagcgagagccagcccgagaaggagagcagacagagcctggcctgccccgccgagccccccgccctgccccacggcctggagaaggaccagatcaagaccctgagcaccagcgagcagttctacagcagattctgcctgtacaccagacagggcgccgagcccgaggccccccacagagcccagcccgccgagccccagcccctgggcacccaggtgccccccgagaaggacagatgcaccagcccccccggcctgagctacatgaaggccaaggagaagaccgtggaggacctgaagagcgaggagctggccagagagatcgtgggcaaggacaagagcctggccgacatcctggaccccagcgtgaagatcaagaccaccatggacctgatggagggcatcttccccaaggacgagcacctgctggaggaggcccagcagagaagaaagctgctgcccaagatccccagccccagaagcaccgaggagagaaaggaggagcccagcgtgcccgccgccgtgagcctggccaccaacagcacctactacagcaccagcgcccccaaggccgagctgctgatcaagatgaaggacctgcaggagcagcaggagcacgaggaggacagcggcagcgacctggaccacgacctgagcgtgaagaagcaggagctgatcgagagcatcagcagaaagctgcaggtgctgagagaggccagagagagcctgctggaggacgtgcaggccaacaccgtgctgggcgccgaggtggaggccatcgtgaagggcgtgtgcaagcccagcgagttcgacaagttcagaatgttcatcggcgacctggacaaggtggtgaacctgctgctgagcctgagcggcagactggccagagtggagaacgccctgaacaacctggacgacggcgccagccccggcgacagacagagcctgctggagaagcagagagtgctgatccagcagatgtgcgtggacttcatgctggacacctaccacagccccatcaacagaagcagctgcctgaccgtgaccaagtag

SEQ ID NO: 98863 - DNA, 777 bp, Artificial Sequence
  Description of Artificial Sequence: Synthetic coding sequence
atgagagagagagccccccccccccccccccccagccaggagacccccgtgtacagcatggacgacttcccccccccccccccccacaccgtgtgcgaggcccagctggacagcgaggaccccgagggccccagacccagcttcaacaagctgagcaaggtgaccatcgccagagagagacacatgcccggcgccgcccacgtggtgggcagccagaccctggccagcagactgcagaccagcatcaagggcagcgaggccgagagcaccccccccagcttcatgagcgtgcacgcccagctggccggcagcctgggcggccagcccgcccccatccagacccagagcctgagccacgaccccgtgagcggcacccagggcctggagaagaaggtgagccccgacccccagaagagcagcgaggacatcagaaccgaggccctggccaaggagatcgtgcaccaggacaagagcctggccgacatcctggaccccgacagcagactgaagaccaccatggacctgatggagggcctgttccccagagacgtgaacctgctgaaggagaacagcgtgaagagaaaggccatccagagaaccgtgagcagcagcggctgcgagggcaagagaaacgaggacaaggaggccgtgagcatgctggtgaactgcccccagatcagcttccccagactgggcccctggctgtgcccccagaccagcagagtgagccccttcctgctgggcgccgtgctgagcgtggtgttcagccagcactag

SEQ ID NO: 98864 - DNA, 5991 bp, Artificial Sequence
  Description of Artificial Sequence: Synthetic coding sequence
atgatgagaaccaccgaggacttccacaagcccagcgccaccctgaacagcaacaccgccaccaagggcagatacatctacctggaggccttcctggagggcggcgccccctggggcttcaccctgaagggcggcctggagcacggcgagcccctgatcatcagcaaggtggaggagggcggcaaggccgacaccctgagcagcaagctgcaggccggcgacgaggtggtgcacatcaacgaggtgaccctgagcagcagcagaaaggaggccgtgagcctggtgaagggcagctacaagaccctgagactggtggtgagaagagacgtgtgcaccgaccccggccacgccgacaccggcgccagcaacttcgtgagccccgagcacctgaccagcggcccccagcacagaaaggccgcctggagcggcggcgtgaagctgagactgaagcacagaagaagcgagcccgccggcagaccccacagctggcacaccaccaagagcggcgagaagcagcccgacgccagcatgatgcagatcagccagggcatgatcggccccccctggcaccagagctaccacagcagcagcagcaccagcgacctgagcaactacgaccacgcctacctgagaagaagccccgaccagtgcagcagccagggcagcatggagagcctggagcccagcggcgcctaccccccctgccacctgagccccgccaagagcaccggcagcatcgaccagctgagccacttccacaacaagagagacagcgcctacagcagcttcagcaccagcagcagcatcctggagtacccccaccccggcatcagcggcagagagagaagcggcagcatggacaacaccagcgccagaggcggcctgctggagggcatgagacaggccgacatcagatacgtgaagaccgtgtacgacaccagaagaggcgtgagcgccgagtacgaggtgaacagcagcgccctgctgctgcagggcagagaggccagagccagcgccaacggccagggctacgacaagtggagcaacatccccagaggcaagggcgtgcccccccccagctggagccagcagtgccccagcagcctggagaccgccaccgacaacctgccccccaaggtgggcgcccccctgccccccgccagaagcgacagctacgccgccttcagacacagagagagacccagcagctggagcagcctggaccagaagagactgtgcagaccccaggccaacagcctgggcagcctgaagagccccttcatcgaggagcagctgcacaccgtgctggagaagagccccgagaacagcccccccgtgaagcccaagcacaactacacccagaaggcccagcccggccagcccctgctgcccaccagcatctaccccgtgcccagcctggagccccacttcgcccaggtgccccagcccagcgtgagcagcaacggcatgctgtaccccgccctggccaaggagagcggctacatcgccccccagggcgcctgcaacaagatggccaccatcgacgagaacggcaaccagaacggcagcggcagacccggcttcgccttctgccagcccctggagcacgacctgctgagccccgtggagaagaagcccgaggccaccgccaagtacgtgcccagcaaggtgcacttctgcagcgtgcccgagaacgaggaggacgccagcctgaagagacacctgacccccccccagggcaacagcccccacagcaacgagagaaagagcacccacagcaacaagcccagcagccacccccacagcctgaagtgcccccaggcccaggcctggcaggccggcgaggacaagagaagcagcagactgagcgagccctgggagggcgacttccaggaggaccacaacgccaacctgtggagaagactggagagagagggcctgggccagagcctgagcggcaacttcggcaagaccaagagcgccttcagcagcctgcagaacatccccgagagcctgagaagacacagcagcctggagctgggcagaggcacccaggagggctaccccggcggcagacccacctgcgccgtgaacaccaaggccgaggaccccggcagaaaggccgcccccgacctgggcagccacctggacagacaggtgagctaccccagacccgagggcagaaccggcgccagcgccagcttcaacagcaccgaccccagccccgaggagccccccgcccccagccacccccacaccagcagcctgggcagaagaggccccggccccggcagcgccagcgccctgcagggcttccagtacggcaagccccactgcagcgtgctggagaaggtgagcaagttcgagcagagagagcagggcagccagagacccagcgtgggcggcagcggcttcggccacaactacagaccccacagaaccgtgagcaccagcagcaccagcggcaacgacttcgaggagaccaaggcccacatcagattcagcgagagcgccgagcccctgggcaacggcgagcagcacttcaagaacggcgagctgaagctggaggaggccagcagacagccctgcggccagcagctgagcggcggcgccagcgacagcggcagaggcccccagagacccgacgccagactgctgagaagccagagcaccttccagctgagcagcgagcccgagagagagcccgagtggagagacagacccggcagccccgagagccccctgctggacgcccccttcagcagagcctacagaaacagcatcaaggacgcccagagcagagtgctgggcgccaccagcttcagaagaagagacctggagctgggcgcccccgtggccagcagaagctggagacccagacccagcagcgcccacgtgggcctgagaagccccgaggccagcgccagcgccagcccccacacccccagagagagacacagcgtgacccccgccgagggcgacctggccagacccgtgccccccgccgccagaagaggcgccagaagaagactgacccccgagcagaagaagagaagctacagcgagcccgagaagatgaacgaggtgggcatcgtggaggaggccgagcccgcccccctgggcccccagagaaacggcatgagattccccgagagcagcgtggccgacagaagaagactgttcgagagagacggcaaggcctgcagcaccctgagcctgagcggccccgagctgaagcagttccagcagagcgccctggccgactacatccagagaaagaccggcaagagacccaccagcgccgccggctgcagcctgcaggagcccggccccctgagagagagagcccagagcgcctacctgcagcccggccccgccgccctggagggcagcggcctggccagcgccagcagcctgagcagcctgagagagcccagcctgcagcccagaagagaggccaccctgctgcccgccaccgtggccgagacccagcaggcccccagagacagaagcagcagcttcgccggcggcagaagactgggcgagagaagaagaggcgacctgctgagcggcgccaacggcggcaccagaggcacccagagaggcgacgagacccccagagagcccagcagctggggcgccagagccggcaagagcatgagcgccgaggacctgctggagagaagcgacgtgctggccggccccgtgcacgtgagaagcagaagcagccccgccaccgccgacaagagacaggacgtgctgctgggccaggacagcggcttcggcctggtgaaggacccctgctacctggccggccccggcagcagaagcctgagctgcagcgagagaggccaggaggagatgctgcccctgttccaccacctgacccccagatggggcggcagcggctgcaaggccatcggcgacagcagcgtgcccagcgagtgccccggcaccctggaccaccagagacaggccagcagaaccccctgccccagaccccccctggccggcacccagggcctggtgaccgacaccagagccgcccccctgacccccatcggcacccccctgcccagcgccatccccagcggctactgcagccaggacggccagaccggcagacagcccctgcccccctacacccccgccatgatgcacagaagcaacggccacaccctgacccagccccccggccccagaggctgcgagggcgacggccccgagcacggcgtggaggagggcaccagaaagagagtgagcctgccccagtggcccccccccagcagagccaagtgggcccacgccgccagagaggacagcctgcccgaggagagcagcgcccccgacttcgccaacctgaagcactaccagaagcagcagagcctgcccagcctgtgcagcaccagcgaccccgacacccccctgggcgcccccagcacccccggcagaatcagcctgagaatcagcgagagcgtgctgagagacagcccccccccccacgaggactacgaggacgaggtgttcgtgagagacccccaccccaaggccaccagcagccccaccttcgagcccctgccccccccccccccccccccccccagccaggagacccccgtgtacagcatggacgacttcccccccccccccccccacaccgtgtgcgaggcccagctggacagcgaggaccccgagggccccagacccagcttcaacaagctgagcaaggtgaccatcgccagagagagacacatgcccggcgccgcccacgtggtgggcagccagaccctggccagcagactgcagaccagcatcaagggcagcgaggccgagagcaccccccccagcttcatgagcgtgcacgcccagctggccggcagcctgggcggccagcccgcccccatccagacccagagcctgagccacgaccccgtgagcggcacccagggcctggagaagaaggtgagccccgacccccagaagagcagcgaggacatcagaaccgaggccctggccaaggagatcgtgcaccaggacaagagcctggccgacatcctggaccccgacagcagactgaagaccaccatggacctgatggagggcctgttccccagagacgtgaacctgctgaaggagaacagcgtgaagagaaaggccatccagagaaccgtgagcagcagcggctgcgagggcaagagaaacgaggacaaggaggccgtgagcatgctggtgaactgccccgcctactacagcgtgagcgcccccaaggccgagctgctgaacaagatcaaggagatgcccgccgaggtgaacgaggaggaggagcaggccgacgtgaacgagaagaaggccgagctgatcggcagcctgacccacaagctggagaccctgcaggaggccaagggcagcctgctgaccgacatcaagctgaacaacgccctgggcgaggaggtggaggccctgatcagcgagctgtgcaagcccaacgagttcgacaagtacagaatgttcatcggcgacctggacaaggtggtgaacctgctgctgagcctgagcggcagactggccagagtggagaacgtgctgagcggcctgggcgaggacgccagcaacgaggagagaagcagcctgtacgagaagagaaagatcctggccggccagcacgaggacgccagagagctgaaggagaacctggacagaagagagagagtggtgctgggcatcctggccaactacctgagcgaggagcagctgcaggactaccagcacttcgtgaagatgaagagcaccctgctgatcgagcagagaaagctggacgacaagatcaagctgggccaggagcaggtgaagtgcctgctggagagcctgcccagcgacttcatccccaaggccggcgccctggccctgccccccaacctgaccagcgagcccatccccgccggcggctgcaccttcagcggcatcttccccaccctgaccagccccctgtag

SEQ ID NO: 98865 - DNA, 561 bp, Artificial Sequence
  Description of Artificial Sequence: Synthetic coding sequence
atggccttctacagcaccaccgagtacgacatccagctggccagaggcctgctgagcggcatgttcctgttcgccaccagaagaagcgagcccgccggcagaccccacagctggcacaccaccaagagcggcgagaagcagcccgacgccagcatgatgcagatcagccagggcatgatcggccccccctggcaccagagctaccacagcagcagcagcaccagcgacctgagcaactacgaccacgcctacctgagaagaagccccgaccagtgcagcagccagggcagcatggagagcctggagcccagcggcgcctaccccccctgccacctgagccccgccaagagcaccggcagcatcgaccagctgagccacttccacaacaagagagacagcgcctacagcagcttcagcaccagcagcagcatcctggagtacccccaccccggcaagagagtgaagaccagagacctgcccggcagccagagccccggcagagccatcagcagaaagaccaccatgcccaccagcggcggcggctggagagagaaggcctag

SEQ ID NO: 98866 - DNA, 4482 bp, Artificial Sequence
  Description of Artificial Sequence: Synthetic coding sequence
atggagaacagacccggcagcttccagtacgtgcccgtgcagctgcagggcggcgccccctggggcttcaccctgaagggcggcctggagcactgcgagcccctgaccgtgagcaagatcgaggacggcggcaaggccgccctgagccagaagatgagaaccggcgacgagctggtgaacatcaacggcacccccctgtacggcagcagacaggaggccctgatcctgatcaagggcagcttcagaatcctgaagctgatcgtgagaagaagaaacgcccccgtgagcagaccccacagctggcacgtggccaagctgctggagggctgccccgaggccgccaccaccatgcacttccccagcgaggccttcagcctgagctggcacagcggctgcaacaccagcgacgtgtgcgtgcagtggtgccccctgagcagacactgcagcaccgagaagagcagcagcatcggcagcatggagagcctggagcagcccggccaggccacctacgagagccacctgctgcccatcgaccagaacatgtaccccaaccagagagacagcgcctacagcagcttcagcgccagcagcaacgccagcgactgcgccctgagcctgagacccgaggagcccgccagcaccgactgcatcatgcagggccccggccccaccaaggcccccagcggcagacccaacgtggccgagaccagcggcggcagcagaagaaccaacggcggccacctgacccccagcagccagatgagcagcagaccccaggagggctaccagagcggccccgccaaggccgtgagaggccccccccagccccccgtgagaagagacagcctgcaggccagcagagcccagctgctgaacggcgagcagagaagagccagcgagcccgtggtgcccctgccccagaaggagaagctgagcctggagcccgtgctgcccgccagaaaccccaacagattctgctgcctgagcggccacgaccaggtgaccagcgagggccaccagaactgcgagttcagccagccccccgagagcagccagcagggcagcgagcacctgctgatgcaggccagcaccaaggccgtgggcagccccaaggcctgcgacagagccagcagcgtggacagcaaccccctgaacgaggccagcgccgagctggccaaggccagcttcggcagacccccccacctgatcggccccaccggccacagacacagcgcccccgagcagctgctggccagccacctgcagcacgtgcacctggacaccagaggcagcaagggcatggagctgccccccgtgcaggacggccaccagtggaccctgagccccctgcacagcagccacaagggcaagaagagcccctgcccccccaccggcggcacccacgaccagagcagcaaggagagaaagaccagacaggtggacgacagaagcctggtgctgggccaccagagccagagcagccccccccacggcgaggccgacggccaccccagcgagaagggcttcctggaccccaacagaaccagcagagccgccagcgagctggccaaccagcagcccagcgccagcggcagcctggtgcagcaggccaccgactgcagcagcaccaccaaggccgccagcggcaccgaggccggcgaggagggcgacagcgagcccaaggagtgcagcagaatgggcggcagaagaagcggcggcaccagaggcagaagcatccagaacagaagaaagagcgagagattcgccaccaacctgagaaacgagatccagagaagaaaggcccagctgcagaagagcaagggccccctgagccagctgtgcgacaccaaggagcccgtggaggagacccaggagccccccgagagcccccccctgaccgccagcaacaccagcctgctgagcagctgcaagaagccccccagccccagagacaagctgttcaacaagagcatgatgctgagagccagaagcagcgagtgcctgagccaggcccccgagagccacgagagcagaaccggcctggagggcagaatcagccccggccagagacccggccagagcagcctgggcctgaacacctggtggaaggcccccgaccccagcagcagcgaccccgagaaggcccacgcccactgcggcgtgagaggcggccactggagatggagccccgagcacaacagccagcccctggtggccgccgccatggagggccccagcaaccccggcgacaacaaggagctgaaggccagcaccgcccaggccggcgaggacgccatcctgctgcccttcgccgacagaagaaagttcttcgaggagagcagcaagagcctgagcaccagccacctgcccggcctgaccacccacagcaacaagaccttcacccagagacccaagcccatcgaccagaacttccagcccatgagcagcagctgcagagagctgagaagacaccccatggaccagagctaccacagcgccgaccagccctaccacgccaccgaccagagctaccacagcatgagccccctgcagagcgagacccccacctacagcgagtgcttcgccagcaagggcctggagaacagcatgtgctgcaagcccctgcactgcggcgacttcgactaccacagaacctgcagctacagctgcagcgtgcagggcgccctggtgcacgacccctgcatctactgcagcggcgagatctgccccgccctgctgaagagaaacatgatgcccaactgctacaactgcagatgccaccaccaccagtgcatcagatgcagcgtgtgctaccacaacccccagcacagcgccctggaggacagcagcctggcccccggcaacacctggaagcccagaaagctgaccgtgcaggagttccccggcgacaagtggaaccccatcaccggcaacagaaagaccagccagagcggcagagagatggcccacagcaagaccagcttcagctgggccacccccttccacccctgcctggagaaccccgccctggacctgagcagctacagagccatcagcagcctggacctgctgggcgacttcaagcacgccctgaagaagagcgaggagaccagcgtgtacgaggagggcagcagcctggccagcatgccccaccccctgagaagcagagccttcagcgagagccacatcagcctggccccccagagcaccagagcctggggccagcacagaagagagctgttcagcaagggcgacgagacccagagcgacctgctgggcgccagaaagaaggccttccccccccccagaccccccccccccaactgggagaagtacagactgttcagagccgcccagcagcagaagcagcagcagcagcagcagaagcagcaggaggaggaggaggaggaggaggaggaggaggaggaggaggaggaggaggaggaggaggaggccgaggaggaggaggaggagctgcccccccagtacttcagcagcgagaccagcggcagctgcgccctgaaccccgaggaggtgctggagcagccccagcccctgagcttcggccacctggagggcagcagacagggcagccagagcgtgcccgccgagcaggagagcttcgccctgcacagcagcgacttcctgccccccatcagaggccacctgggcagccagcccgagcaggcccagcccccctgctactacggcatcggcggcctgtggagaaccagcggccaggaggccaccgagagcgccaagcaggagttccagcacttcagcccccccagcggcgcccccggcatccccaccagctacagcgcctactacaacatcagcgtggccaaggccgagctgctgaacaagctgaaggaccagcccgagatggccgagatcggcctgggcgaggaggaggtggaccacgagctggcccagaagaagatccagctgatcgagagcatcagcagaaagctgagcgtgctgagagaggcccagagaggcctgctggaggacatcaacgccaacagcgccctgggcgaggaggtggaggccaacctgaaggccgtgtgcaagagcaacgagttcgagaagtaccacctgttcgtgggcgacctggacaaggtggtgaacctgctgctgagcctgagcggcagactggccagagtggagaacgccctgaacagcatcgacagcgaggccaaccaggagaagctggtgctgatcgagaagaagcagcagctgaccggccagctggccgacgccaaggagctgaaggagcacgtggacagaagagagaagctggtgttcggcatggtgagcagatacctgccccaggaccagctgcaggactaccagcacttcgtgaagatgaagagcgccctgatcatcgagcagagagagctggaggagaagatcaagctgggcgaggagcagctgaagtgcctgagagagagcctgctgctgggccccagcaacttctag

SEQ ID NO: 98867 - DNA, 4482 bp, Artificial Sequence; identical to SEQ ID NO: 98866
  Description of Artificial Sequence: Synthetic coding sequence

SEQ ID NO: 98868 - DNA, 4134 bp, Artificial Sequence
  Description of Artificial Sequence: Synthetic coding sequence
atgcacttccccagcgaggccttcagcctgagctggcacagcggctgcaacaccagcgacgtgtgcgtgcagtggtgccccctgagcagacactgcagcaccgagaagagcagcagcatcggcagcatggagagcctggagcagcccggccaggccacctacgagagccacctgctgcccatcgaccagaacatgtaccccaaccagagagacagcgcctacagcagcttcagcgccagcagcaacgccagcgactgcgccctgagcctgagacccgaggagcccgccagcaccgactgcatcatgcagggccccggccccaccaaggcccccagcggcagacccaacgtggccgagaccagcggcggcagcagaagaaccaacggcggccacctgacccccagcagccagatgagcagcagaccccaggagggctaccagagcggccccgccaaggccgtgagaggccccccccagccccccgtgagaagagacagcctgcaggccagcagagcccagctgctgaacggcgagcagagaagagccagcgagcccgtggtgcccctgccccagaaggagaagctgagcctggagcccgtgctgcccgccagaaaccccaacagattctgctgcctgagcggccacgaccaggtgaccagcgagggccaccagaactgcgagttcagccagccccccgagagcagccagcagggcagcgagcacctgctgatgcaggccagcaccaaggccgtgggcagccccaaggcctgcgacagagccagcagcgtggacagcaaccccctgaacgaggccagcgccgagctggccaaggccagcttcggcagacccccccacctgatcggccccaccggccacagacacagcgcccccgagcagctgctggccagccacctgcagcacgtgcacctggacaccagaggcagcaagggcatggagctgccccccgtgcaggacggccaccagtggaccctgagccccctgcacagcagccacaagggcaagaagagcccctgcccccccaccggcggcacccacgaccagagcagcaaggagagaaagaccagacaggtggacgacagaagcctggtgctgggccaccagagccagagcagccccccccacggcgaggccgacggccaccccagcgagaagggcttcctggaccccaacagaaccagcagagccgccagcgagctggccaaccagcagcccagcgccagcggcagcctggtgcagcaggccaccgactgcagcagcaccaccaaggccgccagcggcaccgaggccggcgaggagggcgacagcgagcccaaggagtgcagcagaatgggcggcagaagaagcggcggcaccagaggcagaagcatccagaacagaagaaagagcgagagattcgccaccaacctgagaaacgagatccagagaagaaaggcccagctgcagaagagcaagggccccctgagccagctgtgcgacaccaaggagcccgtggaggagacccaggagccccccgagagcccccccctgaccgccagcaacaccagcctgctgagcagctgcaagaagccccccagccccagagacaagctgttcaacaagagcatgatgctgagagccagaagcagcgagtgcctgagccaggcccccgagagccacgagagcagaaccggcctggagggcagaatcagccccggccagagacccggccagagcagcctgggcctgaacacctggtggaaggcccccgaccccagcagcagcgaccccgagaaggcccacgcccactgcggcgtgagaggcggccactggagatggagccccgagcacaacagccagcccctggtggccgccgccatggagggccccagcaaccccggcgacaacaaggagctgaaggccagcaccgcccaggccggcgaggacgccatcctgctgcccttcgccgacagaagaaagttcttcgaggagagcagcaagagcctgagcaccagccacctgcccggcctgaccacccacagcaacaagaccttcacccagagacccaagcccatcgaccagaacttccagcccatgagcagcagctgcagagagctgagaagacaccccatggaccagagctaccacagcgccgaccagccctaccacgccaccgaccagagctaccacagcatgagccccctgcagagcgagacccccacctacagcgagtgcttcgccagcaagggcctggagaacagcatgtgctgcaagcccctgcactgcggcgacttcgactaccacagaacctgcagctacagctgcagcgtgcagggcgccctggtgcacgacccctgcatctactgcagcggcgagatctgccccgccctgctgaagagaaacatgatgcccaactgctacaactgcagatgccaccaccaccagtgcatcagatgcagcgtgtgctaccacaacccccagcacagcgccctggaggacagcagcctggcccccggcaacacctggaagcccagaaagctgaccgtgcaggagttccccggcgacaagtggaaccccatcaccggcaacagaaagaccagccagagcggcagagagatggcccacagcaagaccagcttcagctgggccacccccttccacccctgcctggagaaccccgccctggacctgagcagctacagagccatcagcagcctggacctgctgggcgacttcaagcacgccctgaagaagagcgaggagaccagcgtgtacgaggagggcagcagcctggccagcatgccccaccccctgagaagcagagccttcagcgagagccacatcagcctggccccccagagcaccagagcctggggccagcacagaagagagctgttcagcaagggcgacgagacccagagcgacctgctgggcgccagaaagaaggccttccccccccccagaccccccccccccaactgggagaagtacagactgttcagagccgcccagcagcagaagcagcagcagcagcagcagaagcagcaggaggaggaggaggaggaggaggaggaggaggaggaggaggaggaggaggaggaggaggaggccgaggaggaggaggaggagctgcccccccagtacttcagcagcgagaccagcggcagctgcgccctgaaccccgaggaggtgctggagcagccccagcccctgagcttcggccacctggagggcagcagacagggcagccagagcgtgcccgccgagcaggagagcttcgccctgcacagcagcgacttcctgccccccatcagaggccacctgggcagccagcccgagcaggcccagcccccctgctactacggcatcggcggcctgtggagaaccagcggccaggaggccaccgagagcgccaagcaggagttccagcacttcagcccccccagcggcgcccccggcatccccaccagctacagcgcctactacaacatcagcgtggccaaggccgagctgctgaacaagctgaaggaccagcccgagatggccgagatcggcctgggcgaggaggaggtggaccacgagctggcccagaagaagatccagctgatcgagagcatcagcagaaagctgagcgtgctgagagaggcccagagaggcctgctggaggacatcaacgccaacagcgccctgggcgaggaggtggaggccaacctgaaggccgtgtgcaagagcaacgagttcgagaagtaccacctgttcgtgggcgacctggacaaggtggtgaacctgctgctgagcctgagcggcagactggccagagtggagaacgccctgaacagcatcgacagcgaggccaaccaggagaagctggtgctgatcgagaagaagcagcagctgaccggccagctggccgacgccaaggagctgaaggagcacgtggacagaagagagaagctggtgttcggcatggtgagcagatacctgccccaggaccagctgcaggactaccagcacttcgtgaagatgaagagcgccctgatcatcgagcagagagagctggaggagaagatcaagctgggcgaggagcagctgaagtgcctgagagagagcctgctgctgggccccagcaacttctag

SEQ ID NO: 98869 - DNA, 1686 bp, Artificial Sequence
  Description of Artificial Sequence: Synthetic coding sequence
atggccaaggagagatgcctgaagaagagcttccaggacagcctggaggacatcaagaagagaatgaaggagaagagaaacaagaacctggccgagatcggcaagagaagaagcttcatcgccgccccctgccagatcatcaccaacaccagcaccctgctgaagaactaccaggacaacaacaagatgctggtgctggccctggagaacgagaagagcaaggtgaaggaggcccaggacatcatcctgcagctgagaaaggagtgctactacctgacctgccagctgtacgccctgaagggcaagctgaccagccagcagaccgtggagcccgcccagaaccaggagatctgcagcagcggcatggaccccaacagcgacgacagcagcagaaacctgttcgtgaaggacctgccccagatccccctggaggagaccgagctgcccggccagggcgagagcttccagatcgaggaccagatccccaccatcccccaggacaccctgggcgtggacttcgacagcggcgaggccaagagcaccgacaacgtgctgcccagaaccgtgagcgtgagaagcagcctgaagaagcactgcaacagcatctgccagttcgacagcctggacgacttcgagaccagccacctggccggcaagagcttcgagttcgagagagtgggcttcctggaccccctggtgaacatgcacatccccgagaacgtgcagcacaacgcctgccagtggagcaaggaccaggtgaacctgagccccaagctgatccagcccggcaccttcaccaagaccaaggaggacatcctggagagcaagagcgagcagaccaagagcaagcagagagacacccaggagagaaagagagaggagaagagaaaggccaacagaagaaagagcaagagaatgagcaagtacaaggagaacaagagcgagaacaagaagaccgtgccccagaagaagatgcacaagagcgtgagcagcaacgacgcctacaacttcaacctggaggagggcgtgcacctgacccccttcagacagaaggtgagcaacgacagcaacagagaggagaacaacgagagcgaggtgagcctgtgcgagagcagcggcagcggcgacgacagcgacgacctgtacctgcccacctgcaagtacatccagaaccccaccagcaacagcgacagacccgtgaccagacccctggccaagagagccctgaagtacaccgacgagaaggagaccgagggcagcaagcccaccaagacccccaccaccaccccccccgagacccagcagagcccccacctgagcctgaaggacatcaccaacgtgagcctgtaccccgtggtgaagatcagaagactgagcctgagccccaagaagaacaaggccagccccgccgtggccctgcccaagagaagatgcaccgccagcgtgaactacaaggagcccaccctggccagcaagctgagaagaggcgaccccttcaccgacctgtgcttcctgaacagccccatcttcaagcagaagaaggacctgagaagaagcaagaagagagccctggaggtgagccccgccaaggaggccatcttcatcctgtactacgtgagagagttcgtgagcagattccccgactgcagaaagtgcaagctggagacccacatctgcctgagatag

SEQ ID NO: 98870 - DNA, 879 bp, Artificial Sequence
  Description of Artificial Sequence: Synthetic coding sequence
atggccaaggagagatgcctgaagaagagcttccaggacagcctggaggacatcaagaagagaatgaaggagaagagaaacaagaacctggccgagatcggcaagagaagaagcttcatcgccgccccctgccagatcatcaccaacaccagcaccctgctgaagaactaccaggacaacaacaagatgctggtgctggccctggagaacgagaagagcaaggtgaaggaggcccaggacatcatcctgcagctgagaaaggagtgctactacctgacctgccagctgtacgccctgaagggcaagctgaccagccagcagaccgtggagcccgcccagaaccaggagatctgcagcagcggcatggaccccaacagcgacgacagcagcagaaacctgttcgtgaaggacctgccccagatccccctggaggagaccgagctgcccggccagggcgagagcttccagatcgaggccaccccccccgagacccagcagagcccccacctgagcctgaaggacatcaccaacgtgagcctgtaccccgtggtgaagatcagaagactgagcctgagccccaagaagaacaaggccagccccgccgtggccctgcccaagagaagatgcaccgccagcgtgaactacaaggagcccaccctggccagcaagctgagaagaggcgaccccttcaccgacctgtgcttcctgaacagccccatcttcaagcagaagaaggacctgagaagaagcaagaagagagccctggaggtgagccccgccaaggaggccatcttcatcctgtactacgtgagagagttcgtgagcagattccccgactgcagaaagtgcaagctggagacccacatctgcctgagatag

SEQ ID NO: 98871 - DNA, 648 bp, Artificial Sequence
  Description of Artificial Sequence: Synthetic coding sequence
atggccaaggagagatgcctgaagaagagcttccaggacagcctggaggacatcaagaagagaatgaaggagaagagaaacaagaacctggccgagatcggcaagagaagaagcttcatcgccgccccctgccagatcatcaccaacaccagcaccctgctgaagaactaccaggacaacaacaagatgctggtgctggccctggagaacgagaagagcaaggtgaaggaggcccaggacatcatcctgcagctgagaaaggagtgctactacctgacctgccagctgtacgccctgaagggcaagctgaccagccagcagaccgtggagcccgcccagaaccaggagatctgcagcagcggcatggaccccaacagcgacgacagcagcagaaacctgttcgtgaaggacctgccccagatccccctggaggagaccgagctgcccggccagggcgagagcttccagatcgaggaccagatccccaccatcccccaggacaccctgggcgtggacttcgacagcggcgccctggaggtgagccccgccaaggaggccatcttcatcctgtactacgtgagagagttcgtgagcagattccccgactgcagaaagtgcaagctggagacccacatctgcctgagatag

SEQ ID NO: 98872 - DNA, 1584 bp, Artificial Sequence
  Description of Artificial Sequence: Synthetic coding sequence
atggccaaggagagatgcctgaagaagagcttccaggacagcctggaggacatcaagaagagaatgaaggagaagagaaacaagaacctggccgagatcggcaagagaagaagcttcatcgccgccccctgccagatcatcaccaacaccagcaccctgctgaagaactaccaggacaacaacaagatgctggtgctggccctggagaacgagaagagcaaggtgaaggaggcccaggacatcatcctgcagctgagaaaggagtgctactacctgacctgccagctgtacgccctgaagggcaagctgaccagccagcagaccgtggagcccgcccagaaccaggagatctgcagcagcggcatggaccccaacagcgacgacagcagcagaaacctgttcgtgaaggacctgccccagatccccctggaggagaccgagctgcccggccagggcgagagcttccagatcgaggaccagatccccaccatcccccaggacaccctgggcgtggacttcgacagcggcgaggccaagagcaccgacaacgtgctgcccagaaccgtgagcgtgagaagcagcctgaagaagcactgcaacagcatctgccagttcgacagcctggacgacttcgagaccagccacctggccggcaagagcttcgagttcgagagagtgggcttcctggaccccctggtgaacatgcacatccccgagaacgtgcagcacaacgcctgccagtggagcaaggaccaggtgaacctgagccccaagctgatccagcccggcaccttcaccaagaccaaggaggacatcctggagagcaagagcgagcagaccaagagcaagcagagagacacccaggagagaaagagagaggagaagagaaaggccaacagaagaaagagcaagagaatgagcaagtacaaggagaacaagagcgagaacaagaagaccgtgccccagaagaagatgcacaagagcgtgagcagcaacgacgcctacaacttcaacctggaggagggcgtgcacctgacccccttcagacagaaggtgagcaacgacagcaacagagaggagaacaacgagagcgaggtgagcctgtgcgagagcagcggcagcggcgacgacagcgacgacctgtacctgcccacctgcaagtacatccagaaccccaccagcaacagcgacagacccgtgaccagacccctggccaagagagccctgaagtacaccgacgagaaggagaccgagggcagcaagcccaccaagacccccaccaccaccccccccgagacccagcagagcccccacctgagcctgaaggacatcaccaacgtgagcctgtaccccgtggtgaagatcagaagactgagcctgagccccaagaagaacaaggccagccccgccgtggccctgcccaagagaagatgcaccgccagcgtgaactacaaggagcccaccctggccagcaagctgagaagaggcgaccccttcaccgacctgtgcttcctgaacagccccatcttcaagcagaagaaggacctgagaagaagcaagaagagcatgaagcagatccagtag

SEQ ID NO: 98873 - DNA, 1584 bp, Artificial Sequence; identical to SEQ ID NO: 98872
  Description of Artificial Sequence: Synthetic coding sequence

SEQ ID NO: 98874 - DNA, 828 bp, Artificial Sequence
  Description of Artificial Sequence: Synthetic coding sequence
atggccaaggagagatgcctgaagaagagcttccaggacagcctggaggacatcaagaagagaatgaaggagaagagaaacaagaacctggccgagatcggcaagagaagaagcttcatcgccgccccctgccagatcatcaccaacaccagcaccctgctgaagaactaccaggacaacaacaagatgctggtgctggccctggagaacgagaagagcaaggtgaaggaggcccaggacatcatcctgcagctgagaaaggagtgctactacctgacctgccagctgtacgccctgaagggcaagctgaccagccagcagaccgtggagcccgcccagaaccaggagatctgcagcagcggcatggaccccaacagcgacgacagcagcagaaacctgttcgtgaaggacctgccccagatccccctggaggagaccgagctgcccggccagggcgagagcttccagatcgaggaccagatccccaccatcccccaggacaccctgggcgtggacttcgacagcgccaccccccccgagacccagcagagcccccacctgagcctgaaggacatcaccaacgtgagcctgtaccccgtggtgaagatcagaagactgagcctgagccccaagaagaacaaggccagccccgccgtggccctgcccaagagaagatgcaccgccagcgtgaactacaaggagcccaccctggccagcaagctgagaagaggcgaccccttcaccgacctgtgcttcctgaacagccccatcttcaagcagaagaaggacctgagaagaagcaagaagagcatgaagcagatccagtag

SEQ ID NO: 98875 - DNA, 930 bp, Artificial Sequence
  Description of Artificial Sequence: Synthetic coding sequence
atggccaaggagagatgcctgaagaagagcttccaggacagcctggaggacatcaagaagagaatgaaggagaagagaaacaagaacctggccgagatcggcaagagaagaagcttcatcgccgccccctgccagatcatcaccaacaccagcaccctgctgaagaactaccaggacaacaacaagatgctggtgctggccctggagaacgagaagagcaaggtgaaggaggcccaggacatcatcctgcagctgagaaaggagtgctactacctgacctgccagctgtacgccctgaagggcaagctgaccagccagcagaccgtggagcccgcccagaaccaggagatctgcagcagcggcatggaccccaacagcgacgacagcagcagaaacctgttcgtgaaggacctgccccagatccccctggaggagaccgagctgcccggccagggcgagagcttccagatcgaggaccagatccccaccatcccccaggacaccctgggcgtggacttcgacagcgccaccccccccgagacccagcagagcccccacctgagcctgaaggacatcaccaacgtgagcctgtaccccgtggtgaagatcagaagactgagcctgagccccaagaagaacaaggccagccccgccgtggccctgcccaagagaagatgcaccgccagcgtgaactacaaggagcccaccctggccagcaagctgagaagaggcgaccccttcaccgacctgtgcttcctgaacagccccatcttcaagcagaagaaggacctgagaagaagcaagaagagagccctggaggtgagccccgccaaggaggccatcttcatcctgtactacgtgagagagttcgtgagcagattccccgactgcagaaagtgcaagctggagacccacatctgcctgagatag

SEQ ID NO: 98876 - DNA, 1686 bp, Artificial Sequence; identical to SEQ ID NO: 98869
  Description of Artificial Sequence: Synthetic coding sequence

SEQ ID NO: 98877 - DNA, 930 bp, Artificial Sequence; identical to SEQ ID NO: 98875
  Description of Artificial Sequence: Synthetic coding sequence

SEQ ID NO: 98878 - DNA, 777 bp, Artificial Sequence
  Description of Artificial Sequence: Synthetic coding sequence
atggccaaggagagatgcctgaagaagagcttccaggacagcctggaggacatcaagaagagaatgaaggagaagagaaacaagaacctggccgagatcggcaagagaagaagcttcatcgccgccccctgccagatcatcaccaacaccagcaccctgctgaagaactaccaggacaacaacaagatgctggtgctggccctggagaacgagaagagcaaggtgaaggaggcccaggacatcatcctgcagctgagaaaggagtgctactacctgacctgccagctgtacgccctgaagggcaagctgaccagccagcagaccgtggagcccgcccagaaccaggagatctgcagcagcggcatggaccccaacagcgacgacagcagcagaaacctgttcgtgaaggacctgccccagatccccctggaggagaccgagctgcccggccagggcgagagcttccagatcgaggccaccccccccgagacccagcagagcccccacctgagcctgaaggacatcaccaacgtgagcctgtaccccgtggtgaagatcagaagactgagcctgagccccaagaagaacaaggccagccccgccgtggccctgcccaagagaagatgcaccgccagcgtgaactacaaggagcccaccctggccagcaagctgagaagaggcgaccccttcaccgacctgtgcttcctgaacagccccatcttcaagcagaagaaggacctgagaagaagcaagaagagcatgaagcagatccagtag

SEQ ID NO: 98879 - DNA, 828 bp, Artificial Sequence; identical to SEQ ID NO: 98874
  Description of Artificial Sequence: Synthetic coding sequence

SEQ ID NO: 98880 - DNA, 777 bp, Artificial Sequence; identical to SEQ ID NO: 98878
  Description of Artificial Sequence: Synthetic coding sequence

SEQ ID NO: 98881 - DNA, 879 bp, Artificial Sequence; identical to SEQ ID NO: 98870
  Description of Artificial Sequence: Synthetic coding sequence

SEQ ID NO: 98882 - DNA, 3798 bp, Artificial Sequence
  Description of Artificial Sequence: Synthetic coding sequence
atggagtgccccgtgatggagaccggcagcctgttcaccagcggcatcaagagacacctgaaggacaagagaatcagcaagaccaccaagctgaacgtgagcctggccagcaagatcaagaccaagatcctgaacaacagcagcatcttcaagatcagcctgaagcacaacaacagagccctggcccaggccctgagcagagagaaggagaacagcagaagaatcaccaccgagaagatgctgctgcagaaggaggtggagaagctgaacttcgagaacaccttcctgagactgaagctgaacaacctgaacaagaagctgatcgacatcgaggccctgatgaacaacaacctgatcaccgccatcgagatgagcagcctgagcgagttccaccagagcagcttcctgctgagcgccagcaagaagaagagaatcagcaagcagtgcaagctgatgagactgcccttcgccagagtgcccctgaccagcaacgacgacgaggacgaggacaaggagaagatgcagtgcgacaacaacatcaagagcaagaccctgcccgacatccccagcagcggcagcaccacccagcccctgagcacccaggacaacagcgaggtgctgttcctgaaggagaacaaccagaacgtgtacggcctggacgacagcgagcacatcagcagcatcgtggacgtgccccccagagagagccacagccacagcgaccagagcagcaagaccagcctgatgagcgagatgagaaacgcccagagcatcggcagaagatgggagaagcccagccccagcaacgtgaccgagagaaagaagagaggcagcagctgggagagcaacaacctgagcgccgacaccccctgcgccaccgtgctggacaagcagcacatcagcagccccgagctgaactgcaacaacgagatcaacggccacaccaacgagaccaacaccgagatgcagagaaacaagcaggacctgcccggcctgagcagcgagagcgccagagagcccaacgccgagtgcatgaaccagatcgaggacaacgacgacttccagctgcagaagaccgtgtacgacgccgacatggacctgaccgccagcgaggtgagcaagatcgtgaccgtgagcaccggcatcaagaagaagagcaacaagaagaccaacgagcacggcatgaagaccttcagaaaggtgaaggacagcagcagcgagaagaagagagagagaagcaagagacagttcaagaacagcagcgacgtggacatcggcgagaagatcgagaacagaaccgagagaagcgacgtgctggacggcaagagaggcgccgaggaccccggcttcatcttcaacaacgagcagctggcccagatgaacgagcagctggcccaggtgaacgagctgaagaagatgaccctgcagaccggcttcgagcagggcgacagagagaacgtgctgtgcaacaagaaggagaagagaatcaccaacgagcaggaggagacctacagcctgagccagagcagcggcaagttccaccaggagagcaagttcgacaagggccagaacagcctgacctgcaacaagagcaaggccagcagacagaccttcgtgatccacaagctggagaaggacaacctgctgcccaaccagaaggacaaggtgaccatctacgagaacctggacgtgaccaacgagttccacaccgccaacctgagcaccaaggacaacggcaacctgtgcgactacggcacccacaacatcctggacctgaagaagtacgtgaccgacatccagcccagcgagcagaacgagagcaacatcaacaagctgagaaagaaggtgaacagaaagaccgagatcatcagcggcatgaaccacatgtacgaggacaacgacaaggacgtggtgcacggcctgaagaagggcaacttcttcttcaagacccaggaggacaaggagcccatcagcgagaacatcgaggtgagcaaggagctgcagatccccgccctgagcaccagagacaacgagaaccagtgcgactacagaacccagaacgtgctgggcctgcagaagcagatcaccaacatgtaccccgtgcagcagaacgagagcaaggtgaacaagaagctgagacagaaggtgaacagaaagaccgagatcatcagcgaggtgaaccacctggacaacgacaagagcatcgagtacaccgtgaagagccacagcctgttcctgacccagaaggacaaggagatcatccccggcaacctggaggaccccagcgagttcgagacccccgccctgagcaccaaggacagcggcaacctgtacgacagcgagatccagaacgtgctgggcgtgaagcacggccacgacatgcagcccgcctgccagaacgacagcaagatcggcaagaagcccagactgaacgtgtgccagaagagcgagatcatccccgagaccaaccagatctacgagaacgacaacaagggcgtgcacgacctggagaaggacaacttcttcagcctgacccccaaggacaaggagaccatcagcgagaacctgcaggtgaccaacgagttccagaccgtggacctgctgatcaaggacaacggcaacctgtgcgactacgacacccagaacatcctggagctgaagaagtacgtgaccgacagaaagagcgccgagcagaacgagagcaagatcaacaagctgagaaacaaggtgaactggaagaccgagatcatcagcgagatgaaccagatctacgaggacaacgacaaggacgcccacgtgcaggagagctacaccaaggacctggacttcaaggtgaacaagagcaagcagaagctggagtgccaggacatcatcaacaagcactacatggaggtgaacagcaacgagaaggagagctgcgaccagatcctggacagctacaaggtggtgaagaagagaaagaaggagagcagctgcaaggccaagaacatcctgaccaaggccaagaacaagctggccagccagctgaccgagagcagccagaccagcatcagcctggagagcgacctgaagcacatcaccagcgaggccgacagcgaccccggcaaccccgtggagctgtgcaagacccagaagcagagcaccaccaccctgaacaagaaggacctgcccttcgtggaggagatcaaggagggcgagtgccaggtgaagaaggtgaacaagatgaccagcaagagcaagaagagaaagaccagcatcgaccccagccccgagagccacgaggtgatggagagaatcctggacagcgtgcagggcaagagcaccgtgagcgagcaggccgacaaggagaacaacctggagaacgagaagatggtgaagaacaagcccgacttctacaccaaggccttcagaagcctgagcgagatccacagccccaacatccaggacagcagcttcgacagcgtgagagagggcctggtgcccctgagcgtgagcagcggcaagaacgtgatcatcaaggagaacttcgccctggagtgcagccccgccttccaggtgagcgacgacgagcacgagaagatgaacaagatgaagttcaaggtgaacagaagaacccagaagagcggcatcggcgacagacccctgcaggacctgagcaacaccagcttcgtgagcaacaacaccgccgagagcgagaacaagagcgaggacctgagcagcgagagaaccagcagaagaagaagatgcacccccttctacttcaaggagcccagcctgagagacaagatgagaagatag

SEQ ID NO: 98883 - DNA, 744 bp, Artificial Sequence
  Description of Artificial Sequence: Synthetic coding sequence
atggagtgccccgtgatggagaccggcagcctgttcaccagcggcatcaagagacacctgaaggacaagagaatcagcaagaccaccaagctgaacgtgagcctggccagcaagatcaagaccaagatcctgaacaacagcagcatcttcaagatcagcctgaagcacaacaacagagccctggcccaggccctgagcagagagaaggagaacagcagaagaatcaccaccgagaagatgctgctgcagaaggaggtggagaagctgaacttcgagaacaccttcctgagactgaagctgaacaacctgaacaagaagctgatcgacatcgaggccctgatgaacaacaacctgatcaccgccatcgagatgagcagcctgagcgagttccaccagagcagcttcctgctgagcgccagcaagaagaagagaatcagcaagcagtgcaagctgatgagactgcccttcgccagagtgcccctgaccagcaacgacgacgaggacgaggacaaggagaagatgcagtgcgacaacaacatcaagagcaagaccctgcccgacatccccagcagcggcagcaccacccagcccctgagcacccaggacaacagcgaggtgctgttcctgaaggagaacaaccagaacgtgtacggcctggacgacagcgagcacatcagcagcatcgtggacgtgccccccagaggcgagatcgtgctgaagatccacttcgagtacctgtactag

SEQ ID NO: 98884 - DNA, 264 bp, Artificial Sequence
  Description of Artificial Sequence: Synthetic coding sequence
atggagtgccccgtgatggagaccggcagcctgttcaccagcggcatcaagagacacctgaaggacaagagaatcagcaagaccaccaagctgaacgtgagcctggccagcaagatcaagaccaagatcctgaacaacagcagcatcttcaagatcagcctgaagcacaacaacagagccctggcccaggccctgagcagagagaaggagaacagcagaagaatcaccaccgagaagatgctgctgcagaaggaggtggagtag

SEQ ID NO: 98885 - DNA, 753 bp, Artificial Sequence
  Description of Artificial Sequence: Synthetic coding sequence
atgagcatcttcacccccaccaaccagatcagactgaccaacgtggccgtggtgagaatgaagagagccggcaagagattcgagatcgcctgctacaagaacaaggtggtgggctggagaagcggcgtggagaaggacctggacgaggtgctgcagacccacagcgtgttcgtgaacgtgagcaagggccaggtggccaagaaggaggacctgatcagcgccttcggcaccgacgaccagaccgagatctgcaagcagatcctgaccaagggcgaggtgcaggtgagcgacaaggagagacacacccagctggagcagatgttcagagacatcgccaccatcgtggccgacaagtgcgtgaaccccgagaccaagagaccctacaccgtgatcctgatcgagagagccatgaaggacatccactacagcgtgaagaccaacaagagcaccaagcagcaggccctggaggtgatcaagcagctgaaggagaagatgaagatcgagagagcccacatgagactgagattcatcctgcccgtgaacgagggcaagaagctgaaggagaagctgaagcccctgatcaaggtgatcgagagcgaggactacggccagcagctggagatcgtgtgcctgatcgaccccggctgcttcagagagatcgacgagctgatcaagaaggagaccaagggcaagggcagcctggaggtgctgaacctgaaggacgtggaggagggcgacgagaagttcgagtag

SEQ ID NO: 98886 - DNA, 1572 bp, Artificial Sequence
  Description of Artificial Sequence: Synthetic coding sequence
atggtggcccccggcctggtgctgggcctggtgctgcccctgatcctgtgggccgacagaagcgccggcatcggcttcagattcgccagctacatcaacaacgacatggtgctgcagaaggagcccgccggcgccgtgatctggggcttcggcacccccggcgccaccgtgaccgtgaccctgagacagggccaggagaccatcatgaagaaggtgaccagcgtgaaggcccacagcgacacctggatggtggtgctggaccccatgaagcccggcggccccttcgaggtgatggcccagcagaccctggagaagatcaacttcaccctgagagtgcacgacgtgctgttcggcgacgtgtggctgtgcagcggccagagcaacatgcagatgaccgtgctgcagatcttcaacgccaccagagagctgagcaacaccgccgcctaccagagcgtgagaatcctgagcgtgagccccatccaggccgagcaggagctggaggacctggtggccgtggacctgcagtggagcaagcccaccagcgagaacctgggccacggctacttcaagtacatgagcgccgtgtgctggctgttcggcagacacctgtacgacaccctgcagtaccccatcggcctgatcgccagcagctggggcggcacccccatcgaggcctggagcagcggcagaagcctgaaggcctgcggcgtgcccaagcagggcagcatcccctacgacagcgtgaccggccccagcaagcacagcgtgctgtggaacgccatgatccaccccctgtgcaacatgaccctgaagggcgtggtgtggtaccagggcgagagcaacatcaactacaacaccgacctgtacaactgcaccttccccgccctgatcgaggactggagagagaccttccacagaggcagccagggccagaccgagagattcttccccttcggcctggtgcagctgagcagcgacctgagcaagaagagcagcgacgacggcttcccccagatcagatggcaccagaccgccgacttcggctacgtgcccaaccccaagatgcccaacaccttcatggccgtggccatggacctgtgcgacagagacagccccttcggcagcatccaccccagagacaagcagaccgtggcctacagactgcacctgggcgccagagccctggcctacggcgagaagaacctgaccttcgagggccccctgcccgagaagatcgagctgctggcccacaagggcctgctgaacctgacctactaccagcagatccaggtgcagaagaaggacaacaagatcttcgagatcagctgctgcagcgaccacagatgcaagtggctgcccgccagcatgaacaccgtgagcacccagagcctgaccctggccatcgacagctgccacggcaccgtggtggccctgagatacgcctggaccacctggccctgcgagtacaagcagtgccccctgtaccaccccagcagcgccctgcccgccccccccttcatcgccttcatcaccgaccagggccccggccaccagagcaacgtggccaagtag

SEQ ID NO: 98887 - DNA, 1467 bp, Artificial Sequence
  Description of Artificial Sequence: Synthetic coding sequence
atggtgctgcagaaggagcccgccggcgccgtgatctggggcttcggcacccccggcgccaccgtgaccgtgaccctgagacagggccaggagaccatcatgaagaaggtgaccagcgtgaaggcccacagcgacacctggatggtggtgctggaccccatgaagcccggcggccccttcgaggtgatggcccagcagaccctggagaagatcaacttcaccctgagagtgcacgacgtgctgttcggcgacgtgtggctgtgcagcggccagagcaacatgcagatgaccgtgctgcagatcttcaacgccaccagagagctgagcaacaccgccgcctaccagagcgtgagaatcctgagcgtgagccccatccaggccgagcaggagctggaggacctggtggccgtggacctgcagtggagcaagcccaccagcgagaacctgggccacggctacttcaagtacatgagcgccgtgtgctggctgttcggcagacacctgtacgacaccctgcagtaccccatcggcctgatcgccagcagctggggcggcacccccatcgaggcctggagcagcggcagaagcctgaaggcctgcggcgtgcccaagcagggcagcatcccctacgacagcgtgaccggccccagcaagcacagcgtgctgtggaacgccatgatccaccccctgtgcaacatgaccctgaagggcgtggtgtggtaccagggcgagagcaacatcaactacaacaccgacctgtacaactgcaccttccccgccctgatcgaggactggagagagaccttccacagaggcagccagggccagaccgagagattcttccccttcggcctggtgcagctgagcagcgacctgagcaagaagagcagcgacgacggcttcccccagatcagatggcaccagaccgccgacttcggctacgtgcccaaccccaagatgcccaacaccttcatggccgtggccatggacctgtgcgacagagacagccccttcggcagcatccaccccagagacaagcagaccgtggcctacagactgcacctgggcgccagagccctggcctacggcgagaagaacctgaccttcgagggccccctgcccgagaagatcgagctgctggcccacaagggcctgctgaacctgacctactaccagcagatccaggtgcagaagaaggacaacaagatcttcgagatcagctgctgcagcgaccacagatgcaagtggctgcccgccagcatgaacaccgtgagcacccagagcctgaccctggccatcgacagctgccacggcaccgtggtggccctgagatacgcctggaccacctggccctgcgagtacaagcagtgccccctgtaccaccccagcagcgccctgcccgccccccccttcatcgccttcatcaccgaccagggccccggccaccagagcaacgtggccaagtag

SEQ ID NO: 98888 - DNA, 2094 bp, Artificial Sequence
  Description of Artificial Sequence: Synthetic coding sequence
atgctgctgcccctgctgctgagcagcctgctgggcggcagccaggccatggacggcagattctggatcagagtgcaggagagcgtgatggtgcccgagggcctgtgcatcagcgtgccctgcagcttcagctaccccagacaggactggaccggcagcacccccgcctacggctactggttcaaggccgtgaccgagaccaccaagggcgcccccgtggccaccaaccaccagagcagagaggtggagatgagcaccagaggcagattccagctgaccggcgaccccgccaagggcaactgcagcctggtgatcagagacgcccagatgcaggacgagagccagtacttcttcagagtggagagaggcagctacgtgagatacaacttcatgaacgacggcttcttcctgaaggtgaccgccctgacccagaagcccgacgtgtacatccccgagaccctggagcccggccagcccgtgaccgtgatctgcgtgttcaactgggccttcgaggagtgccccccccccagcttcagctggaccggcgccgccctgagcagccagggcaccaagcccaccaccagccacttcagcgtgctgagcttcacccccagaccccaggaccacaacaccgacctgacctgccacgtggacttcagcagaaagggcgtgagcgcccagagaaccgtgagactgagagtggcctacgcccccagagacctggtgatcagcatcagcagagacaacacccccgccctggagccccagccccagggcaacgtgccctacctggaggcccagaagggccagttcctgagactgctgtgcgccgccgacagccagccccccgccaccctgagctgggtgctgcagaacagagtgctgagcagcagccacccctggggccccagacccctgggcctggagctgcccggcgtgaaggccggcgacagcggcagatacacctgcagagccgagaacagactgggcagccagcagagagccctggacctgagcgtgcagtacccccccgagaacctgagagtgatggtgagccaggccaacagaaccgtgctggagaacctgggcaacggcaccagcctgcccgtgctggagggccagagcctgtgcctggtgtgcgtgacccacagcagcccccccgccagactgagctggacccagagaggccaggtgctgagccccagccagcccagcgaccccggcgtgctggagctgcccagagtgcaggtggagcacgagggcgagttcacctgccacgccagacaccccctgggcagccagcacgtgagcctgagcctgagcgtgcactacagccccaagctgctgggccccagctgcagctgggaggccgagggcctgcactgcagctgcagcagccaggccagccccgcccccagcctgagatggtggctgggcgaggagctgctggagggcaacagcagccaggacagcttcgaggtgacccccagcagcgccggcccctgggccaacagcagcctgagcctgcacggcggcctgagcagcggcctgagactgagatgcgaggcctggaacgtgcacggcgcccagagcggcagcatcctgcagctgcccgacaagaagggcctgatcagcaccgccttcagcaacggcgccttcctgggcatcggcatcaccgccctgctgttcctgtgcctggccctgatcatcatgaagatcctgcccaagagaagaacccagaccgagacccccagacccagattcagcagacacagcaccatcctggactacatcaacgtggtgcccaccgccggccccctggcccagaagagaaaccagaaggccacccccaacagccccagaacccccctgccccccggcgcccccagccccgagagcaagaagaaccagaagaagcagtaccagctgcccagcttccccgagcccaagagcagcacccaggcccccgagagccaggagagccaggaggagctgcactacgccaccctgaacttccccggcgtgagacccagacccgaggccagaatgcccaagggcacccaggccgactacgccgaggtgaagttccagtag

SEQ ID NO: 98889 - DNA, 1809 bp, Artificial Sequence
  Description of Artificial Sequence: Synthetic coding sequence
atgctgctgcccctgctgctgagcagcctgctgggcggcagccaggccatggacggcagattctggatcagagtgcaggagagcgtgatggtgcccgagggcctgtgcatcagcgtgccctgcagcttcagctaccccagacaggactggaccggcagcacccccgcctacggctactggttcaaggccgtgaccgagaccaccaagggcgcccccgtggccaccaaccaccagagcagagaggtggagatgagcaccagaggcagattccagctgaccggcgaccccgccaagggcaactgcagcctggtgatcagagacgcccagatgcaggacgagagccagtacttcttcagagtggagagaggcagctacgtgagatacaacttcatgaacgacggcttcttcctgaaggtgaccgccctgacccagaagcccgacgtgtacatccccgagaccctggagcccggccagcccgtgaccgtgatctgcgtgttcaactgggccttcgaggagtgccccccccccagcttcagctggaccggcgccgccctgagcagccagggcaccaagcccaccaccagccacttcagcgtgctgagcttcacccccagaccccaggaccacaacaccgacctgacctgccacgtggacttcagcagaaagggcgtgagcgcccagagaaccgtgagactgagagtggcctacgcccccagagacctggtgatcagcatcagcagagacaacacccccgccctggagccccagccccagggcaacgtgccctacctggaggcccagaagggccagttcctgagactgctgtgcgccgccgacagccagccccccgccaccctgagctgggtgctgcagaacagagtgctgagcagcagccacccctggggccccagacccctgggcctggagctgcccggcgtgaaggccggcgacagcggcagatacacctgcagagccgagaacagactgggcagccagcagagagccctggacctgagcgtgcagtacccccccgagaacctgagagtgatggtgagccaggccaacagaaccgtgctggagaacctgggcaacggcaccagcctgcccgtgctggagggccagagcctgtgcctggtgtgcgtgacccacagcagcccccccgccagactgagctggacccagagaggccaggtgctgagccccagccagcccagcgaccccggcgtgctggagctgcccagagtgcaggtggagcacgagggcgagttcacctgccacgccagacaccccctgggcagccagcacgtgagcctgagcctgagcgtgcactacaagaagggcctgatcagcaccgccttcagcaacggcgccttcctgggcatcggcatcaccgccctgctgttcctgtgcctggccctgatcatcatgaagatcctgcccaagagaagaacccagaccgagacccccagacccagattcagcagacacagcaccatcctggactacatcaacgtggtgcccaccgccggccccctggcccagaagagaaaccagaaggccacccccaacagccccagaacccccctgccccccggcgcccccagccccgagagcaagaagaaccagaagaagcagtaccagctgcccagcttccccgagcccaagagcagcacccaggcccccgagagccaggagagccaggaggagctgcactacgccaccctgaacttccccggcgtgagacccagacccgaggccagaatgcccaagggcacccaggccgactacgccgaggtgaagttccagtag

SEQ ID NO: 98890 - DNA, 2094 bp, Artificial Sequence; identical to SEQ ID NO: 98888
  Description of Artificial Sequence: Synthetic coding sequence

SEQ ID NO: 98891 - DNA, 1560 bp, Artificial Sequence
  Description of Artificial Sequence: Synthetic coding sequence
atgctgctgcccctgctgctgagcagcctgctgggcggcagccaggccatggacggcagattctggatcagagtgcaggagagcgtgatggtgcccgagggcctgtgcatcagcgtgccctgcagcttcagctaccccagacaggactggaccggcagcacccccgcctacggctactggttcaaggccgtgaccgagaccaccaagggcgcccccgtggccaccaaccaccagagcagagaggtggagatgagcaccagaggcagattccagctgaccggcgaccccgccaagggcaactgcagcctggtgatcagagacgcccagatgcaggacgagagccagtacttcttcagagtggagagaggcagctacgtgagatacaacttcatgaacgacggcttcttcctgaaggtgaccgccctgacccagaagaccgtgagactgagagtggcctacgcccccagagacctggtgatcagcatcagcagagacaacacccccgccctggagccccagccccagggcaacgtgccctacctggaggcccagaagggccagttcctgagactgctgtgcgccgccgacagccagccccccgccaccctgagctgggtgctgcagaacagagtgctgagcagcagccacccctggggccccagacccctgggcctggagctgcccggcgtgaaggccggcgacagcggcagatacacctgcagagccgagaacagactgggcagccagcagagagccctggacctgagcgtgcagtacccccccgagaacctgagagtgatggtgagccaggccaacagaaccgtgctggagaacctgggcaacggcaccagcctgcccgtgctggagggccagagcctgtgcctggtgtgcgtgacccacagcagcccccccgccagactgagctggacccagagaggccaggtgctgagccccagccagcccagcgaccccggcgtgctggagctgcccagagtgcaggtggagcacgagggcgagttcacctgccacgccagacaccccctgggcagccagcacgtgagcctgagcctgagcgtgcactacaagaagggcctgatcagcaccgccttcagcaacggcgccttcctgggcatcggcatcaccgccctgctgttcctgtgcctggccctgatcatcatgaagatcctgcccaagagaagaacccagaccgagacccccagacccagattcagcagacacagcaccatcctggactacatcaacgtggtgcccaccgccggccccctggcccagaagagaaaccagaaggccacccccaacagccccagaacccccctgccccccggcgcccccagccccgagagcaagaagaaccagaagaagcagtaccagctgcccagcttccccgagcccaagagcagcacccaggcccccgagagccaggagagccaggaggagctgcactacgccaccctgaacttccccggcgtgagacccagacccgaggccagaatgcccaagggcacccaggccgactacgccgaggtgaagttccagtag

SEQ ID NO: 98892 - DNA, 1920 bp, Artificial Sequence
  Description of Artificial Sequence: Synthetic coding sequence
atgctgctgcccctgctgctgagcagcctgctgggcggcagccaggccatggacggcagattctggatcagagtgcaggagagcgtgatggtgcccgagggcctgtgcatcagcgtgccctgcagcttcagctaccccagacaggactggaccggcagcacccccgcctacggctactggttcaaggccgtgaccgagaccaccaagggcgcccccgtggccaccaaccaccagagcagagaggtggagatgagcaccagaggcagattccagctgaccggcgaccccgccaagggcaactgcagcctggtgatcagagacgcccagatgcaggacgagagccagtacttcttcagagtggagagaggcagctacgtgagatacaacttcatgaacgacggcttcttcctgaaggtgaccgtgctgagcttcacccccagaccccaggaccacaacaccgacctgacctgccacgtggacttcagcagaaagggcgtgagcgcccagagaaccgtgagactgagagtggcctacgcccccagagacctggtgatcagcatcagcagagacaacacccccgccctggagccccagccccagggcaacgtgccctacctggaggcccagaagggccagttcctgagactgctgtgcgccgccgacagccagccccccgccaccctgagctgggtgctgcagaacagagtgctgagcagcagccacccctggggccccagacccctgggcctggagctgcccggcgtgaaggccggcgacagcggcagatacacctgcagagccgagaacagactgggcagccagcagagagccctggacctgagcgtgcagtacccccccgagaacctgagagtgatggtgagccaggccaacagaaccgtgctggagaacctgggcaacggcaccagcctgcccgtgctggagggccagagcctgtgcctggtgtgcgtgacccacagcagcccccccgccagactgagctggacccagagaggccaggtgctgagccccagccagcccagcgaccccggcgtgctggagctgcccagagtgcaggtggagcacgagggcgagttcacctgccacgccagacaccccctgggcagccagcacgtgagcctgagcctgagcgtgcactacagccccaagctgctgggccccagctgcagctgggaggccgagggcctgcactgcagctgcagcagccaggccagccccgcccccagcctgagatggtggctgggcgaggagctgctggagggcaacagcagccaggacagcttcgaggtgacccccagcagcgccggcccctgggccaacagcagcctgagcctgcacggcggcctgagcagcggcctgagactgagatgcgaggcctggaacgtgcacggcgcccagagcggcagcatcctgcagctgcccgacaagaagggcctgatcagcaccgccttcagcaacggcgccttcctgggcatcggcatcaccgccctgctgttcctgtgcctggccctgatcatcatgaagatcctgcccaagagaagaacccagaccgagacccccagacccagattcagcagacacagcaccatcctggactacatcaacgtggtgcccaccgccggccccctggcccagaagagaaaccagaaggccacccccaacagccccagaacccccctgccccccggcgcccccagccccgagagcaagaagaaccagaagaagcagtaccagctgcccagcttccccgagcccaagagcagcacccaggcccccgagagccaggagagccaggaggagctgcactacgccaccctgaacttccccggcgtgagacccagacccgaggccagaatgcccaagggcacccaggccgactacgccgaggtgaagttccagtag

SEQ ID NO: 98893 - DNA, 1635 bp, Artificial Sequence
  Description of Artificial Sequence: Synthetic coding sequence
atgctgctgcccctgctgctgagcagcctgctgggcggcagccaggccatggacggcagattctggatcagagtgcaggagagcgtgatggtgcccgagggcctgtgcatcagcgtgccctgcagcttcagctaccccagacaggactggaccggcagcacccccgcctacggctactggttcaaggccgtgaccgagaccaccaagggcgcccccgtggccaccaaccaccagagcagagaggtggagatgagcaccagaggcagattccagctgaccggcgaccccgccaagggcaactgcagcctggtgatcagagacgcccagatgcaggacgagagccagtacttcttcagagtggagagaggcagctacgtgagatacaacttcatgaacgacggcttcttcctgaaggtgaccgtgctgagcttcacccccagaccccaggaccacaacaccgacctgacctgccacgtggacttcagcagaaagggcgtgagcgcccagagaaccgtgagactgagagtggcctacgcccccagagacctggtgatcagcatcagcagagacaacacccccgccctggagccccagccccagggcaacgtgccctacctggaggcccagaagggccagttcctgagactgctgtgcgccgccgacagccagccccccgccaccctgagctgggtgctgcagaacagagtgctgagcagcagccacccctggggccccagacccctgggcctggagctgcccggcgtgaaggccggcgacagcggcagatacacctgcagagccgagaacagactgggcagccagcagagagccctggacctgagcgtgcagtacccccccgagaacctgagagtgatggtgagccaggccaacagaaccgtgctggagaacctgggcaacggcaccagcctgcccgtgctggagggccagagcctgtgcctggtgtgcgtgacccacagcagcccccccgccagactgagctggacccagagaggccaggtgctgagccccagccagcccagcgaccccggcgtgctggagctgcccagagtgcaggtggagcacgagggcgagttcacctgccacgccagacaccccctgggcagccagcacgtgagcctgagcctgagcgtgcactacaagaagggcctgatcagcaccgccttcagcaacggcgccttcctgggcatcggcatcaccgccctgctgttcctgtgcctggccctgatcatcatgaagatcctgcccaagagaagaacccagaccgagacccccagacccagattcagcagacacagcaccatcctggactacatcaacgtggtgcccaccgccggccccctggcccagaagagaaaccagaaggccacccccaacagccccagaacccccctgccccccggcgcccccagccccgagagcaagaagaaccagaagaagcagtaccagctgcccagcttccccgagcccaagagcagcacccaggcccccgagagccaggagagccaggaggagctgcactacgccaccctgaacttccccggcgtgagacccagacccgaggccagaatgcccaagggcacccaggccgactacgccgaggtgaagttccagtag

SEQ ID NO: 98894 - DNA, 1365 bp, Artificial Sequence
  Description of Artificial Sequence: Synthetic coding sequence
atgctgctgcccctgctgctgagcagcctgctgggcggcagccaggccatggacggcagattctggatcagagtgcaggagagcgtgatggtgcccgagggcctgtgcatcagcgtgccctgcagcttcagctaccccagacaggactggaccggcagcacccccgcctacggctactggttcaaggccgtgaccgagaccaccaagggcgcccccgtggccaccaaccaccagagcagagaggtggagatgagcaccagaggcagattccagctgaccggcgaccccgccaagggcaactgcagcctggtgatcagagacgcccagatgcaggacgagagccagtacttcttcagagtggagagaggcagctacgtgagatacaacttcatgaacgacggcttcttcctgaaggtgaccgtgctgagcttcacccccagaccccaggaccacaacaccgacctgacctgccacgtggacttcagcagaaagggcgtgagcgcccagagaaccgtgagactgagagtggcctacgcccccagagacctggtgatcagcatcagcagagacaacacccccgacccccccgagaacctgagagtgatggtgagccaggccaacagaaccgtgctggagaacctgggcaacggcaccagcctgcccgtgctggagggccagagcctgtgcctggtgtgcgtgacccacagcagcccccccgccagactgagctggacccagagaggccaggtgctgagccccagccagcccagcgaccccggcgtgctggagctgcccagagtgcaggtggagcacgagggcgagttcacctgccacgccagacaccccctgggcagccagcacgtgagcctgagcctgagcgtgcactacaagaagggcctgatcagcaccgccttcagcaacggcgccttcctgggcatcggcatcaccgccctgctgttcctgtgcctggccctgatcatcatgaagatcctgcccaagagaagaacccagaccgagacccccagacccagattcagcagacacagcaccatcctggactacatcaacgtggtgcccaccgccggccccctggcccagaagagaaaccagaaggccacccccaacagccccagaacccccctgccccccggcgcccccagccccgagagcaagaagaaccagaagaagcagtaccagctgcccagcttccccgagcccaagagcagcacccaggcccccgagagccaggagagccaggaggagctgcactacgccaccctgaacttccccggcgtgagacccagacccgaggccagaatgcccaagggcacccaggccgactacgccgaggtgaagttccagtag

SEQ ID NO: 98895 - DNA, 1665 bp, Artificial Sequence
  Description of Artificial Sequence: Synthetic coding sequence
atgctgctgcccctgctgctgagcagcctgctgggcggcagccaggccatggacggcagattctggatcagagtgcaggagagcgtgatggtgcccgagggcctgtgcatcagcgtgccctgcagcttcagctaccccagacaggactggaccggcagcacccccgcctacggctactggttcaaggccgtgaccgagaccaccaagggcgcccccgtggccaccaaccaccagagcagagaggtggagatgagcaccagaggcagattccagctgaccggcgaccccgccaagggcaactgcagcctggtgatcagagacgcccagatgcaggacgagagccagtacttcttcagagtggagagaggcagctacgtgagatacaacttcatgaacgacggcttcttcctgaaggtgaccggcaccaagcccaccaccagccacttcagcgtgctgagcttcacccccagaccccaggaccacaacaccgacctgacctgccacgtggacttcagcagaaagggcgtgagcgcccagagaaccgtgagactgagagtggcctacgcccccagagacctggtgatcagcatcagcagagacaacacccccgccctggagccccagccccagggcaacgtgccctacctggaggcccagaagggccagttcctgagactgctgtgcgccgccgacagccagccccccgccaccctgagctgggtgctgcagaacagagtgctgagcagcagccacccctggggccccagacccctgggcctggagctgcccggcgtgaaggccggcgacagcggcagatacacctgcagagccgagaacagactgggcagccagcagagagccctggacctgagcgtgcagtacccccccgagaacctgagagtgatggtgagccaggccaacagaaccgtgctggagaacctgggcaacggcaccagcctgcccgtgctggagggccagagcctgtgcctggtgtgcgtgacccacagcagcccccccgccagactgagctggacccagagaggccaggtgctgagccccagccagcccagcgaccccggcgtgctggagctgcccagagtgcaggtggagcacgagggcgagttcacctgccacgccagacaccccctgggcagccagcacgtgagcctgagcctgagcgtgcactacaagaagggcctgatcagcaccgccttcagcaacggcgccttcctgggcatcggcatcaccgccctgctgttcctgtgcctggccctgatcatcatgaagatcctgcccaagagaagaacccagaccgagacccccagacccagattcagcagacacagcaccatcctggactacatcaacgtggtgcccaccgccggccccctggcccagaagagaaaccagaaggccacccccaacagccccagaacccccctgccccccggcgcccccagccccgagagcaagaagaaccagaagaagcagtaccagctgcccagcttccccgagcccaagagcagcacccaggcccccgagagccaggagagccaggaggagctgcactacgccaccctgaacttccccggcgtgagacccagacccgaggccagaatgcccaagggcacccaggccgactacgccgaggtgaagttccagtag

SEQ ID NO: 98896 - DNA, 2097 bp, Artificial Sequence
  Description of Artificial Sequence: Synthetic coding sequence
atggtgcccggccaggcccagccccagagccccgagatgctgctgctgcccctgctgctgcccgtgctgggcgccggcagcctgaacaaggaccccagctacagcctgcaggtgcagagacaggtgcccgtgcccgagggcctgtgcgtgatcgtgagctgcaacctgagctaccccagagacggctgggacgagagcaccgccgcctacggctactggttcaagggcagaaccagccccaagaccggcgcccccgtggccaccaacaaccagagcagagaggtggagatgagcaccagagacagattccagctgaccggcgaccccggcaagggcagctgcagcctggtgatcagagacgcccagagagaggacgaggcctggtacttcttcagagtggagagaggcagcagagtgagacacagcttcctgagcaacgccttcttcctgaaggtgaccgccctgaccaagaagcccgacgtgtacatccccgagaccctggagcccggccagcccgtgaccgtgatctgcgtgttcaactgggccttcaagaagtgccccgcccccagcttcagctggaccggcgccgccctgagccccagaagaaccagacccagcaccagccacttcagcgtgctgagcttcacccccagcccccaggaccacgacaccgacctgacctgccacgtggacttcagcagaaagggcgtgagcgcccagagaaccgtgagactgagagtggcctacgcccccaaggacctgatcatcagcatcagccacgacaacaccagcgccctggagctgcagggcaacgtgatctacctggaggtgcagaagggccagttcctgagactgctgtgcgccgccgacagccagccccccgccaccctgagctgggtgctgcaggacagagtgctgagcagcagccacccctggggccccagaaccctgggcctggagctgagaggcgtgagagccggcgacagcggcagatacacctgcagagccgagaacagactgggcagccagcagcaggccctggacctgagcgtgcagtacccccccgagaacctgagagtgatggtgagccaggccaacagaaccgtgctggagaacctgggcaacggcaccagcctgcccgtgctggagggccagagcctgagactggtgtgcgtgacccacagcagcccccccgccagactgagctggaccagatggggccagaccgtgggccccagccagcccagcgaccccggcgtgctggagctgccccccatccagatggagcacgagggcgagttcacctgccacgcccagcaccccctgggcagccagcacgtgagcctgagcctgagcgtgcactaccccccccagctgctgggccccagctgcagctgggaggccgagggcctgcactgcagctgcagcagccaggccagccccgcccccagcctgagatggtggctgggcgaggagctgctggagggcaacagcagccagggcagcttcgaggtgacccccagcagcgccggcccctgggccaacagcagcctgagcctgcacggcggcctgagcagcggcctgagactgagatgcaaggcctggaacgtgcacggcgcccagagcggcagcgtgttccagctgctgcccggcaagctggagcacggcggcggcctgggcctgggcgccgccctgggcgccggcgtggccgccctgctggccttctgcagctgcctggtggtgttcagagtgaagatctgcagaaaggaggccagaaagagagccgccgccgagcaggacgtgcccagcaccctgggccccatcagccagggccaccagcacgagtgcagcgccggcagcagccaggaccaccccccccccggcgccgccacctacacccccggcaagggcgaggagcaggagctgcactacgccagcctgagcttccagggcctgagactgtgggagcccgccgaccaggaggcccccagcaccaccgagtacagcgagatcaagatccacaccggccagcccctgagaggccccggcttcggcctgcagctggagagagagatgagcggcatggtgcccaagtag

SEQ ID NO: 98897 - DNA, 1809 bp, Artificial Sequence
  Description of Artificial Sequence: Synthetic coding sequence
atggtgcccggccaggcccagccccagagccccgagatgctgctgctgcccctgctgctgcccgtgctgggcgccggcagcctgaacaaggaccccagctacagcctgcaggtgcagagacaggtgcccgtgcccgagggcctgtgcgtgatcgtgagctgcaacctgagctaccccagagacggctgggacgagagcaccgccgcctacggctactggttcaagggcagaaccagccccaagaccggcgcccccgtggccaccaacaaccagagcagagaggtggagatgagcaccagagacagattccagctgaccggcgaccccggcaagggcagctgcagcctggtgatcagagacgcccagagagaggacgaggcctggtacttcttcagagtggagagaggcagcagagtgagacacagcttcctgagcaacgccttcttcctgaaggtgaccgccctgaccaagaagcccgacgtgtacatccccgagaccctggagcccggccagcccgtgaccgtgatctgcgtgttcaactgggccttcaagaagtgccccgcccccagcttcagctggaccggcgccgccctgagccccagaagaaccagacccagcaccagccacttcagcgtgctgagcttcacccccagcccccaggaccacgacaccgacctgacctgccacgtggacttcagcagaaagggcgtgagcgcccagagaaccgtgagactgagagtggcctacgcccccaaggacctgatcatcagcatcagccacgacaacaccagcgccctggagctgcagggcaacgtgatctacctggaggtgcagaagggccagttcctgagactgctgtgcgccgccgacagccagccccccgccaccctgagctgggtgctgcaggacagagtgctgagcagcagccacccctggggccccagaaccctgggcctggagctgagaggcgtgagagccggcgacagcggcagatacacctgcagagccgagaacagactgggcagccagcagcaggccctggacctgagcgtgcagtacccccccgagaacctgagagtgatggtgagccaggccaacagaaccgtgctggagaacctgggcaacggcaccagcctgcccgtgctggagggccagagcctgagactggtgtgcgtgacccacagcagcccccccgccagactgagctggaccagatggggccagaccgtgggccccagccagcccagcgaccccggcgtgctggagctgccccccatccagatggagcacgagggcgagttcacctgccacgcccagcaccccctgggcagccagcacgtgagcctgagcctgagcgtgcactggaagctggagcacggcggcggcctgggcctgggcgccgccctgggcgccggcgtggccgccctgctggccttctgcagctgcctggtggtgttcagagtgaagatctgcagaaaggaggccagaaagagagccgccgccgagcaggacgtgcccagcaccctgggccccatcagccagggccaccagcacgagtgcagcgccggcagcagccaggaccaccccccccccggcgccgccacctacacccccggcaagggcgaggagcaggagctgcactacgccagcctgagcttccagggcctgagactgtgggagcccgccgaccaggaggcccccagcaccaccgagtacagcgagatcaagatccacaccggccagcccctgagaggccccggcttcggcctgcagctggagagagagatgagcggcatggtgcccaagtag

SEQ ID NO: 98898 - DNA, 1809 bp, Artificial Sequence; identical to SEQ ID NO: 98897
  Description of Artificial Sequence: Synthetic coding sequence

SEQ ID NO: 98899 - DNA, 1788 bp, Artificial Sequence
  Description of Artificial Sequence: Synthetic coding sequence
atgctgctgctgctgctgctgctgccccccctgctgtgcggcagagtgggcgccaaggagcagaaggactacctgctgaccatgcagaagagcgtgaccgtgcaggagggcctgtgcgtgagcgtgctgtgcagcttcagctacccccagaacggctggaccgccagcgaccccgtgcacggctactggttcagagccggcgaccacgtgagcagaaacatccccgtggccaccaacaaccccgccagagccgtgcaggaggagaccagagacagattccacctgctgggcgacccccagaacaaggactgcaccctgagcatcagagacaccagagagagcgacgccggcacctacgtgttctgcgtggagagaggcaacatgaagtggaactacaagtacgaccagctgagcgtgaacgtgaccgccagccaggacctgctgagcagatacagactggaggtgcccgagagcgtgaccgtgcaggagggcctgtgcgtgagcgtgccctgcagcgtgctgtacccccactacaactggaccgccagcagccccgtgtacggcagctggttcaaggagggcgccgacatcccctgggacatccccgtggccaccaacacccccagcggcaaggtgcaggaggacacccacggcagattcctgctgctgggcgacccccagaccaacaactgcagcctgagcatcagagacgccagaaagggcgacagcggcaagtactacttccaggtggagagaggcagcagaaagtggaactacatctacgacaagctgagcgtgcacgtgaccgccctgacccacatgcccaccttcagcatccccggcaccctggagagcggccaccccagaaacctgacctgcagcgtgccctgggcctgcgagcagggcaccccccccaccatcacctggatgggcgccagcgtgagcagcctggaccccaccatcaccagaagcagcatgctgagcctgatcccccagccccaggaccacggcaccagcctgacctgccaggtgaccctgcccggcgccggcgtgaccatgaccagagccgtgagactgaacatcagctaccccccccagaacctgaccatgaccgtgttccagggcgacggcaccgccagcaccaccctgagaaacggcagcgccctgagcgtgctggagggccagagcctgcacctggtgtgcgccgtggacagcaacccccccgccagactgagctggacctggggcagcctgaccctgagccccagccagagcagcaacctgggcgtgctggagctgcccagagtgcacgtgaaggacgagggcgagttcacctgcagagcccagaaccccctgggcagccagcacatcagcctgagcctgagcctgcagaacgagtacaccggcaagatgagacccatcagcggcgtgaccctgggcgccttcggcggcgccggcgccaccgccctggtgttcctgtacttctgcatcatcttcgtggtggtgagaagctgcagaaagaagagcgccagacccgccgtgggcgtgggcgacaccggcatggaggacgccaacgccgtgagaggcagcgccagccagggccccctgatcgagagccccgccgacgacagccccccccaccacgccccccccgccctggccacccccagccccgaggagggcgagatccagtacgccagcctgagcttccacaaggccagaccccagtacccccaggagcaggaggccatcggctacgagtacagcgagatcaacatccccaagtag

SEQ ID NO: 98900 - DNA, 1290 bp, Artificial Sequence
  Description of Artificial Sequence: Synthetic coding sequence
atgcccctgtgcagacccgagcacctgatgcccagagccagcagagtgcccgtggccgccagcctgcccctgagccacgccgtgatccccacccagctgcccagcagacccggccacagaccccccggcagacccagaagatgccccaaggccagctgcctgcccccccccgtgggccccagcagcacccagaccgccaagagagtgaccatgggctggcccagacccggcagagccctggtggccgtgaaggccctgctggtgctgagcctgctgcaggtgcccgcccaggccgtggtgagagccgtgctggaggacaacagcagcagcgtggacttcgccgacctgcccgccctgttcggcgtgcccctggcccccgagggcatcagaggctacctgatggaggtgaagcccgccaacgcctgccaccccatcgaggcccccagactgggcaacagaagcctgggcgccatcgtgctgatcagaagatacgactgcaccttcgacctgaaggtgctgaacgcccagagagccggcttcgaggccgccatcgtgcacaacgtgcacagcgacgacctggtgagcatgacccacgtgtacgaggacctgagaggccagatcgccatccccagcgtgttcgtgagcgaggccgccagccaggacctgagagtgatcctgggctgcaacaagagcgcccacgccctgctgctgcccgacgaccccccctgccacgacctgggctgccaccccgtgctgaccgtgagctgggtgctgggctgcaccctggccctggtggtgagcgccttcttcgtgctgaaccacctgtggctgtgggcccaggcctgctgcagccacagaagacccgtgaagaccagcacctgccagaaggcccaggtgagaaccttcacctggcacaacgacctgtgcgccatctgcctggacgagtacgaggagggcgaccagctgaagatcctgccctgcagccacacctaccactgcaagtgcatcgacccctggttcagccaggcccccagaagaagctgccccgtgtgcaagcagagcgtggccgccaccgaggacagcttcgacagcaccacctacagcttcagagacgaggaccccagcctgcccggccacagaccccccatctgggccatccaggtgcagctgagaagcagaagactggagctgctgggcagagccagcccccactgccactgcagcaccaccagcctggaggccgagtacaccaccgtgagcagcgccccccccgaggcccccggccagtag

SEQ ID NO: 98901 - DNA, 1656 bp, Artificial Sequence; identical to SEQ ID NO: 84855
  Description of Artificial Sequence: Synthetic coding sequence

SEQ ID NO: 98902 - DNA, 1062 bp, Artificial Sequence
  Description of Artificial Sequence: Synthetic coding sequence
atgcagggcgcccaggaggccagcgccagcgagatgctgcccctgctgctgcccctgctgtgggccggcgccctggcccaggagagaagattccagctggagggccccgagagcctgaccgtgcaggagggcctgtgcgtgctggtgccctgcagactgcccaccaccctgcccgccagctactacggctacggctactggttcctggagggcgccgacgtgcccgtggccaccaacgaccccgacgaggaggtgcaggaggagaccagaggcagattccacctgctgtgggaccccagaagaaagaactgcagcctgagcatcagagacgccagaagaagagacaacgccgcctacttcttcagactgaagagcaagtggatgaagtacggctacaccagcagcaagctgagcgtgagagtgatggccctgacccacagacccaacatcagcatccccggcaccctggagagcggccaccccagcaacctgacctgcagcgtgccctgggtgtgcgagcagggcaccccccccatcttcagctggatgagcgccgcccccaccagcctgggccccagaaccacccagagcagcgtgctgaccatcacccccagaccccaggaccacagcaccaacctgacctgccaggtgaccttccccggcgccggcgtgaccatggagagaaccatccagctgaacgtgagctacgccccccagaaggtggccatcagcatcttccagggcaacagcgccgccttcaagatcctgcagaacaccagcagcctgcccgtgctggagggccaggccctgagactgctgtgcgacgccgacggcaacccccccgcccacctgagctggttccagggcttccccgccctgaacgccacccccatcagcaacaccggcgtgctggagctgccccaggtgggcagcgccgaggagggcgacttcacctgcagagcccagcaccccctgggcagcctgcagatcagcctgagcctgttcgtgcactggagcagcgcccccgtgcccgacagacacagcttcagacccccctgctag

SEQ ID NO: 98903 - DNA, 1281 bp, Artificial Sequence
  Description of Artificial Sequence: Synthetic coding sequence
atgctgcccctgctgctgcccctgctgtgggccggcgccctggcccaggagagaagattccagctggagggccccgagagcctgaccgtgcaggagggcctgtgcgtgctggtgccctgcagactgcccaccaccctgcccgccagctactacggctacggctactggttcctggagggcgccgacgtgcccgtggccaccaacgaccccgacgaggaggtgcaggaggagaccagaggcagattccacctgctgtgggaccccagaagaaagaactgcagcctgagcatcagagacgccagaagaagagacaacgccgcctacttcttcagactgaagagcaagtggatgaagtacggctacaccagcagcaagctgagcgtgagagtgatggccctgacccacagacccaacatcagcatccccggcaccctggagagcggccaccccagcaacctgacctgcagcgtgccctgggtgtgcgagcagggcaccccccccatcttcagctggatgagcgccgcccccaccagcctgggccccagaaccacccagagcagcgtgctgaccatcacccccagaccccaggaccacagcaccaacctgacctgccaggtgaccttccccggcgccggcgtgaccatggagagaaccatccagctgaacgtgagcagcttcaagatcctgcagaacaccagcagcctgcccgtgctggagggccaggccctgagactgctgtgcgacgccgacggcaacccccccgcccacctgagctggttccagggcttccccgccctgaacgccacccccatcagcaacaccggcgtgctggagctgccccaggtgggcagcgccgaggagggcgacttcacctgcagagcccagcaccccctgggcagcctgcagatcagcctgagcctgttcgtgcactggaagcccgagggcagagccggcggcgtgctgggcgccgtgtggggcgccagcatcaccaccctggtgttcctgtgcgtgtgcttcatcttcagagtgaagaccagaagaaagaaggccgcccagcccgtgcagaacaccgacgacgtgaaccccgtgatggtgagcggcagcagaggccaccagcaccagttccagaccggcatcgtgagcgaccaccccgccgaggccggccccatcagcgaggacgagcaggagctgcactacgccgtgctgcacttccacaaggtgcagccccaggagcccaaggtgaccgacaccgagtacagcgagatcaagatccacaagtag

SEQ ID NO: 98904 - DNA, 1314 bp, Artificial Sequence
  Description of Artificial Sequence: Synthetic coding sequence
atgcagggcgcccaggaggccagcgccagcgagatgctgcccctgctgctgcccctgctgtgggccggcgccctggcccaggagagaagattccagctggagggccccgagagcctgaccgtgcaggagggcctgtgcgtgctggtgccctgcagactgcccaccaccctgcccgccagctactacggctacggctactggttcctggagggcgccgacgtgcccgtggccaccaacgaccccgacgaggaggtgcaggaggagaccagaggcagattccacctgctgtgggaccccagaagaaagaactgcagcctgagcatcagagacgccagaagaagagacaacgccgcctacttcttcagactgaagagcaagtggatgaagtacggctacaccagcagcaagctgagcgtgagagtgatggccctgacccacagacccaacatcagcatccccggcaccctggagagcggccaccccagcaacctgacctgcagcgtgccctgggtgtgcgagcagggcaccccccccatcttcagctggatgagcgccgcccccaccagcctgggccccagaaccacccagagcagcgtgctgaccatcacccccagaccccaggaccacagcaccaacctgacctgccaggtgaccttccccggcgccggcgtgaccatggagagaaccatccagctgaacgtgagcagcttcaagatcctgcagaacaccagcagcctgcccgtgctggagggccaggccctgagactgctgtgcgacgccgacggcaacccccccgcccacctgagctggttccagggcttccccgccctgaacgccacccccatcagcaacaccggcgtgctggagctgccccaggtgggcagcgccgaggagggcgacttcacctgcagagcccagcaccccctgggcagcctgcagatcagcctgagcctgttcgtgcactggaagcccgagggcagagccggcggcgtgctgggcgccgtgtggggcgccagcatcaccaccctggtgttcctgtgcgtgtgcttcatcttcagagtgaagaccagaagaaagaaggccgcccagcccgtgcagaacaccgacgacgtgaaccccgtgatggtgagcggcagcagaggccaccagcaccagttccagaccggcatcgtgagcgaccaccccgccgaggccggccccatcagcgaggacgagcaggagctgcactacgccgtgctgcacttccacaaggtgcagccccaggagcccaaggtgaccgacaccgagtacagcgagatcaagatccacaagtag

SEQ ID NO: 98905 - DNA, 1362 bp, Artificial Sequence
  Description of Artificial Sequence: Synthetic coding sequence
atgcagggcgcccaggaggccagcgccagcgagatgctgcccctgctgctgcccctgctgtgggccggcgccctggcccaggagagaagattccagctggagggccccgagagcctgaccgtgcaggagggcctgtgcgtgctggtgccctgcagactgcccaccaccctgcccgccagctactacggctacggctactggttcctggagggcgccgacgtgcccgtggccaccaacgaccccgacgaggaggtgcaggaggagaccagaggcagattccacctgctgtgggaccccagaagaaagaactgcagcctgagcatcagagacgccagaagaagagacaacgccgcctacttcttcagactgaagagcaagtggatgaagtacggctacaccagcagcaagctgagcgtgagagtgatggccctgacccacagacccaacatcagcatccccggcaccctggagagcggccaccccagcaacctgacctgcagcgtgccctgggtgtgcgagcagggcaccccccccatcttcagctggatgagcgccgcccccaccagcctgggccccagaaccacccagagcagcgtgctgaccatcacccccagaccccaggaccacagcaccaacctgacctgccaggtgaccttccccggcgccggcgtgaccatggagagaaccatccagctgaacgtgagctacgccccccagaaggtggccatcagcatcttccagggcaacagcgccgccttcaagatcctgcagaacaccagcagcctgcccgtgctggagggccaggccctgagactgctgtgcgacgccgacggcaacccccccgcccacctgagctggttccagggcttccccgccctgaacgccacccccatcagcaacaccggcgtgctggagctgccccaggtgggcagcgccgaggagggcgacttcacctgcagagcccagcaccccctgggcagcctgcagatcagcctgagcctgttcgtgcactggaagcccgagggcagagccggcggcgtgctgggcgccgtgtggggcgccagcatcaccaccctggtgttcctgtgcgtgtgcttcatcttcagagtgaagaccagaagaaagaaggccgcccagcccgtgcagaacaccgacgacgtgaaccccgtgatggtgagcggcagcagaggccaccagcaccagttccagaccggcatcgtgagcgaccaccccgccgaggccggccccatcagcgaggacgagcaggagctgcactacgccgtgctgcacttccacaaggtgcagccccaggagcccaaggtgaccgacaccgagtacagcgagatcaagatccacaagtag

SEQ ID NO: 98906 - DNA, 1170 bp, Artificial Sequence
  Description of Artificial Sequence: Synthetic coding sequence
atgcagggcgcccaggaggccagcgccagcgagatgctgcccctgctgctgcccctgctgtgggccggcgccctggcccaggagagaagattccagctggagggccccgagagcctgaccgtgcaggagggcctgtgcgtgctggtgccctgcagactgcccaccaccctgcccgccagctactacggctacggctactggttcctggagggcgccgacgtgcccgtggccaccaacgaccccgacgaggaggtgcaggaggagaccagaggcagattccacctgctgtgggaccccagaagaaagaactgcagcctgagcatcagagacgccagaagaagagacaacgccgcctacttcttcagactgaagagcaagtggatgaagtacggctacaccagcagcaagctgagcgtgagagtgatggccctgacccacagacccaacatcagcatccccggcaccctggagagcggccaccccagcaacctgacctgcagcgtgccctgggtgtgcgagcagggcaccccccccatcttcagctggatgagcgccgcccccaccagcctgggccccagaaccacccagagcagcgtgctgaccatcacccccagaccccaggaccacagcaccaacctgacctgccaggtgaccttccccggcgccggcgtgaccatggagagaaccatccagctgaacgtgagctggatgctgagaagaccccccctgagcacccccgacgccccccagaaggtggccatcagcatcttccagggcaacagcgccgccttcaagatcctgcagaacaccagcagcctgcccgtgctggagggccaggccctgagactgctgtgcgacgccgacggcaacccccccgcccacctgagctggttccagggcttccccgccctgaacgccacccccatcagcaacaccggcgtgctggagctgccccaggtgggcagcgccgaggagggcgacttcacctgcagagcccagcaccccctgggcagcctgcagatcagcctgagcctgttcgtgcactggaagcccgagggcagagccggcggcgtgctgggcgccgtgtggggcgccagcatcaccaccctggtgttcctgtgcgtgtgcttcatcttcagagtgatcagcaccagcagcagacaggcctag

SEQ ID NO: 98907 - DNA, 1206 bp, Artificial Sequence
  Description of Artificial Sequence: Synthetic coding sequence
atgcagggcgcccaggaggccagcgccagcgagatgctgcccctgctgctgcccctgctgtgggccgccagctactacggctacggctactggttcctggagggcgccgacgtgcccgtggccaccaacgaccccgacgaggaggtgcaggaggagaccagaggcagattccacctgctgtgggaccccagaagaaagaactgcagcctgagcatcagagacgccagaagaagagacaacgccgcctacttcttcagactgaagagcaagtggatgaagtacggctacaccagcagcaagctgagcgtgagagtgatggccctgacccacagacccaacatcagcatccccggcaccctggagagcggccaccccagcaacctgacctgcagcgtgccctgggtgtgcgagcagggcaccccccccatcttcagctggatgagcgccgcccccaccagcctgggccccagaaccacccagagcagcgtgctgaccatcacccccagaccccaggaccacagcaccaacctgacctgccaggtgaccttccccggcgccggcgtgaccatggagagaaccatccagctgaacgtgagcagcttcaagatcctgcagaacaccagcagcctgcccgtgctggagggccaggccctgagactgctgtgcgacgccgacggcaacccccccgcccacctgagctggttccagggcttccccgccctgaacgccacccccatcagcaacaccggcgtgctggagctgccccaggtgggcagcgccgaggagggcgacttcacctgcagagcccagcaccccctgggcagcctgcagatcagcctgagcctgttcgtgcactggaagcccgagggcagagccggcggcgtgctgggcgccgtgtggggcgccagcatcaccaccctggtgttcctgtgcgtgtgcttcatcttcagagtgaagaccagaagaaagaaggccgcccagcccgtgcagaacaccgacgacgtgaaccccgtgatggtgagcggcagcagaggccaccagcaccagttccagaccggcatcgtgagcgaccaccccgccgaggccggccccatcagcgaggacgagcaggagctgcactacgccgtgctgcacttccacaaggtgcagccccaggagcccaaggtgaccgacaccgagtacagcgagatcaagatccacaagtag

SEQ ID NO: 98908 - DNA, 1125 bp, Artificial Sequence
  Description of Artificial Sequence: Synthetic coding sequence
atgctgctgctgctgctgctgcccctgctgtggggcagagagagagtggagggccagaagagcaacagaaaggactacagcctgaccatgcagagcagcgtgaccgtgcaggagggcatgtgcgtgcacgtgagatgcagcttcagctaccccgtggacagccagaccgacagcgaccccgtgcacggctactggttcagagccggcaacgacatcagctggaaggcccccgtggccaccaacaaccccgcctgggccgtgcaggaggagaccagagacagattccacctgctgggcgacccccagaccaagaactgcaccctgagcatcagagacgccagaatgagcgacgccggcagatacttcttcagaatggagaagggcaacatcaagtggaactacaagtacgaccagctgagcgtgaacgtgaccgaccccccccagaacctgaccgtgaccgtgttccagggcgagggcaccgccagcaccgccctgggcaacagcagcagcctgagcgtgctggagggccagagcctgagactggtgtgcgccgtggacagcaacccccccgccagactgagctggacctggagaagcctgaccctgtaccccagccagcccagcaaccccctggtgctggagctgcaggtgcacctgggcgacgagggcgagttcacctgcagagcccagaacagcctgggcagccagcacgtgagcctgaacctgagcctgcagcaggagtacaccggcaagatgagacccgtgagcggcgtgctgctgggcgccgtgggcggcgccggcgccaccgccctggtgttcctgagcttctgcgtgatcttcatcgtggtgagaagctgcagaaagaagagcgccagacccgccgccgacgtgggcgacatcggcatgaaggacgccaacaccatcagaggcagcgccagccagggcaacctgaccgagagctgggccgacgacaaccccagacaccacggcctggccgcccacagcagcggcgaggagagagagatccagtacgcccccctgagcttccacaagggcgagccccaggacctgagcggccaggaggccaccaacaacgagtacagcgagatcaagatccccaagtag

SEQ ID NO: 98909 - DNA, 1404 bp, Artificial Sequence
  Description of Artificial Sequence: Synthetic coding sequence
atgctgctgctgctgctgctgcccctgctgtggggcagagagagagtggagggccagaagagcaacagaaaggactacagcctgaccatgcagagcagcgtgaccgtgcaggagggcatgtgcgtgcacgtgagatgcagcttcagctaccccgtggacagccagaccgacagcgaccccgtgcacggctactggttcagagccggcaacgacatcagctggaaggcccccgtggccaccaacaaccccgcctgggccgtgcaggaggagaccagagacagattccacctgctgggcgacccccagaccaagaactgcaccctgagcatcagagacgccagaatgagcgacgccggcagatacttcttcagaatggagaagggcaacatcaagtggaactacaagtacgaccagctgagcgtgaacgtgaccgccctgacccacagacccaacatcctgatccccggcaccctggagagcggctgcttccagaacctgacctgcagcgtgccctgggcctgcgagcagggcaccccccccatgatcagctggatgggcaccagcgtgagccccctgcaccccagcaccaccagaagcagcgtgctgaccctgatcccccagccccagcaccacggcaccagcctgacctgccaggtgaccctgcccggcgccggcgtgaccaccaacagaaccatccagctgaacgtgagctaccccccccagaacctgaccgtgaccgtgttccagggcgagggcaccgccagcaccgccctgggcaacagcagcagcctgagcgtgctggagggccagagcctgagactggtgtgcgccgtggacagcaacccccccgccagactgagctggacctggagaagcctgaccctgtaccccagccagcccagcaaccccctggtgctggagctgcaggtgcacctgggcgacgagggcgagttcacctgcagagcccagaacagcctgggcagccagcacgtgagcctgaacctgagcctgcagcaggagtacaccggcaagatgagacccgtgagcggcgtgctgctgggcgccgtgggcggcgccggcgccaccgccctggtgttcctgagcttctgcgtgatcttcatcgtggtgagaagctgcagaaagaagagcgccagacccgccgccgacgtgggcgacatcggcatgaaggacgccaacaccatcagaggcagcgccagccagggcaacctgaccgagagctgggccgacgacaaccccagacaccacggcctggccgcccacagcagcggcgaggagagagagatccagtacgcccccctgagcttccacaagggcgagccccaggacctgagcggccaggaggccaccaacaacgagtacagcgagatcaagatccccaagtag

SEQ ID NO: 98910 - DNA, 438 bp, Artificial Sequence
  Description of Artificial Sequence: Synthetic coding sequence
atgctgctgctgctgctgctgcccctgctgtggggcagagagagagtggagggccagaagagcaacagaaaggactacagcctgaccatgcagagcagcgtgaccgtgcaggagggcatgtgcgtgcacgtgagatgcagcttcagctaccccgtggacagccagaccgacagcgaccccgtgcacggctactggttcagagccggcaacgacatcagctggaaggcccccgtggccaccaacaaccccgcctgggccgtgcaggaggagaccagagacagattccacctgctgggcgacccccagaccaagaactgcaccctgagcatcagagacgccagaatgagcgacgccggcagatacttcttcagaatggagaagggcaacatcaagtggaactacaagtacgaccagctgagcgtgaacgtgaccgagtag

SEQ ID NO: 98911 - DNA, 1500 bp, Artificial Sequence
  Description of Artificial Sequence: Synthetic coding sequence
atgctgctgctgctgctgctgctgcccctgctgtggggcaccaagggcatggagggcgacagacagtacggcgacggctacctgctgcaggtgcaggagctggtgaccgtgcaggagggcctgtgcgtgcacgtgccctgcagcttcagctacccccaggacggctggaccgacagcgaccccgtgcacggctactggttcagagccggcgacagaccctaccaggacgcccccgtggccaccaacaaccccgacagagaggtgcaggccgagacccagggcagattccagctgctgggcgacatctggagcaacgactgcagcctgagcatcagagacgccagaaagagagacaagggcagctacttcttcagactggagagaggcagcatgaagtggagctacaagagccagctgaactacaagaccaagcagctgagcgtgttcgtgaccgccctgacccacagacccgacatcctgatcctgggcaccctggagagcggccacagcagaaacctgacctgcagcgtgccctgggcctgcaagcagggcaccccccccatgatcagctggatcggcgccagcgtgagcagccccggccccaccaccgccagaagcagcgtgctgaccctgacccccaagccccaggaccacggcaccagcctgacctgccaggtgaccctgcccggcaccggcgtgaccaccaccagcaccgtgagactggacgtgagctaccccccctggaacctgaccatgaccgtgttccagggcgacgccaccgccagcaccgccctgggcaacggcagcagcctgagcgtgctggagggccagagcctgagactggtgtgcgccgtgaacagcaacccccccgccagactgagctggaccagaggcagcctgaccctgtgccccagcagaagcagcaaccccggcctgctggagctgcccagagtgcacgtgagagacgagggcgagttcacctgcagagcccagaacgcccagggcagccagcacatcagcctgagcctgagcctgcagaacgagggcaccggcaccagcagacccgtgagccaggtgaccctggccgccgtgggcggcgccggcgccaccgccctggccttcctgagcttctgcatcatcttcatcatcgtgagaagctgcagaaagaagagcgccagacccgccgccggcgtgggcgacaccggcatggaggacgccaaggccatcagaggcagcgccagccagggccccctgaccgagagctggaaggacggcaaccccctgaagaagcccccccccgccgtggcccccagcagcggcgaggagggcgagctgcactacgccaccctgagcttccacaaggtgaagccccaggacccccagggccaggaggccaccgacagcgagtacagcgagatcaagatccacaagagagagaccgccgagacccaggcctgcctgagaaaccacaaccccagcagcaaggaggtgagaggctag

SEQ ID NO: 98912 - DNA, 1221 bp, Artificial Sequence
  Description of Artificial Sequence: Synthetic coding sequence
atgctgctgctgctgctgctgctgcccctgctgtggggcaccaagggcatggagggcgacagacagtacggcgacggctacctgctgcaggtgcaggagctggtgaccgtgcaggagggcctgtgcgtgcacgtgccctgcagcttcagctacccccaggacggctggaccgacagcgaccccgtgcacggctactggttcagagccggcgacagaccctaccaggacgcccccgtggccaccaacaaccccgacagagaggtgcaggccgagacccagggcagattccagctgctgggcgacatctggagcaacgactgcagcctgagcatcagagacgccagaaagagagacaagggcagctacttcttcagactggagagaggcagcatgaagtggagctacaagagccagctgaactacaagaccaagcagctgagcgtgttcgtgaccgaccccccctggaacctgaccatgaccgtgttccagggcgacgccaccgccagcaccgccctgggcaacggcagcagcctgagcgtgctggagggccagagcctgagactggtgtgcgccgtgaacagcaacccccccgccagactgagctggaccagaggcagcctgaccctgtgccccagcagaagcagcaaccccggcctgctggagctgcccagagtgcacgtgagagacgagggcgagttcacctgcagagcccagaacgcccagggcagccagcacatcagcctgagcctgagcctgcagaacgagggcaccggcaccagcagacccgtgagccaggtgaccctggccgccgtgggcggcgccggcgccaccgccctggccttcctgagcttctgcatcatcttcatcatcgtgagaagctgcagaaagaagagcgccagacccgccgccggcgtgggcgacaccggcatggaggacgccaaggccatcagaggcagcgccagccagggccccctgaccgagagctggaaggacggcaaccccctgaagaagcccccccccgccgtggcccccagcagcggcgaggagggcgagctgcactacgccaccctgagcttccacaaggtgaagccccaggacccccagggccaggaggccaccgacagcgagtacagcgagatcaagatccacaagagagagaccgccgagacccaggcctgcctgagaaaccacaaccccagcagcaaggaggtgagaggctag

SEQ ID NO: 98913 - DNA, 1173 bp, Artificial Sequence
  Description of Artificial Sequence: Synthetic coding sequence
atgctgctgctgctgctgctgctgcccctgctgtggggcaccaagggcatggagggcgacagacagtacggcgacggctacctgctgcaggtgcaggagctggtgaccgtgcaggagggcctgtgcgtgcacgtgccctgcagcttcagctacccccaggacggctggaccgacagcgaccccgtgcacggctactggttcagagccggcgacagaccctaccaggacgcccccgtggccaccaacaaccccgacagagaggtgcaggccgagacccagggcagattccagctgctgggcgacatctggagcaacgactgcagcctgagcatcagagacgccagaaagagagacaagggcagctacttcttcagactggagagaggcagcatgaagtggagctacaagagccagctgaactacaagaccaagcagctgagcgtgttcgtgaccgccagcaccgccctgggcaacggcagcagcctgagcgtgctggagggccagagcctgagactggtgtgcgccgtgaacagcaacccccccgccagactgagctggaccagaggcagcctgaccctgtgccccagcagaagcagcaaccccggcctgctggagctgcccagagtgcacgtgagagacgagggcgagttcacctgcagagcccagaacgcccagggcagccagcacatcagcctgagcctgagcctgcagaacgagggcaccggcaccagcagacccgtgagccaggtgaccctggccgccgtgggcggcgccggcgccaccgccctggccttcctgagcttctgcatcatcttcatcatcgtgagaagctgcagaaagaagagcgccagacccgccgccggcgtgggcgacaccggcatggaggacgccaaggccatcagaggcagcgccagccagggccccctgaccgagagctggaaggacggcaaccccctgaagaagcccccccccgccgtggcccccagcagcggcgaggagggcgagctgcactacgccaccctgagcttccacaaggtgaagccccaggacccccagggccaggaggccaccgacagcgagtacagcgagatcaagatccacaagagagagaccgccgagacccaggcctgcctgagaaaccacaaccccagcagcaaggaggtgagaggctag

SEQ ID NO: 98914 - DNA, 1392 bp, Artificial Sequence
  Description of Artificial Sequence: Synthetic coding sequence
atgctgctgctgctgctgcccctgctgtggggcagagagagagccgagggccagaccagcaagctgctgaccatgcagagcagcgtgaccgtgcaggagggcctgtgcgtgcacgtgccctgcagcttcagctaccccagccacggctggatctaccccggccccgtggtgcacggctactggttcagagagggcgccaacaccgaccaggacgcccccgtggccaccaacaaccccgccagagccgtgtgggaggagaccagagacagattccacctgctgggcgacccccacaccaagaactgcaccctgagcatcagagacgccagaagaagcgacgccggcagatacttcttcagaatggagaagggcagcatcaagtggaactacaagcaccacagactgagcgtgaacgtgaccgccctgacccacagacccaacatcctgatccccggcaccctggagagcggctgcccccagaacctgacctgcagcgtgccctgggcctgcgagcagggcaccccccccatgatcagctggatcggcaccagcgtgagccccctggaccccagcaccaccagaagcagcgtgctgaccctgatcccccagccccaggaccacggcaccagcctgacctgccaggtgaccttccccggcgccagcgtgaccaccaacaagaccgtgcacctgaacgtgagctaccccccccagaacctgaccatgaccgtgttccagggcgacggcaccgtgagcaccgtgctgggcaacggcagcagcctgagcctgcccgagggccagagcctgagactggtgtgcgccgtggacgccgtggacagcaacccccccgccagactgagcctgagctggagaggcctgaccctgtgccccagccagcccagcaaccccggcgtgctggagctgccctgggtgcacctgagagacgccgccgagttcacctgcagagcccagaaccccctgggcagccagcaggtgtacctgaacgtgagcctgcagagcaaggccaccagcggcgtgacccagggcgtggtgggcggcgccggcgccaccgccctggtgttcctgagcttctgcgtgatcttcgtggtggtgagaagctgcagaaagaagagcgccagacccgccgccggcgtgggcgacaccggcatcgaggacgccaacgccgtgagaggcagcgccagccagggccccctgaccgagccctgggccgaggacagcccccccgaccagcccccccccgccagcgccagaagcagcgtgggcgagggcgagctgcagtacgccagcctgagcttccagatggtgaagccctgggacagcagaggccaggaggccaccgacaccgagtacagcgagatcaagatccacagatag

SEQ ID NO: 98915 - DNA, 1440 bp, Artificial Sequence
  Description of Artificial Sequence: Synthetic coding sequence
atgctgctgctgctgctgcccctgctgtggggcagagagagagccgagggccagaccagcaagctgctgaccatgcagagcagcgtgaccgtgcaggagggcctgtgcgtgcacgtgccctgcagcttcagctaccccagccacggctggatctaccccggccccgtggtgcacggctactggttcagagagggcgccaacaccgaccaggacgcccccgtggccaccaacaaccccgccagagccgtgtgggaggagaccagagacagattccacctgctgggcgacccccacaccaagaactgcaccctgagcatcagagacgccagaagaagcgacgccggcagatacttcttcagaatggagaagggcagcatcaagtggaactacaagcaccacagactgagcgtgaacgtgaccgccctgacccacagacccaacatcctgatccccggcaccctggagagcggctgcccccagaacctgacctgcagcgtgccctgggcctgcgagcagggcaccccccccatgatcagctggatcggcaccagcgtgagccccctggaccccagcaccaccagaagcagcgtgctgaccctgatcccccagccccaggaccacggcaccagcctgacctgccaggtgaccttccccggcgccagcgtgaccaccaacaagaccgtgcacctgaacgtgagctaccccccccagaacctgaccatgaccgtgttccagggcgacggcaccgtgagcaccgtgctgggcaacggcagcagcctgagcctgcccgagggccagagcctgagactggtgtgcgccgtggacgccgtggacagcaacccccccgccagactgagcctgagctggagaggcctgaccctgtgccccagccagcccagcaaccccggcgtgctggagctgccctgggtgcacctgagagacgccgccgagttcacctgcagagcccagaaccccctgggcagccagcaggtgtacctgaacgtgagcctgcagagcaaggccaccagcggcgtgacccagggcgtggtgggcggcgccggcgccaccgccctggtgttcctgagcttctgcgtgatcttcgtggtggtgagaagctgcagaaagaagagcgccagacccgccgccggcgtgggcgacaccggcatcgaggacgccaacgccgtgagaggcagcgccagccagatcctgaaccacttcatcggcttccccaccttcctgggcctgggcttcgagttcctgctgaacctgagagacctgtgctgccaccccgacagcgagttctacgtgtaccacttcagccacttcagactgatcaagaacatcgccggcgagatcgtgtggagcctggagggcaagatcctgtggctgctggacgtgagcgacttcttccactggttcttcctgatctgcgtgggctag

SEQ ID NO: 98916 - DNA, 735 bp, Artificial Sequence
  Description of Artificial Sequence: Synthetic coding sequence
atggccgccgccgccagccccgccttcctgctgtgcctgcccctgctgcacctgctgagcggctggagcagagccggctgggtggacacccactgcctgtgctacgacttcatcatcacccccaagagcagacccgagccccagtggtgcgaggtgcagggcctggtggacgagagacccttcctgcactacgactgcgtgaaccacaaggccaaggccttcgccagcctgggcaagaaggtgaacgtgaccaagacctgggaggagcagaccgagaccctgagagacgtggtggacttcctgaagggccagctgctggacatccaggtggagaacctgatccccatcgagcccctgaccctgcaggccagaatgagctgcgagcacgaggcccacggccacggcagaggcagctggcagttcctgttcaacggccagaagttcctgctgttcgacagcaacaacagaaagtggaccgccctgcaccccggcgccaagaagatgaccgagaagtgggagaagaacagagacgtgaccatgttcttccagaagatcagcctgggcgactgcaagatgtggctggaggagttcctgatgtactgggagcagatgctggaccccaccaagccccccagcctggcccccggcaccacccagcccaaggccatggccaccaccctgagcccctggagcctgctgatcatcttcctgtgcttcatcctggccggcagatag

SEQ ID NO: 98917 - DNA, 1248 bp, Artificial Sequence
  Description of Artificial Sequence: Synthetic coding sequence
atgaccggcgagagacccagcaccgccctgcccgacagaagatggggccccagaatcctgggcttctggggcggctgcagagtgtgggtgttcgccgccatcttcctgctgctgagcctggccgccagctggagcaaggccgagaacgacttcggcctggtgcagcccctggtgaccatggagcagctgctgtgggtgagcggcagacagatcggcagcgtggacaccttcagaatccccctgatcaccgccacccccagaggcaccctgctggccttcgccgaggccagaaagatgagcagcagcgacgagggcgccaagttcatcgccctgagaagaagcatggaccagggcagcacctggagccccaccgccttcatcgtgaacgacggcgacgtgcccgacggcctgaacctgggcgccgtggtgagcgacgtggagaccggcgtggtgttcctgttctacagcctgtgcgcccacaaggccggctgccaggtggccagcaccatgctggtgtggagcaaggacgacggcgtgagctggagcacccccagaaacctgagcctggacatcggcaccgaggtgttcgcccccggccccggcagcggcatccagaagcagagagagcccagaaagggcagactgatcgtgtgcggccacggcaccctggagagagacggcgtgttctgcctgctgagcgacgaccacggcgccagctggagatacggcagcggcgtgagcggcatcccctacggccagcccaagcaggagaacgacttcaaccccgacgagtgccagccctacgagctgcccgacggcagcgtggtgatcaacgccagaaaccagaacaactaccactgccactgcagaatcgtgctgagaagctacgacgcctgcgacaccctgagacccagagacgtgaccttcgaccccgagctggtggaccccgtggtggccgccggcgccgtggtgaccagcagcggcatcgtgttcttcagcaaccccgcccaccccgagttcagagtgaacctgaccctgagatggagcttcagcaacggcaccagctggagaaaggagaccgtgcagctgtggcccggccccagcggctacagcagcctggccaccctggagggcagcatggacggcgaggagcaggccccccagctgtacgtgctgtacgagaagggcagaaaccactacaccgagagcatcagcgtggccaagatcagcgtgtacggcaccctgtag

SEQ ID NO: 98918 - DNA, 1248 bp, Artificial Sequence; identical to SEQ ID NO: 98917
  Description of Artificial Sequence: Synthetic coding sequence

SEQ ID NO: 98919 - DNA, 1248 bp, Artificial Sequence; identical to SEQ ID NO: 98917
  Description of Artificial Sequence: Synthetic coding sequence

SEQ ID NO: 98920 - DNA, 1248 bp, Artificial Sequence; identical to SEQ ID NO: 98917
  Description of Artificial Sequence: Synthetic coding sequence

SEQ ID NO: 98921 - DNA, 1248 bp, Artificial Sequence; identical to SEQ ID NO: 98917
  Description of Artificial Sequence: Synthetic coding sequence

SEQ ID NO: 98922 - DNA, 1248 bp, Artificial Sequence; identical to SEQ ID NO: 98917
  Description of Artificial Sequence: Synthetic coding sequence

SEQ ID NO: 98923 - DNA, 1248 bp, Artificial Sequence; identical to SEQ ID NO: 98917
  Description of Artificial Sequence: Synthetic coding sequence

SEQ ID NO: 98924 - DNA, 2277 bp, Artificial Sequence
  Description of Artificial Sequence: Synthetic coding sequence
atggccgtgagcgccggcagcgccagaaccagccccagcagcgacaaggtgcagaaggacaaggccgagctgatcagcggccccagacaggacagcagaatcggcaagctgctgggcttcgagtggaccgacctgagcagctggagaagactggtgaccctgctgaacagacccaccgaccccgccagcctggccgtgttcagattcctgttcggcttcctgatggtgctggacatcccccaggagagaggcctgagcagcctggacagaaagtacctggacggcctggacgtgtgcagattccccctgctggacgccctgagacccctgcccctggactggatgtacctggtgtacaccatcatgttcctgggcgccctgggcatgatgctgggcctgtgctacagaatcagctgcgtgctgttcctgctgccctactggtacgtgttcctgctggacaagaccagctggaacaaccacagctacctgtacggcctgctggccttccagctgaccttcatggacgccaaccactactggagcgtggacggcctgctgaacgcccacagaagaaacgcccacgtgcccctgtggaactacgccgtgctgagaggccagatcttcatcgtgtacttcatcgccggcgtgaagaagctggacgccgactgggtggagggctacagcatggagtacctgagcagacactggctgttcagccccttcaagctgctgctgagcgaggagctgaccagcctgctggtggtgcactggggcggcctgctgctggacctgagcgccggcttcctgctgttcttcgacgtgagcagaagcatcggcctgttcttcgtgagctacttccactgcatgaacagccagctgttcagcatcggcatgttcagctacgtgatgctggccagcagccccctgttctgcagccccgagtggcccagaaagctggtgagctactgccccagaagactgcagcagctgctgcccctgaaggccgccccccagcccagcgtgagctgcgtgtacaagagaagcagaggcaagagcggccagaagcccggcctgagacaccagctgggcgccgccttcaccctgctgtacctgctggagcagctgttcctgccctacagccacttcctgacccagggctacaacaactggaccaacggcctgtacggctacagctgggacatgatggtgcacagcagaagccaccagcacgtgaagatcacctacagagacggcagaaccggcgagctgggctacctgaaccccggcgtgttcacccagagcagaagatggaaggaccacgccgacatgctgaagcagtacgccacctgcctgagcagactgctgcccaagtacaacgtgaccgagccccagatctacttcgacatctgggtgagcatcaacgacagattccagcagagaatcttcgaccccagagtggacatcgtgcaggccgcctggagccccttccagagaaccagctgggtgcagcccctgctgatggacctgagcccctggagagccaagctgcaggagatcaagagcagcctggacaaccacaccgaggtggtgttcatcgccgacttccccggcctgcacctggagaacttcgtgagcgaggacctgggcaacaccagcatccagctgctgcagggcgaggtgaccgtggagctggtggccgagcagaagaaccagaccctgagagagggcgagaagatgcagctgcccgccggcgagtaccacaaggtgtacaccaccagccccagccccagctgctacatgtacgtgtacgtgaacaccaccgagctggccctggagcaggacctggcctacctgcaggagctgaaggagaaggtggagaacggcagcgagaccggccccctgccccccgagctgcagcccctgctggagggcgaggtgaagggcggccccgagcccacccccctggtgcagaccttcctgagaagacagcagagactgcaggagatcgagagaagaagaaacacccccttccacgagagattcttcagattcctgctgagaaagctgtacgtgttcagaagaagcttcctgatgacctgcatcagcctgagaaacctgatcctgggcagacccagcctggagcagctggcccaggaggtgacctacgccaacctgagacccttcgaggccgtgggcgagctgaaccccagcaacaccgacagcagccacagcaacccccccgagagcaaccccgaccccgtgcacagcgagttctag

SEQ ID NO: 98925 - DNA, 1386 bp, Artificial Sequence
  Description of Artificial Sequence: Synthetic coding sequence
atgagacccgccgacctgccccccagacccatggaggagagccccgccagcagcagcgcccccaccgagaccgaggagcccggcagcagcgccgaggtgatggaggaggtgaccacctgcagcttcaacagccccctgttcagacaggaggacgacagaggcatcacctacagaatccccgccctgctgtacatcccccccacccacaccttcctggccttcgccgagaagagaagcaccagaagagacgaggacgccctgcacctggtgctgagaagaggcctgagaatcggccagctggtgcagtggggccccctgaagcccctgatggaggccaccctgcccggccacagaaccatgaacccctgccccgtgtgggagcagaagagcggctgcgtgttcctgttcttcatctgcgtgagaggccacgtgaccgagagacagcagatcgtgagcggcagaaacgccgccagactgtgcttcatctacagccaggacgccggctgcagctggagcgaggtgagagacctgaccgaggaggtgatcggcagcgagctgaagcactgggccaccttcgccgtgggccccggccacggcatccagctgcagagcggcagactggtgatccccgcctacacctactacatccccagctggttcttctgcttccagctgccctgcaagaccagaccccacagcctgatgatctacagcgacgacctgggcgtgacctggcaccacggcagactgatcagacccatggtgaccgtggagtgcgaggtggccgaggtgaccggcagagccggccaccccgtgctgtactgcagcgccagaacccccaacagatgcagagccgaggccctgagcaccgaccacggcgagggcttccagagactggccctgagcagacagctgtgcgagcccccccacggctgccagggcagcgtggtgagcttcagacccctggagatcccccacagatgccaggacagcagcagcaaggacgcccccaccatccagcagagcagccccggcagcagcctgagactggaggaggaggccggcacccccagcgagagctggctgctgtacagccaccccaccagcagaaagcagagagtggacctgggcatctacctgaaccagacccccctggaggccgcctgctggagcagaccctggatcctgcactgcggcccctgcggctacagcgacctggccgccctggaggaggagggcctgttcggctgcctgttcgagtgcggcaccaagcaggagtgcgagcagatcgccttcagactgttcacccacagagagatcctgagccacctgcagggcgactgcaccagccccggcagaaaccccagccagttcaagagcaactag

SEQ ID NO: 98926 - DNA, 1386 bp, Artificial Sequence; identical to SEQ ID NO: 98925
  Description of Artificial Sequence: Synthetic coding sequence

SEQ ID NO: 98927 - DNA, 1287 bp, Artificial Sequence
  Description of Artificial Sequence: Synthetic coding sequence
atggaggaggtgaccacctgcagcttcaacagccccctgttcagacaggaggacgacagaggcatcacctacagaatccccgccctgctgtacatcccccccacccacaccttcctggccttcgccgagaagagaagcaccagaagagacgaggacgccctgcacctggtgctgagaagaggcctgagaatcggccagctggtgcagtggggccccctgaagcccctgatggaggccaccctgcccggccacagaaccatgaacccctgccccgtgtgggagcagaagagcggctgcgtgttcctgttcttcatctgcgtgagaggccacgtgaccgagagacagcagatcgtgagcggcagaaacgccgccagactgtgcttcatctacagccaggacgccggctgcagctggagcgaggtgagagacctgaccgaggaggtgatcggcagcgagctgaagcactgggccaccttcgccgtgggccccggccacggcatccagctgcagagcggcagactggtgatccccgcctacacctactacatccccagctggttcttctgcttccagctgccctgcaagaccagaccccacagcctgatgatctacagcgacgacctgggcgtgacctggcaccacggcagactgatcagacccatggtgaccgtggagtgcgaggtggccgaggtgaccggcagagccggccaccccgtgctgtactgcagcgccagaacccccaacagatgcagagccgaggccctgagcaccgaccacggcgagggcttccagagactggccctgagcagacagctgtgcgagcccccccacggctgccagggcagcgtggtgagcttcagacccctggagatcccccacagatgccaggacagcagcagcaaggacgcccccaccatccagcagagcagccccggcagcagcctgagactggaggaggaggccggcacccccagcgagagctggctgctgtacagccaccccaccagcagaaagcagagagtggacctgggcatctacctgaaccagacccccctggaggccgcctgctggagcagaccctggatcctgcactgcggcccctgcggctacagcgacctggccgccctggaggaggagggcctgttcggctgcctgttcgagtgcggcaccaagcaggagtgcgagcagatcgccttcagactgttcacccacagagagatcctgagccacctgcagggcgactgcaccagccccggcagaaaccccagccagttcaagagcaactag

SEQ ID NO: 98928 - DNA, 1059 bp, Artificial Sequence
  Description of Artificial Sequence: Synthetic coding sequence
atggaggccaccctgcccggccacagaaccatgaacccctgccccgtgtgggagcagaagagcggctgcgtgttcctgttcttcatctgcgtgagaggccacgtgaccgagagacagcagatcgtgagcggcagaaacgccgccagactgtgcttcatctacagccaggacgccggctgcagctggagcgaggtgagagacctgaccgaggaggtgatcggcagcgagctgaagcactgggccaccttcgccgtgggccccggccacggcatccagctgcagagcggcagactggtgatccccgcctacacctactacatccccagctggttcttctgcttccagctgccctgcaagaccagaccccacagcctgatgatctacagcgacgacctgggcgtgacctggcaccacggcagactgatcagacccatggtgaccgtggagtgcgaggtggccgaggtgaccggcagagccggccaccccgtgctgtactgcagcgccagaacccccaacagatgcagagccgaggccctgagcaccgaccacggcgagggcttccagagactggccctgagcagacagctgtgcgagcccccccacggctgccagggcagcgtggtgagcttcagacccctggagatcccccacagatgccaggacagcagcagcaaggacgcccccaccatccagcagagcagccccggcagcagcctgagactggaggaggaggccggcacccccagcgagagctggctgctgtacagccaccccaccagcagaaagcagagagtggacctgggcatctacctgaaccagacccccctggaggccgcctgctggagcagaccctggatcctgcactgcggcccctgcggctacagcgacctggccgccctggaggaggagggcctgttcggctgcctgttcgagtgcggcaccaagcaggagtgcgagcagatcgccttcagactgttcacccacagagagatcctgagccacctgcagggcgactgcaccagccccggcagaaaccccagccagttcaagagcaactag

SEQ ID NO: 98929 - DNA, 1203 bp, Artificial Sequence
  Description of Artificial Sequence: Synthetic coding sequence
atggccaccctgctgctgctgctgggcgtgctggtggtgagccccgacgccctgggcagcaccaccgccgtgcagacccccaccagcggcgagcccctggtgagcaccagcgagcccctgagcagcaagatgtacaccaccagcatcaccagcgaccccaaggccgacagcaccggcgaccagaccagcgccctgccccccagcaccagcatcaacgagggcagccccctgtggaccagcatcggcgccagcaccggcagccccctgcccgagcccaccacctaccaggaggtgagcatcaagatgagcagcgtgccccaggagaccccccacgccaccagccaccccgccgtgcccatcaccgccaacagcctgggcagccacaccgtgaccggcggcaccatcaccaccaacagccccgagaccagcagcagaaccagcggcgcccccgtgaccaccgccgccagcagcctggagaccagcagaggcaccagcggcccccccctgaccatggccaccgtgagcctggagaccagcaagggcaccagcggcccccccgtgaccatggccaccgacagcctggagaccagcaccggcaccaccggcccccccgtgaccatgaccaccggcagcctggagcccagcagcggcgccagcggcccccaggtgagcagcgtgaagctgagcaccatgatgagccccaccaccagcaccaacgccagcaccgtgcccttcagaaaccccgacgagaacagcagaggcatgctgcccgtggccgtgctggtggccctgctggccgtgatcgtgctggtggccctgctgctgctgtggagaagaagacagaagagaagaaccggcgccctggtgctgagcagaggcggcaagagaaacggcgtggtggacgcctgggccggccccgcccaggtgcccgaggagggcgccgtgaccgtgaccgtgggcggcagcggcggcgacaagggcagcggcttccccgacggcgagggcagcagcagaagacccaccctgaccaccttcttcggcagaagaaagagcagacagggcagcctggccatggaggagctgaagagcggcagcggccccagcctgaagggcgaggaggagcccctggtggccagcgaggacggcgccgtggacgcccccgcccccgacgagcccgagggcggcgacggcgccgccccctag

SEQ ID NO: 98930 - DNA, 1203 bp, Artificial Sequence; identical to SEQ ID NO: 98929
  Description of Artificial Sequence: Synthetic coding sequence

SEQ ID NO: 98931 - DNA, 1068 bp, Artificial Sequence
  Description of Artificial Sequence: Synthetic coding sequence
atggccaccctgctgctgctgctgggcgtgctggtggtgagccccgacgccctgggcagcaccaccgccgtgcagacccccaccagcggcgagcccctggtgagcaccagcgagcccctgagcagcaagatgtacaccaccagcatcaccagcgaccccaaggccgacagcaccggcgaccagaccagcgccctgccccccagcaccagcatcaacgagggcagccccctgtggaccagcatcggcgccagcaccggcagccccctgcccgagcccaccacctaccaggaggtgagcatcaagatgagcagcgtgccccaggagaccccccacgccaccagccaccccgccgtgcccatcaccgccaacagcctgggcagccacaccgtgaccggcggcaccatcaccaccaacagccccgagaccagcagcagaaccagcggcgcccccgtgaccaccgccgccagcagcctggagaccagcagaggcaccagcggcccccccctgaccatggccaccgtgagcctggagaccagcaagggcaccagcggcccccccgtgaccatggccaccgacagcctggagaccagcaccggcaccaccggcccccccgtgaccatgaccaccggcagcctggagcccagcagcggcgccagcggcccccaggtgagcagcgtgaagctgagcaccatgatgagccccaccaccagcaccaacgccagcaccgtgcccttcagaaaccccgacgagaacagcagaggcatgctgcccgtggccgtgctggtggccctgctggccgtgatcgtgctggtggccctgctgctgctgtggagaagaagacagaagagaagaaccggcgccctggtgctgagcagaggcggcaagagaaacggcgtggtggacgcctgggccggccccgcccaggtgcccgaggagggcgccgtgaccgtgaccgtgggcggcagcggcggcgacaagggcagcggcttccccgacggcgagggcagcagcagaagacccaccctgaccaccttcttcggcagaagaaagagcagacagggcagctag

SEQ ID NO: 98932 - DNA, 672 bp, Artificial Sequence
  Description of Artificial Sequence: Synthetic coding sequence
atgcagtgggccgtgggcagaagatgggcctgggccgccctgctgctggccgtggccgccgtgctgacccaggtggtgtggctgtggctgggcacccagagcttcgtgttccagagagaggagatcgcccagctggccagacagtacgccggcctggaccacgagctggccttcagcagactgatcgtggagctgagaagactgcaccccggccacgtgctgcccgacgaggagctgcagtgggtgttcgtgaacgccggcggctggatgggcgccatgtgcctgctgcacgccagcctgagcgagtacgtgctgctgttcggcaccgccctgggcagcagaggccacagcggcagatactgggccgagatcagcgacaccatcatcagcggcaccttccaccagtggagagagggcaccaccaagagcgaggtgttctaccccggcgagaccgtggtgcacggccccggcgaggccaccgccgtggagtggggccccaacacctggatggtggagtacggcagaggcgtgatccccagcaccctggccttcgccctggccgacaccgtgttcagcacccaggacttcctgaccctgttctacaccctgagaagctacgccagaggcctgagactggagctgaccacctacctgttcggccaggacccctag

SEQ ID NO: 98933 - DNA, 570 bp, Artificial Sequence
  Description of Artificial Sequence: Synthetic coding sequence
atgcagtgggccgtgggcagaagatgggcctgggccgccctgctgctggccgtggccgccgtgctgacccaggtggtgtggctgtggctgggcctggaccacgagctggccttcagcagactgatcgaggagctgcagtgggtgttcgtgaacgccggcggctggatgggcgccatgtgcctgctgcacgccagcctgagcgagtacgtgctgctgttcggcaccgccctgggcagcagaggccacagcggcagatactgggccgagatcagcgacaccatcatcagcggcaccttccaccagtggagagagggcaccaccaagagcgaggtgttctaccccggcgagaccgtggtgcacggccccggcgaggccaccgccgtggagtggggccccaacacctggatggtggagtacggcagaggcgtgatccccagcaccctggccttcgccctggccgacaccgtgttcagcacccaggacttcctgaccctgttctacaccctgagaagctacgccagaggcctgagactggagctgaccacctacctgttcggccaggacccctag

SEQ ID NO: 98934 - DNA, 405 bp, Artificial Sequence
  Description of Artificial Sequence: Synthetic coding sequence
atgggcgccatgtgcctgctgcacgccagcctgagcgagtacgtgctgctgttcggcaccgccctgggcagcagaggccacagcggcagatactgggccgagatcagcgacaccatcatcagcggcaccttccaccagtggagagagggcaccaccaagagcgaggtgttctaccccggcgagaccgtggtgcacggccccggcgaggccaccgccgtggagtggggccccaacacctggatggtggagtacggcagaggcgtgatccccagcaccctggccttcgccctggccgacaccgtgttcagcacccaggacttcctgaccctgttctacaccctgagaagctacgccagaggcctgagactggagctgaccacctacctgttcggccaggacccctag

SEQ ID NO: 98935 - DNA, 579 bp, Artificial Sequence
  Description of Artificial Sequence: Synthetic coding sequence
atgcagtgggccgtgggcagaagatgggcctgggccgccctgctgctggccgtggccgccgtgctgacccaggtggtgtggctgtggctgggcacccagagcttcgtgttccagagagaggagatcgcccagctggccagacagtacgccggcctggaccacgagctggccttcagcagactgatcgtggagctgagaagactgcaccccggccacgtgctgcccgacgaggagctgcagtgggtgttcgtgaacgccggcggctggatgggcgccatgtgcctgctgcacgccagcctgagcgagtacgtgctgctgttcggcaccgccctgggcagcagaggccacagcggcgagaccgtggtgcacggccccggcgaggccaccgccgtggagtggggccccaacacctggatggtggagtacggcagaggcgtgatccccagcaccctggccttcgccctggccgacaccgtgttcagcacccaggacttcctgaccctgttctacaccctgagaagctacgccagaggcctgagactggagctgaccacctacctgttcggccaggacccctag

SEQ ID NO: 98936 - DNA, 2916 bp, Artificial Sequence
  Description of Artificial Sequence: Synthetic coding sequence
atgggcgtggccggcagaaacagacccggcgccgcctgggccgtgctgctgctgctgctgctgctgccccccctgctgctgctggccggcgccgtgccccccggcagaggcagagccgccggcccccaggaggacgtggacgagtgcgcccagggcctggacgactgccacgccgacgccctgtgccagaacacccccaccagctacaagtgcagctgcaagcccggctaccagggcgagggcagacagtgcgaggacatcgacgagtgcggcaacgagctgaacggcggctgcgtgcacgactgcctgaacatccccggcaactacagatgcacctgcttcgacggcttcatgctggcccacgacggccacaactgcctggacgtggacgagtgcctggagaacaacggcggctgccagcacacctgcgtgaacgtgatgggcagctacgagtgctgctgcaaggagggcttcttcctgagcgacaaccagcacacctgcatccacagaagcgaggagggcctgagctgcatgaacaaggaccacggctgcagccacatctgcaaggaggcccccagaggcagcgtggcctgcgagtgcagacccggcttcgagctggccaagaaccagagagactgcatcctgacctgcaaccacggcaacggcggctgccagcacagctgcgacgacaccgccgacggccccgagtgcagctgccacccccagtacaagatgcacaccgacggcagaagctgcctggagagagaggacaccgtgctggaggtgaccgagagcaacaccaccagcgtggtggacggcgacaagagagtgaagagaagactgctgatggagacctgcgccgtgaacaacggcggctgcgacagaacctgcaaggacaccagcaccggcgtgcactgcagctgccccgtgggcttcaccctgcagctggacggcaagacctgcaaggacatcgacgagtgccagaccagaaacggcggctgcgaccacttctgcaagaacatcgtgggcagcttcgactgcggctgcaagaagggcttcaagctgctgaccgacgagaagagctgccaggacgtggacgagtgcagcctggacagaacctgcgaccacagctgcatcaaccaccccggcaccttcgcctgcgcctgcaacagaggctacaccctgtacggcttcacccactgcggcgacaccaacgagtgcagcatcaacaacggcggctgccagcaggtgtgcgtgaacaccgtgggcagctacgagtgccagtgccaccccggctacaagctgcactggaacaagaaggactgcgtggaggtgaagggcctgctgcccaccagcgtgagccccagagtgagcctgcactgcggcaagagcggcggcggcgacggctgcttcctgagatgccacagcggcatccacctgagcagcggcctgcagggcgcctacagcgtgacctgcggcagcagcagccccctgagaaacaagcagcagaagagcaacgacagcgccttcggcgacgtgaccaccatcagaaccagcgtgaccttcaagctgaacgagggcaagtgcagcctgaagaacgccgagctgttccccgagggcctgagacccgccctgcccgagaagcacagcagcgtgaaggagagcttcagatacgtgaacctgacctgcagcagcggcaagcaggtgcccggcgcccccggcagacccagcacccccaaggagatgttcatcaccgtggagttcgagctggagaccaaccagaaggaggtgaccgccagctgcgacctgagctgcatcgtgaagagaaccgagaagagactgagaaaggccatcagaaccctgagaaaggccgtgcacagagagcagttccacctgcagctgagcggcatgaacctggacgtggccaagaagccccccagaaccagcgagagacaggccgagagctgcggcgtgggccagggccacgccgagaaccagtgcggcctgtgccagcccggcgagtacagcgccgacggcttcgccccctgccacctgtgcgccctgggcaccttccagcccgaggccggcagaaccagctgcttcccctgcggcggcggcctggccaccaagcaccagggcgccaccagcttccaggactgcgagaccagagtgcagtgcagccccggccacttctacaacaccaccacccacagatgcatcagatgccccgtgggcacctaccagcccgagttcggcaagaacaactgcgtgagctgccccggcaacaccaccaccgacttcgacggcagcaccaacatcacccagtgcaagaacagaagatgcggcggcgagctgggcgacttcaccggctacatcgagagccccaactaccccggcaactaccccgccaacaccgagtgcacctggaccatcaaccccccccccaagagaagaatcctgatcgtggtgcccgagatcttcctgcccatcgaggacgactgcggcgactacctggtgatgagaaagaccagcagcagcaacagcgtgaccacctacgagacctgccagacctacgagagacccatcgccttcaccagcagaagcaagaagctgtggatccagttcaagagcaacgagggcaacagcgccagaggcttccaggtgccctacgtgacctacgacgaggactaccaggagctgatcgaggacatcgtgagagacggcagactgtacgccagcgagaaccaccaggagatcctgaaggacaagaagctgatcaaggccctgttcgacgtgctggcccacccccagaactacttcaagtacaccgcccaggagagcagagagatgttccccagaagcttcatcagactgctgagaagcaaggtgagcagattcctgagaccctacaagtag

SEQ ID NO: 98937 - DNA, 1044 bp, Artificial Sequence
  Description of Artificial Sequence: Synthetic coding sequence
atgggcgccgccgccgtgagatggcacctgtgcgtgctgctggccctgggcaccagaggcagactggccggcggcagcggcctgcccggcagcgtggacgtggacgagtgcagcgagggcaccgacgactgccacatcgacgccatctgccagaacacccccaagagctacaagtgcctgtgcaagcccggctacaagggcgagggcaagcagtgcgaggacatcgacgagtgcgagaacgactactacaacggcggctgcgtgcacgagtgcatcaacatccccggcaactacagatgcacctgcttcgacggcttcatgctggcccacgacggccacaactgcctggacgtggacgagtgccaggacaacaacggcggctgccagcagatctgcgtgaacgccatgggcagctacgagtgccagtgccacagcggcttcttcctgagcgacaaccagcacacctgcatccacagaagcaacgagggcatgaactgcatgaacaaggaccacggctgcgcccacatctgcagagagacccccaagggcggcgtggcctgcgactgcagacccggcttcgacctggcccagaaccagaaggactgcaccctgacctgcaactacggcaacggcggctgccagcacagctgcgaggacaccgacaccggccccacctgcggctgccaccagaagtacgccctgcacagcgacggcagaacctgcatcgagaaggacgaggccgccatcgagagaagccagttcaacgccaccagcgtggccgacgtggacaagagagtgaagagaagactgctgatggagacctgcgccgtgaacaacggcggctgcgacagaacctgcaaggacaccgccaccggcgtgagatgcagctgccccgtgggcttcaccctgcagcccgacggcaagacctgcaagggccagcacgtggagctgtgcggctgcccctgcctgtactggcccggccaggagcccccctgcgcctgcatcgccggccccagagccggcctgaacggcggccacgtgtag

SEQ ID NO: 98938 - DNA, 2967 bp, Artificial Sequence
  Description of Artificial Sequence: Synthetic coding sequence
atgggcgccgccgccgtgagatggcacctgtgcgtgctgctggccctgggcaccagaggcagactggccggcggcagcggcctgcccggcagcgtggacgtggacgagtgcagcgagggcaccgacgactgccacatcgacgccatctgccagaacacccccaagagctacaagtgcctgtgcaagcccggctacaagggcgagggcaagcagtgcgaggacatcgacgagtgcgagaacgactactacaacggcggctgcgtgcacgagtgcatcaacatccccggcaactacagatgcacctgcttcgacggcttcatgctggcccacgacggccacaactgcctggacgtggacgagtgccaggacaacaacggcggctgccagcagatctgcgtgaacgccatgggcagctacgagtgccagtgccacagcggcttcttcctgagcgacaaccagcacacctgcatccacagaagcaacgagggcatgaactgcatgaacaaggaccacggctgcgcccacatctgcagagagacccccaagggcggcgtggcctgcgactgcagacccggcttcgacctggcccagaaccagaaggactgcaccctgacctgcaactacggcaacggcggctgccagcacagctgcgaggacaccgacaccggccccacctgcggctgccaccagaagtacgccctgcacagcgacggcagaacctgcatcgagacctgcgccgtgaacaacggcggctgcgacagaacctgcaaggacaccgccaccggcgtgagatgcagctgccccgtgggcttcaccctgcagcccgacggcaagacctgcaaggacatcaacgagtgcctggtgaacaacggcggctgcgaccacttctgcagaaacaccgtgggcagcttcgagtgcggctgcagaaagggctacaagctgctgaccgacgagagaacctgccaggacatcgacgagtgcagcttcgagagaacctgcgaccacatctgcatcaacagccccggcagcttccagtgcctgtgccacagaggctacatcctgtacggcaccacccactgcggcgacgtggacgagtgcagcatgagcaacggcagctgcgaccagggctgcgtgaacaccaagggcagctacgagtgcgtgtgcccccccggcagaagactgcactggaacggcaaggactgcgtggagaccggcaagtgcctgagcagagccaagaccagccccagagcccagctgagctgcagcaaggccggcggcgtggagagctgcttcctgagctgccccgcccacaccctgttcgtgcccgacagcgagaacagctacgtgctgagctgcggcgtgcccggcccccagggcaaggccctgcagaagagaaacggcaccagcagcggcctgggccccagctgcagcgacgcccccaccacccccatcaagcagaaggccagattcaagatcagagacgccaagtgccacctgagaccccacagccaggccagagccaaggagaccgccagacagcccctgctggaccactgccacgtgaccttcgtgaccctgaagtgcgacagcagcaagaagagaagaagaggcagaaagagccccagcaaggaggtgagccacatcaccgccgagttcgagatcgagaccaagatggaggaggccagcgacacctgcgaggccgactgcctgagaaagagagccgagcagagcctgcaggccgccatcaagaccctgagaaagagcatcggcagacagcagttctacgtgcaggtgagcggcaccgagtacgaggtggcccagagacccgccaaggccctggagggccagggcgcctgcggcgccggccaggtgctgcaggacagcaagtgcgtggcctgcggccccggcacccacttcggcggcgagctgggccagtgcgtgagctgcatgcccggcacctaccaggacatggagggccagctgagctgcaccccctgccccagcagcgacggcctgggcctgcccggcgccagaaacgtgagcgagtgcggcggccagtgcagccccggcttcttcagcgccgacggcttcaagccctgccaggcctgccccgtgggcacctaccagcccgagcccggcagaaccggctgcttcccctgcggcggcggcctgctgaccaagcacgagggcaccaccagcttccaggactgcgaggccaaggtgcactgcagccccggccaccactacaacaccaccacccacagatgcatcagatgccccgtgggcacctaccagcccgagttcggccagaaccactgcatcacctgccccggcaacaccagcaccgacttcgacggcagcaccaacgtgacccactgcaagaaccagcactgcggcggcgagctgggcgactacaccggctacatcgagagccccaactaccccggcgactaccccgccaacgccgagtgcgtgtggcacatcgcccccccccccaagagaagaatcctgatcgtggtgcccgagatcttcctgcccatcgaggacgagtgcggcgacgtgctggtgatgagaaagagcgccagccccaccagcatcaccacctacgagacctgccagacctacgagagacccatcgccttcaccagcagaagcagaaagctgtggatccagttcaagagcaacgagggcaacagcggcaagggcttccaggtgccctacgtgacctacgacgaggactaccagcagctgatcgaggacatcgtgagagacggcagactgtacgccagcgagaaccaccaggagatcctgaaggacaagaagctgatcaaggccctgttcgacgtgctggcccacccccagaactacttcaagtacaccgcccaggagagcaaggagatgttccccagaagcttcatcaagctgctgagaagcaaggtgagcagattcctgagaccctacaagtag

SEQ ID NO: 98939 - DNA, 1857 bp, Artificial Sequence
  Description of Artificial Sequence: Synthetic coding sequence
atggagaccgaggccgccagcaccgccgtgagaacccagacccaggcccccagagtggtggccaccagaagcacccccagcacccagaccgtggccagagccagcagaagagcccagagcatcaccgaggccgccaccggccacgccagaacccagcccctggcctgcgacgccgccgcccccctggacagccactgcagcagaaccggcagacacgccaagaccagcaccagcgcctggagcaccaccgaggccgccaccaccagcgccgccaccccctgggccgccagcagcgccgccgccggcagagccaccagctgcagccccaccagcgcccccgccagaaccagcaccagcgcccccagcagcggccccgtgaccaccagcgccagcaccccccaggccagagccaaggagaccgccagacagcccctgctggaccactgccacgtgaccttcgtgaccctgaagtgcgacagcagcaagaagagaagaagaggcagaaagagccccagcaaggaggtgagccacatcaccgccgagttcgagatcgagaccaagatggaggaggccagcgacacctgcgaggccgactgcctgagaaagagagccgagcagagcctgcaggccgccatcaagaccctgagaaagagcatcggcagacagcagttctacgtgcaggtgagcggcaccgagtacgaggtggcccagagacccgccaaggccctggagggccagggcgcctgcggcgccggccaggtgctgcaggacagcaagtgcgtggcctgcggccccggcacccacttcggcggcgagctgggccagtgcgtgagctgcatgcccggcacctaccaggacatggagggccagctgagctgcaccccctgccccagcagcgacggcctgggcctgcccggcgccagaaacgtgagcgagtgcggcggccagtgcagccccggcttcttcagcgccgacggcttcaagccctgccaggcctgccccgtgggcacctaccagcccgagcccggcagaaccggctgcttcccctgcggcggcggcctgctgaccaagcacgagggcaccaccagcttccaggactgcgaggccaaggtgcactgcagccccggccaccactacaacaccaccacccacagatgcatcagatgccccgtgggcacctaccagcccgagttcggccagaaccactgcatcacctgccccggcaacaccagcaccgacttcgacggcagcaccaacgtgacccactgcaagaaccagcactgcggcggcgagctgggcgactacaccggctacatcgagagccccaactaccccggcgactaccccgccaacgccgagtgcgtgtggcacatcgcccccccccccaagagaagaatcctgatcgtggtgcccgagatcttcctgcccatcgaggacgagtgcggcgacgtgctggtgatgagaaagagcgccagccccaccagcatcaccacctacgagacctgccagacctacgagagacccatcgccttcaccagcagaagcagaaagctgtggatccagttcaagagcaacgagggcaacagcggcaagggcttccaggtgccctacgtgacctacgacgaggactaccagcagctgatcgaggacatcgtgagagacggcagactgtacgccagcgagaaccaccaggagatcctgaaggacaagaagctgatcaaggccctgttcgacgtgctggcccacccccagaactacttcaagtacaccgcccaggagagcaaggagatgttccccagaagcttcatcaagctgctgagaagcaaggtgagcagattcctgagaccctacaagtag

SEQ ID NO: 98940 - DNA, 1092 bp, Artificial Sequence
  Description of Artificial Sequence: Synthetic coding sequence
atgggcgccgccgccgtgagatggcacctgtgcgtgctgctggccctgggcaccagaggcagactggccggcggcagcggcctgcccggcagcgtggacgtggacgagtgcagcgagggcaccgacgactgccacatcgacgccatctgccagaacacccccaagagctacaagtgcctgtgcaagcccggctacaagggcgagggcaagcagtgcgaggacatcgacgagtgcgagaacgactactacaacggcggctgcgtgcacgagtgcatcaacatccccggcaactacagatgcacctgcttcgacggcttcatgctggcccacgacggccacaactgcctggacgtggacgagtgccaggacaacaacggcggctgccagcagatctgcgtgaacgccatgggcagctacgagtgccagtgccacagcggcttcttcctgagcgacaaccagcacacctgcatccacagaagcaacgagggcatgaactgcatgaacaaggaccacggctgcgcccacatctgcagagagacccccaagggcggcgtggcctgcgactgcagacccggcttcgacctggcccagaaccagaaggactgcaccctgacctgcaactacggcaacggcggctgccagcacagctgcgaggacaccgacaccggccccacctgcggctgccaccagaagtacgccctgcacagcgacggcagaacctgcatcgagacctgcgccgtgaacaacggcggctgcgacagaacctgcaaggacaccgccaccggcgtgagatgcagctgccccgtgggcttcaccctgcagcccgacggcaagacctgcaaggacatcaacgagtgcctggtgaacaacggcggctgcgaccacttctgcagaaacaccgtgggcagcttcgagtgcggctgcagaaagggctacaagctgctgaccgacgagagaacctgccaggacatcgacgagtgcagcttcgagagaacctgcgaccacatctgcatcaacagccccggcagcttccagtgcctgatcaagctgctgagaagcaaggtgagcagattcctgagaccctacaagtag

SEQ ID NO: 98941 - DNA, 528 bp, Artificial Sequence
  Description of Artificial Sequence: Synthetic coding sequence
tgaagagagacccccaagggcggcgtggcctgcgactgcagacccggcttcgacctggcccagaaccagaaggactgcaccctgacctgcaactacggcaacggcggctgccagcacagctgcgaggacaccgacaccggccccacctgcggctgccaccagaagtacgccctgcacagcgacggcagaacctgcatcgagaaggacgaggccgccatcgagagaagccagttcaacgccaccagcgtggccgacgtggacaagagagtgaagagaagactgctgatggagacctgcgccgtgaacaacggcggctgcgacagaacctgcaaggacaccgccaccggcgtgagatgcagctgccccgtgggcttcaccctgcagcccgacggcaagacctgcaaggacatcaacgagtgcctggtgaacaacggcggctgcgaccacttctgcagaaacaccgtgggcagcttcgagtgcggctgcagaaagggctacaagctgctgaccgacgagagaacctgctag

SEQ ID NO: 98942 - DNA, 3000 bp, Artificial Sequence
  Description of Artificial Sequence: Synthetic coding sequence
atgggcgtggccggcagaaacagacccggcgccgcctgggccgtgctgctgctgctgctgctgctgccccccctgctgctgctggccggcgccgtgccccccggcagaggcagagccgccggcccccaggaggacgtggacgagtgcgcccagggcctggacgactgccacgccgacgccctgtgccagaacacccccaccagctacaagtgcagctgcaagcccggctaccagggcgagggcagacagtgcgaggacatcgacgagtgcggcaacgagctgaacggcggctgcgtgcacgactgcctgaacatccccggcaactacagatgcacctgcttcgacggcttcatgctggcccacgacggccacaactgcctggacgtggacgagtgcctggagaacaacggcggctgccagcacacctgcgtgaacgtgatgggcagctacgagtgctgctgcaaggagggcttcttcctgagcgacaaccagcacacctgcatccacagaagcgaggagggcctgagctgcatgaacaaggaccacggctgcagccacatctgcaaggaggcccccagaggcagcgtggcctgcgagtgcagacccggcttcgagctggccaagaaccagagagactgcatcctgacctgcaaccacggcaacggcggctgccagcacagctgcgacgacaccgccgacggccccgagtgcagctgccacccccagtacaagatgcacaccgacggcagaagctgcctggagagagaggacaccgtgctggaggtgaccgagagcaacaccaccagcgtggtggacggcgacaagagagtgaagagaagactgctgatggagacctgcgccgtgaacaacggcggctgcgacagaacctgcaaggacaccagcaccggcgtgcactgcagctgccccgtgggcttcaccctgcagctggacggcaagacctgcaaggacatcgacgagtgccagaccagaaacggcggctgcgaccacttctgcaagaacatcgtgggcagcttcgactgcggctgcaagaagggcttcaagctgctgaccgacgagaagagctgccaggacgtggacgagtgcagcctggacagaacctgcgaccacagctgcatcaaccaccccggcaccttcgcctgcgcctgcaacagaggctacaccctgtacggcttcacccactgcggcgacaccaacgagtgcagcatcaacaacggcggctgccagcaggtgtgcgtgaacaccgtgggcagctacgagtgccagtgccaccccggctacaagctgcactggaacaagaaggactgcgtggaggtgaagggcctgctgcccaccagcgtgagccccagagtgagcctgcactgcggcaagagcggcggcggcgacggctgcttcctgagatgccacagcggcatccacctgagcagcgacgtgaccaccatcagaaccagcgtgaccttcaagctgaacgagggcaagtgcagcctgaagaacgccgagctgttccccgagggcctgagacccgccctgcccgagaagcacagcagcgtgaaggagagcttcagatacgtgaacctgacctgcagcagcggcaagcaggtgcccggcgcccccggcagacccagcacccccaaggagatgttcatcaccgtggagttcgagctggagaccaaccagaaggaggtgaccgccagctgcgacctgagctgcatcgtgaagagaaccgagaagagactgagaaaggccatcagaaccctgagaaaggccgtgcacagagagcagttccacctgcagctgagcggcatgaacctggacgtggccaagaagccccccagaaccagcgagagacaggccgagagctgcggcgtgggccagggccacgccgagaaccagtgcgtgagctgcagagccggcacctactacgacggcgccagagagagatgcatcctgtgccccaacggcaccttccagaacgaggagggccagatgacctgcgagccctgccccagacccggcaacagcggcgccctgaagacccccgaggcctggaacatgagcgagtgcggcggcctgtgccagcccggcgagtacagcgccgacggcttcgccccctgccacctgtgcgccctgggcaccttccagcccgaggccggcagaaccagctgcttcccctgcggcggcggcctggccaccaagcaccagggcgccaccagcttccaggactgcgagaccagagtgcagtgcagccccggccacttctacaacaccaccacccacagatgcatcagatgccccgtgggcacctaccagcccgagttcggcaagaacaactgcgtgagctgccccggcaacaccaccaccgacttcgacggcagcaccaacatcacccagtgcaagaacagaagatgcggcggcgagctgggcgacttcaccggctacatcgagagccccaactaccccggcaactaccccgccaacaccgagtgcacctggaccatcaaccccccccccaagagaagaatcctgatcgtggtgcccgagatcttcctgcccatcgaggacgactgcggcgactacctggtgatgagaaagaccagcagcagcaacagcgtgaccacctacgagacctgccagacctacgagagacccatcgccttcaccagcagaagcaagaagctgtggatccagttcaagagcaacgagggcaacagcgccagaggcttccaggtgccctacgtgacctacgacgaggactaccaggagctgatcgaggacatcgtgagagacggcagactgtacgccagcgagaaccaccaggagatcctgaaggacaagaagctgatcaaggccctgttcgacgtgctggcccacccccagaactacttcaagtacaccgcccaggagagcagagagatgttccccagaagcttcatcagactgctgagaagcaaggtgagcagattcctgagaccctacaagtag

SEQ ID NO: 98943 - DNA, 2424 bp, Artificial Sequence
  Description of Artificial Sequence: Synthetic coding sequence
atgggcgtggccggcagaaacagacccggcgccgcctgggccgtgctgctgctgctgctgctgctgccccccctgctgctgctggccggcgccgtgccccccggcagaggcagagccgccggcccccaggaggacgtggacgagtgcgcccagggcctggacgactgccacgccgacgccctgtgccagaacacccccaccagctacaagtgcagctgcaagcccggctaccagggcgagggcagacagtgcgaggacatcgacgagtgcggcaacgagctgaacggcggctgcgtgcacgactgcctgaacatccccggcaactacagatgcacctgcttcgacggcttcatgctggcccacgacggccacaactgcctggacgtggacgagtgcctggagaacaacggcggctgccagcacacctgcgtgaacgtgatgggcagctacgagtgctgctgcaaggagggcttcttcctgagcgacaaccagcacacctgcatccacagaagcgaggagggcctgagctgcatgaacaaggaccacggctgcagccacatctgcaaggaggcccccagaggcagcgtggcctgcgagtgcagacccggcttcgagctggccaagaaccagagagactgcatcctgacctgcaaccacggcaacggcggctgccagcacagctgcgacgacaccgccgacggccccgagtgcagctgccacccccagtacaagatgcacaccgacggcagaagctgcctggagagagaggacaccgtgctggaggtgaccgagagcaacaccaccagcgtggtggacggcgacaagagagtgaagagaagactgctgatggagacctgcgccgtgaacaacggcggctgcgacagaacctgcaaggacaccagcaccggcgtgcactgcagctgccccgtgggcttcaccctgcagctggacggcaagacctgcaaggacatcgacgagtgccagaccagaaacggcggctgcgaccacttctgcaagaacatcgtgggcagcttcgactgcggctgcaagaagggcttcaagctgctgaccgacgagaagagctgccaggacgtggacgagtgcagcctggacagaacctgcgaccacagctgcatcaaccaccccggcaccttcgcctgcgcctgcaacagaggctacaccctgtacggcttcacccactgcggcgacaccaacgagtgcagcatcaacaacggcggctgccagcaggtgtgcgtgaacaccgtgggcagctacgagtgccagtgccaccccggctacaagctgcactggaacaagaaggactgcgtggccagctgcgacctgagctgcatcgtgaagagaaccgagaagagactgagaaaggccatcagaaccctgagaaaggccgtgcacagagagcagttccacctgcagctgagcggcatgaacctggacgtggccaagaagccccccagaaccagcgagagacaggccgagagctgcggcgtgggccagggccacgccgagaaccagtgcgtgagctgcagagccggcacctactacgacggcgccagagagagatgcatcctgtgccccaacggcaccttccagaacgaggagggccagatgacctgcgagccctgccccagacccggcaacagcggcgccctgaagacccccgaggcctggaacatgagcgagtgcggcggcctgtgccagcccggcgagtacagcgccgacggcttcgccccctgccacctgtgcgccctgggcaccttccagcccgaggccggcagaaccagctgcttcccctgcggcggcggcctggccaccaagcaccagggcgccaccagcttccaggactgcgagaccagagtgcagtgcagccccggccacttctacaacaccaccacccacagatgcatcagatgccccgtgggcacctaccagcccgagttcggcaagaacaactgcgtgagctgccccggcaacaccaccaccgacttcgacggcagcaccaacatcacccagtgcaagaccagcagcaacagcgtgaccacctacgagacctgccagacctacgagagacccatcgccttcaccagcagaagcaagaagctgtggatccagttcaagagcaacgagggcaacagcgccagaggcttccaggtgccctacgtgacctacgacgaggactaccaggagctgatcgaggacatcgtgagagacggcagactgtacgccagcgagaaccaccaggagatcctgaaggacaagaagctgatcaaggccctgttcgacgtgctggcccacccccagaactacttcaagtacaccgcccaggagagcagagagatgttccccagaagcttcatcagactgctgagaagcaaggtgagcagattcctgagaccctacaagtag

SEQ ID NO: 98944 - DNA, 3087 bp, Artificial Sequence
  Description of Artificial Sequence: Synthetic coding sequence
atgggcgtggccggcagaaacagacccggcgccgcctgggccgtgctgctgctgctgctgctgctgccccccctgctgctgctggccggcgccgtgccccccggcagaggcagagccgccggcccccaggaggacgtggacgagtgcgcccagggcctggacgactgccacgccgacgccctgtgccagaacacccccaccagctacaagtgcagctgcaagcccggctaccagggcgagggcagacagtgcgaggacatcgacgagtgcggcaacgagctgaacggcggctgcgtgcacgactgcctgaacatccccggcaactacagatgcacctgcttcgacggcttcatgctggcccacgacggccacaactgcctggacgtggacgagtgcctggagaacaacggcggctgccagcacacctgcgtgaacgtgatgggcagctacgagtgctgctgcaaggagggcttcttcctgagcgacaaccagcacacctgcatccacagaagcgaggagggcctgagctgcatgaacaaggaccacggctgcagccacatctgcaaggaggcccccagaggcagcgtggcctgcgagtgcagacccggcttcgagctggccaagaaccagagagactgcatcctgacctgcaaccacggcaacggcggctgccagcacagctgcgacgacaccgccgacggccccgagtgcagctgccacccccagtacaagatgcacaccgacggcagaagctgcctggagagagaggacaccgtgctggaggtgaccgagagcaacaccaccagcgtggtggacggcgacaagagagtgaagagaagactgctgatggagacctgcgccgtgaacaacggcggctgcgacagaacctgcaaggacaccagcaccggcgtgcactgcagctgccccgtgggcttcaccctgcagctggacggcaagacctgcaaggacatcgacgagtgccagaccagaaacggcggctgcgaccacttctgcaagaacatcgtgggcagcttcgactgcggctgcaagaagggcttcaagctgctgaccgacgagaagagctgccaggacgtggacgagtgcagcctggacagaacctgcgaccacagctgcatcaaccaccccggcaccttcgcctgcgcctgcaacagaggctacaccctgtacggcttcacccactgcggcgacaccaacgagtgcagcatcaacaacggcggctgccagcaggtgtgcgtgaacaccgtgggcagctacgagtgccagtgccaccccggctacaagctgcactggaacaagaaggactgcgtggaggtgaagggcctgctgcccaccagcgtgagccccagagtgagcctgcactgcggcaagagcggcggcggcgacggctgcttcctgagatgccacagcggcatccacctgagcagcggcctgcagggcgcctacagcgtgacctgcggcagcagcagccccctgagaaacaagcagcagaagagcaacgacagcgccttcggcgacgtgaccaccatcagaaccagcgtgaccttcaagctgaacgagggcaagtgcagcctgaagaacgccgagctgttccccgagggcctgagacccgccctgcccgagaagcacagcagcgtgaaggagagcttcagatacgtgaacctgacctgcagcagcggcaagcaggtgcccggcgcccccggcagacccagcacccccaaggagatgttcatcaccgtggagttcgagctggagaccaaccagaaggaggtgaccgccagctgcgacctgagctgcatcgtgaagagaaccgagaagagactgagaaaggccatcagaaccctgagaaaggccgtgcacagagagcagttccacctgcagctgagcggcatgaacctggacgtggccaagaagccccccagaaccagcgagagacaggccgagagctgcggcgtgggccagggccacgccgagaaccagtgcgtgagctgcagagccggcacctactacgacggcgccagagagagatgcatcctgtgccccaacggcaccttccagaacgaggagggccagatgacctgcgagccctgccccagacccggcaacagcggcgccctgaagacccccgaggcctggaacatgagcgagtgcggcggcctgtgccagcccggcgagtacagcgccgacggcttcgccccctgccacctgtgcgccctgggcaccttccagcccgaggccggcagaaccagctgcttcccctgcggcggcggcctggccaccaagcaccagggcgccaccagcttccaggactgcgagaccagagtgcagtgcagccccggccacttctacaacaccaccacccacagatgcatcagatgccccgtgggcacctaccagcccgagttcggcaagaacaactgcgtgagctgccccggcaacaccaccaccgacttcgacggcagcaccaacatcacccagtgcaagaacagaagatgcggcggcgagctgggcgacttcaccggctacatcgagagccccaactaccccggcaactaccccgccaacaccgagtgcacctggaccatcaaccccccccccaagagaagaatcctgatcgtggtgcccgagatcttcctgcccatcgaggacgactgcggcgactacctggtgatgagaaagaccagcagcagcaacagcgtgaccacctacgagacctgccagacctacgagagacccatcgccttcaccagcagaagcaagaagctgtggatccagttcaagagcaacgagggcaacagcgccagaggcttccaggtgccctacgtgacctacgacgaggactaccaggagctgatcgaggacatcgtgagagacggcagactgtacgccagcgagaaccaccaggagatcctgaaggacaagaagctgatcaaggccctgttcgacgtgctggcccacccccagaactacttcaagtacaccgcccaggagagcagagagatgttccccagaagcttcatcagactgctgagaagcaaggtgagcagattcctgagaccctacaagtag

SEQ ID NO: 98945 - DNA, 411 bp, Artificial Sequence
  Description of Artificial Sequence: Synthetic coding sequence
atggtgctgctggagagcgagcagttcctgaccgagctgaccagactgttccagaagtgcagaaccagcggcagcgtgtacatcaccctgaagaagtacgacggcagaaccaagcccatccccaagaagggcaccgtggagggcttcgagcccgccgacaacaagtgcctgctgagagccaccgacggcaagaagaagatcagcaccgtggtgagcagcaaggaggtgaacaagttccagatggcctacagcaacctgctgagagccaacatggacggcctgaagaagagagacaagaagaacaagaccaagaagaccaaggccgccgccgccgccgccgccgccgcccccgccgccgccgccaccgcccccaccaccgccgccaccaccgccgccaccgccgcccagtag

SEQ ID NO: 98946 - DNA, 333 bp, Artificial Sequence
  Description of Artificial Sequence: Synthetic coding sequence
atggcctgcgccgccgccagaagccccgccgaccaggacagattcatctgcatctaccccgcctacctgaacaacaagaagaccatcgccgagggcagaagaatccccatcagcaaggccgtggagaaccccaccgccaccgagatccaggacgtgtgcagcgccgtgggcctgaacgtgttcctggagaagaacaagatgtacagcagagagtggaacagagacgtgcagtacagaggcagagtgagagtgcagctgaagcaggaggacggcagcctgtgcctggtgcagttccccagccactacaccctgagcctgaccagcggcagctag

SEQ ID NO: 98947 - DNA, 435 bp, Artificial Sequence
  Description of Artificial Sequence: Synthetic coding sequence
atggcctgcgccgccgccagaagccccgccgaccaggacagattcatctgcatctaccccgcctacctgaacaacaagaagaccatcgccgagggcagaagaatccccatcagcaaggccgtggagaaccccaccgccaccgagatccaggacgtgtgcagcgccgtgggcctgaacgtgttcctggagaagaacaagatgtacagcagagagtggaacagagacgtgcagtacagaggcagagtgagagtgcagctgaagcaggaggacggcagcctgtgcctggtgcagttccccagcagaaagagcgtgatgctgtacgccgccgagatgatccccaagctgaagaccagaacccagaagaccggcggcgccgaccagagcctgcagcagggcgagggcagcaagaagggcaagggcaagaagaagaagtag

SEQ ID NO: 98948 - DNA, 237 bp, Artificial Sequence
  Description of Artificial Sequence: Synthetic coding sequence
atggcctgcgccgccgccagaagccccgccgaccaggacagactgctgaagatcctgcagctgcagagattcaagatgtacgtgcagcagctggacctgacctacttcctgagaaagatcaagtgcaccctggagaacggcatcgtgatgagcaacaccgaggccgagagcggcagcagcagcaacagaaagatgggcgccagcgccctgtacagcagccaccacgtgagccagtag

SEQ ID NO: 98949 - DNA, 639 bp, Artificial Sequence; identical to SEQ ID NO: 78060
  Description of Artificial Sequence: Synthetic coding sequence

SEQ ID NO: 98950 - DNA, 1368 bp, Artificial Sequence
  Description of Artificial Sequence: Synthetic coding sequence
atgccccccctgagcatgaagagaagcgccatcgacctggaggagatggccagcggcctgaacaagagaaagatgatccagcacgccgtgttcaaggagctggtgaagctggtggaccccggcgtgaaggcctggacccccaccaagggcaagcagaacgtgatcatgttcgtgggcctgcagggcagcggcaagaccaccacctgcagcaagctggcctactactaccagagaaagggctggaagacctgcctgatctgcgccgacaccttcagagccggcgccttcgaccagctgaagcagaacgccaccaaggccagaatccccttctacggcagctacaccgagatggaccccgtgatcatcgccagcgagggcgtggagaagttcaagaacgagaacttcgagatcatcatcgtggacaccagcggcagacacaagcaggaggacagcctgttcgaggagatgctgcaggtggccaacgccatccagcccgacaacatcgtgtacgtgatggacgccagcatcggccaggcctgcgaggcccaggccaaggccttcaaggacaaggtggacgtggccagcgtgatcgtgaccaagctggacggccacgccaagggcggcggcgccctgagcgccgtggccgccaccaagagccccatcatcttcatcggcaccggcgagcacatcgacgacttcgagcccttcaagacccagcccttcatcagcaagctgctgggcatgggcgacatcgagggcctgatcgacaaggtgaacgagctgaagctggacgacaacgaggccctgatcgagaagctgaagcacggccagttcaccctgagagacatgtacgagcagttccagaacatcatgaagatgggccccttcagccagatcctgggcatgatccccggcttcggcaccgacttcatgagcaagggcaacgagcaggagagcatggccagactgaagaagctgatgaccatcatggacagcatgaacgaccaggagctggacagcaccgacggcgccaaggtgttcagcaagcagcccggcagaatccagagagtggccagaggcagcggcgtgagcaccagagacgtgcaggagctgctgacccagtacaccaagttcgcccagatggtgaagaagatgggcggcatcaagggcctgttcaagggcggcgacatgagcaagaacgtgagccagagccagatggccaagctgaaccagcagatggccaagatgatggaccccagagtgctgcaccacatgggcggcatggccggcctgcagagcatgatgagacagttccagcagggcgccgccggcaacatgaagggcatgatgggcttcaacaacatgtag

SEQ ID NO: 98951 - DNA, 135 bp, Artificial Sequence
  Description of Artificial Sequence: Synthetic coding sequence
atggtgctggccgacctgggcagaaagatcaccagcgccctgagaagcctgagcaacgccaccatcatcaacgaggaggtgctgaacgccatgctgaaggaggtgtgcaccgccctgctggaggccgacgtgtag

SEQ ID NO: 98952 - DNA, 225 bp, Artificial Sequence
  Description of Artificial Sequence: Synthetic coding sequence
atggtgctggccgacctgggcagaaagatcaccagcgccctgagaagcctgagcaacgccaccatcatcaacgaggaggtgctgaacgccatgctgaaggaggtgtgcaccgccctgctggaggccgacgtgaacatcaagctggtgaagcagctgagagagaacgtgaagagcgccatcgacctggaggagatggccagcggcctgaacaagagaaagatgtag

SEQ ID NO: 98953 - DNA, 1515 bp, Artificial Sequence; identical to SEQ ID NO: 77628
  Description of Artificial Sequence: Synthetic coding sequence

SEQ ID NO: 98954 - DNA, 1791 bp, Artificial Sequence
  Description of Artificial Sequence: Synthetic coding sequence
atggccgccgagaagcaggtgcccggcggcggcggcggcggcggcagcggcggcggcggcggcagcggcggcggcggcagcggcggcggcagaggcgccggcggcgaggagaacaaggagaacgagagacccagcgccggcagcaaggccaacaaggagttcggcgacagcctgagcctggagatcctgcagatcatcaaggagagccagcagcagcacggcctgagacacggcgacttccagagatacagaggctactgcagcagaagacagagaagactgagaaagaccctgaacttcaagatgggcaacagacacaagttcaccggcaagaaggtgaccgaggagctgctgaccgacaacagatacctgctgctggtgctgatggacgccgagagagcctggagctacgccatgcagctgaagcaggaggccaacaccgagcccagaaagagattccacctgctgagcagactgagaaaggccgtgaagcacgccgaggagctggagagactgtgcgagagcaacagagtggacgccaagaccaagctggaggcccaggcctacaccgcctacctgagcggcatgctgagattcgagcaccaggagtggaaggccgccatcgaggccttcaacaagtgcaagaccatctacgagaagctggccagcgccttcaccgaggagcaggccgtgctgtacaaccagagagtggaggagatcagccccaacatcagatactgcgcctacaacatcggcgagaccagagccaagcaggccgccaccatgagcgaggtggagtggagaggcagaaccgtgcccgtgaagatcgacaaggtgagaatcttcctgctgggcctggccgacaacgaggccgccatcgtgcaggccgagagcgaggagaccaaggagagactgttcgagagcatgctgagcgagtgcagagacgccatccaggtggtgagagaggagctgaagcccgaccagaagcagagagactacatcctggagggcgagcccggcaaggtgagcaacctgcagtacctgcacagctacctgacctacatcaagctgagcaccgccatcaagagaaacgagaacatggccaagggcctgcagagagccctgctgcagcagcagcccgaggacgacagcaagagaagccccagaccccaggacctgatcagactgtacgacatcatcctgcagaacctggtggagctgctgcagctgcccggcctggaggaggacaaggccttccagaaggagatcggcctgaagaccctggtgttcaaggcctacagatgcttcttcatcgcccagagctacgtgctggtgaagaagtggagcgaggccctggtgctgtacgacagagtgctgaagtacgccaacgaggtgaacagcgacgccggcgccttcaagaacagcctgaaggacctgcccgacgtgcaggagctgatcacccaggtgagaagcgagaagtgcagcctgcaggccgccgccatcctggacgccaacgacgcccaccagaccgagaccagcagcagccaggtgaaggacaacaagcccctggtggagagattcgagaccttctgcctggaccccagcctggtgaccaagcaggccaacctggtgcacttcccccccggcttccagcccatcccctgcaagcccctgttcttcgacctggccctgaaccacgtggccttcccccccctggaggacaagctggagcagaagaccaagagcggcctgaccggctacatcaagggcatcttcggcttcagaagctag

SEQ ID NO: 98955 - DNA, 1884 bp, Artificial Sequence
  Description of Artificial Sequence: Synthetic coding sequence
atggccgccgagaagcaggtgcccggcggcggcggcggcggcggcagcggcggcggcggcggcagcggcggcggcggcagcggcggcggcagaggcgccggcggcgaggagaacaaggagaacgagagacccagcgccggcagcaaggccaacaaggagttcggcgacagcctgagcctggagatcctgcagatcatcaaggagagccagcagcagcacggcctgagacacggcgacttccagagatacagaggctactgcagcagaagacagagaagactgagaaagaccctgaacttcaagatgggcaacagacacaagttcaccggcaagaaggtgaccgaggagctgctgaccgacaacagatacctgctgctggtgctgatggacgccgagagagcctggagctacgccatgcagctgaagcaggaggccaacaccgagcccagaaagagattccacctgctgagcagactgagaaaggccgtgaagcacgccgaggagctggagagactgtgcgagagcaacagagtggacgccaagaccaagctggaggcccaggcctacaccgcctacctgagcggcatgctgagattcgagcaccaggagtggaaggccgccatcgaggccttcaacaagtgcaagaccatctacgagaagctggccagcgccttcaccgaggagcaggccgtgctgtacaaccagagagtggaggagatcagccccaacatcagatactgcgcctacaacatcggcgaccagagcgccatcaacgagctgatgcagatgagactgagaagcggcggcaccgagggcctgctggccgagaagctggaggccctgatcacccagaccagagccaagcaggccgccaccatgagcgaggtggagtggagaggcagaaccgtgcccgtgaagatcgacaaggtgagaatcttcctgctgggcctggccgacaacgaggccgccatcgtgcaggccgagagcgaggagaccaaggagagactgttcgagagcatgctgagcgagtgcagagacgccatccaggtggtgagagaggagctgaagcccgaccagaagcagagagactacatcctggagggcgagcccggcaaggtgagcaacctgcagtacctgcacagctacctgacctacatcaagctgagcaccgccatcaagagaaacgagaacatggccaagggcctgcagagagccctgctgcagcagcagcccgaggacgacagcaagagaagccccagaccccaggacctgatcagactgtacgacatcatcctgcagaacctggtggagctgctgcagctgcccggcctggaggaggacaaggccttccagaaggagatcggcctgaagaccctggtgttcaaggcctacagatgcttcttcatcgcccagagctacgtgctggtgaagaagtggagcgaggccctggtgctgtacgacagagtgctgaagtacgccaacgaggtgaacagcgacgccggcgccttcaagaacagcctgaaggacctgcccgacgtgcaggagctgatcacccaggtgagaagcgagaagtgcagcctgcaggccgccgccatcctggacgccaacgacgcccaccagaccgagaccagcagcagccaggtgaaggacaacaagcccctggtggagagattcgagaccttctgcctggaccccagcctggtgaccaagcaggccaacctggtgcacttcccccccggcttccagcccatcccctgcaagcccctgttcttcgacctggccctgaaccacgtggccttcccccccctggaggacaagctggagcagaagaccaagagcggcctgaccggctacatcaagggcatcttcggcttcagaagctag

SEQ ID NO: 98956 - DNA, 1581 bp, Artificial Sequence
  Description of Artificial Sequence: Synthetic coding sequence
atgggcaacagacacaagttcaccggcaagaaggtgaccgaggagctgctgaccgacaacagatacctgctgctggtgctgatggacgccgagagagcctggagctacgccatgcagctgaagcaggaggccaacaccgagcccagaaagagattccacctgctgagcagactgagaaaggccgtgaagcacgccgaggagctggagagactgtgcgagagcaacagagtggacgccaagaccaagctggaggcccaggcctacaccgcctacctgagcggcatgctgagattcgagcaccaggagtggaaggccgccatcgaggccttcaacaagtgcaagaccatctacgagaagctggccagcgccttcaccgaggagcaggccgtgctgtacaaccagagagtggaggagatcagccccaacatcagatactgcgcctacaacatcggcgaccagagcgccatcaacgagctgatgcagatgagactgagaagcggcggcaccgagggcctgctggccgagaagctggaggccctgatcacccagaccagagccaagcaggccgccaccatgagcgaggtggagtggagaggcagaaccgtgcccgtgaagatcgacaaggtgagaatcttcctgctgggcctggccgacaacgaggccgccatcgtgcaggccgagagcgaggagaccaaggagagactgttcgagagcatgctgagcgagtgcagagacgccatccaggtggtgagagaggagctgaagcccgaccagaagcagagagactacatcctggagggcgagcccggcaaggtgagcaacctgcagtacctgcacagctacctgacctacatcaagctgagcaccgccatcaagagaaacgagaacatggccaagggcctgcagagagccctgctgcagcagcagcccgaggacgacagcaagagaagccccagaccccaggacctgatcagactgtacgacatcatcctgcagaacctggtggagctgctgcagctgcccggcctggaggaggacaaggccttccagaaggagatcggcctgaagaccctggtgttcaaggcctacagatgcttcttcatcgcccagagctacgtgctggtgaagaagtggagcgaggccctggtgctgtacgacagagtgctgaagtacgccaacgaggtgaacagcgacgccggcgccttcaagaacagcctgaaggacctgcccgacgtgcaggagctgatcacccaggtgagaagcgagaagtgcagcctgcaggccgccgccatcctggacgccaacgacgcccaccagaccgagaccagcagcagccaggtgaaggacaacaagcccctggtggagagattcgagaccttctgcctggaccccagcctggtgaccaagcaggccaacctggtgcacttcccccccggcttccagcccatcccctgcaagcccctgttcttcgacctggccctgaaccacgtggccttcccccccctggaggacaagctggagcagaagaccaagagcggcctgaccggctacatcaagggcatcttcggcttcagaagctag

SEQ ID NO: 98957 - DNA, 984 bp, Artificial Sequence
  Description of Artificial Sequence: Synthetic coding sequence
atgcagatgagactgagaagcggcggcaccgagggcctgctggccgagaagctggaggccctgatcacccagaccagagccaagcaggccgccaccatgagcgaggtggagtggagaggcagaaccgtgcccgtgaagatcgacaaggtgagaatcttcctgctgggcctggccgacaacgaggccgccatcgtgcaggccgagagcgaggagaccaaggagagactgttcgagagcatgctgagcgagtgcagagacgccatccaggtggtgagagaggagctgaagcccgaccagaagcagagagactacatcctggagggcgagcccggcaaggtgagcaacctgcagtacctgcacagctacctgacctacatcaagctgagcaccgccatcaagagaaacgagaacatggccaagggcctgcagagagccctgctgcagcagcagcccgaggacgacagcaagagaagccccagaccccaggacctgatcagactgtacgacatcatcctgcagaacctggtggagctgctgcagctgcccggcctggaggaggacaaggccttccagaaggagatcggcctgaagaccctggtgttcaaggcctacagatgcttcttcatcgcccagagctacgtgctggtgaagaagtggagcgaggccctggtgctgtacgacagagtgctgaagtacgccaacgaggtgaacagcgacgccggcgccttcaagaacagcctgaaggacctgcccgacgtgcaggagctgatcacccaggtgagaagcgagaagtgcagcctgcaggccgccgccatcctggacgccaacgacgcccaccagaccgagaccagcagcagccaggtgaaggacaacaagcccctggtggagagattcgagagcacccccggcaccgacggcgccctgaagagattcgtgatgctgctgcagtaccacggcttcgagatgaacagcagcctgctgtag

SEQ ID NO: 98958 - DNA, 1770 bp, Artificial Sequence
  Description of Artificial Sequence: Synthetic coding sequence
atggccgccgagaagcaggtgcccggcggcggcggcggcggcggcagcggcggcggcggcggcagcggcggcggcggcagcggcggcggcagaggcgccggcggcgaggagaacaaggagaacgagagacccagcgccggcagcaaggccaacaaggagttcggcgacagcctgagcctggagatcctgcagatcatcaaggagagccagcagcagcacggcctgagacacggcgacttccagagatacagatacctgctgctggtgctgatggacgccgagagagcctggagctacgccatgcagctgaagcaggaggccaacaccgagcccagaaagagattccacctgctgagcagactgagaaaggccgtgaagcacgccgaggagctggagagactgtgcgagagcaacagagtggacgccaagaccaagctggaggcccaggcctacaccgcctacctgagcggcatgctgagattcgagcaccaggagtggaaggccgccatcgaggccttcaacaagtgcaagaccatctacgagaagctggccagcgccttcaccgaggagcaggccgtgctgtacaaccagagagtggaggagatcagccccaacatcagatactgcgcctacaacatcggcgaccagagcgccatcaacgagctgatgcagatgagactgagaagcggcggcaccgagggcctgctggccgagaagctggaggccctgatcacccagaccagagccaagcaggccgccaccatgagcgaggtggagtggagaggcagaaccgtgcccgtgaagatcgacaaggtgagaatcttcctgctgggcctggccgacaacgaggccgccatcgtgcaggccgagagcgaggagaccaaggagagactgttcgagagcatgctgagcgagtgcagagacgccatccaggtggtgagagaggagctgaagcccgaccagaagcagagagactacatcctggagggcgagcccggcaaggtgagcaacctgcagtacctgcacagctacctgacctacatcaagctgagcaccgccatcaagagaaacgagaacatggccaagggcctgcagagagccctgctgcagcagcagcccgaggacgacagcaagagaagccccagaccccaggacctgatcagactgtacgacatcatcctgcagaacctggtggagctgctgcagctgcccggcctggaggaggacaaggccttccagaaggagatcggcctgaagaccctggtgttcaaggcctacagatgcttcttcatcgcccagagctacgtgctggtgaagaagtggagcgaggccctggtgctgtacgacagagtgctgaagtacgccaacgaggtgaacagcgacgccggcgccttcaagaacagcctgaaggacctgcccgacgtgcaggagctgatcacccaggtgagaagcgagaagtgcagcctgcaggccgccgccatcctggacgccaacgacgcccaccagaccgagaccagcagcagccaggtgaaggacaacaagcccctggtggagagattcgagaccttctgcctggaccccagcctggtgaccaagcaggccaacctggtgcacttcccccccggcttccagcccatcccctgcaagcccctgttcttcgacctggccctgaaccacgtggccttcccccccctggaggacaagctggagcagaagaccaagagcggcctgaccggctacatcaagggcatcttcggcttcagaagctag

SEQ ID NO: 98959 - DNA, 1110 bp, Artificial Sequence
  Description of Artificial Sequence: Synthetic coding sequence
atggccgccgagaagcaggtgcccggcggcggcggcggcggcggcagcggcggcggcggcggcagcggcggcggcggcagcggcggcggcagaggcgccggcggcgaggagaacaaggagaacgagagacccagcgccggcagcaaggccaacaaggagttcggcgacagcctgagcctggagatcctgcagatcatcaaggagagccagcagcagcacggcctgagacacggcgacttccagagatacagaggctactgcagcagaagacagagaagactgagaaagaccctgaacttcaagatgggcaacagacacaagttcaccggcaagaaggtgaccgaggagctgctgaccgacaacagatacctgctgctggtgctgatggacgccgagagagcctggagctacgccatgcagctgaagcaggaggccaacaccgagcccagaaagagattccacctgctgagcagactgagaaaggccgtgaagcacgccgaggagctggagagactgtgcgagagcaacagagtggacgccaagaccaagctggaggcccaggcctacaccgcctacctgagcggcatgctgagattcgagcaccaggagtggaaggccgccatcgaggccttcaacaagtgcaagaccatctacgagaagctggccagcgccttcaccgaggagcaggccgtgctgtacaaccagagagtggaggagatcagccccaacatcagatactgcgcctacaacatcggcgaccagagcgccatcaacgagctgatgcagatgagactgagaagcggcggcaccgagggcctgctggccgagaagctggaggccctgatcacccagaccagagccaagcaggccgccaccatgagcgaggtggagtggagaggcagaaccgtgcccgtgaagatcgacaaggtgagaatcttcctgctgggcctggccgacaacgaggccgccatcgtgcaggccgagagcgaggagaccaaggagagactgttcgagagcatgctgagcgagtgcagagacgccatccaggtggtgagagaggagctgaagcccgaccagagagacctgctgctgcccagccagggccagtag

SEQ ID NO: 98960 - DNA, 867 bp, Artificial Sequence
  Description of Artificial Sequence: Synthetic coding sequence
atgctgagcgagtgcagagacgccatccaggtggtgagagaggagctgaagcccgaccagaagcagagagactacatcctggagggcgagcccggcaaggtgagcaacctgcagtacctgcacagctacctgacctacatcaagctgagcaccgccatcaagagaaacgagaacatggccaagggcctgcagagagccctgctgcagcagcagcccgaggacgacagcaagagaagccccagaccccaggacctgatcagactgtacgacatcatcctgcagaacctggtggagctgctgcagctgcccggcctggaggaggacaaggccttccagaaggagatcggcctgaagaccctggtgttcaaggcctacagatgcttcttcatcgcccagagctacgtgctggtgaagaagtggagcgaggccctggtgctgtacgacagagtgctgaagtacgccaacgaggtgaacagcgacgccggcgccttcaagaacagcctgaaggacctgcccgacgtgcaggagctgatcacccaggtgagaagcgagaagtgcagcctgcaggccgccgccatcctggacgccaacgacgcccaccagaccgagaccagcagcagccaggtgaaggacaacaagcccctggtggagagattcgagaccttctgcctggaccccagcctggtgaccaagcaggccaacctggtgcacttcccccccggcttccagcccatcccctgcaagcccctgttcttcgacctggccctgaaccacgtggccttcccccccctggaggacaagctggagcagaagaccaagagcggcctgaccggctacatcaagggcatcttcggcttcagaagctag

SEQ ID NO: 98961 - DNA, 2016 bp, Artificial Sequence
  Description of Artificial Sequence: Synthetic coding sequence
atggccagcggcggcagcggcggcgtgagcgtgcccgccctgtggagcgaggtgaacagatacggccagaacggcgacttcaccagagccctgaagaccgtgaacaagatcctgcagatcaacaaggacgacgtgaccgccctgcactgcaaggtggtgtgcctgatccagaacggcagcttcaaggaggccctgaacgtgatcaacacccacaccaaggtgctggccaacaacagcctgagcttcgagaaggcctactgcgagtacagactgaacagaatcgagaacgccctgaagaccatcgagagcgccaaccagcagaccgacaagctgaaggagctgtacggccaggtgctgtacagactggagagatacgacgagtgcctggccgtgtacagagacctggtgagaaacagccaggacgactacgacgaggagagaaagaccaacctgagcgccgtggtggccgcccagagcaactgggagaaggtggtgcccgagaacctgggcctgcaggagggcacccacgagctgtgctacaacaccgcctgcgccctgatcggccagggccagctgaaccaggccatgaagatcctgcagaaggccgaggacctgtgcagaagaagcctgagcgaggacaccgacggcaccgaggaggacccccaggccgagctggccatcatccacggccagatggcctacatcctgcagctgcagggcagaaccgaggaggccctgcagctgtacaaccagatcatcaagctgaagcccaccgacgtgggcctgctggccgtgatcgccaacaacatcatcaccatcaacaaggaccagaacgtgttcgacagcaagaagaaggtgaagctgaccaacgccgagggcgtggagttcaagctgagcaagaagcagctgcaggccatcgagttcaacaaggccctgctggccatgtacaccaaccaggccgagcagtgcagaaagatcagcgccagcctgcagagccagagccccgagcacctgctgcccgtgctgatccaggccgcccagctgtgcagagagaagcagcacaccaaggccatcgagctgctgcaggagttcagcgaccagcaccccgagaacgccgccgagatcaagctgaccatggcccagctgaagatcagccagggcaacatcagcaaggcctgcctgatcctgagaagcatcgaggagctgaagcacaagcccggcatggtgagcgccctggtgaccatgtacagccacgaggaggacatcgacagcgccatcgaggtgttcacccaggccatccagtggtaccagaaccaccagcccaagagccccgcccacctgagcctgatcagagaggccgccaacttcaagctgaagtacggcagaaagaaggaggccatcagcgacctgcagcagctgtggaagcagaaccccaaggacatccacaccctggcccagctgatcagcgcctacagcctggtggaccccgagaaggccaaggccctgagcaagcacctgcccagcagcgacagcatgagcctgaaggtggacgtggaggccctggagaacagcgccggcgccacctacatcagaaagaagggcggcaaggtgaccggcgacagccagcccaaggagcagggccagggcgacctgaagaagaagaagaagaagaagaagggcaagctgcccaagaactacgaccccaaggtgacccccgaccccgagagatggctgcccatgagagagagaagctactacagaggcagaaagaagggcaagaagaaggaccagatcggcaagggcacccagggcgccaccgccggcgccagcagcgagctggacgccagcaagaccgtgagcagcccccccaccagccccagacccggcagcgccgccaccgtgagcgccagcaccagcaacatcatcccccccagacaccagaagcccgccggcgcccccgccaccaagaagaagcagcagcagaagaagaagaagggcggcaagggcggctggtag

SEQ ID NO: 98962 - DNA, 1878 bp, Artificial Sequence
  Description of Artificial Sequence: Synthetic coding sequence
cccctggtgagcagcaagatggccagcggcggcagcggcggcgtgagcgtgcccgccctgtggagcgaggtgaacagatacggccagaacggcgacttcaccagagccctgaagaccgtgaacaagatcctgcagatcaacaaggacgacgtgaccgccctgcactgcaaggtggtgtgcctgatccagaacggcagcttcaaggaggccctgaacgtgatcaacacccacaccaaggtgctggccaacaacagcctgagcttcgagaaggcctactgcgagtacagactgaacagaatcgagaacgccctgaagaccatcgagagcgccaaccagcagaccgacaagctgaaggagctgtacggccaggtgctgtacagactggagagatacgacgagtgcctggccgtgtacagagacctggtgagaaacagccaggacgactacgacgaggagagaaagaccaacctgagcgccgtggtggccgcccagagcaactgggagaaggtggtgcccgagaacctgggcctgcaggagggcacccacgagctgtgctacaacaccgcctgcgccctgatcggccagggccagctgaaccaggccatgaagatcctgcagaaggccgaggacctgtgcagaagaagcctgagcgaggacaccgaccagaacgtgttcgacagcaagaagaaggtgaagctgaccaacgccgagggcgtggagttcaagctgagcaagaagcagctgcaggccatcgagttcaacaaggccctgctggccatgtacaccaaccaggccgagcagtgcagaaagatcagcgccagcctgcagagccagagccccgagcacctgctgcccgtgctgatccaggccgcccagctgtgcagagagaagcagcacaccaaggccatcgagctgctgcaggagttcagcgaccagcaccccgagaacgccgccgagatcaagctgaccatggcccagctgaagatcagccagggcaacatcagcaaggcctgcctgatcctgagaagcatcgaggagctgaagcacaagcccggcatggtgagcgccctggtgaccatgtacagccacgaggaggacatcgacagcgccatcgaggtgttcacccaggccatccagtggtaccagaaccaccagcccaagagccccgcccacctgagcctgatcagagaggccgccaacttcaagctgaagtacggcagaaagaaggaggccatcagcgacctgcagcagctgtggaagcagaaccccaaggacatccacaccctggcccagctgatcagcgcctacagcctggtggaccccgagaaggccaaggccctgagcaagcacctgcccagcagcgacagcatgagcctgaaggtggacgtggaggccctggagaacagcgccggcgccacctacatcagaaagaagggcggcaaggtgaccggcgacagccagcccaaggagcagggccagggcgacctgaagaagaagaagaagaagaagaagggcaagctgcccaagaactacgaccccaaggtgacccccgaccccgagagatggctgcccatgagagagagaagctactacagaggcagaaagaagggcaagaagaaggaccagatcggcaagggcacccagggcgccaccgccggcgccagcagcgagctggacgccagcaagaccgtgagcagcccccccacccaggacctggccgtgctgcagcagtacctgcccctgcaggtgaccagctacccccaggacaccagaaacctgcagggcctgcagcagcagaagagaaacagcaacagaaagagaagaaaggtggagaaggtggccggcgacgagaacatcctggtggccggctgcttctag

SEQ ID NO: 98963 - DNA, 1833 bp, Artificial Sequence
  Description of Artificial Sequence: Synthetic coding sequence
atggccagcggcggcagcggcggcgtgagcgtgcccgccctgtggagcgaggtgaacagatacggccagaacggcgacttcaccagagccctgaagaccgtgaacaagatcctgcagatcaacaaggacgacgtgaccgccctgcactgcaaggtggtgtgcctgatccagaacggcagcttcaaggaggccctgaacgtgatcaacacccacaccaaggtgctggccaacaacagcctgagcttcgagaaggcctactgcgagtacagactgaacagaatcgagaacgccctgaagaccatcgagagcgccaaccagcagaccgacaagctgaaggagctgtacggccaggtgctgtacagactggagagatacgacgagtgcctggccgtgtacagagacctggtgagaaacagccaggacgactacgacgaggagagaaagaccaacctgagcgccgtggtggccgcccagagcaactgggagaaggtggtgcccgagaacctgggcctgcaggagggcacccacgagctgtgctacaacaccgcctgcgccctgatcggccagggccagctgaaccaggccatgaagatcctgcagaaggccgaggacctgtgcagaagaagcctgagcgaggacaccgaccagaacgtgttcgacagcaagaagaaggtgaagctgaccaacgccgagggcgtggagttcaagctgagcaagaagcagctgcaggccatcgagttcaacaaggccctgctggccatgtacaccaaccaggccgagcagtgcagaaagatcagcgccagcctgcagagccagagccccgagcacctgctgcccgtgctgatccaggccgcccagctgtgcagagagaagcagcacaccaaggccatcgagctgctgcaggagttcagcgaccagcaccccgagaacgccgccgagatcaagctgaccatggcccagctgaagatcagccagggcaacatcagcaaggcctgcctgatcctgagaagcatcgaggagctgaagcacaagcccggcatggtgagcgccctggtgaccatgtacagccacgaggaggacatcgacagcgccatcgaggtgttcacccaggccatccagtggtaccagaaccaccagcccaagagccccgcccacctgagcctgatcagagaggccgccaacttcaagctgaagtacggcagaaagaaggaggccatcagcgacctgcagcagctgtggaagcagaaccccaaggacatccacaccctggcccagctgatcagcgcctacagcctggtggaccccgagaaggccaaggccctgagcaagcacctgcccagcagcgacagcatgagcctgaaggtggacgtggaggccctggagaacagcgccggcgccacctacatcagaaagaagggcggcaaggtgaccggcgacagccagcccaaggagcagggccagggcgacctgaagaagaagaagaagaagaagaagggcaagctgcccaagaactacgaccccaaggtgacccccgaccccgagagatggctgcccatgagagagagaagctactacagaggcagaaagaagggcaagaagaaggaccagatcggcaagggcacccagggcgccaccgccggcgccagcagcgagctggacgccagcaagaccgtgagcagcccccccaccagccccagacccggcagcgccgccaccgtgagcgccagcaccagcaacatcatcccccccagacaccagaagcccgccggcgcccccgccaccaagaagaagcagcagcagaagaagaagaagggcggcaagggcggctggtag

SEQ ID NO: 98964 - DNA, 1917 bp, Artificial Sequence
  Description of Artificial Sequence: Synthetic coding sequence
atgctggacttcttcaccatcttcagcaagggcggcctggtgctgtggtgcttccagggcgtgagcgacagctgcaccggccccgtgaacgccctgatcagaagcgtgctgctgcaggagagaggcggcaacaacagcttcacccacgaggccctgaccctgaagtacaagctggacaaccagttcgagctggtgttcgtggtgggcttccagaagatcctgaccctgacctacgtggacaagctgatcgacgacgtgcacagactgttcagagacaagtacagaaccgagatccagcagcagagcgccctgagcctgctgaacggcaccttcgacttccagaacgacttcctgagactgctgagagaggccgaggagagcagcaagatcagagcccccaccaccatgaagaagttcgaggacagcgagaaggccaagaagcccgtgagaagcatgatcgagaccagaggcgagaagcccaaggagaaggccaagaacagcaagaagaagggcgccaagaaggagggcagcgacggccccctggccaccagcaagcccgtgcccgccgagaagagcggcctgcccgtgggccccgagaacggcgtggagctgagcaaggaggagctgatcagaagaaagagagaggagttcatccagaagcacggcagaggcatggagaagagcaacaagagcaccaagagcgacgcccccaaggagaagggcaagaaggcccccagagtgtgggagctgggcggctgcgccaacaaggaggtgctggactacagcacccccaccaccaacggcacccccgaggccgccctgagcgaggacatcaacctgatcagaggcaccggcagcggcggccagctgcaggacctggactgcagcagcagcgacgacgagggcgccgcccagaacagcaccaagcccagcgccaccaagggcaccctgggcggcatgttcggcatgctgaagggcctggtgggcagcaagagcctgagcagagaggacatggagagcgtgctggacaagatgagagaccacctgatcgccaagaacgtggccgccgacatcgccgtgcagctgtgcgagagcgtggccaacaagctggagggcaaggtgatgggcaccttcagcaccgtgaccagcaccgtgaagcaggccctgcaggagagcctggtgcagatcctgcagccccagagaagagtggacatgctgagagacatcatggacgcccagagaagacagagaccctacgtggtgaccttctgcggcgtgaacggcgtgggcaagagcaccaacctggccaagatcagcttctggctgctggagaacggcttcagcgtgctgatcgccgcctgcgacaccttcagagccggcgccgtggagcagctgagaacccacaccagaagactgagcgccctgcacccccccgagaagcacggcggcagaaccatggtgcagctgttcgagaagggctacggcaaggacgccgccggcatcgccatggaggccatcgccttcgccagaaaccagggcttcgacgtggtgctggtggacaccgccggcagaatgcaggacaacgcccccctgatgaccgccctggccaagctgatcaccgtgaacacccccgacctggtgctgttcgtgggcgaggccctggtgggcaacgaggccgtggaccagctggtgaagttcaacagagccctggccgaccacagcatggcccagacccccagactgatcgacggcatcgtgctgaccaagttcgacaccatcgacgacaaggtgggcgccgccatcagcatgacctacatcaccagcaagcccatcgtgttcgtgggcaccggccagacctactgcgacctgagaagcctgaacgccaaggccgtggtggccgccctgatgaaggcctag

SEQ ID NO: 98965 - DNA, 552 bp, Artificial Sequence
  Description of Artificial Sequence: Synthetic coding sequence
atgagactgctgagcttcgtggtgctggccctgttcgccgtgacccaggccgaggagggcgccagactgctggccagcaagagcctgctgaacagatacgccgtggagggcagagacctgaccctgcagtacaacatctacaacgtgggcagcagcgccgccctggacgtggagctgagcgacgacagcttcccccccgaggacttcggcatcgtgagcggcatgctgaacgtgaagtgggacagaatcgcccccgccagcaacgtgagccacaccgtggtgctgagacccctgaaggccggctacttcaacttcaccagcgccaccatcacctacctggcccaggaggacggccccgtggtgatcggcagcaccagcgcccccggccagggcggcatcctggcccagagagagttcgacagaagattcagcccccacttcctggactgggccgccttcggcgtgatgaccctgcccagcatcggcatccccctgctgctgtggtacagcagcaagagaaagtacgacacccccaagaccaagaagaactag

SEQ ID NO: 98966 - DNA, 552 bp, Artificial Sequence; identical to SEQ ID NO: 98965
  Description of Artificial Sequence: Synthetic coding sequence

SEQ ID NO: 98967 - DNA, 258 bp, Artificial Sequence
  Description of Artificial Sequence: Synthetic coding sequence
atgagactgctgagcttcgtggtgctggccctgttcgccgtgacccaggccgaggagggcgccagactgctggccagcaagagcctgctgaacagatacgccgtggagggcagagacctgaccctgcagtacaacatctacaacgtgggcagcagcgccgccctggacgtggagctgagcgacgacagcttcccccccgaggacttcggcatcgtgagcggcatgctgaacgtgaagtgggacagaatcgccccctag

SEQ ID NO: 98968 - DNA, 444 bp, Artificial Sequence
  Description of Artificial Sequence: Synthetic coding sequence
atgagactgctgagcttcgtggtgctggccctgttcgccgtgacccaggccgaggagggcgccagactgctggccagcaagagcctgctgaacagatacgccgtggagggcagagacctgaccctgcagtacaacatctacaacgtgggcagcagcgccgccctggacgtggagctgagcgacgacagcttcccccccgaggacttcggcatcgtgagcggcatgctgaacgtgaagtgggacagaatcgcccccgccagcaacgtgagccacaccgtggtgctgagacccctgaaggccggctacttcaacttcaccagcgccaccatcacctacctggcccaggaggacggccccgtggtgatcggcagcaccagcgcccccggccagggcggcatcctggcccagagagagttcgacagaagattcagcccccacttctag

SEQ ID NO: 98969 - DNA, 522 bp, Artificial Sequence
  Description of Artificial Sequence: Synthetic coding sequence
atggccgccatggccagcctgggcgccctggccctgctgctgctgagcagcctgagcagatgcagcgccgaggcctgcctggagccccagatcacccccagctactacaccaccagcgacgccgtgatcagcaccgagaccgtgttcatcgtggagatcagcctgacctgcaagaacagagtgcagaacatggccctgtacgccgacgtgggcggcaagcagttccccgtgaccagaggccaggacgtgggcagataccaggtgagctggagcctggaccacaagagcgcccacgccggcacctacgaggtgagattcttcgacgaggagagctacagcctgctgagaaaggcccagagaaacaacgaggacatcagcatcatcccccccctgttcaccgtgagcgtggaccacagaggcacctggaacggcccctgggtgagcaccgaggtgctggccgccgccatcggcctggtgatctactacctggccttcagcgccaagagccacatccaggcctag

SEQ ID NO: 98970 - DNA, 447 bp, Artificial Sequence
  Description of Artificial Sequence: Synthetic coding sequence
atggccgccatggccagcctgggcgccctggccctgctgctgctgagcagcctgagcagatgcagcgccgaggcctgcctggagccccagatcacccccagctactacaccaccagcgacgccgtgatcagcaccgagaccgtgttcatcgtggagatcagcctgacctgcaagaacagagtgcaggtgagctggagcctggaccacaagagcgcccacgccggcacctacgaggtgagattcttcgacgaggagagctacagcctgctgagaaaggcccagagaaacaacgaggacatcagcatcatcccccccctgttcaccgtgagcgtggaccacagaggcacctggaacggcccctgggtgagcaccgaggtgctggccgccgccatcggcctggtgatctactacctggccttcagcgccaagagccacatccaggcctag

SEQ ID NO: 98971 - DNA, 522 bp, Artificial Sequence; identical to SEQ ID NO: 98969
  Description of Artificial Sequence: Synthetic coding sequence

SEQ ID NO: 98972 - DNA, 522 bp, Artificial Sequence; identical to SEQ ID NO: 98969
  Description of Artificial Sequence: Synthetic coding sequence

SEQ ID NO: 98973 - DNA, 363 bp, Artificial Sequence
  Description of Artificial Sequence: Synthetic coding sequence
tgagtgggcagcggctgcagaagcgccgccgtgagcgccctggtggtgagagtggcccccccctgccccctgtgcccccacagcgcccagcaccccacccaggtgagctggagcctggaccacaagagcgcccacgccggcacctacgaggtgagattcttcgacgaggagagctacagcctgctgagaaaggcccagagaaacaacgaggacatcagcatcatcccccccctgttcaccgtgagcgtggaccacagaggcacctggaacggcccctgggtgagcaccgaggtgctggccgccgccatcggcctggtgatctactacctggccttcagcgccaagagccacatccaggcctag
